United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 4

SEQ ID NO: 5221 - DNA, 710 bp, Camellia sinensis
ctgtcgaacccaatgagagaaatcaaagtccagaagctcgtcctcaatatctccgttggagagagcggcgatcgcctcacccgcgccgccaaggttttggaacaactcagtggtcaaacccctgtcttctctaaagcgaggtacactgttagatcctttggaatcagacgtaacgagaagattgcgtgtttcgtgaccgtcaggggcgagaaagcaatgcaacttctggagagtgggctaaaggtgaaagagtatgagctgttgcgccgaaatttcagcgagaccggctgtttcgggtttggtattcaggaacacatcgatctcggtattaagtatgacccttcaactggcatttatggaatggacttctatgctgtgcttgaacgcccaggataccgtgtgggtcgtcgccgtaggtgcaagtcacgcattggaatccagcatagagttacaaaggaggattcaatgaagtggttccaggtcaaatatgagggagtgatcctcaacaaatcctacgcaatcggagcttaaagaatccctcagcattgataaactctacttacaagttattatttgctgttttttaatcaaagtggtattacacttttatgcattggttgaatctagaatactatttctagtggttctttatgtttgaactcttgtaggcttttctaatatgggagtagaagatattttttaatggttac

SEQ ID NO: 5222 - DNA, 649 bp, Vinca minor
ttgaacaatccaatgagagaaatcaaagttcaaaagcttgttcttaacatttctgttggtgaaagtggagatcgtctcactcgtgctgctaaggtgttggaacaactcagtggccaatctcctgtcttctctaaggcaagatacactgtccgatcatttggaattaggcgtaatgaaaagattgcctgctatgttactgttagaggtgacaaggcaatgcaacttttggagagtggtctaaaagtgaaggagtacgaattgctaaggagaaacttcagcgatactggatgctttggttttggtattcaagagcacatcgatcttggaataaagtatgatccttctactggtatttatggaatggacttctatgttgttctagagcgcccaggttaccgtgtaggtcgtcgcagaaggtgcaagtctcgtgttggaatccaccagagggttacaaaggatgatgcaatgaagtggttccaggtcaaatatgagggcgtgatcctcaacaaatctcaaaacattacaaattagaagtctgatgtgtctagctacctggataatgaaattgtagctttaaaatattacttctacttctgttcctatggttttccagaccctattttgctattgttttccctgggaaattttt

SEQ ID NO: 5223 - DNA, 756 bp, Festuca arundinacea
agtggtatcaacgcagagtacggggggccgcagccacacacaccacagcaccagctaacccctctcttcttcggcttcctccccgttcagatcaccatgtcgacggagaagaaacagttgaacccgatgcgggagatcaaggtgcagaagcttgtgctcaacatctccgttggcgagagcggtgatcgcctcactcgcgcctccaaggtgttggagcagctgagcgggcagtcgccagttttctcaaaggcgaggtacactgtgaggtctttcggtatccgtcgtaatgagaagatcgcttgctatgtgacgatcaggggtgagaaggcaatgcagcttctcgaaagtgggctgaaggtgaaggagtacgagctgctcaggaggaacttcagtgacactggctgctttggatttggtatccaggagcacattgatcttggcatgaagtatgacccgtccactggtatttatggtatggatttcttcgttgttctggagcgtgctggataccgtgtttctcgccggcgccgatgcaaggcccgcattggtatccaccaaagggtgaccaaggaagatgccatgaagtggttccaggtcaagtacgagggtgtcatcctcaacaagtcccacgcgagctagtaaccttttgagtgaacaagttgtcagttagaactccagccagctgagtgttatctgcatcatggaatcatatgtttattggatacaatatgcactgtcaattttgcctctattcaa

SEQ ID NO: 5224 - DNA, 902 bp, Setaria italica
aaagtttcctcgtccgccgccgccgccccgcgcagcactgcagaacccatctcacctccctcgccgtcgcctcccagatcttccccatggcgtcggagaagaagcagtctaacccgatgcgggagatcaaggtccagaagctcgtgctcaacatctccgtcggcgagagcggtgatcgcctcactcgcgccgccaaggtgctcgagcagctgagtgggcagtcaccggtgttctccaaggcgaggtacactgtgaggtcgttcggcatcaggcgtaatgagaagattgcgtgctatgtgacggtgaggggagagaaggcgatgcagcttctggagagtggcctgaaggtcaaggagtacgagctgctgaggaggaacttcagtgacaccggctgcttcgggtttggtatccaggagcacattgatcttggcatcaagtatgacccatctaccggtatctacggcatggacttctacgtcgtccttgagcgtgctgggtaccgtgttgcccgccgccgcaggtgcaagtcccgtgttggtatccagcacagggtcaccaaggaggacgccatgaagtggttccaggtcaagtacgagggtgtgatcctcaacaaggcccaagccaactaactcttaagcatcacaagaagagcttagcccctctttagagctcgagctatttaagtctatctggtggttggatttgaactagaagaaaccagaatgttttgtcagttttgcctgtactgctgcagttggatccttttctgggcgccctatactttcatcttaattctgcttgtgttttacccccattggcaccgacagcaatagtagatgtctggcttattctgtcgagtatcgttttgttttgttttgtttcgttcttggaaaatcctgagc

SEQ ID NO: 5225 - DNA, 1069 bp, Hordeum vulgare
cttcgcgctagggtttcctcccctccctacaaatcccctgccgccgccgccgccgcccctcaccacgctttaaacctctcccccctccacctccccctcttctctcccccgccgccgccgctccccagatcccgccgccatgtcgacggagaagaagcagatgaaccccatgcgggatatcaaggtgcagaagctcgtcctcaacatctccgtcggtgagagcggagatcgtctcacccgcgcctccaaggtgctggagcagctgagtggacaatcaccagtgttctccaaggcgaggtacactgtcaggtcttttggtatcaggcgtaatgagaagatcgcgtgctacgttactattaggggtgagaaggcgatgcagctgctggagagtggcctgaaggtgaaggagtacgagctgctcaggaggaacttcagcgacaccggatgctttggcttcggtatccaggagcacatcgatctcggcatgaagtacgatccatctactggcatctatggtatggacttcttcgtggtgctcgagcgtgctgggtaccgtgtctcccgccgccgcaggtgcaaggcccgtgtcggtatccaccagagggtcaccaaggaggacgccatgaagtggttccaggtcaagtatgagggtgtcatcctcaacaagtcccatgcgagctaagaaggatgtagctatcgctagaccttgagttaattaagttcacctggttgctggatatgtatgttacctagaaacctgctttgtcactttttgcctgtactcaagctggatgatttctgtttgatctgcactttcgtctaagaggcccagtctgttttattatcctcttcaacaatagatatatgtttggcgcatgagatgacctgcgtttgtttgatcttcttgtccggttcagcatctgttaaatttcaaaaaattcacttcctagcagatgcttgcaagcacgaaagtcttgtctatccttgaaaaggtttgtaactatactcttttctgtgcatcgtcctaaatctcgagcaagaaatcgttgtcgataaaaaaagaatcccg

SEQ ID NO: 5226 - DNA, 812 bp, Festuca arundinacea
ggggggccgcagccacacaccacagcaccagctaacccctctcttcctcggctccctctccaccggcggcctccccgttcagatcaccatgtcgacggagaagaagcagctgaacccgatgcgggagatcaaggtgcagaagctcgtgctcaacatctccgttggcgagagcggtgatcgcctcactcgcgcctccaaggtgttggagcagctgagcgggcagtcgccagttttctcaaaggctaggtacactgtgaggtctttcggtatccgtcgtaatgagaagatcgcttgctacgtcacgatcaggggtgagaaggcaatgcagcttctcgaaagtgggctgaaggtgaaggagtacgagctgctcaggaggaacttcagtgacactggttgctttgggtttggtatccaggagcacattgatcttggcatgaagtatgacccgtcaactggtatttatggtatggatttcttcgttgttctggagcgtgctggataccgtgtttctcgccggcgccgttgcaaggcccgcattggtatccaccaaagggtgaccaaggaagatgccatgaagtggttccaggtcaagtacgagggtgtcatcctcaacaagtcccacgcgagttagtaatcttttgagtgaagaagttgtccttcagaactctagtcattcagagtgtcttctggatcatggaatcatatgtttattggatacaaagtgcactgtcaattttgcctctgtttgagttgacctgcgtttataattccatcagatcctttcttggtcccaaaaaaaaaaaaaaaaaaaa

SEQ ID NO: 5227 - DNA, 637 bp, Festuca arundinacea
  misc_feature (160)..(160): n is a, c, g, or t
  misc_feature (265)..(265): n is a, c, g, or t
  misc_feature (286)..(286): n is a, c, g, or t
  misc_feature (514)..(514): n is a, c, g, or t
gcacgagggccacacaccacagcaccagctaacccctctcttcttcggcttcctctccaccggcggcctccccgttcagatcaccatgtcgacggagaagaagcagttgaacccgatgcgggagatcaaggtgcagaagctcgtgctcaacatctccgtnggcgagagcggtgatcgcctcactcgcgcctccaaggtgttggagcagctgagcgggcagtcgccagttttctcaaaggctaggtacactgtgaggtctttcggnatccgtcgtaatgagaagatngcttgctacgtcacgatcaggggtgagaaggcaatgcagcttctcgaaagtgggctgaaggtgaaggagtacgagctgctcaggaggaacttcagtgacactggttgctttgggtttggtatccaggagcacattgatcttggcatgaagtatgacccgtcaactggtatttatggtatggatttcttcgttgttctggagcgtgctggataccgtgtttctcgccgncgccgttgcaaggcccgcattggtatccaccaaagggtgaccaaggaagatgccatgaagtggttccaggtcaagtatgagggtgtcatcctcaacaagtcccacgccagttagtaatcttct

SEQ ID NO: 5228 - DNA, 841 bp, Nicotiana benthamiana
atttttggttttgcaggcgtcagagaagaaattgagcaaccccatgagagaaattaaggtccagaagctcgttctcaatatctccgtcggtgagagcggagatcgtctcactagagcagctaaggtcttggagcagcttagcggccaatcccctgttttctccaaggcaaggtatactgtgcggtcttttggaatcaggcgtaatgaaaagatagcttgctatgtaactgtcagaggggagaaagctatgcagctacttgagagtggattgaaagttaaggaatatgagttgttgagaaggaacttcagtgagaccggctgctttggttttggtattcaggagcacattgatcttggaattaaatatgatccgtcaactggtatttatggcatggacttctatgttgtattggagcgtcctggataccgtgttgcccgtcgccgcaggtgcaagtctcgagttgggattcagcacagagtcacaaaggaggatgcgatgaagtggttccaggtcaaatatgaaggtgttatccttaacaagtcctcaaacattcagtgataagcttagaaagccaacttctggatcagtctgtctcctcgcaaggaagttttggagagtttctagtagtggtgtatgaggatgttttagttctcgttttggctatcagatcaattcaatctttttttggtcattttcttttgttccaattaaatcagaagcattcaactccacaatctagtacaatagacgccttgaatacctgatttgtttgctattgtggtaacaaattaatccactgtttaagcgttggttttttggcatggagtacaaccaagtata

SEQ ID NO: 5229 - DNA, 876 bp, Avena sativa
tcgacgttctaaaccccttctccctcccccctcgcgtgtcccgccgccgctccccagatcccggcgtcatgtcgacggagaagaagcagttgaaccccatgcgggagatcaaagtgcagaagctcgtcctcaacatctccgtcggcgagagcggagatcgcctcacccgcgcctccaaggtgctggagcagctgagtggacagtcgccagtgttctctaaggcgaggtacactgtgaggtcttttggtatccggcgtaatgagaagattgcatgctacgtgacgatcaggggtgagaaggcgatgcagctgctggagagtggcctgaaggtgaaggagtacgagcttctcaggaggaacttcagcgacaccggatgctttgggttcggtatccaggagcacattgatcttggcatgaagtatgacccatctactggtatctatggtatggatttctttgtcgttctggagcgtgctgggtaccgtgtttcccgtcgccgcaggtgcaaggctcgtattggcatccaccagagggtcaccaaggaggacgccatgaagtggttccaggtcaagtatgagggtgtcatcctcaacaagtcccatgctagctaagagaagaacgcagctctcgttagaccttgagttaatctaagttcacctggttgctggatatgtatgtgttccttagaaaccaaatgctttgtcagtttttgcctgtactgaagttggatgattttggttgttctgcactttcgtctaagacactcacttctgttttatcctctctctcaatagatatttgtttggttgtagatatccttcttttgttttgttgttcttcttaaacgttacttaacaacaaaaaaaaaaaaaccag

SEQ ID NO: 5230 - DNA, 1337 bp, Avena sativa
ggccgccgccgccccacacgacgttctaaaccccttctccctccccctcgcgtgtcccgccgccgctccccagatcccggcgccatgtcgacggagaagaagcagttgaaccccatgcgggagatcaaagtgcagaagctcgtcctcaacatctccgtcggcgagagcggagatcgcctcacccgcgcctccaaggtgctggagcagctgagtggacagtcgccagtgttctccaaggcgagatacactgtgaggtctttcggtatccggcgtaatgagaagattgcgtgctacgtgacgatcaggggtgagaaggcgatgcagctgctggagagtggcctgaaggtgaaggagtacgagctgctcaggaggaacttcagcgacaccggatgctttgggtttggtatccaggagcacattgatcttgggatgaagtatgacccatccactggtatctatggtatggacttctttgtcgttctggagcgtgctgggtaccgtgtttcccgtcgccgcaggtgcaaggcccgtattggcatccaccagagggtcaccaaggaggacgccatgaagtggttccaggtcaagtatgagggtgtcatcctcaacaagtcccatgctagctaagagaaggacgcagctctcgttagaccttgagttaatctcagttcacctggttgctggatatgcatgtgttccttagaaaccaaatgctttgtcagtttttgcctgtactgaagatggatgattttggttgttctgcacttttgtctaagacactcacttctgtttcatcctctttccgcaatagatatatgtttggtcttgagatatccttcttttgtttcgtctctcttaaattcttcttggaactcgttcgttctccacggtgtgagtattacttcggaactgttctcattgaccagataaataccaactgtctgtttctaatcctgagaactgatgaagatcgagaagttgacagaggaagtcgctgccgctgacaatgaagagcatatgaagatcttttgtctggcaggtgtatacactttggcagcacaactgtggccaactagtgccagactactttgccgatgatccattgcacgatgacgtggtatttcaacgccatttcaggatgaatcaaaagctttccctaaagcatttcaggatgaatcaaaagctttccctaaagattgttaaggctcgcgatgtggtatttagattgttaagcctcgcgatgtggtatttcagcgtcgttttaggatgaatcggaaaagtatgtggtatttcaacgctattttaggatgaattggaagcttttcctgaagattatt

SEQ ID NO: 5231 - DNA, 932 bp, Secale cereale
cctccctccttccccatcccccgccgccgctcctacccagatcccgccgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcaccggtgttctccaaggcgaggtacactgtcaggtcattcggtatcaggcgtaatgagaagatcgcgtgctatgtgactatcaggggtgagaaggcgatgcagctgctggagagtggcctgaaggtgaaggagtacgagctgctcaggaggaacttcagcgacaccggatgctttggcttcggtatccaggagcacatcgaccttggcatgaagtacgatccatctaccggcatctacggtatggacttcttcgtggtgctcgagcgtgctgggtaccgcgtctcccgccgccgcaggtgcaaaggcccgggtcggtatccaccagagggtcaccaaggaggacgccatgaagtggttccaggtcaagtacgagggtgtcatcctcaacaagtcccatgcgagctaagaaggacgtagctctctttagaccttgagttaatgaagttcacctggttgctggatatgtatgttacctagaaaccaaatgctttgtcagttttgtctgtactcaagctggatgatttctgtttgatctgcactttcttctaagaggctcactgctgctttatcctctttcaacaatagagtatatgtttggcttatgtgatgacctgccttttgtttggtcacccttgaatcttctctaaatttgttgttcgtccacccgaatttagtgcgccctacccaatgaaaattgtatcttccaggttgcaaccgcttacttatatttgttcgttatccca

SEQ ID NO: 5232 - DNA, 697 bp, Sciadopitys verticillata
acattgcacaaaaatggcctctgataaactaaagaacccgatgagggaaataaaggtgcagaagttggttctcaacatatcagttggtgaaagtggtgatagactgactagagctgcaaaggtcttggagcagctgagtgggcagactccagtcttttcaaaagcaagatatactgtaaggtcttttggaatcaggcgaaatgaaaagattgcatgctatgttactgtgagaggagaaaaagctatgcagcttttggagagtggattgaaagtcaaggaatatgaattgcttcgaagaaacttcagtgaaactggttgttttggttttggaattcaggagcacattgatttggggatcaagtatgatccttcaactagtatatatggcatggacttttatgtagtcctagagcgtccaggttacagcattagcaggaggaagagatcgaagtcccgtgttggcattcaacacagggtgaccaaggatgatgctatgaagtggttccagaacaaatatgagggagtgatcctcaacaagtcacaatctaacacctaagacttcaaatacaaggtaatgatgctatgaagtagttttggtaattccttgttatgagcagtctgagttttggtgtaccatttgtcttttacaccttaatggaaggagtgtccttctttgttattgatggaagttttcttt

SEQ ID NO: 5233 - DNA, 968 bp, Triticum aestivum
ccccgccgccgctccccagatccgctgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcacctgtgttctccaaggcgaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggacgtagctctctttagaccttgagttaattaagttcacctggttgctggatatgtatgttacctagaaaccaaaatgctttgtcagttttgcctgtactcaagctggatgatttctgtttgatgcgcactttcgtctaagaggctctctactgttttatcctctttcaacaatagagtatatgtctggcttatgtgatgacctgccttttgtttggtcactctcgaatctgctctaagtttttggctcgtccacctgaattttggtgcgccctacgcgatgaccattgtatctttcaagttgccactgcttccttatatttgtctatatacgcaactggaagtgatggaaacagtcacgaatgcctttgtttaataaagctctctgaagtt

SEQ ID NO: 5234 - DNA, 756 bp, Zostera marina
ggggaaaaccaacacgcacccaaattccgccgtccttagaagaacaatggccgaaaggaagcagtcgaatcccatgagggaaataaaagttcagaagctcgttcttaacatctccgttggagaatctggggatcgtctcaccagggcctcgaaggttttggaacagctgagtgggcaaagccctgttttctcaaaagcaagattcactgttcgatcatttggaattagacgaaatgaaaaaattgcttgccatgtgacggttagaggtgagaaggcaatgcaactaattgagagtggtttgaaagtcaaggaatatgagttgttgcgaaagaactttagcgacactggttgcttcggctttggcattcaggagcatattgatttgggaatcaaatatgatccttccactggtatctacggtatggatttctatgtagtcctagagcgacccgggtaccgtgttgcccggcgtcgtagggccaaagctcgtgttggtattcaacatcgagttaccaaagatgatgctatgaaatggttccaggtgaagtacgagggtgtcatccttaacaaatctcaaaatattggttgaccttcctcagattagaaatgaattattattcatcttttttacattgtaagaagaagatttcatccttaaacttgtcatactttctgtttttctttctcaattgaagttttgagtactactatttagttttcaattgatgtgttaaagatggttcgtattaaatattg

SEQ ID NO: 5235 - DNA, 913 bp, Panax ginseng
aatgtcccgaaaacctctaggacggcacagaaggcctaattcaccgagaacatcatcaaaaccctagatttagtcgcactcccgcttcctatatttagggtttctctcctcttcccgattctgcattttttccccacttgcagagttgcagttgcagttgcagttgcagttgcgaacttcaccaccggcgaatcgccatggcttcagagagaaaattagcgaacccgatgagggagattaaggttcaaaaactcgtccttaatatttctgttggagagagtggagatcgactcactagagcctctaaggtcttggaacaactcagtggtcaaacccctgttttctccaatgcaaggtatactgtgaggtcttttgcgatcaggcgtaatgagaagattgcctgctatgtcacagtgagaggtgacaaggcaatgcaacttctagatagcgggttgaatgtgaaggaatgtgaattgtataggaagaacttcagtgattctggctgttttggctttggtatcccggagcacattgatcttggaattaagtatgatccttccactggcatttacggtatggatttctatgttgtgcttgaacgtccgggttgccgtgtgggccgccgccgtaaatgcaaatcacgtgttggaatccagcacagggttacaaaggaggatgcaatgaaatggttccaagtcaaatatgagggggtgattcttaacaagtcccagaatattgggaattagttgagtgatgcctgatctgttaggtttatgccttttggactagctgaggataaaaaaatttaagagcaatgttgtgaataattgcagactggcggtcatgtttgcatctagttagtcaaatttaacatattttttgagagaatttgaactttacaatgtttttggct

SEQ ID NO: 5236 - DNA, 884 bp, Setaria italica
ctagccgcagaaccatcttacctccgccgccgtcgccccgcacagcactgcagaaccatctcacccccgccgccgtcgcctcccggatcttcccatggcgtcggagaagaagcaggcgaacccgatgcgggagatcaaggtccagaagctcgtgctcaacatctccgtcggcgagagcggtgatcgcctcacccgcgcggccaaggtgctcgagcagctgagtgggcagtcaccggtgttctccaaggcgaggtacactgtgaggtcattcggcatcaggcgtaatgagaagattgcgtgctatgtgacagttaggggagagaaggcgatgcagctgctggagagtggcttgaaggtcaaggagtatgagctgctgaggaggaacttcagtgagactggctgctttgggtttggtatccaggagcacattgatcttggcatcaagtatgacccatctactggtatctacggcatggacttctacgtcgtccttgagcgggctgggtaccgcgttgcccgccgccgcaggtgcaagtcccgtgttggtatccagcacagggtcaccaaggaggacgccatgaagtggttccaggtcaagtacgagggtgtgatcctcaacaaggcccaggccaactcctaagcatcacaagaagagcttagctcctcgtcaaatctcgagttcattaagtctatctggtggttgggtttgtactagaattaaccaaaaatccatgtcagttttgcatgtactgagctggatccttttttgggtgccatgtactttcatctggattctcgcttgtgttttacccacattggcagcaatagtagatgtctggcttattctgtgaaatagcgttttgttttgttttgttctcgaataa

SEQ ID NO: 5237 - DNA, 689 bp, Brassica juncea
agagaagaagctgtcgaaccccatgagggacatcaaggtccagaagcttgttctcaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcttgctacgtcactgttagaggtgacaaggcgatgcagcttcttgagagtggcttgaaagttaaggagtatgagcttcttaggaggaactttagtgacactggttgctttggattcggtatccaagagcacattgatcttggtatcaagtatgatccatctactggtatctacggaatggacttctatgttgttctcgaacgtccaggataccgtgtggcacgtcgtcgtagatgcaaggctcgtgttggtatccaacacagagtgactaaggatgatgcaatgaaatggttccaagtcaagtatgaaggagttatcctcaacaagtctcagaacatcaccggctaaaaagatttttgttgattttagctttgtttcgagttgtttatcttttaaagagttctggatgctaaagacctctttgttgtagtaaaaccttttgtgacgtctgtggtagtatctaaaatcttcgaaagaaccttggtgatatgatttt

SEQ ID NO: 5238 - DNA, 553 bp, Brassica juncea
aagaagctctcgaaccccatgagggacattaaggtccagaagcttgttctaaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcgtgctacgtcactgttagaggtgacaaggcaatgcagcttcttgagagtggcttgaaagtcaaggagtatgagcttcttaggaggaacttcagtgacactggttgctttggattcggtatccaagagcacattgatcttggtatcaagtatgatccatctactggtatctatggaatggacttctatgttgttctcgaacgtccaggataccgtgtggcccgtcgccgtagatgcaaggctcgtgttggtatccaacacagagtgaccaaggatgatgcaatgaaatggttccaagtcaagtatgaaggagttatcctcaacaagtctcagaacattactggctaaaccaaacttcaatctt

SEQ ID NO: 5239 - DNA, 669 bp, Brassica napus
ggcgtcagagaagaagctctcgaaccccatgagggacattaaggtccagaagcttgttctaaacatctccgttggtgaaagtggtgatcgtctcacccgtgcctcaaaggttttggaacagctcagtggacaaacccctgttttctcaaaggcgaggtacactgtgaggtcttttggtattaggcgtaacgaaaagattgcgtgctacgtcactgttagaggtgacaaggcaatgcagcttcttgagagtggcttgaaagtcaaggagtatgagcttcttaggaggaactttagtgacactggttgctttggattcggtatccaagagcacattgatcttggtatcaagtatgatccatctactggtatctacggaatggacttctatgttgttcttgaacgtccaggataccgtgtggcacgtcgtcgtagatgcaaggctcgtgttggtatccaacacagagtgactaaggatgatgcaatgaaatggttccaagtcaagtatgaaggagttatcctcaacaagtctcagaacatcaccggctaaaaagatttttgttgattttagctttgtttcgagttgtttatcttttaaagagttctggatgctaaagacctctttgttgtagtaaaaccttttgtgacgtctgtggtagtatctaaaatctt

SEQ ID NO: 5240 - DNA, 959 bp, Ceratodon purpureus
caaagctttagcttgctctcgtttatgccccgcaagcagccgtcatcgccaatctgccccgtcgtcgccttctgccatggcgtccgataaaaagcagcagaattgtatgcgggacatcaaggttcagaagcttgttctgaacatctctgttggggagagtggagatcgtcttacgcgtggttccaaggttttggaacagctcagcgggcagtcccccgtcttctcgaaagcaagatacactgtccgttccttcggaatcaggcgtaatgaaaagattgcatgctacgtgactgttcgtggcgagaaagccatgcaactcttggagagtggcttgaaggtgaaggaatacgagctgctccgtcgcaacttcagtgagtctggttgctttgggtttggaatccaagagcacattgatcttggaatcaagtacgatccctccacaggtatctacggtatggacttctacgtggtgcttgagcgcccaggttacagagtaggaagaagacggagagccaaatctcgcgttggtatcaagcaccgcgttacgagggaggatgccatgaagtggttccaggttaagtacgagggtgtgatcttgaacaagtctcagaacatcacaggttaaatgtgtgggacactgcaggtttttgaaagaaaaagagacctcgattgattgatcacggtatccgcctgcttgtactctgagttcgcaagtctcaatattattgggaattttaccacaagcaattgcaaatcatacttctgcattcagtgtcaatctttgagggcccaatggtattgatctaccgaagcttctgtcgatgcgacgctcagttatgttaagctacattgctgcgtgtctacggtatcggaactatctacatctttatctgaatttcagtatgttgatctgcccttttatttttggcatttattttggcattgtagtgccagtttgc

SEQ ID NO: 5241 - DNA, 789 bp, Lolium multiflorum
ggcacgaggcacaccacagcaccagctaacccctctcttcctcggctccctctccgccggcggcctccccgttcagatcaccatgtcgacggagaagaagcagctgaacccgatgcgggatatcaaggtgcagaagctcgtgctcaacatctccgtcggcgagagcggtgatcgcctcactcgcgcctccaaggtcttggagcagctgagcgggcagtcgccagttttctcaaaggctaggtacactgtgaggtctttcggtatccgtcgtaatgagaagatcgcttgctacgtcaccatcaggggtgagaaggcaatgcagcttctcgaaagtgggctcaaggtcaaggagtacgagctgctcaggaggaacttcagtgacactggctgctttgggtttggtatccaggagcacattgatcttggcatgaagtatgacccgtcaactggtatttatggtatggatttcttcgttgttctggagcgtgctggataccgtgtttctcgtcggcgccgttgcaaggcccgcattggtatccaccaaagggtgaccaaggaagatgccatgaagtggttccaggtcaagtacgagggtgtcatcctcaacaagtcccacgcgagttagtaatcttttgagtgaagaagttgtccttcagaattctagtcattcagagtgtcttctggatcatggaatcatatgtttattggatacaaagtgcactgtcaattttgcctctgtttgagttgacctgcgtttataattccatcagatcctttctttggtctaac

SEQ ID NO: 5242 - DNA, 931 bp, Lolium multiflorum
ggcacgaggcacaccacagcaccagctaacccctctcttcctcggctccctctccgccggcggcctccccgctcagatcaccatgtcgacggagaagaagcagctgaacccgatgcgggatatcaaggtgcagaagctcgtgctcaacatctccgtcggcgagagcggtgatcgcctcactcgcgcctccaaggtgttggagcagctgagcgggcagtcgccagttttctcaaaggctaggtacactgtgaggtctttcggtatccgtcgtaatgagaagatcgcttgctacgtcacgatcaggggtgagaaggcaatgcagcttctcgaaagtgggctcaaggtcaaggagtacgagctgctcaggaggaacttcagtgacactggctgctttgggtttggtatccaggagcacattgatcttggcatgaagtatgacccgtcaactggtatttatggtatggatttcttcgttgttctggagcgtgctggataccgtgtttctcgtcggcgccgttgcaaggcccgcattggtatccaccaaagggtgaccaaggaagatgccatgaagtggttccaggtcaagtacgagggtgtcatcctcaacaagtcccacgcgagttagtaatcttttgagtgaagaagttgtccttcagaattctagtcattcagagtgtcttctggatcatggaatcatatgtttattggatacaaagtgcactgtcaattttgcctctgtttgagttgacctgcgtttataattccatcagatcctttctttggtctcattttcccaatctactatttcatgaattctttgctagctgatgttattcagtttacttcgtatatcattttaccagcaataggcccacaactataaatgtcaatctgattgtgcacgcatttgctaccaagtatagaagtatag

SEQ ID NO: 5243 - DNA, 1289 bp, Eragrostis curvula
  misc_feature (27)..(27): n is a, c, g, or t
  misc_feature (55)..(55): n is a, c, g, or t
  misc_feature (437)..(437): n is a, c, g, or t
  misc_feature (464)..(464): n is a, c, g, or t
  misc_feature (485)..(485): n is a, c, g, or t
  misc_feature (488)..(488): n is a, c, g, or t
  misc_feature (539)..(539): n is a, c, g, or t
  misc_feature (544)..(544): n is a, c, g, or t
  misc_feature (551)..(552): n is a, c, g, or t
  misc_feature (614)..(615): n is a, c, g, or t
  misc_feature (664)..(664): n is a, c, g, or t
  misc_feature (719)..(719): n is a, c, g, or t
  misc_feature (725)..(725): n is a, c, g, or t
  misc_feature (746)..(746): n is a, c, g, or t
  misc_feature (773)..(773): n is a, c, g, or t
  misc_feature (782)..(782): n is a, c, g, or t
  misc_feature (785)..(785): n is a, c, g, or t
  misc_feature (791)..(791): n is a, c, g, or t
  misc_feature (801)..(801): n is a, c, g, or t
aggagaaaaggagagaagaggatgcgnccgcacactaaaccttttcctctctccntccctctccgccgccgtctctgctctcccgatccgccatggcgtcggagaagaagcaggcgaacccgatgcgggagatcaaggtgcagaagctcgtgctcaacatctccgtcggagagagcggagatcgtctcacgcgtgccgccaaggtgttggagcagctgagtggccagtccccagttttctccaaggctaggtacactgtgaggtcctttggtatccgtcgtaatgagaagatcgcgtgctacgtcacagtcaggggagagaaggcgatgcagcttctcgagagtgggctgaaggtgaaggagtacgagttgctgaggagaaacttcagcgagactggatgtattgggttcggtatccaggagcacattgatcttggnatcaaatatgacccatcaactggtatntatggtatggacttctatgtngtncttgagcgtgctggataccgcgttgctcgccggcgcaggtgcaaggcccgngtggncatccannacagggtgaccaaggaagatgccatgaagtggttccaggttaagtacgagggtgtcatcctnnacaaggcccaaggaaacacctcgtaatcatctagaagagtgaactgtanctcttttgaactccggttaagtttactccgttccatgggattgtatgtttgttgngtaccntgtgtactgtcagttttgccnctggagttgacctgcgtctatattccntcttaatcncanacaagnacttatcagncacttggtattttccttttcccggtgctatttatgtttgtcccgcatgaacgtacaaacaataaacattaacaaacacacagtaactctgcgttaatcccctgcttattcgttaattaatttcctgcccgcctgtagtttacttttatgggaaaacccctaccgaggtggaagctaatcttgaagtattctaagcggcccctaaatagctgggtgaaacatggctcaacttgttttcttgttgatatttttattcctcttcttaatttccatttttaattccactttaaaaaataaaaggggtaaaaccttgggggtggtaaatagatgattaaaccctacacataaattgagttgccctctccttcgcccccatttttcctcctacaaaatcctgtcatgcgcctcacgtcaatttactaaatccgaccttcaatagctgcttgcgatgaaaggagcattttgtttgtcaatttagggcaacctcct

SEQ ID NO: 5244 - DNA, 728 bp, Nicotiana benthamiana
ctctgttttatttttaggcttcagagaagaaattgagcaacccaatgagggagattaaagtccagaagctcgttctcaacatctccgtcggtgaaagcggagatcgtctcaccagagccgccaaggtcttggagcaactcagtggccaatcccctgttttctccaaggcaaggtatactgtccgatccttcggaattagacgtaatgaaaagattgcctgctacgtcactgtcagaggggaaaaagctatgcagctcctcgagagtggattgaaggtcaaggagtatgagttgttgagaaggaacttcagtgaaactggctgctttggttttggtattcaggagcacattgatcttggaattaagtatgacccttcgactggtatctatggtatggatttctatgttgtcctggaacgcgcaggataccgtgttgccagacgtcgtaggtgcaagtctcgggttgggatccagcacagggttacaaaggaagatgccatgaagtggttccaggtcaaatatgaaggtgttatccttaacaagtcctctaacattcagtaagctgaaagctagttgagagctgtctgctggatcaatttgttcagtagctagtttatgtctatgcattttgtagaccaacatttaattactccccgagttgaatagtttttgagactgttatttggcatattatgttttcatttttggctatcatcaactcaatcttac

SEQ ID NO: 5245 - DNA, 945 bp, Avena sativa
cccctccccgccgccgtcgccgaagccgaagaatctgccgccatgtcgacggagaagaagcgggcgaaccccatgagggagatcaaggtgcagaagctcgtcctcaactgctccgtcggggagagcggcgacaggctcacccgtgccgccaaggtgctcgagcagctgagcgggcagtcgccggtgttctccaaggcgaggtacaccgtgcgttcgttcggcatccggcgtaacgagaagattgcgtgctacgtgacggtcaggggcgagaaggccatgcagctgctcgagagcgggctcaaggtcaaggagtacgagctgctcaggaggaacttcagtgaaaccggctgctttggcttcggtatccaggagcacatcgatcttggcatgaagtatgatccctcaacaggtatctacgggatggacttctatgttgtccttgagcgtgctggctaccgtgtgtcccgtcgccgcaggtgcaagtctcgcatcgggatccaccagagggttaccaaggaggacgccatgaagtggttccaggtcaagtatgagggagtcatcctcaacaagtcccacaccgcctagaaacctcacctctgtatgcagcagtgtttagaacctatctctatcgtcgcgaacagaagttcaccttgcaaattgaccgttcactcggatgaattctctagccagatgttttgtttgcctattacctgggatctaaaggcctaattgcttggccagactcttgattttgttccctgttcattttgtgttggtgcgtgtttcagttcgtgccattctgctatcattttgttgaatttgcttgttaagtcggtcattgttgggttgatttcatgaacacgatgtatggttttcatcgttggtgtctaatccttccttctcgtgtaaaattcatactcctatatacggtatgttctctttcat

SEQ ID NO: 5246 - DNA, 807 bp, Avena sativa
gttctaaaccccttctccctccccctcgcgtgtcccgccgccgctccccagatcccggcgccatgtcgacggagaagaagcagttgaaccccatgcgggagatcaaagtgcaaaagctcgtcctcaacatctccgtcggcgagagcggagatcgcctcacccgcgcctccaaggtgctggagcagctgagtggacagtcgccggtgttctccaaggctaggtacactgtgaggtctttcggtatccgacgtaatgagaagattgcgtgctatgtgacgatcaggggtgagaaggcgatgcagctgctggagagtggcctgaaggtgaaggagtacgagctgctcaggaggaacttcagtgacactggatgctttgggttcggtatccaggagcacattgatcttgggatgaagtatgacccatctactggtatctatggtatggacttctttgttgttctggagcgtgctgggtaccgtgtttcccgtcgccgcaggtgcaaggcccgtattggcatccaccagagggtcaccaaggaggacgccatgaagtggttccaggtcaagtatgggggtgtcatcctcaacaagtcccatgctagctaagagaagaacgcagctctcgttagaccttgagttaatctaagttcacctggttgctggatatgtatgtgttccttaaaaaccaaatgctttgtcagtttttgcctgtactgaagttggatgattttggttgttctgcactttcgtctatgacactcacttctgtttcatcctctttccgcaatagatatatgtttggtcttgc

SEQ ID NO: 5247 - DNA, 840 bp, Avena sativa
ccgccgtcgccgaagccgaagaatctgccgccatgtcgacggagaagaagcgggcgaaccccatgcgggagatcaaggtgcagaagctcgtcctcaactgctccgtcggggagagcggagacaggctcacccgcgccgccaaggtgctcgagcagctcagcgggcagtcgccggtgttctccaaggcgaggtacacggtgcgttcgttcggcatccggcgtaacgagaagatcgcgtgctacgtgacggtcaggggcgagaaggccatgcagctgctcgagagcgggctcaaggtcaaggagtacgagctgctcaggaggaacttcagtgaaaccggatgctttggcttcggtatccaggagcacatcgatcttggcatgaagtatgatccctcaacaggtatctacgggatggacttctacgttgtccttgagcgtgctggctaccgtgtgtcccgtcgccgcaggtgcaagtctcgcatcgggatccaccagagggttaccaaggaggacgccatgaagtggttccaggtcaagtatgagggagtcatcctcaacaagtcccacaccgcctagaaacctcacctctgtatgcagcagtgtttagaacttatccttgcaaattgaccgttcactcggatgaattctctagccagatgttttgtttgcctattacctgggatctaaaggcctaattgcttggccagactcttgattttgttccctgttcattttgtgttggtgcgtgtttcagttcgtgccattctggtatcgttttgttgaatttgcttgttaagtcggtcattgttgggttgatttcatgaacacgatgtatggtttt

SEQ ID NO: 5248 - DNA, 837 bp, Capsicum annuum
ggcttcagagaagaaattgaacaaccctatgagggatatcaaggtacagaagcttgtcctcaacatctccgttggtgagagtggagatcgactcaccagagcagcaaaggtgttggagcagcttagtggccaatcacctgttttctccaaggcaaggtatactgtgcggtcctttggaatcaggcgtaacgaaaagatagcttgctacgtgactgtcagaggtgagaaagccatgcagctacttgagagtggattgaaagttaaggaatatgagttgttgagaaggaacttcagtgaaaccggctgctttggatttggtattcaggagcacattgatcttggaattaaatatgacccttcaactggtatttatggcatggatttctatgttgtcttggagcgtcctggataccgtgttgctcgtcgccgcaggtgcaagtctcgcgttgggatccagcacagggtcacaaaggaggatgcaatgaagtggttccaggtcaaatatgaaggtgttatcctcaacaagtcctcaaacattcagtgataagctgagagccagcttagcaagtttatggttatgcattttgtagaccagtatctatgtcactcctagaggaaagttttggtgagtttcaattagttggtgtatgagagtgtgttagttggattagttctcattttgaccatcagatgatctaaaatcttttttctttttgttgcaatcgtagtagaatcagcaatctagtattacaagagacgttatgaatacttatttggtgtcccattgtggtaatgaattgatgttgttttaacatctttatgaaaaaaagcggccgc

SEQ ID NO: 5249 - DNA, 943 bp, Ananas comosus
atctcgtccctctcgcacaccgtcgccacttgagcgcgtcctctgcggccatggtacgaagcccacctcctctcgatctcttcctcttcttcgtcttcgtggatccctactctttcgatctcttcttcttcttcttcttcttcttcgtagcttttgatgggttccctgctcaatgtaggcgtcggagaagaagctatcgaaccccatgagggagatcaaggtgcagaagctcgtgctcaacatctccgtcggagagagcggcgatcgcctcacccgtgcgtcaaaggtgttggagcaattgagcggacaaactcctgtgttttcaaaagccaggtacacagttcggtcttttggtatccggcgtaacgaaaaaattgcttgctatgtcacggttcgtggtgagaaggccatgcaacttctcgagagtggcttgaaagtgaaagagtatgaattgctgaggagaaacttcagtgataccgggtgtttcggctttggtattcaggagcatatcgaccttgggattaagtacgatccgtctactggcatatacgggatggacttctatgtcgtcttagagcgccccggatacagagtgggccgccgccgccgctgcaagtccggtgtcgggatccagcacagggtcacgaaggatgatgcgatgaagtggttccaggtaaggtacgagggcgtgatcctcaacaggtcccaggcaatagcctcgtaggtgcgttcggacatgccatatcacctcatccgaaggtagctcagtttctttcagtcaaattccgactgctcgaaaacgagtgcttattaggtgattctttttttttctcttttcctgtgttttagaaatgacttgaattttcatgtgcttctcttcgaagagccgagttgcctttttctttctgctttcggtagtaattgggagtactgcgattttgtt

SEQ ID NO: 5250 - DNA, 590 bp, Papaver somniferum
aacgaatccaatgagagacatcaaagttcagaaacttgtcctcaacatctctgttggggagagtggtgatcgtctcactagagccgccaaggttctggagcaactaagtggacaagccccagttttctctaaggctagatacactgttcgatcttttggtatcaggcgtaatgagaagattgcttgctatgttactattaggggagagaaggcaatgcaattgctggagagtggattgaaagtgaaggagtatgaactgttgaggagaaattttagtgatactggttgttttggctttggtgttcaggaacatattgatcttggaattaagtatgacccatctactggtatctatggaatggacttctatgttgttttggagcgtcctggttaccgtgttggtcgtagacgacgttgcaagtctcgtgttgggatccaacatcgagtcacaaaggaggatgctatgaagtggttccaagtcaagtatgaaggtgtcatcctcaacaagtcccagaacatcccttgttgataacaacaagggaagagggaactgattccagttaaatttttttttttttccacattagttt

SEQ ID NO: 5251 - DNA, 978 bp, Sciadopitys verticillata
attgacgatagagcagcagctgtaggcggacggagttgaagagacgatcattattctaaaaaaatgacatcggcagctgacaaactgaagaacccgatgagggaaattaaggtgcagaagctggttctcaacatatcagttggtgagagtggtgatcggctgactcgagctgcaaaggtgttggagcagctgagtggtcagactccagtcttttccaaggcaagatatactgtgaggtcatttggaatcaggcgaaatgaaaagattgcttgctacgttactgtgagaggcgataaagccatgcagcttttggagagtggattgaaagtcaaggagtatgagttgcttcgaagaaacttcagtgatacaggttgttttggttttggcattcaggaacacattgatttggggatcaagtatgatccttcaactggtatttatggcatggacttctttgtagtcctagaacgtccaggctatagaattgctaggaggaagagagccaagtccagggttggcattaaacacagggtaaccaaggacgattctatgaaatggttccaaaacaaatacgagggagtgatccttaacaaatcacagaataactgatagatgtttgtttgttatttttgtaatttctaattagagtattctgaattttggtgtacgttttctgtctacactttcaaaaggatccttttgggttattgacagcaattttgccttttaaagagattttaaaggtcttacactttttacttgggaggaagctactttttcacatgttgaattcaagaacattctttcttatttgaaacactatgttgaagtagtatttcattcaatgtttcaaagttttctagtttgattcgctatttgaagtctgttacatacccaatgtatttctagtttcaaagttttctttggttgatatttcactatgtttgagatattaaattgttcatgaaggtgaatggc

SEQ ID NO: 5252 - DNA, 748 bp, Malus domestica
atggtgagttggattttgtggggtgtggaaatgcaggcgtcggagaacaagctggcgaatcccatgagggaaatcaaggttcagaagctcgtcctcaacatctccgtcggagaaagcggcgatcgtctcaccagagccgccaaggtcttggagcagctcagtggccagacccctgtcttctccaaagctcggtacactgtgaggtctttcgggatcaggcgtaacgagaagattgcctgctacgtgactgtccgcggcgataaggcaatgcagcttttggagagtggactgaaggtcaaggaatacgagctgttgcgcaggaacttcagcgacaccggatgctttggtttcggtattcaggaacacattgatctcggaatcaagtatgacccttctaccggtatctatggtatggacttctatgttgttctagagcgcccagggtaccgtgtgggacgccgccgcagatgcaagtcgcgcgttggcattcagcacagggttaccaaggaggacgccatgaagtggttccaggtcaaatatgaaggagtcatcctcaacaagtcgcagcagctctcagcttcgtaggcccttaggatcgtcaaattaatttgatcagtctctatgaccggcttctgttaattttcagttttgcaaagctcgagttagcgtttggagcgaagtatgttaatttgttttttgacttataaagcttttggaagttattatatatcattagagttgcctggaa

SEQ ID NO: 5253 - DNA, 825 bp, Catharanthus roseus
ggcatcagagaagaaattaaacaacccaatgagggaaatcaaggtccagaagcttgtcctcaacatctccgtcggagaaagtggtgatcgtctcaccagagctgccaaggtcttggaacaactcagtggtcagaccccggttttctccaaggctagatacactgtcaggtcctttggaatcaggcgtaatgaaaagattgcttgctatgtcactgtgagaggagacaaggcaatgcaactcctagagagtggattgaaggttaaggaatatgagctcctgaagagaaactttagtgagactggctgcttcggttttggtatccaggagcacattgatcttggaatcaagtatgacccttcaactggtatttatggtatggatttctatgttgtcttggagcgccctggttaccgggtagcacgtcgccgtaggtgcaagtctcgtgttggaatccagcatagagtcaccaaggatgacgccatgaagtggttccagggcaagtatgaaggtgtcatccttaacaagtctcagaatattcaaactgcttagatttggtgaagtgtagtaaaccagattgaggttttagaaagttaatgcattttgtagaccaaacctactgatgagttcaaaattttggatatttgctatgttattgaatcagggatatatttactgttttaatttttcttggaaatgaatttctgctattatatctcagtattatactattatatgttttgtcggagacatattcgtaattgtttatgtgcctcatatgagacagcaaaatgcattaaattctttgatttctctaaaaaaaaaaa

SEQ ID NO: 5254 - DNA, 816 bp, Fagopyrum esculentum
tagccgctccatatcaaatcgtagagcttcgttgctataatggcgactaccaaggacaagaagctgactaatcctatgcgagatatcaaggtacaaaagcttgttctcaacatttcagtcggtgagagcggagatcgtcttacacgtgcttccaaggttttggagcaactcagtggtcaaacccctgtgttctccaaagcaaggtacactgttaggtcattcggtattagacgtaatgagaagattgcttgctatgtgactgtgaggggtgaaaaggcaatgcaacttcttgagagcggtttgaaggtcaaggagtatgaactgttgaggcgtaacttcagtgataccggttgttttggatttggtatccaggaacacattgatcttggtatcaagtacgatccctcaaccggtatctatggtatggatttctatgttgtattggaacgcccaggataccgtgttgctcgtcgccgtcgatgcaagtcacgtgttgggattcagcacagggttactaaggatgatgccatgaaatggttccagatgaagtacgaaggagtcatcctcaacaagtcacaaaatatcacaggctaatacgctaacgttttgtcacaaacacttttgtgaacctagggggcttttgttttcactcgggtaaactttttggactgtcatgttacattgttagtgccgagttcgaatcagaattgttctttgttaatcgatctatctgctcgtcctaaatgttcctaattctaatttacatacagtgctactacaagttcaggatgaactataaaacgtaaattcaagtgt

SEQ ID NO: 5255 - DNA, 750 bp, Fagopyrum esculentum
ttgctataagatataatggcgaccaccaaggacaagaagctgaccaatcctatgcgagatatcaaggtacaaaagcttgttctcaacatttcagtcggtgagagcggagatcgtcttactcgtgcttccaaggtcttggagcaactcagtggtcaatcccctgtgttctccaaagcaaggtacactgttaggtcattcggtattagacgtaatgagaaaattgcttgctatgtaactgtgaggggtgacaaggcaatgcaactacttgagagcggtttgaaggtcaaggagtatgaactgttgaggcgtaacttcagtgataccggttgttttggatttggtatccaggaacacatcgatcttggtatcaagtacgatccatcaaccggtatctatggtatggatttctacgttgtattggaacgcccaggataccgtgtagctcgtcgccgtcgttgcaagtcacgtgtcgggattcagcacagggttactaaggatgatgccatgaaatggttccagatgaagtacgaaggagttatcctcaacaagtcacaaaatatcacaggctaatacgtgattgttttgtttagtacacaaacacttttgtgaacctagggcttgtcttttgttttcactcgggtaaactttttggactgtcatgttacattattagtgctgagttcgaatcaaaattgttctttgttaatcgatctatctgatcgccctaaatacagaggtactacaagttaa

SEQ ID NO: 5256 - DNA, 880 bp, Adiantum capillus-veneris
caaaaccctagaactcttcttcgtgccatggtgctgcgaggctacgatctgtagcacagtggtggatgtgattgcgtgggccttctgcttataccccctctcttggtagctgaggcttcgtcatctgcattgaagcgtcccccccttgctgcaatggccgtgtccgagaagaaagctgcgaaccccatgcgggagatcaaggtgcagaagcttgtgctgaacatatcagttggcgagagtggcgatcgtttgacaagagctgccaaggttcttgagcagctaagcgggcaaactccagtgttttcaaaggctcgctacacggtgagatcttttggaatcagaaggaatgagaagattgcttgctatgttactgttcgaggagctaaggccatgcaactactggagagtggcttgaaggtgaaagagtacgagcttatcagaaggaatttcagtgacacgggatgttttggctttggcattcaagagcacatcgatttgggtatcaagtacgacccatccactggtatttatggcatggatttttatgtggtgcttgagcgagctggttacagagttggtaggagaaagagggccaaggctcgtgttggcatccagcacagggtaacgaaggaagatgcaatgaagtggttccaagtgaaatatgagggagtcattttgaacagatctcaagctattacaaactagctcagtgaagtgcaattgtagctccaaatatccgaagattgttagtgctgagtggcgtttgtgtgcatgaaggcttttgcatgtaatggtctcagggcttcaggcttttttgaaggcttgaattttttttaaagcctggtaataccaattttaagtgcgaatactttttgggctt

SEQ ID NO: 5257 - DNA, 849 bp, Adiantum capillus-veneris
taagactttaagtagccagctgcgttcgagggcttcctttcgcagcagcgcatcagcgagatcggagggggcttcttctcgtcgcacctatggccgtgtcagagaagaaggctgccaaccccatgcgggagatcaaagtgcagaagcttgtgctgaacatatcagtcggtgagagtggtgatcgtctcacaagggctgctaaggttcttgagcaactaagtgggcaaactccagtcttttccaaggctcgctacactgtgaggtcgtttggaatcaggaggaacgaaaagattgcctgttatgtaactgttcggggatctaaggccatgcaactccttgagagtggcttgaaggtgaaagagtatgagctcatcagaagaaatttcagtgacactggctgttttggtttcggcattcaagagcacattgatctgggtatcaaatatgacccatctactggtatttatggcatggatttctatgtggtgcttgagcgtgctggctacagagtcggtaggagaaagagggccaaggcacgtgttggcatccagcaccgggtgactaaggaagatgcgatgaagtggtttcaagtgaagtatgaaggagtcattttgaaccgatctcaagccatcacaaattaatctttgtagggtggtaaatcaaactttagtatctaatgtcccatgatctcaaatctgggaagctttatgagggttgtggctattacatcatatatcggtctcaggacttgcggctttgatggcctgaaaattttcagagcctgaaatacttatgtaaacgagttacttttggaaggaaattttgtgtggtggttttttaggtctgctg

SEQ ID NO: 5258 - DNA, 586 bp, Brassica juncea
ggcagttttgttctcccgcaactctcttttagctcaactcgaaatggcgtcagagaagaagctctcgaacccccatgagggacattaaggtccagaagcttgttctcaacatctccgttggtgaaagtggtgatcgtctcacccgtgcctcaaaggtttttggacagctcagtggacaaacccctgttttctcaaaggcgaggtacactgtgaggtcttttggtattaggcgtaacgaaaagattgcttgctacgtcactgttagaggtgacaaggcgatgcagcttcttgagagtggcttgaaagttaaggagtatgagcttcttaggaggaactttagtgacactggttgctttggattcggtatccaagagcacatcgatcttggaatcaagtatgatccatctactggtatctacggaatggacttctatgttgttcttgaacgtccaggataccgtgtggcacgtcgccgcaggtgcaaggctcgtgtcggtatccaacacagagtgactaaggatgatgcaatgaaatggttccaagtcaagtatgaaggagttatcctcaacaagtctcagaacatcac

SEQ ID NO: 5259 - DNA, 526 bp, Cirsium arvense
gtcctcctccgcaaaccgcaatggcttcagagaggaagcaagcgaatccaatgagggagattaaggttcagaagctcgttctcaacatctccgtcggagaatccggtgatcgtcttactcgtgctgccaaggttttggagcaactcagtggacagtctcctgtcttttccaaggcaaggtacactgtgaggtcgttcgggattaggcgtaatgaaaagattgcatgctatgtcactgttaggggagacaaggcaatgcagcttttggagagtggtttgaaggtcaaggaatacgagcttttgaggcgtaacttcagtgataccggatgctttggtttcggtattcaggagcacatcgatcttggtatcaagtatgatccatccaccggtatctatggtatggacttctttgtggttctagaacgcccaggataccgtgttggtcgccgccgtaggtgcaaggcccgtgttggtatccaacatagagtgacaaaggatgacgcaatgaaatggttccaggtcaagta

SEQ ID NO: 5260 - DNA, 580 bp, Nicotiana benthamiana
caggcttcagagaagaagttgagcaacccaatgagggaaatcaaggttcagaagttagtccttaacatctctgttggtgaaagcggagataggctcaccagagcagccaaggtcttggagcaactcagcggccaatcccctgttttctctaaggctaggtatactgtgcggtccttcggaatttgccgtaatgagaagattgcttgctatgtcactgtcagaggagacaaagctatgcagctccttgagagtggattgaaagtcaaggaatacgagttgttgagaagaaacttcagtgagactggctgctttggttttggcattcaggagcacattgatcttggaatcaagtatgacccttcaaccggtatctatggtatggatttctatgttgtgctcgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgattgtggatcagtttgtcccccagcaagtt

SEQ ID NO: 5261 - DNA, 793 bp, Avena sativa
ccttttaaccccgcgccgccaccctgcccatcctctctcgacgccagtaccaccaccccccgccccccctccccgcccgccgtcgccgaagccgaagaatctgccgccatgtcgacggagaagaagcgggcgaaccccatgcgggagatcaaggtgcagaagctcgtcctcaactgctccgtcggggagagcggcgacaggctcacccgcgccgccaaggtgctcgagcagctcagcggacagtcaccggtgttctccaaggcgaggtacacggtgcgttcgttcggcatccggcgtaacgagaagatcgcgtgctacgtgacggtcaggggcgagaaggccatgcagctgctcgagagcgggctcaaggtcaaggagtacgagctgctcaggaggaacttcagtgaaaccggatgctttggcttcggtatccaggagcacatcgatcttggcatgaagtacgatccctcaacaggtatctacgggatggacttctacgtcgtcctcgagcgtgctggctaccgtgtgtcccgtcgccgcaggtgcaaggcccgcatcgggatccaccagagggtgaccaaggaggatgccatgaagtggttccaggtcaagtatgagggagtcatcctcaacaagtcccacacggcttagaaatcccacctctatgcgcagcagctgttagaacctatctcttatcgtcgcgaacagaagttcaccttgcaaattgactgttcactcggatgaattctctagccagatgttttgtttgcctactacctgggatctaaaggcc

SEQ ID NO: 5262 - DNA, 503 bp, Heritiera littoralis
gttcagaaacttgtactcaacatatcggtcggtgagagcggtgatcgcctaacccgtgccgccaaggtgttggaacaactcagtggtcaaacccctgtcttctccaaggcgaggtacactgtcagatccttcggaatcaggcgtaatgagaagatcgcttgctatgtaacagtgagaggggagaaggctatgcagcttctcgagagcggtttgaaggttaaggagtatgagcttttgaggaggaacttcagtgatactggctgctttggattcggtatccaggagcacattgatcttggcatcaagtatgacccttcaaccgggatctatggtatggacttttatgtagttttggagcgagctgggtaccgtgtgggtcgtcgccgcaggtgcaagtcccgcgttggcatttaacacagagttactaaggaagacgccatgaagtggtttcaggttaagtatgaaggcgtcatccttaacaaatctcagaacattggagctta

SEQ ID NO: 5263 - DNA, 743 bp, Lolium multiflorum
cgccggcggcctccccggtcagatcaccatgtcgacggagaagaagcagttgaaccccatgcgggacatcaaggtccagaagctcgtcctcaacatctccgtcggcgagagcggagatcgtctcacccgcgcctccaaggtgctggagcagctgagtggacagtcaccggtgttctccaaggcgaggtacactgtgaggtctttcggcatccggcgtaatgagaagattgcgtgctacgtgaccatcaggggcgagaaggcgatgcagctgctggatagtggcctcaaggtgaaggagtacgagctgctcaggaggaacttcagtgacactggctgctttgggtttggtatccaggagcacattgatcttggcatgaagtatgacccatccactggtatctatggtatggacttcttcgtcgttctggagcgtgctgggtaccgtgtttcacgccgccgcaggtgcaaggcccgcattggcatccaccagagggtcaccaaggaggacgcaatgaagtggttccaggtcaagtatgagggtattatcctcaacaagtcccatgcgggctaagagaagaacgcagcttttgttagaccctgagttaattaagttggcctggttgctggatatgtatgttccttagaaaccaaatgctttgtcagtttttgcctgtactgaagttggatgattttggttgatgacccgcactctcgtctaagtaagaggctcacttatgctttat

SEQ ID NO: 5264 - DNA, 730 bp, Festuca arundinacea
ggccgaggcctcgtgccctcgcgtctgccgccgccgcccccaagatccggccgccatgtcgacggagaagaagctggcgaaccccatgcgggacatcaaggtgcagaagctcgtcctcaacatctccgtcggcgagagcggagatcgtctcacccgcgcctccaaggtgctggagcagctgagcggacagtcaccggtgttctccaaggcgaggtacactgtgaggtcttttggtatccggcgtaatgagaagattgcgtgctatgtgacgatcaggggcgagaaggcgatgcagctgctggatagtggcctgaaggtgaaggagtatgagctgctcaggaggaacttcagtgacaccggatgctttgggttcggtatccaggagcacattgatcttggcatgaagtatgacccatccactggtatctatggtatggacttctacgtcgttctggagcgtgctgggtaccgtgtttcacgccgccgcaggtgcaaggcccgcattggcatccaccagagggtcaccaaggaggacgcaatgaagtggttccaggtcaagtatgagggtattatcctcaacaagtcccatgcgagctaagagaagaacgcagctttcgttagaccccgagttaattaagttggcctggttgctggatatgtatgttccgtagaaaccaaatgctttcagtttttgcctgtactgaagttggatgattttggttgatgatcc

SEQ ID NO: 5265 - DNA, 591 bp, Flaveria ramosissima
gaagctggttctcaacatctccgtcggtgaaagtggtgatcgtctcactcgcgctgccaaggttttggagcaacttagtgggcaatcaccagtgttttccaaggcaaggtacaccgtgagatcgtttggcattaggcgtaacgaaaagatagcatgctatgtcactgttaggggagacaaggcaatgcagcttttggaaagtggcttgaaggttaaggaatatgagcttttgagacgcaacttcagtgacactgggtgctttggctttggtattcaggagcacattgatcttggtatcaagtatgatccttctactggtatctatggtatggacttctttgtggttctagaacgcccaggctatcgtgtgggccgcagacgtaggtgcaaggcccgtgttggtatccagcatagagttactaaggaggatgcaatgaagtggttccaggtgaagtatgaaggagttatcctcaacaaatctcagcagattggagcatagaagactcgcatcaagttttcttttggcggttaacagatcccagttttcttattacatcaatttttgtgtttcagtctcttgcatttcgacta

SEQ ID NO: 5266 - DNA, 671 bp, Selaginella moellendorffii
cgccctaatctttggaggcgctgcgccatggcggacaagcagaatcccatgcgggagatcaaggtgcagaagctcgtcctcaacatctccgtcggcgagagcggcgatcggctgacaagagccgccaaggtcctggagcagctcagcggacagcagccagtgttctccaaggcgagattcactgtccgctcgtttggcatccggcgaaacgagaagatcgcgtgctacgtgacggtgaggggcgacaaggcgatgcagctcctggagagcggcctcaaggtcaaggaatacgagctgctgcgccggaacttcagcgacaccggctgctttggatttggcatccaggagcacatcgatctcggcatcaagtatgatccatccactgggatttacgggatggatttcttcgtggtgctcgagcggcctggataccgcgtcgcgaggaggaggcgatgcaaatccaaggtcggacacaagcagcgggtgaccaaggaggacgccatgaagtggttccagctcaagtacgagggtgtgatccttaacaagtcccaggcaatctgagatcatcgtgatggactttcttttttgttctatcaaaagctttagggttcttggagctcgggtttacgctgaatatataaaagcgtgttaaccacgtggatttaggtttt

SEQ ID NO: 5267 - DNA, 663 bp, Lolium multiflorum
gtacgcctgcaggtacccgggaaattcggccattacggccggggacgctctaaaccctcctccctccccactcgcgccgccgccgccccgcgccagatccggccgccatgtcgacggagaagaagcagttgaaccccatgcgggacatcaaggtccagaagctcgtcctcaacatctccgtcggcgagagcggagatcgtctcacccgcgcctccaaggtgctggagcagctgagcggacagtcaccggtgttctccaaggcgaggtacaccgtgaggtctttcggcatccggcgtaatgagaagattgcgtgctacgtgaccatcaggggcgagaaggcgatgcagctgctggatagtggcctcaaggtgaaggagtacgagctgctcaggaggaacttcagcgacaccggatgctttgggttcggtatccaggagcacattgatcttggcatgaagtatgacccatccactggtatctatggtatggacttcttcgtcgttctggagcgttctgggtaccgcgtgtcacgccgccgcaggtgcaaggcccgcattggcatccaccagagggtcaccaaggagacgccatgaagtggttccaggtcaagtatgagggtattatcctcaacaagtcccatgcgagctaagagaagaacgcagc

SEQ ID NO: 5268 - DNA, 750 bp, Nicotiana benthamiana
ttttgctggaaagctccccagaccgaatcgaaatggcttcagagaagaagttgagcaacccaatgagggaaatcaaggttcagaagctagtccttaacatctctgttggtgaaagcggagataggctcaccagagcagccaaggtcttggagcaactcagtggccaatcccctgttttctctaagtctaggtatattgtgcggtccttcggaatttgccgtaatgagaagattgcttgctatgtcactatcagaggagacaaagctatgcggctccttgagagtggattgaaagtcaaggaatacgagttgttgagaagaaacttctgtgagactggatgctttggttttggcattcaggagcacattgatcttggaatcaagtatgactcttcaaccggtatctatggtatggatttctatgttgtgctccagcgcccaggataccgtgttgctcgtcgtaggaggtgcaatgcccgagttgaaatttagcacagggtcacaaaggatgacgctatgaagtggttccaagtcaaatatgaaggtgttatccctaacaaatcctcaaacattcagtaagttgatatccactttggatcagtttttcccttggcgagtttatgttttttatgcattttgtagaccaacatttaatactcctagagttcaaaggttttgaagagttgctgttatttggcatatcaggatattatagtttgtttacatttttgctatctgatgaatttaaatt

SEQ ID NO: 5269 - DNA, 830 bp, Vitis vinifera
gtcctgtggctcctcaactcaatcctatctcccaatggcttcggagaggaaactggcgaacccaatgagggacatcaaagtccagaagctcgtcctcaacatctccgtcggtgaaagcggcgatcgcctcaccagggctgctaaggttttggaacagttgagtggccaaagtcctgtgttctcaaaggcaagatatactgtccggtcctttgcgatcaggcgtaatgagaagattgcttgctatgtcactgtcaggggtgaaaaggcaatgcagcttcttgagagtgggttgaaggttaaggaatatgagctcttgaggaggaactttagtgatactggttgctttggttttggtattcaagagcacattgatcttggaatcaagtatgacccttcaactggtatctatggcatggacttctatgttgttttagaacgcccagggtatcgtgtaggtcgtcgccgaagatgcaaggcccgtgttggaccccaccacagagttactaaggatgatgcaatgaagtggttccaggtcaaatatgagggagtgatccttaataaggcccaaaacattgtaggttcatagagagatcctttacatccatgcgtatgtgtgttgcttctttttattggtgtctgcaggataagatgggatttatgagttggtaggactagaaaataccacttgtggtggttttcagttttttttattattaatttttgtggttttaattctagttgcttttaatatgctggtttgtggcatttgataccgttattttgctttacacagctgtgcccataagttatcttaatgttctgtaatgttg

SEQ ID NO: 5270 - DNA, 661 bp, Selaginella moellendorffii
gtctcgccctaatctttggaggcgctgcgccatggcggacaagcagaatcccatgcgggagatcaaggtgcagaagctcgtcctcaacatctccgtcggcgagagcggcgatcggctgacaagagccgccaaggtcctggagcagctcagcggacagcagccagtgttctccaaggcgagattcactgtccgctcgttcggcatccggcgaaacgagaagatcgcgtgctacgtgacggtgaggggcgacaaggcgatgcagctcctggagagcggcctcaaggtcaaggaatacgagctgctgcgccggaacttcagcgacaccggctgctttggatttggcatccaggagcacatcgatctcggcatcaagtatgatccatccactgggatttacgggatggatttcttcgtggtgctcgagcggcctggataccgcgtcgcgaggaggagacgatgcaaatccaaggtcggacacaagcagcgggtgaccaaggaggacgccatgaagtggttccagctcaagtacgagggtgtgatccttaacaagtcccaggcaatctgagatcatcgtgatggactttcttttttgttctatcaaaagctttagggttcttggagctcgggtttacgctgaatatataaaagcgtgttaaccact

SEQ ID NO: 5271 - DNA, 532 bp, Panax ginseng
tgcagctgccaactttaccacccgggaaatcgccatggcttcagagaaaaaactattgaacccgatgagagagatcaaggtccagaaactcgtactcaacatttctgtgggggagagtggagatcgactcactagagcctctaaggtcctggaacaactcagtagtcagacccctgttttctccaaagcaaggtatactgtgaggtcttttgggatcaggcgtaatgagaagattgcctgctacgtcacagtgaggggagacaaggcaatgcagcttctggagagcgggttgaaggtgaaggaatacgaattgctgaggaggaacttcagtgatactggctgctttggtttcggtatccaggagcacattgatcttggaattaagtatgacccttcaactggcatttatggtatggtatttctttgttgtacttgtaacgtcctggttaccgtgtgggacgtcgtcgtagatgcaaatctcgtgttggaatccagcacgagggtcacgaaaggaggatgcaatgaagtggtt

SEQ ID NO: 5272 - DNA, 767 bp, Brachypodium distachyon
ccctcccctcccccgccgtcgaccccccagatcccccgccgccatgtcgacggagaagaagcagctgaaccccatgcgggagatcaaggtgcaaaagctcgtcctcaacatctccgtcggcgagagcggagatcgcctcacccgcgcctccaaggtgctggagcagctgagtggacaatcacctgtgttctccaaggcgaggtacactgtgaggtcgttcggtatcaggcgtaatgagaagattgcgtgctacgttacagtcaggggtgagaaggcgatgcagctgctggagagtggcctgaaggtgaaggagtatgagcttctgaggaggaacttcagtgacaccgggtgctttgggtttggtatccaggagcacattgaccttggcatgaagtatgacccatctactggtatctatggtatggacttctacgttgttcttgagcgtgctggctaccgtgtttcccgccgccgcagatgcaaggcccgcgttgggatccaccagagggtcaccaaggaggacgccatgaagtggttccaggtcaaatacgagggtgtcatcctcaacaagtcccatgcgagctaagaagaacaccaagttgattaaactagtgttgatgctggatttgtatgtttcttagaaaccaaaatgctttgtcagttttgcctgtactgaagttggatattttcgggtggtctgcactttcgtctaaaatgctcacttatgttttatccttgcaagaatagagatatatgttgatatggga

SEQ ID NO: 5273 - DNA, 754 bp, Brachypodium distachyon
cgccgccgcagccacagcccagcaccagctaaaccctctcttctctgcgtacaggcgccatccctgttcagatcgccatgtcgaccgagaagaagcagttgaaccccatgcgggagatcaaggtgcaaaagctcgtactcaacatctccgtcggagagagcggcgatcgcctcacccgcgcctccaaggtgttggagcagcttagcgggcagtcgcctgttttctccaaggcgaggtacactgtgaggtctttcggcatccgtcgtaatgagaagattgcgtgctacgtaacggttaggggtgagaaggcgatgcagcttcttgagagcgggctgaaggtgaaggagtacgagctgctgaggaggaacttcagcgacaccggctgctttgggtttggtatccaggagcacattgatcttggcatgaagtatgacccgtcgactggtatttatggtatggatttctatgttgttctggagcgtgctggataccgtgtttctcgtcgccgcagatgcaaggcacgtgttgggatccaccaaagggtgaccaaggaagatgccatgaagtggttccaggtcaagtacgagggtgtcatcctgaacaagtcccacgcaagctagttatctttttgagtaaaccagttgccctttagaactccagtcaagtttcatctgtatccatggaatcatatgtttattgggtaccaaacgcactgtcaattttgcctctctttaaatttgtcctgcgcctatat

SEQ ID NO: 5274 - DNA, 800 bp, Brachypodium distachyon
gcgccgccaccctcctcatccccctctcgacgccagtctccctgccgccgccgccgaagaagccgaaggatatccgatcttctgccgccatgtcgacggagaagaagcagttgaaccccatgcgggagatcaaggtgcagaaactcgtcctcaacatctccgtcggcgagagcggcgacaggctcacccgtgcctccaaggtgctcgagcagctcagcgggcagtcgcctgtgttctccaaggcgaggtacaccgtgcgttcatttggcatccggcgtaacgagaagatcgcgtgttatgtgacggtgcgaggtgagaaggccatgcagctgctcgagagcgggctcaaggtgaaggagtacgagcttctcaggaggaacttcagcgacaccggctgctttggcttcggtatccaggaacacatcgatcttggcatgaagtatgatccctcaacaggtatttatgggatggacttctatgtcgtacttgagcgtgctggctaccgtgtgtcccgtcgccgcaggtgcaaggctcgtgtcgggatccatcagagggtgaccaaggaggatgccatgaagtggttccaggtcaagtatgaaggagtcatcctcaacaagtcccatgcgtcttaaaatcttttctctaggtgcagcggctgttagaacctttctcttgttgcacaatcagaagttcaccttgcaaattgaattatctggccagatgtttttgcctgttacttgaagctgaatgctgacctttttctcatttgtgtttgtccttccctacctggttgcctaaat

SEQ ID NO: 5275 - DNA, 1037 bp, Lolium multiflorum
ttaaccccgcgccgccaccctgcgcatcccctctcgacgccagaagctcaccaccatctccatccccgccgccgtcgccgaagccgaagaatctgccgccatgtcgacggagaagaagcgggcgaaccccatgcgggagatcaaggtgcagaagctcgtcctcaactgctccgtcggggagagcggcgacaggctcacccgcgcctccaaggtgctcgagcagctcagcgggcagtcgccggtgttctccaaggcgaggtacaccgtgcgttcgttcggcatcaggcgtaacgagaagatcgcgtgctacgtgacggtgcgtggcgagaaggccatgcagctgctcgagagcgggctcaaggtcaaggagtacgagctgctcaggaggaacttcagtgagaccggctgctttggattcggtatccaggagcacatcgaccttggcatgaagtacgatccctcaacaggtatctacggaatggacttctacgtcgtgcttgagcgtgctggctaccgtgtgtcccgccgccgcaggtgcaaggctcgcatcgggatccaccagagggtgaccaaggaggatgcaatgaggtggttccaggccaagtacgagggagtcatcctcaacaagtcgcacaacgcttgaaatctcatctctatctgttgcagcttttagaacctttatcctcttgtcgcgaacggaagttcaccttgcaaattgacgatgaattctgtagccagatattttgcctattacctacctggagctaaaggctgactttcattcctttctggtagtctagttaattggcccagctcgtaatttttgtcgccttttcattttgcatcagtttgttattttgttcgtgccgttctggattcctgtccttgttgaattttattgctacgacagtgttggtttgattaaacctcgaaggtggttcgtgaacacattggaagtttttcatttatcttgaaatgtatgttatgtttttttacattaataccatatatttatagtactcaaaaaaaaaaaaaaa

SEQ ID NO: 5276 - DNA, 755 bp, Festuca arundinacea
caccatctccttccccgccgccgtcgccgaagccgaagaatctgccgccatgtcgacggaaaagaagcgggcgaaccccatgcgggagatcaaggtgcagaagctcgtcctcaactgctccgtcggggagagcggcgacaggctcacccgcgcctccaaggtgctcgagcagctcagcgggcagtcgccggtgttctccaaggcgaggtacaccgtgcgttcgttcggcatcaggcgtaacgagaagatcgcgtgctacgtgacggtgcgtggcgagaaggccatgcagctgctcgagagcgggctcaaggtcaaggagtacgagctgctcaggaggaacttcagtgagaccggctgctttggattcggtatccaggagcacatcgaccttggcatgaagtacgatccctcaacaggtatctacggaatggacttctacgtcgtgctcgagcgtgctggctaccgtgtgtcccgccgccgcaggtgcaaggctcgcatcgggatccaccagagggtgaccaaggaggatgccatgaggtggttccaggccaagtacgagggagtcatcctcaacaagtcccattcggcttgaaatctcaccgctatacgccagcagctgttagatctttcttctcctgtcgcgaacagaagatcaactctcaaattgtgacgttctctcgatgaattctatagccagatgttttgtttgcccattacctggagcgaaaggccgactttcagtcatttctggtagc

SEQ ID NO: 5277 - DNA, 586 bp, Fragaria vesca
ttttgcgggtaaacaaaatgcaggcttcaaagaagaagttagcgaacccaatgagggaaatgaaggtctagaagctcatcctcaacatctccgtcggcgagagtggtgatcaactcaccagagttgctaaggtgttggagcaactcagtggccaaaccctagttttctccaaagcaaggtacactgtttggagctttggcatcaggcataatgagaagattgcctgctatgtcactgtcaggggtgaaaaggccatgcaacttctggagagtgggttgaaagtcaaggaatacaagttgctgcgaaagaactttagtgacaccgattgctttggctttggtatctaggagcacatcgatctgagaatcaagtacgatccttctactagtatttacagaatggatttctatgttgttttggagcgaccgagttatcgtgtgggtcgccgccgtagatgcaagtctcgtgttgggatccagcacagggtcacaaaggaggattccatgaagtggttccaagtcaaatatgagggagtaataatccttaacaaatctcagcaaatctcttaggccattaggatcgcaga

SEQ ID NO: 5278 - DNA, 530 bp, Lippia dulcis
ccgacgattatccaatggcttcagagagaaattgtcgaacccgatgagggagatcaaggtgcagaagctggtgctcaacatctcagtcggagagagcggagatcgtctcacgagagctgctaaggtgctggagcaactcagcggtcaatctcctggtttctccaaggcaagatacactgttcgatcattcgggattaggaggaatgaaaaaattgcttgctatgtaaccgtgagaggtgacaaggcaatgcaactccttgagagtggcttgaaggtcaaggagtatgaactgttgaggaggaacttcagtgaaaccggatgcttcggtttcggtatccaggagcacattgatcttggaattaagtatgatccatctactggtatttacggtatggacttctacgtcgtattggaacgccctggttaccgtgtggggcgtcgccgtaggtgcaaggcccgcgtcggaatccaacaccgtgtcaccaaggaggacgccatgaagtggttccaggtaaaatatgaaggtgtga

SEQ ID NO: 5279 - DNA, 762 bp, Podocarpus macrophillus
gcttgcagcaccataggaggagagatccaaacacaacagagccggcaaggtacttcggttcagtaagattcagcccgttgatcaatcatgacatcccagatgagcaaaaagagagaggtttcggataaagataaaaatccaatgaaggaaattaaagtacagaagcttgttcttaacatctctgttggtgagagtggggatcgattaactcgagcttcaaaggtgttggagcaattgtctggtcagactccagttttttcaaaggcaagatatactgtgaggtcctttggaatcaggcgaaatgaaaaaattgcttgctatgtaactgtgagaggggaaaaagctatgcaacttttggaaagtggattgaaggtgaaggagtacgagttgctccgaagaaacttcagtgatactgggtgttttggatttggaatacaagagcatattgatttggggattaagtacgatccttccactggcatatatggtatggacttctatgttgttctagagcgtgcaggttacagaatctctaggaggaagagatgcaagtctcgtgttggcattaagcacagagtaaccaaagatgacgcaatgaagtggtttcaaaacaaatatgagggtgtcatcctaaataagtcacagtccaatacataattttgagggtgtaatttctttttagttatctggactctggtatattctttatttacacacctaactctagaacctcattttgttgtaggaaatagttttttaatc

SEQ ID NO: 5280 - DNA, 778 bp, Pseudoroegneria spicata
  misc_feature (716)..(716): n is a, c, g, or t
  misc_feature (748)..(750): n is a, c, g, or t
ctggccatgtttgaagtcattacccttaaccgtaaggagaagaagcagctgaaccccatgcgggacatcaaggtgcagaagctcgtcctcaacatctccgtcggcgagagcggagatcgcctcacccgcgcctccaaggtgctggagcagctgagcggacaggcaccggtgttctccaaggcgaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggatgctttggctttggtatccaggagcacatcgatctcggcatgaagtacgacccatctactggaatctacggtatggacttcttcgtggtcctcgagcgcgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggacgtagctctcgttagaccttgagttaattaagttcacctggttgctggatatgtatgttacctagaaaccaaatcctatgtcagttttgcctgtactgaagttggatgatttctgtttgatcagcactttcgtctaaggntcacttctgtttcttctgttttattatcatcnnncaacaatagagatgtcatatatgtttgg

SEQ ID NO: 5281 - DNA, 741 bp, Secale cereale
cgttagaaccccatgcgggagatcaaggcgcagaagctcgtccttaatatctccgtcggcgagagcggcgatcgcctcactcgcgctgccaaggtgttggagcagctcagcgggcagtcgccagttttctccaaggcgagatacactgttaggtcttttggcattcgtcgtaatgagaagatcgcctgctacgtgacgatcaggggcgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaactggcatctacggtatggacttctttgtcgtactggagcgagctggataccgtgtctcccgccggcgccgatgcaaggcacgtgtggggatcgacaaggtgacagagatgccatgaagtggttccaggtcaagtatgagggtgtcatcctcaacaagtcccacgccagctagtaaccttccgagtgattgagttgtcgttagagcttaagtcagtcaagcgtaatcaggatcatggaatcatatgtttattggatacaaagttgcactatcaattttacctcaactgttgagcttaagtcgagcgtaatcaggatcatgtaataacaaaaaaaacaaaaaaaaataaaatactatgtgtaacactactatatatacagaacaacaacgaacgacg

SEQ ID NO: 5282 - DNA, 602 bp, Papaver somniferum
cgaaccccatggaagggaaatctaaagttcagaagcttcgtcctcaacatctccgtcggtagaaagcggagatcgtctgaccagagctgcgaaggtcttggaacagctaagtggtcaatcacctgttttttccaaagcaaggtacaccgttaggtcttttggaatcaggcgtaacgaaaagattgcttgtcacgttactgtgagggtgagaaggcgatgcagcttttagagagtggattgaaggttaaggaatacgagcttttgaggaaaaacttcagtgagactggttgctttggattcggtatccaggagcacattgatcttggaattaagtatgatccttccaccggtatttatggtatggacttctacgtggtcttggaacgccctggatatcgtgttggtcgtcgtcgtaggtgcaaggccaaggttggtattcagcacagagttaagaaggatgatgcaatgaagtggttccaggttaagtacgagggtgtcattctcaacaagtcccaaaatatcactggttaattgttgacttttatcagattcaagttttgtgatagctcaggtgacttattgtgttctgtagtctagtaaac

SEQ ID NO: 5283 - DNA, 595 bp, Festuca arundinacea
gatgcgggagatcaaggtgcagaagctcgtgctcaacatctccgtcggcgagagcggtgatcgcctcactcgcgcctccaaggtgttggagcagctgagcgggcagtcgccagttttctcaaaggcgagatacactgtgaggtcttttggcatccgtcgtaatgagaagatcgcttgctacgtgacgatcaggggtgagaaggcaatgcagcttctcgaaagtgggctgaaggtgaaggagtacgagctgctcaggaggaacttcagtgacactggctgctttgggtttggtatccaggagcacattgatcttggcatgaagtatgacccgtcaactggtatttatggtatggatttctttgttgttctggagcgtgctggataccgtgtttcccgccggcgccgatgcaaggcccgcattggtatccaccaaagggtgaccaaggaagatgccatgaagtggttccaggtcaagtacgagggtgtcatcctcaacaaatcccacacgggctaggaaccttttgagcgaagaagttgtcctttagagatccagtcagtcgattgtcatcaggatcatggaatcatatgtttattg

SEQ ID NO: 5284 - DNA, 1338 bp, Eragrostis curvula
  misc_feature (96)..(96): n is a, c, g, or t
  misc_feature (111)..(111): n is a, c, g, or t
  misc_feature (117)..(117): n is a, c, g, or t
  misc_feature (125)..(125): n is a, c, g, or t
  misc_feature (129)..(129): n is a, c, g, or t
  misc_feature (148)..(148): n is a, c, g, or t
  misc_feature (150)..(150): n is a, c, g, or t
  misc_feature (191)..(191): n is a, c, g, or t
ttcccccttctccttcctcccttctccgccgccgtctctgctctcccgatccgccatggccattaagaagaagcaggcgaacccgaggcgggagancaaggggcagaagcncgggcncaacatcnccgncggagagagcggagatcgncncacgcgtgccgccaaggggttggagcagctgagtggccagnccccagttttctccaaggctaggtacactgtgaggtcctttggtatccgtcgtaatgagaagatcgcgtgctacgtcacagtcaggggagagaaggcgatgcagcttctcgagagtgggctgaaggtgaaggagtacgagttgctgaggagaaacttcagcgagactggatgttttgggttcggtatccaggagcacattgatcttggcatcaaatatgacccatcaactggtatttatggtatggacttctatgttgttcttgagcgtgctggataccgcgttgctcgccggcgcaggtgcaaggcccgtgtgggcatccagcacagggtgaccaaggaagatgccatgaagtggttccaggttaagtacgagggtgtcatcctcaacaaggcccaaggaaacacctcgtaatcatctagaagagtgaactgtagctcttttgaactcctgttaagtttactccgttccatgggattgtatgtttgttgggtaccatgtgtactgtcagttttgccactggagttgacctgcgtctataatttccatcttaatctcagacaagaacttattcaaaaaaaaaaaaaaaaaagaaaaaaaaaaaaagtactctgccgttgatacccgcggcttaatcaaattccccgcggtccgccatgggtggcggggtatcaatggaaagtcgggcccctttccccccttattaggggtccgtatttacattttacttggggccgtttgttttaaaacgttggggatctgggaaaacccctggaggtaaccataaataaaatccacgtggaaccgattccgcccattttgcccggtgcgggcgaaaaaagagagaaaaggtcccggcactaattcgccctttcaacagctatgtggccatctggtggaagagggagatgaggaaagctcacggcacggggctaaatataaaccggcggggggcggtgaggataatattagatgaaaacggggaacgtattataatttatgttgttcccgctgagcgcggccgccgtattgtggtatatgtttttttggtatgtttttttgatggaactatagatctgaggagcggtatctgcacccatgcgaaaagtgcttgagagaacacggagaggggagcgcgcacgcggtga

SEQ ID NO: 5285 - DNA, 748 bp, Festuca arundinacea
catgcgggacatcaaggtccagaagctcgtcctcaacatctccgtcggcgagagcggagatcgtctcacccgcgcctccaaggtgctggagcagctgagcggacagtcaccggtgttctccaaggcgaggtacactgtgaggtcttttggtatccggcgtaatgagaagattgcgtgctatgtgacgatcaggggcgagaaggcgatgcagctgctggatagtggcctgaaggtgaaggagtacgagctgctcaggaggaacttcagtgacaccggatgctttgggttcggtatccaggagcacattgatcttggcatgaagtatgacccatccactggtatctatggtatggacttctacgtcgttctggagcgtgctgggtaccgtgtttcacgccgccgcaggtgcaaggcccgcattggcatccaccagagggtcaccaaggaggacgccatgaagtggttccaggtcaagtatgagggtgtcatcctcaacaagtcccatgcgagctaagagaagaacgcagctcttgttagaccctgagttaattaagttcacccggttgctggatatgtatgtttcgtagaaaccaaatgctttgtcagtttttgcctgtactgaagttggatgattttggttgatccgcactttatctaagtaagaggttcacttctgttttatcctatcgacaatagatatatgtttggcatatgagataacttactgttgtggtacaaaaaaaaaaaa

SEQ ID NO: 5286 - DNA, 937 bp, Lolium multiflorum
aagcgggcgaaccccatgcgggacatcaaggtgcagaagctcgtcctcaactgctccgtcggggagagcggcgacaggctcacccgcgcctccaaggtgctggagcagctgagtggacagtcaccggtgttctccaaggcgaggtacaccgtgcgttcgttcggcatcaggcgtaacgagaagatcgcgtgctacgtgacggtgcgtggcgagaaggccatgcagctgctcgagagcgggctcaaggtcaaggagtacgagctgctcaggaggaacttcagtgacaccggatgctttgggtttggtatccaggagcacattgatcttggcatgaagtatgacccatccactggtatctatggtatggacttctacgtcgttctggagcgtgctgggtaccgtgtttcacgccgccgcaggtgcaaggcccgcattggcatccaccagagggtcaccaaggaggatgcaatgaagtggttccaggtcaagtatgagggtattatcctcaacaagtcccatgcgggctaagagaagaacgcagctttcgttagaccctgagttaattaagttggcctggttgctggatatgtatgttccttagaaaaccaaatgctttgtcagtttttgcctgtactgaagttggatgattttggttgatgacctgcactctcgtctaagtaagaggctcacttatgctttatgctctttggacaatagatatatgtttggcatatgagataacctgctttgtttggtcactcataagtcttctaaattactgctatcacgggttacaaattgttggaactgttgttcttattaatcagatatcatccgtatgcccatttctgcagttggaacagttttgagaattgacgattgtagggaaattcctgaagagtttaacataaaacattgattttattgttatcgtagc

SEQ ID NO: 5287 - DNA, 672 bp, Primula obconica
tctctgtcggagagagtggcgatcgcctcacacgcgccgctaaggttttggagcagctcagtggccaaaccccagtattctccaaggctaggtacactgttaggtcattcggtattaggcgtaatgagaagatcgcttgttacgtaactgtgagaggtgacaaagcaatgcaacttcttgagagtggcctgaaagtgaaggagtatgagctgctgagacgcaacttcagtgacactggctgctttgggtttggtattcaggagcacattgatctcggcatcaagtatgacccctcaaccggtatttatggtatggacttttatgtggtgcttgagcgcccaggttaccgtgtgggccgtcgtcgtaggtgcaaagcacgtgttgggatccaacacagagtcactaaggaagattccatgaagtggttccaagtcaagtacgaaggtgtgatcctcaacaaagctcagacaatcggttgaataatccaccaccgtccttttgaatattattgtgctttttgagatttaatagcataagagatatttgcttttcttgtagaaccaggataatcgtattttgcagttttgaaggtttggaaactagatttggttatctacttttcatgtttgaacttctaccatcttttctaatattatgccggcgttgttgttt

SEQ ID NO: 5288 - DNA, 633 bp, Eschscholzia californica
tcaatatctctgtcggtgaaagcggagatcgtctcaccagagccgccaaggtcttggaacaattgagtggtcaaagccctgtattttctaaagctaggtacaccgttaggtcctttggaatcaggcgtaacgaaaagattgcttgctatgttactgttaggggtgaaaaagcaatgcaacttcttgagagtggtttgaaggttaaggaatatgagcttttgaggaggaacttcagtgatactggttgtttcggtttcggaattcaggagcacattgatcttggaattaagtatgatccatcaactggtatctatggtatggacttctacgtggtattagaacgtccaggataccgtgttggtcgtcgccgtaggtgcaagtcaagagttggtattcaacacagggtgacaaaggatgatgcaatgaagtggttccaggtcaaatatgaaggagtcattctcaacaagtctcaaaatatcactggttaattgtagacttgtaactattttaccttttttgaaactcacatctgactatttaatcgtttgtagtaggcaagtaaactaccttttctatcttgttgagaatttgagttgtagtattagttatgcttcgtggtttaatagtaaattt

SEQ ID NO: 5289 - DNA, 683 bp, Cyamopsis tetragonoloba
cagaagctggtcctaacgtgtccgtcggtgagagtggtgatcgtctcaccagagctgccaaggtgctggagcaacttagtggccaatccgcagtgttttccaaagcacggtacactgttcgatcctttgggattagacgtaatgagaagattgcatgctatgtgactgttagaggtgacaaggcaatgcaacttttggagagtggtttgaaggtcaaggagtatgaacttctcagaaggaacttcagtgatttggctttggtatccaggagcatattgatttgggaatcaagtatgatccttcaactggcatttatggaatggacttctatgttgttctggagcgcccaggttatcgtgtgggacgtcgccgtaggtgcaagtcccgtgtggggattcagcacagggtcacaaaggaggatgctatgaagtggttccaggtgaaatatgagggagtgatccttaacaaggcccaaacagtagttggttaggttgacttcactttaggagtgtatcactattaccagttttgttgagagtatcttattcaggcagattttgaatcagtgttaattatgagttctgttgttttgttttttgatgaagaatatggattaacaatagccctgttaaatgtctcttaaagcaaagaactattgaaccaccgttaattcaaggcaacaa

SEQ ID NO: 5290 - DNA, 789 bp, Bruguiera gymnorhiza
gacgctgtgcttctcttttcactctcacaaccttcactgggcagccgccgcgaactccatcgtcctcccaatccaatggcatcggagaggaagctatcgaacccgatgagggaaatcaaggtccaaaagctcgttctcaacatctccgtcggcgaaagcggcgatcgtctcaccagagctgctaaggtccttgaacagctcagtggccaaacgcccgttttctccaaagcaaggtacactgttcggtcatttggtataaggcgtaatgagaagattgcatgctatgtcactgtcagaggtgaaaaagcaatgcagctactggagagtggattgaaggtgaaggaatacgaattgctgaggaggaatttcagtgatactggctgctttggtttcggtattcaggagcatattgatctgggtatcaagtatgatccatctactggaatctatgggatggacttctatgttgttctggaacgcccaggttatcgggtgggtcgtcgccgcagttgtaagagtctggttggaatcaaacacagggtccctaaggaggatgctatgaaggggttcccagttctaattaggagggccggaacccttaaacaagtcccagtgcggggcccttataaaagattctgaaaaaaagaaaggattttgccttttccaggggtgattctgttagacaaacaaccccttgtttcatcccttggtttcctgggaaaattttcctggttaaatggcggccaaaaatcccctttcttttcgatgttgtcaaaattttgttgccca

SEQ ID NO: 5291 - DNA, 827 bp, Papaver somniferum
gttgcttgcttgtctgtgatattcggcacagacattagtgatggagtcggagaagaagcatacgaatcctatgagggatattaaagttcaaaaacttgttctaaacatatctgttggtgaaagtggtgatcgtctcaccagagctgctaaggtggtggagcagttgactggacaagcccctgtgttttccaaggctaagaacactgtaaggtcgtttgggattaggcgtaatgaaaagactgcttgtcatgtaactgtaagaggtgacaaggctacggaacttcttgagagggggattgaaagttagggaatatgagcttttgagaaggaatttcagtgatactggttgttttggattcggtgttcaagaacatatcgatcttggattgaaatacgacccttccacccggtatctatggtttggatttctacgcagttctggagcgcccagggtaccgtgttagtcgtcgccgcagatgcaaggctagagttggaattgaacacagagtttcaaaggaggatgcaatgaagtggttccaggctaaatatgagggtgtaattcttaacaagtctcagtaaacactgcatagtaaagagctatcagatattcaacccgcattcctgaacctgttctttagattcgtttacagattagaaaattataatcgtattatagactcatacagactcatacggtgtctagaattattatttgtattttttgtcaatagacaactattacaactacttaggaattttttggatataggacaaacaactacctagaggctagagtagttttcgaagagtgctacgtctcatctaac

SEQ ID NO: 5292 - DNA, 1227 bp, Sorghum bicolor
cttttaatcccccgccgccgcctccctcgcaccctgccgccacccatccatctcactccacctgacgccggcgcacagggccctgccgccgtcgccgcgttatccatggcgtcggagaagaagcagtccaacccgatgagggagatcaaggtgcagaagctggtgctcaacatctccgtcggagagagtggggatcgcctcacccgcgccgctaagcatatcagtaagtccatggtttgcttccatgcttgcaggtcctggaggggccaatcaccagtgttctctaaggctaggtacactgtccgttccttcggtatcaggcgtaatgagaagattgtctgctatgttactgtaaggggtgagaaggcaatgcagcttctggagagtgggctgaaggtcaaggaatatgaactgctaaggaggaactttagtgagacagggtgctttggttttggaatccaggagcacattgatcttggcatcaagtatgatccttcaaccggtatctacggaatggacttctacgtcgtccttgagcgcgctgggtaccgtgttgcccgacgctgcaggtgcaagtcccgtgttggaatccagcacatagtgaccaaggaggatgctatgaagtggttccaggtcaagtatgagggtgtcatcctcaacaaggctcaggctaacacttcttagaaacactgttataaagctcagcccttaggcatgataccgatcgcagcagagtttcacctctactcaagttttcgatctcggacgacattatttaccaagactcaagtgcttgaattagttttggatcgaggagcttatggtctctattatactttgaaagctgaatcatggatatgcgcagttttatttggtttcgcaatgtgcttcgtttgacctactttcctctagtggcccatgtatacagagaaggatgtcttttttttgtcccctgttttgaccctacagctgtagtcatggtgcattcggtagtccaatggttgtctgatttgttttgcatttgtagtctgaactcaaaaggacgacgtcaccaacacgtcgacatgcgagaagcatttggaccgagcaaagagttagccgattggcttctgctcgttgatgtgcgtaacacacttaaaagtcataagagacactagctgttgacagcgttgtacaaacagtacctgtcatttcaaacacgatctgcactatccgacgatctcgagc

SEQ ID NO: 5293 - DNA, 599 bp, Panax ginseng
ggggcatattgaattcccagtctgtgggccccattttcccaccccttgcagctgccaactttaccacccgggaaatcgccatggcttcagagaaaaaactattgaacccgatgagagagatcaaggtccagaaactcgtactcaacatttctgtgggggagagtggagatcgactcactagagcctctaaggtcctggaacaactcagtagtcagacccctgttttctccaaagcaaggtatactgtgaggtcttttgggatcaggcgtaatgagaagattgcctgctacgtcacagtgaggggagacaaggcaatgcagcttctggagagcgggttgaaggtgaaggaatacgaattgctgaggaggaacttcagtgatactggctgctttggtttcggtatccaggagcacattgatcttggaattaagtatgacccttcaactggcatttatggtatggatttctttgttgtacttgaacgtcctggttaccgtgtgggacgtcgtcgtagatgcaaatctcgtgttggaatccagcacgagggtcacgaaggaggatgacaatgaagtggtaccaagtcaaatacgagggcgtga

SEQ ID NO: 5294 - DNA, 513 bp, Utricularia gibba
gacgcgattcgttgagccgcgccatgggttcggagaagaaattgtcgaatccaatgagagatatcaaggtgcagaagcttgttctcaacatttccgtcggcgaaagtggagatcgtctcaccagagctgctaaggttttggagcaacttagcgggcaaacacctgttttctccaaggcaagatacactgttagatctttcgggattaggagaaacgaaaaattgcttgttatgtccaccgttagaggtgagaaggccatgcaacttattgagagtggattgaaagtcaaggagtatgaattgctaagacggaatttcagtgaaaccggatgctttggttttggcattcaggagcacatcgatctgggaattaagtatgacccttcgactggcatctatggtatggacttctatgttgtcctggaacgccctggttaccgtgtaggtcgacgcaggagatgcaagtctcgtgtcgggatccagcacagggtaaccaaggaggatgccatgaagt

SEQ ID NO: 5295 - DNA, 871 bp, Arachis hypogaea
tgatagagcggtatcaacgcagagtacgggagacattttagttgtcttgccgcgctgaccgcatttcacttccttccacaaagcgccatggcatcggagaagaagcttgcgaaccctatgagggaaatcaaagtgcagaagcttgtcctcaacatctccgtcggcgagagcggcgatcgtctcaccagagcttccaaggtcttggaacagctcagcggccaaacccctgtcttctccaaggctaggtacactgtgcgttcatttggaataaggcgtaatgaaaagattgcttgctatgtcaccgttaggggagacaaggccatgcaacttcttgagagtgggttgaaggtcaaggagtatgagctgcttaggaggaatttcagcgatactggctgctcatactcctaagcagctcatactccttgaccttcaacccactctcaagaagtatgagctgcttaggaggaatttcagcgatactggctgctttggttttggaatccaggagcacattgatctcgggatcaagtatgatccttctactgggatctacggcatggatttctttgtcgtcttagagcgtgctggataccgtgtgggtaggcggaggagacgaaagtcccgcgttggaattcaacacagggtcaccaaagaagatgcaatgaagtggtttcaagttaagtacgaaggagttattcttaacaagtcccaacaaattgtatcctagacagcactattttagtttttttttttttggactggtagtcagcaacatgcaactattttatttggttttcttcaagttttgatgggatttttcccatttttacgaagcaagatatttgtttcattttgagttcaatacaatgcc

SEQ ID NO: 5296 - DNA, 750 bp, Brassica napus
tctccgtcggtgagagtggagatcgtctcaccagagcctccaaggtcctggaacagttgagtggccagactcctgttttctccaaagcgagatacactgttcgttctttcggtatcagacgtaacgagaagattgcttgctacgtcaccgtcaggggagacaaggctatgcaactccttgaaagtggactcaaggttaaagagtatgagctcttgagaaggaactttagcgacactggttgcttcggttttggtattcaggagcacattgatttgggtatcaagtatgacccgtcgactggaatctacggtatggacttctatgttgttcttgagcgtcctggttaccgtgtggcgcgtcgcagaagatgcaaggctcgtgttggaatccagcacagagtcaccaaagatgatgccatgaaatggttccaagtgaagtacgaaggagtcatcctcaacaagtctcagaacattactggttgaaaccatctgtctcgaacagagatctataaactgtgtttttgtttgtcccctccgtttcgaatcgtgttttgttttgcctttatgttctctatacatttgaatatcattattgcctctatctacaatgctttcatggctctccagagtttttgattatgaagacaaaaatcatttaaaccggattagagttcggtttaacacatataactacgtgaaaacgcgtttttactttgcttacattatttatcttaacgaatctttgactatg

SEQ ID NO: 5297 - DNA, 804 bp, Panax ginseng
tttttcccctaccttgcagagttgcagttgcagttgcagtgcagttgcgaacttcaccaccggcgaatggccatggcttcagagagaaaattagcgaacccgatgagggagattaaggttcaaaaactcgtccttaatatttctgttggagagagtggagatcgactcactagagcctctaagcaaggtatactgtgaggtcttttgcgatcaggcgtaatgagaagattgcctgctatgtcacagtgagaggtgacaaggcaatgcaacttctagatagcgggttgaatgtgaaggaatgtgaattgtataggaagaacttcagtgattctggctgttttggctttggtatcccggagcacattgatcttggaattaagtatgatccttccactggcatttacggtatggatttctatgttgtgcttgaacgtccgggttgccgtgtgggacgccgccgtaaatgcaaatcacgtgttggaatccagcacagggttacaaaggaggatgcaatgaaatggttccaagtcaaatatgagggggtgattcttaacaagtcccagaatattgggaattagttgagtgatgcctgatctgttaggtttatgccttttggactagctgaggataaaaaatttagagcaatgttgtgaataattgcagactggcggtcatgtttgcatctagttagtcaaatttaacatattttttgagagaatttgaactttacaatgtttttggtcttaaatttttattttaccagtttaatttgttttgagtcaattttcctattacaatgtaaag

SEQ ID NO: 5298 - DNA, 695 bp, Petunia hybrida
ctcaatatctctgttggtgaaagcggagatcgactcaccagagccgccaaggtgttggagcaactcagtggccaatcccctgttttctctaaagctaggtatactgtgcggtcctttggaatcaggcgtaatgagaagatagcttgctatgtcacagtcagaggagagaaagctatgcagctccttgagagtggattgaaagtcaaggaatatgagttgttgcgaagaaacttcagtgaaactggctgctttggatttggtattcaggagcacattgatcttggaattaaatatgacccttcaactggtatctatggtatggatttctatgttgtgctagagcgcccaggataccgtgttgctcgtcgtcgcaggtgcaagtctcgagttgggattcaccagagggtcacaaaggatgacgcaatgaagtggttccaggtcaaatatgaaggcgttatccttaacaaatcctcaaacattcagtagttgaaatccacttttcatcagttcgtctcccagcaactttatttttttctgcatttcgtagacctatatttaatattacctagagttgaaaagttttggagagttgatgttatttggcagggatatgtcaatttgttttcattgtcgctatcatatgaattcttgtcactatttccttcttcctttgactggtgagtcactatgttgca

SEQ ID NO: 5299 - DNA, 587 bp, Cirsium arvense
aacatttctgttggtagaaagtggagatcgtctcactcgtgctgctaaggttttggagcaactcagcggccaatctccagttttctccaaggcaagatacactgtgaggtcattcggtatcaggcgtaatgaaaagatcgcatgctatgtcactgttagaggagacaaggctatgcagctcttggagagtggtttgaaggtgaaggaatacgagttgttgaggcgcaatttcagtgacactggatgctttggctttggtattcaggagcacatcgatcttggtatcaagtatgacccttctaccggtatctacggtatggatttctttgtcgttttggaacgtcccggttaccgtgttggacgtcgccgtaggtgcaaggctcgtgttgggatccaacacagagtgactaaggacgatgccatgaagtggtttcaagtgaagtacgagggtgtcatcctcaacaaatctcaacaaatcggaggctaagtatgtgggtttgtttttgtaaaattttggagttgagttaaaaggtttttacttaccatcaaggattatgagatcatattgttttgttgtgttttggacc

SEQ ID NO: 5300 - DNA, 641 bp, Zingiber officinale
  misc_feature (631)..(631): n is a, c, g, or t
tcagaagctcgtcctcatatttccgttggcgagagtggcgatcgtctgaccagagctgccaaggttctcgagcaacttagtggacaaataccagttttctctaaagcaaggtacactgtccggtcctttggaatccggcgcaatgagaagattgcatgctatgtcacagttagaggtgacaaggcaatgcaacttttggaaagtggtctgaaagtgaaggaatatgagttgttgagaagaaacttcagtgatactgggtgctttggttttggcatacaagagcacattgatctcggaattaagtacgacccttccacaggtatttatggcatggacttctatgtcatcttagagcgccccggctatcgtgtgagccgtcgccgtcgctgcaaatcaagagttggcattcaccaacgtgtcaccaaggaggatgctatgaagtggttccaagttaagtatgaaggagtcatcctcaacaaagcccagggaactagttaattaggattcgacacaactgaacctagctactagttctagagctgaattaagctcatctatccactttttccccaaagtagtttttttttggtaaaccgctcttatttgtgtttgtgcccccaaccaagatctntgcctcgtgc

SEQ ID NO: 5301 - DNA, 964 bp, Mesostigma viride
tgctctatcaggcaccaccatagtccggagcacctggcagccatggtgtccgagaagaagaaggcaaaccccatgcgggagatcagggtccagaagctggtcctgaacatttctgtgggagaaagcggagatcgtctcacgcgcgcggcgaaggtgcttgagcagctgtcgggacagcagcctgtgttctccaaggcccgctacacggtgcgtacctttggcatccgccgtggtgagaagatctcttgccacgtgacgctgcggggggagaaggcgatgcagctgatcgagtcgggcctcaaggtgaaggagtacgagctgctgcgtcagaacttcagcgataccggctgcttcggcttcggtatccaggagcacatcgacctggggatcaagtacgacccctccacgggtatttacggaatggacttcttcgttgtgctggagcggccagggttccgtgtcgcccgccggcggagggcgactggccacgtgggcctgcagcacaagatcaccaaggaggacgtgatcaagtggttccaggccaagtacgagggcatcgtgctcaacaagcccaactaaattctttttttctgttcttgtccgcgcgggaaacgtcgcacgccatccagccagtcctgcctgagccggtgtcggtggcaccgtgcgatgccacctggccagtgaggggactgtaccgaacagggcgcgcactgatcatagggtcaaaagtgaagctggtttctccaggcttgcagggcagaccgccaagaataatatggctaggatcgctgcggttggttggggccggcctgatcctgggtgccacgtgccttgctggagcgaaacgtggggagacagccgcgcctgtggggagcgagcaactgtaactagtgcataatttaataactagtattgatgttgaaatgacaaaggagatttgtccagcaagcagcactggcacttg

SEQ ID NO: 5302 - DNA, 551 bp, Picea glauca
tttcagcaggcgtgttcgggtttgaggcagaggcggttgcagaaagagcagtcggcgggaaccagcgaaggagaaatggcagcggagaagaaactgaacaaccccatgcgggatattaaggtgcagaagttagtgctcaacatatcagtcggtgagagtggtgatcgactcactcgagcttctaaggtgttggagcagcttagtggccagactccggttttttcgaaggcaaggtatactgtgaggtcctttggaattaggcgaaatgaaaagattgcctgctatgttactgttagaggagaaaaggctcttcaacttttggagagtgggctgaaagtgaaagaatacgagttactcagaaggaacttcagtgatacaggttgctttggttttggaattcaggagcacattgatccgggaatcaagtatgatccttctactggtatttacggtatggacttctttgtagtcctagagcgccctggatacagaatcggcaggagaaagagagctcagtcccgtgttggcattcagcacagggttaccaagga

SEQ ID NO: 5303 - DNA, 680 bp, Ambrosia trifida
atcctcctccgccgtcatccaccgtaacatcaatggcatcagaaaggaagcaagggaatccaatgagggaattaaggttcagaaattggttctcaacatctccgtcggtgaaagtggtgatcgtctcactcgtgctgctaaggttttggagcaacttagtggccagtctcctgtgttttccaaagcaaggtacacggtgagatcttttggcatcaggcgtaacgaaaagattgcatgctatgttaccgttaggggagacaaggcaatgcagctcttggagagtggcttgaaagtcaaggaatacgagcttttgagacgcaacttcagtgacactggttgctttggttttggtattcaggaacacattgatcttggtatcaagtatgacccgtcaacgggtatctatggtatggacttctttgtggttctagagaggccagggtaccgtgtgggccgcagacgtaggtgcaaggcccgtgtcggtatccagcatagagttacaaaggaggatgcaatgaagtggttccaggtgaagtatgaaggagttatcctcaacaaatcccaaacaaatcggagcatagaaacaaacttatatttactgtaagtttcgctcggcgataactccaattttttgcttctgtctcttatttttacagtaatcgactaatcgggttgtatca

SEQ ID NO: 5304 - DNA, 700 bp, Lippia dulcis
ggagaaagtggagatcgtctcaccagagctgctaaggtgttggagcaactcagcggccaatctcctgtattctcaaaggcaagatacactgtgcgttcctttgggatcagacgtaatgaaaaaattgcttgctatgtcacggtccgaggtgacaaggcaatgcaactacttgagagtggcttgaaggtcaaggaatatgagctgttgaggcggaattttagtgagactggctgttttggcttcggtattcaggagcacattgatcttggaattaagtatgacccttcaactggtatttacggtatggacttctatgttgttttggagcgccctggttaccgtgttggccgtcgccgtagatgcaagtctcgtgttggcattcagcatagagtcaccaaggaggatgcgatgaaatggttccaagtgaaatatgaaggtgttatcttgaacaaggcatccaatattggagcctagattgggagcagtatctgatctaatgaactattatgtcggtttcttgttatttttatctttttgcttgaagttttgtagaatttcagctatagacaagttgattttaaatctatatttcgtgttacattggattggatttatttgcaatttcaatagtacatttgattggatttatttgcaatttcaaccccttggcgacggcagatgtcccaatctttaaaaagaa

SEQ ID NO: 5305 - DNA, 567 bp, Festuca arundinacea
  misc_feature (42)..(42): n is a, c, g, or t
  misc_feature (61)..(61): n is a, c, g, or t
  misc_feature (78)..(78): n is a, c, g, or t
  misc_feature (201)..(201): n is a, c, g, or t
  misc_feature (231)..(231): n is a, c, g, or t
  misc_feature (288)..(288): n is a, c, g, or t
  misc_feature (297)..(297): n is a, c, g, or t
  misc_feature (318)..(318): n is a, c, g, or t
  misc_feature (366)..(366): n is a, c, g, or t
  misc_feature (381)..(381): n is a, c, g, or t
  misc_feature (408)..(408): n is a, c, g, or t
  misc_feature (441)..(441): n is a, c, g, or t
  misc_feature (498)..(498): n is a, c, g, or t
  misc_feature (554)..(554): n is a, c, g, or t
ggcacgaggcctcgtgccaccatctccttccccgccgccgtngccgaagccgaagaatctnccgccatgtcgacgganaagaagcgggcgaaccccatgcgggagatcaaggtgcagaagctcgtcctcaactgctccgtcggggagagcggcgacaggctcacccgcgcctccaaggtgctcgagcagctcagcgggcantcgccggtgttctccaaggcgaggtacacngtgcgttcgttcggcatcaggcgtaacgagaagatcgcgtgctacgtgacggtgcgnggcgagaangccatgcagctgctcgagagngggctcaaggtcaaggagtacgagctgctcaggaggaacttcagcganaccggctgctttggnttcggtatccaggagcacatcgacctnggcatgaagtacgatccctcaacaggtatctanggaatggacttctacgtcgtgctcgagcgtgctggctaccgtgtgtcccgccgccgnaggtgcaaggctcgcatcgggatccaccagagggtgaccaaggaggatgccatgangtggttccaggcc

SEQ ID NO: 5306 - DNA, 967 bp, Mesostigma viride
caaaccccatgcgggagatcaggtccagaagctggtcctgaacatttctgtgggagagagcggagatcgtctcacgcgcgcggcgaaggtgcttgagcagctgtcgggacagcagcctgtgttctccaaggcccgctacacggtgcgtacctttggcatccgccgtggtgagaagatctcttgccacgtgacgctgcggggggagaaggcgatgcagctgatcgagtcgggcctcaaggtgaaggagtacgagctgctgcggcagaacttcagcgataccggctgcttcggcttcggtatccaggagcacatcgacctggggatcaagtacgacccctccacgggtatctacggcatggacttctacgtcgtgctggagcggccagggttccgtgtcgcccgccggcggagggcgaccagccacgtgggcctgcagcacaagatcaccaaggaggacgtgatcaagtggttccaggccaagtacgagggcatcgtgctcaacaagcccaactaaattcttttttttctgttcttttctgcgcgggaaacgtcgcacgccagccagccagtcctgcctgagccggtgtcggtggcactgtgcgatgccacctggccagtgaggggactgtaccaaacaaggcgcacacttgatcatagggtcgaaagggaagctggtctctccaagcttgcagggcagaccgccaagaataatatggctaggatcgctgcggttgggtgggaccggcctgatcctgggtgccaaacgtgccttgctggagcgaaacgtggggagacagccgcgcctgtggggagcgagcaactgtaactagtgcataatttaataactagtattgatgttgaaatgacgaagaagctttgtccagcaagcaactccggcacttgcattgcatgttcatagcatgtatacatgtatactctcatgaagtgagaagtgtcccattgaatt

SEQ ID NO: 5307 - DNA, 469 bp, Thalictrum flavum
gtcgagcggcgatcgtcatggcatcggagaagaagctttcgaatccaatgagagatatcaaagtgcagaaactcgtcctcaacatctccgttggagaaagcggcgatcgtctcaccagagctgccaaggttttggaacagctgagtgggcaaagtccagtcttttcaaaagctagatacactgttcgatcttttggtattcgacgtaatgaaaagatagcttgctatgtcactgtcaggggtgacaaagccatgcaacttttggagagtgggttgaaggtgaaggaatatgagctgttaaggaggaacttcagtgatactggatgttttggatttggtattcaggagcacattgaccttgggatcaagtacgatccttcaactggaatttatggcatggacttttttgcgtttttggagcgtcctggttatcgggttgggcgccgccgccgctgcaagtctagagttgg

SEQ ID NO: 5308 - DNA, 781 bp, Glycine max
tcggaccctatataaaccccaccgccaatctcttccttcttcgtctgttctgcgttcacctttgctcagtttcgtagtaaaatcaaagttccgcttccctccgcagagactggacgatctcgcgagccatgaatgctagacgagacaatcgtaacaatagagtttccctttttgatggtattgaggagggtggcatcagagcatcatctgtttactcctcttctcatgaaattgatgaacatgataatgagcaggcattggatggattgcaagatagagtcaatctgctgaaaagattatcaggtgatataaatgaggaggtggatagccataaccgcatgctggatcgaatggggaatgatatggattcatcaagaggggtcctttcgggcactatggacaaatttaaaatggtattcgagaccaaatccaaccagagaatgttcacgcttgtagcatcctttgttgtgctctttcttataatatactacctcactaggtaatttgatctttcattcaactgccagctttatgttaggtccaagaggacgctatttcctctattactgtaattaatgctactacctctggctctgtaagataactgttctgtataaaggtttgatgttttaaacaggtattgaatccaacgagtaatgtccatatccgatttgcggtatattttccctttcctgttgatttaggatactcctgtttaaccatatggaaaatgaaaaggaaagtgtatttgacgtttaacattttcatctagattttatcg

SEQ ID NO: 5309 - DNA, 900 bp, Glycine max
attttatgtttgttggaggcgtgatattaaacacgcgtcaagcagtgtcggaccctatataaaccccaccgccaatctcttccttcttcgtctgttctgcgttcacctttgctcagtttcgtagtaaaatcaaagttccgcttccctccgcagagactggacgatctcgcgagccatgaatgctagacgagacaatcgtaacaatagagtttccctttttgatggtattgaggagggtggcatcagagcatcatctgtttactcctcttctcatgaaattgatgaacatgataatgagcaggcattggatggattgcaagatagagtcaatctgctgaaaagattatcaggtgatataaatgaggaggtggatagccataaccgcatgctggatcgaatggggaatgatatggattcatcaagaggggtcctttcgggcactatggacaaatttaaaatggtattcgagaccaaatccaaccagagaatgttcacgcttgtagcatcctttgttgtgctctttcttataatatactacctcactaggtaatttgatctttcattcaactgccagctttatgttaggtccaagaggacgctatttcctctattactgtaattaatgctactacctctggctctgtaagataactgttctgtataaaggtttgatgttttaaacaggtattgaatccaacgagtaatgtccatatccgatttgcggtatattttccctttcctgttgatttaggatactcctgtttaaccatatggaaaatgaaaaggaaagtgtatttgacgtttaacattttcatctagattttatcgttgtctaatttatttatttataaccaactcaactaagtatagccttttatttttaaattgtgcttcgtcccc

SEQ ID NO: 5310 - DNA, 685 bp, Glycine max
ctacttctcttttttacactaagtttttatttcaacagaggaaacgcgattgagaatttgcgaaacggtgttggaatttgtgatctggtgagccatgaatgctagaagagatggtcgcaacaacagagttgctctttttgatggtattgaggagggtggcatcagagcatcgtctctttattcctcaagttcttcccatgaaattgatgaacatgataatgaacaagcattggatggattgcaagatagagtcaatctgcttaaaagattgtcaggtgatataaatgaggaagtggatagtcataaccggatgctggatcgtatgggaaatgatatggattcttcgagaggagtcctctcaggcactatggataaattcaaaatggtatttgagacaaaatccagccgaagaatgttttcacttgtagcatcctttgttgtgctttttcttataatatactatctgactaggtaattgatctttctacgcacttgtcagcgttacttgtaagattttcctttatgtttgtataaagactttgctgtttcatttaatccaacgagtaatgtccatatccagtttgtacaccccaaaaacaaaatccaggttgtttatattttctctttgatttagattatgtatgcttcatctattctgtagaagattcgtactcctcatcctaat

SEQ ID NO: 5311 - DNA, 805 bp, Glycine max
acactcgtatcgtatataaacctctgcttcactcttctccttctacttctcttttttacactaagtttttatttcaacagaggaaacgcgattgagaatttgcgaaacggtgttggaatttgtgatctggtgagccatgaatgctagaagagatggtcgcaacaacagagttgctctttttgatggtattgaggagggtggcatcagagcatcgtctctttattcctcaagttcttcccatgaaattgatgaacatgataatgaacaagcattggatggattgcaagatagagtcaatctgcttaaaagattgtcaggtgatataaatgaggaagtggatagtcataaccggatgctggatcgtatgggaaatgatatggattcttcgagaggagtcctctcaggcactatggataaattcaaaatggtatttgagacaaaatccagccgaagaatgttttcacttgtagcatcctttgttgtgctttttcttataatatactatctgactaggtaattgatctttctacgcacttgtcagcgttacttgtaagattttcctttatgtttgtataaagactttgctgtttcatttaatccaacgagtaatgtccatatccagtttgtacaccccaaaaacaaaatccaggttgtttatattttctctttgatttagattatgtatgcttcatctattctgtagaagattcgtactcctcatcctaatagccatttcgaatgaactgattaaacgaactcataaccattaaatcattagttgatatttttcatttttaataaattt

SEQ ID NO: 5312 - DNA, 1042 bp, Glycine max
caacacatacacggttactactaatagcgtgcgtggataacatgagtctaaggattggccctgcacattactaccttttaaagtcttttaactcaaaggtaattacagtgttacactcgtgaagctcgtatcgtatataaacctccgattcactctcttctccttctacctctctttttctgcttttcactgagtttttttttttttattatttatttcaacagaggaaacgcgatctagaacttgccaaacggtgttggaatttgtgatctggtgaatcatgaatgctaggagagatggtcgtaacaacagagttgctctttttgatggtattgaggagggtggcatcagagcatcgtctctttactcctcaacttcttcccatgaaattgatgaacatgataatgaacaagcattggatggattgcaagatagagttaatctgctgaaaagattgtcaggtgatataaatgaggaagtggatagtcataaccggatgctggatcgtatgggaaacgatatggattcttcgagaggagtcctctcaggcactatggataaattcaaaatggtatttgagacaaaatccagccgaagaatgttttcacttgtagcatcctttgtcgtgctttttcttataatatactatctgactaggtaattggtctttcacgcacttgtcagctttatgttagatcgaaaaggaggctactcgcactattcctgtaattagcgttacttgtaagattttccttatgtttgtataaagactttgctgtttcgtttaatccaacgagtaatgtccatatccagtttgtacaagaaaataaaaaccagtttgtgcatattttcactttggtttagattatgtatatgcttcatctattctctagaagattcgtactctatttatcaagaaaaatattttgatcattgttgaggaaagaggatctagtaatgctatcgttctaatcctgaatttatttggttatggttagtctcatcctaatagacgtgtagaccacttcgaatgaattaaaac

SEQ ID NO: 5313 - DNA, 962 bp, Glycine max
caacacatacacggttactactaatagcgtgcgtggataacatgagtctaaggattggccctgcacattactaccttttaaagtcttttaactcaaaggaaaacagtgttacactcgtgaagctcgtatcgtatataaacctccgattcactctcttctccttctacctctctttttctgcttttcactgagtttttttttttttattatttatttcaacagaggaaacgcgatctagaacttgccaaacggtgttggaatttgtgatctggtgaatcatgaatgctaggagagatggtcgtaacaacagagttgctctttttgatggtattgaggagggtggcatcagagcatcgtctctttactcctcaacttcttcccatgaaattgatgaacatgataatgaacaagcattggatggattgcaagatagagttaatctgctgaaaagattgtcaggtgatataaatgaggaagtggatagtcataaccggatgctggatcgtatgggaaacgatatggattcttcgagaggagtcctctcaggcactatggataaattcaaaatggtatttgagacaaaatccagccgaagaatgttttcacttgtagcatcctttgtcgtgctttttcttataatatactatctgactaggtaattggtctttcacgcacttgtcagctttatgttagatcgaaaaggaggctactcgcactattcctgtaattagcgttacttgtaagattttccttatgtttgtataaagactttgctgtttcgtttaatccaacgagtaatgtccatatccagtttgtacaagaaaataaaaaccagtttgtgcatattttcactttggtttagattatgtatatgcttcatctattctctagaagattcgtactctatttatcaagaaaaatattttgatcattgttgaggaaagaggatctagtaatgctat

SEQ ID NO: 5314 - DNA, 641 bp, Vigna unguiculata
ccacgcgtccgcaccaagtttttgtttgaagacacagagcaaacggattgggagaacttgcaaaacggttttaggaatttgtgatctggtgaggcatgaatgctagaagagatggccgtaataacagagttgcactttttgatggtattgaggagggtggcatcagagcatcgtctctttactcaacttcctcccatgaaattgatgaacatgataatgaacaagcattggagggattgcaagatagagtcaatcttctgaaaagattgtcaggtgacataaatgaggaagtggatagtcataaccggatgttggatcgtatgggaaacgatatggattcttcgagaggggtcctctcgggcactatggataaattcaaaatggtatttgaaacaaaatccagccgaagaatgttttctcttgtagcatcctttgttgtgctttttcttataatatattatcttactaggtaattgatctttccctcagttgtcagctatatgttagatcggaaaggaagctatttgctctatttctctaattagctatactgcgtgtaacatgttcctttgtgtttgtataaagattttgacgtttcattttatccaactggtaatgtcaatatctagtttgtatacccc

SEQ ID NO: 5315 - DNA, 1610 bp, Cajanus cajan
atgacttgtgctggatggaagtatgttgtgaatttaatataataatcctaatcacctagcagagaaaattatgggaaatttttctgagggaattcattagaaacttccatatgacatttgatcatattgatctttagtctaaaatcagggatgattttggtgaactggtccttataggccagtggctctgctgtgcaacttggacaaggagaagtactatagtttttctcaagtctctcttcctaatttaagttatagtttatgtctctcttcttcagtttggtcttagttgttgatatatgcaatatgacatgcagtgtgctatagaaattcacctagcgtttttttcttgttataaatttatcaatctctttctgtactggtgaggtgtgcaactttatgattctgtacattgagaattacgccttagtttttgttttcaattaaccatttgataacttgctgcatatgttgcttcaataatctcctgtaaatttggatgcattcaaaccctagcagttaaatgattgcttgttttttgttttatgacgagtgtatgacatagtgaagctttggttgatcagtttttaatggctatttattcagtctctgtttatgatacttggaagagcttaaccttgatccactatcagcttgacagcacaaaacatttatacactatctctctgtttataaagactaagtcaaattctttgggcagtgtgagctatcatgactgtgtaaaagggcttaatataatagtaaaccaaattaaaatctatctggaaaatatggtgtttttatttataggccaagatatttgaaatgcttagagtccttagacatattttttcctttctatttatgttatttataaatcttgatattttatgcaatatggagatgtctcatatctgatgactctccgtttttttaaacagtttaactatgtcgaaaggaaatttatcttgtttgtgtttgtcatgtcacgtgaccatttggttgcttgtacttgtttttgttttagagacaaccgtaacaatagagtttccctttttgatggtatcgaggagggtggcatcagagcatcatctctttactcctcttcccacgaaattgatgaacacgataatgagcaggcattggatggattgcaagatagagtcagtctgctgaaaagattatcaggtgatataaatgaggaggtggatagccataaccgcatgctggatcgaatggggaatgatatggattcatcaagaggagtcctttcgggcaccatggacaaatttaaaatggtattcgagaccaaatccagccggagaatgtttacacttgtagcatcttttgtggtgctttttcttataatatactacctcactaggtaacttgatctttcattcaactatcagctttacgtttgatccgagaggaagctatttactctattactgtaattaatgctactgctacccctgtaagatattatgtatcaaggtttgatgtttcaaacaggtattgaattcaatccaacgagtaatgtccatatccgatttgcggtatatttactagtattatctttcacctactcaattgaatagaccttttgt

SEQ ID NO: 5316 - DNA, 654 bp, Arachis hypogaea
ggtatcaacgcagagtacggggggttgcgttcatccatctactcagctacacaccaagattggacgatcgagtactcgccgacgaatctgcgatctcgtgagccatgaatcctcgacgagacaatcggaacaacagagttgcgctttttgatggcattgaggaggggggcatcagagctcaatctctctactcttcttcccatgaaattgatgagcatgataatgagcaagcaatggatggattgcaagatagagtcaatctcctgaaaaggttatcaggcgatatacacgaggaggtggatagtcataatcgcatgctggatcgtatggggaatgatatggattcatcaaggggaatcctttcaggcactatggacaaatttaaaatggtattcgagacaaaatccagcaggagaatgtttacacttgtagcatcatttgttgtgctttttcttatagtgtattacctaactaggtaactgatatttcattcaattgtcaacttggttagacccgaaaggaggtaactcttatcactgtaattaatgctgcgccctgtaagatattctatcatgtataaagctttttaagtttaaacaggcaaaaaaaaagaaaaaaaacaaaagtactctgcgttgataccactgcttctga

SEQ ID NO: 5317 - DNA, 717 bp, Arachis hypogaea
ggggcggcaataatcctttataaaacaaacttctattgcttattcggttccttgttgcgttcatccatctactcagctacacaccaagattggacgatcgagtactcgccgacgaatctgcgatctcgtgagccatgaatcctcgacgagacaatcggaacaacagagttgcgctttttgatggcattgaggaggggggcatcagagctcaatctctctactcttcttcccatgaaattgatgagcatgataatgagcaagcaatggatggattgcaagatagagtcaatctcctgaaaaggttatcaggcgatatacaggaggaggtggatagtcataatcgcatgctggatcgtatggggaatgatatggattcatcaaggggaatcctttcaggcactatggacaaatttaaaatggtattcgagacaaaatccagccggagaatgtttacacttgtagcatcatttgttgtgctttttcttatagtgtattacctaactaggtaactgatatttcattcaattgtcaacttggttagacccgaaaggaggtaactcttatcactgtaattaatgctgcgccctgtaagatattctatcatgtataaagctttttaagtttaaacaggcattgaacccgattagttatgtacttatgtacatgccttaggggtgtacccattcaccttgatttaaatatacttcttcacgatat

SEQ ID NO: 5318 - DNA, 490 bp, Glycyrrhiza uralensis
gacgtctctttctctcggttctacatcaagttttaaacagagaagggaacacgatcgcgaaacggtagcagaatctgtgatctggtgagccatgaattctagaagagacaaccgtaatggcagagttgctctttttgatgggattgaggagggtggcatcagagcatcatctctttactcctcaacttcttcccatgaaattgatgagcatgataatgaacaagcaatggatggattgcaagatagagtcagtctgctgaaaagattgtcaggtgatatacatgaggaagtcgatagtcataaccgcatgctggaccatatgggcaatgatatggattcttcaagaggagtcctgtcaggaactatggacaaattcaaaatggtatttgagacaaaatccagccgaagaatgttttcgcttgtagcatcctttgttgtgatttttcttataatatactatctgactaggtaattggtctttcactcaact

SEQ ID NO: 5319 - DNA, 641 bp, Medicago truncatula
gcaccagcgcatcttatataaacaaacaaacctctttctatatttcttccaaagaacatttacttacatacagaacaacaggaatcacgatcgagtaaacagttgcagaatccgtgatctggtggtggtgagatatgatgaattctagaagagacacccgaaacaacagagttgctctttttgatggcattgaggagggtggaatcagagcatcatcaatgtattcctcaggttcttcccatgaaattgatgagcatgataatgaacaagcaatggatggattgcaagatagagttaatctgctgaaaagactgtcaggtgatatacatgaggaggtggataatcataaccgcatgctggatcatatgggcaatgatatggattcttcaaggggagtcctctcaggaactatggacaaattcaaaatggtatttgagacaaaatccagccgaagaatgttctcgctggtagcatcctttgttgtgatttttcttatcatttactatctaactaggtaattggtctttcattcaatcagcttgatgttgaatctgaaagaaggctacttgctctgttactgtaattaaatgtcagtacttgtaagatgttccgttatgtttgtataaagatttttacttttt

SEQ ID NO: 5320 - DNA, 592 bp, Medicago truncatula
agaacatttacttacatacagaacaacaggaatcacgatcgagtaaacagttgcagaatccgtgatctggtggtggtgagatatgatgaattctagaagagacacccgaaacaacagagttgctctttttgatggcattgaggagggtggaatcagagcatcatcaatgtattcctcaggttcttcccatgaaattgatgagcatgataatgaacaagcaatggatggattgcaagatagagttaatctgctgaaaagactgtcaggtgatatacatgaggaggtggataatcataaccgcatgctggatcatatgggcaatgatatggattcttcaaggggagtcctctcaggaactatggacaaattcaaaatggtatttgagacaaaatccagccgaagaatgttctcgctggtagcatcctttgttgtgatttttcttatcatttactatctaactaggtaattggtctttcattcaatcagcttgatgttgaatctgaaagaaggctacttgctctgttactgtaattaaatgtcagtacttgtaagatgttccgttatgtttgtataaagatttttactttttaat

SEQ ID NO: 5321 - DNA, 751 bp, Trigonella foenum-graecum
gtgggccctacccctgtatattactaccagcaaatactcttaacactaatcaccaataaccgtaagtaacaagaggaaagtgtaagtgtaaaactcgtgaagctcgcatgctatataaacaaacctctttctatctcttccactccaaaaacctttacttacacacagacacaacacaggaaacacgattgagtaattggttgcagaatctgtgatctggtggtggtcagatatgatgaattctagaagagacacccggaacaacagagttgctctttttgatggtattgaggagggtggaatcagagcatcatctatgtactcctcaggttcttcccatgaaattgatgagcatgagaatgaacaagcaatggatggattgcaagatagagttaatctgctgaaaagactgtcaggtgatatacatgaggaggtggatagtcataaccgcatgctggatcatatgggcaatgatatggattcttcaaggggagtcctctcaggaactatggacaaattcaaaatggtatttgagacaaaatccagccgaagaatgttctcgcttgtagcatcttttgttgtgatttttcttatcatttactatctaactaggtaattggtctttcattcaatcagcttgatgttggatctgaaaggaggctacttgctctgttactgtaattaatgtccgtacttgtatgatgttccgttatgtttgtataaagatttttacttttaattatatttttct

SEQ ID NO: 5322 - DNA, 899 bp, Cicer arietinum
cgtaagagcaagtgtagtgtaaaactcgtaaagctcgcatacatcctatatataaatctctgtttcactctcttctccttctacccctctctctatctatctgcttcactccaacctttatacatacaggaaacacgatcgagcgcttctgaaacggttgcagaatctgcgatccggtgagccatgatgaattctagaagagatactcgtaacaatagagttgctctttttgatggtattgaggagggtggcatcagagcatcatctctctactcctcagcttcttcccatgaaattgatgaacatgataatgaacaagcaatggatggattgcaagatcgagttagtctgctgaaaagattgtcaggtgatataaacgaggaggtggacaatcataaccgcatgttggatcgtatgggcgatgatatggattcttcaaggggaatcctctcaggaactatggacaagttcaaaatggtattcgagacaaaatccagccgaagaatgttctcgcttgtagcatcctttgttgtgatttttcttatcatatactatttaactaggtaattggtctttcattgaatcagcttgatgtttgatttgaaaggaggtcactcgctctgttactgtaattaatgtcactacttgaaagatgtttcgttatgtttgtataaagatttttactttttagtataatttttcatcccctttaagctatgtatacttccatactataatttggagagctttcatctgtactttgattgtgtcaatactcatttagtcaatgaatgataagaacccttggtgacagcgttgttcaattcgaaccatacagatttgggcctgaatttttattcgaatcataaataaactccggatacgctttctgaaatttc

SEQ ID NO: 5323 - DNA, 772 bp, Phaseolus vulgaris
gcgtttgtgatctggtgagccatgaatgctagaagagatggccgtaacaacagagttgcactttttgatggtattgagaagggtggcatcaaagcatcgtctctttactcaacttcttcccatgaaattggtgaacttgataatgaacaagcattggatggattgcaagatagagtcaatctgctgaaaagattgtcaggtgacataaatgaggaagtggatagtcataaccgaatgttggatcggatggcgaacgatatggattcttcgagaggaatcctctcaggcactatggataaattcaaaatggtatttgaaacaaaatccagccgaagaatgttttcacttgtagcatcctttgttgtggtttttcttataatatactatctgactaggtaatttatctttatcaggtaattgatctttatttgagttgtcagctcaagattagattggaaaggaggccacttgctctattcctctaattagcgatattgttgtaagatgttcctttgtgtttgtataaagattttgacgtttcattttatccaaccagtaatgtccatatctagtttgtataccttccaacaaataaccttttctctttgatgtgattcgagtatccaaaatatatgtgttgttaaagctatgcttagattctttgaaatttgttttgggcttagaattagcttctttgagcaaaattggtgccattggagcaaaattggtgccattggagtggatacaaatgtgttagaaatgttctataagg

SEQ ID NO: 5324 - DNA, 561 bp, Glycyrrhiza uralensis
gagcattcactcctgctctgtgcgttacctccacagagagagattggacgatctcgccagccatgaactctagacgagataaccgcaacaataaagttgctctttttgatggtattgaggagggtggcatcagagcatcatctctttactcctcttcccatgaaattgatgaacacgacaatgagctagcagtggatggattgcaagatagagtcaatcttctgaaaagattatcaggcgatatacatgaggaggtggacagccataaccgcatgttggatcatatggggaatgatatggatgcatcacgaggagtcctctcaggcactatggacaaatttaaaatggtatttgagacaaaatccagccggagaatgtttacgctcgtagcatcctttgttgtgctttttctaatagtgtactacctaactaggtaattgatcattcattcaactgtcaactttatgttaggtccgagaggaagctattttctctattactgtaattaatgctactacatgtaacatattgttatgtataaaggttttcagttttgatgtt

SEQ ID NO: 5325 - DNA, 720 bp, Gossypium raimondii
tctaatctcaattcctgattaggatatatcctttttcttcaacaatttgtcgggtgctaccttagccttagcagattttaaaattacccaaacaggtaaaacactttgtttttcacacttgttcgaagaagatttatagggctttggttatcccataattgaagaaacatgaatcctagacgggacatgcgtaacaacagagttgccctctttgatggcatcgaggagggcggcataagggccacttcttcttactcgcatgaaattgatgagcatgataatgaaagagcaatggaaggattgcaggatagagtcaatctgctgaagaggctttcaggcgacatacatgaggaggtggatagccacaatcgcatgcttgatcggatgggaaatgatatggattcatcaagaggaatactctcaggaaccatggacaagtttaagatggtattcgagaccaaatcaagcaggagaatgtttacacttgtggcatcttttgtggttattttccttgttatatactatcttactaggtaactagtctgtaatgtatgtgatgtgatacaactgcaagctttatatgagaatttggaagacccttattctagtacatcgtgttactgtgaacaatgcgcttcctacttgtatgatatcgtggcatgtttgtataaatatgttttgatgtatcaaacaaacaggcctttcttagcatgaactggt

SEQ ID NO: 5326 - DNA, 634 bp, Arachis hypogaea
agtggtatcaacgcagagtggggcttgttgcgttcatccatctactcagctacacaccaagattggacgatcgagtactcgccgacgaatctgcgatctcgtgagccatgaatcctcgacgagacaatcggaacaacagagttgcgctttttgatggcattgaggaggggggcatcagagctcaatctctctactcttcttcccatgaaattgatgagcatgataatgagcaagcaatggatggattgcaagatagagtcaatctcctgaaaagggaggaggtggatagtcataatcgcatgctggatcgtatggggaatgatatggattcatcaaggggaatcctttcaggcactatggacaaatttaaaatggtattcgagacaaaatccagccggagaatgtttacacttgtagcatcatttgttgtgctttttcttatagtgtattacctaactaggtaactgatatttcattcaattgtcaacttggttagacccgaaaggaggtaactcttatcactgtaattaatgctgcgccctgtaagatattctatcatgtataaagctttttaagtttaaacaggaaaaaaaaagaaaaaaaacaaaagtactctgcgttgataccactgctt

SEQ ID NO: 5327 - DNA, 589 bp, Arachis hypogaea
agtggtatcaacgcagagtacggggggtttgcgttcatccatctactcagctacacaccaagattggacgatcgagtactcgccgacgaatctgcgatctcgtgagccatgaatcctcgacgagacaatcggaacaacagagttgcgctttttgatggcattgaggaggggggcatcagagctcaatctctctactcttcttcccatgaaattgatgagcatgataatgagcaagcaatggatggattgcaagatagagtcaatctcctgaaaaggttatcaggcgatatacaggaggaggtggatagtcataatcgcatgctggatcgtatggggaatgatatggattcatcaaggggaatcctttcaggcactatggactaaatttaaatggtattcgagacaaatccagccggagaatgttacacttgtagcatcatttgttgtgctttttcttatagtgtattacctaactaggtaactgatatttcattcaattgtcaacttggttagacccgaaaggaggtaactcttatcactgtaattaatgctgcgccctgtaagatattctatcatgtataaagctttt

SEQ ID NO: 5328 - DNA, 824 bp, Gossypium hirsutum
ctccccagatgaaaatgccattaaatcgttcaaattctaatctcaattcctgattaggatatatcctttttcttcaacaatttgtcgggtgctaccttagccttagcagattttaaaattacccaaacaggtaaaacactttgtttttcacacttgttcgaagaagatttatagggctttggttctcccataattgaagaaacatgaatcctagacgggacatgcgtaacaacagagttgcccttttcgatggcatcgaggagggtggcataagggccacttcttcttactcgcatgaaattgatgagcatgataatgaaagagcaatggaaggattgcaggatagagtcaatctgctgaagaggctttcaggcgacatacatgaggaggtggatagccacaatcgcatgctggatcgaatgggaaatgatatggattcatcaagaggaatactctcaggaaccatggacaagtttaagatggtattcgagaccaaatcaagcaggagaatgtttacacttgtggcatcttttgtggttattttccttgttatatactatcttactaggtaactggtctgtggtgtatgtgatgtaatacaactgcaagctttatatgagaatttggaagacccttattctagtacatcgtgttactgtaaacaatgcgcttcctacttgtatgatatcgtggcatgtttgtataaatatgttttgatgtatcaaacaaacaggcctttcttagcatgaactggttagcagtgacataaacaatatgctcattcatctattcctgtcaatggctgtcttccaatattctactta

SEQ ID NO: 5329 - DNA, 1291 bp, Gossypium raimondii
caaaaactaaaatcccttttgttgggctttattttcattatagcccatttgtttatcttcccaatccccctaacaaagaaaactccccagatgaaaatgccattaaatcgttcaaattctaatctcaattcctgattaggatatatcctttttcttcaacaatttgtcgggtgctaccttagccttagcagattttaaaattacccaaacaggtaaaacactttgtttttcacacttgttcgaagaagatttatagggctttggttctcccataattgaagaaacatgaatcctagacgggacatgcgtaacaacagagttgcccttttcgatggcatcgaggagggtggcataagggccacttcttcttactcgcatgaaattgatgagcatgataatgaaagagcaatggaaggattgcaggatagagtcaatctgctgaagaggctttcaggcgacatacatgaggaggtggatagccacaatcgcatgctggatcgaatgggaaatgatatggattcatcaagaggaatactctcaggaaccatggacaagtttaagatggtattcgagaccaaatcaagcaggagaatgtttacacttgtggcatcttttgtggttattttccttgttatatactatcttactaggtaactggtctgtggtgtatgtgatgtaatacaactgcaagctttatatgagaatttggaagacccttattctagtacatcgtgttactgtgaacaatgcgcttcctacttgtatgatatcgtggcatgtttgtataaatatgttttgatgtatcaaacaaacaggcctttcttagcatgaactggttagcagtgacataaacaatatgctcattcatctattcctgtcaatggctgtcttccaatattctacttataactgagccactgtcatttgtttcaattttttaaatttgaatttttgagttccgagaagcattttaatgattcttcatcctaaaggttaaagcaattaggttgtatggtggattttgacccagaatcacatcaatgcaaaaaacgagacctgcaattacgggaggtcaagtcattaacttcgaagttgattaatcctttttcactttcaatgagatggtagagattggcaggattcatctagtttccaatttcaaagctttgccgtcccaataattccgcctaaatttgccagtttccacacctactacagtcgtcacccacactgattctaattctatctgttgtcgatacttgaaaaggataagcctttgaatggtatgaca

SEQ ID NO: 5330 - DNA, 544 bp, Castanea mollissima
  misc_feature (75)..(75): n is a, c, g, or t
ctctctctctctctctctaactctcaagtctcaaccatgaatgccagaagagactaccgtaacaataaagccgcnctttttgatggaattgaggagggtggcatcagggcctcatcgtcttactcttcccatgaaattgatgagcatgataatgaaagagcagtagatggattgcaagatagagtcattctgctgaagagattgtcaggtgatataaatgaagaggtggaaagtcataatcgaatgctggacagaatgggcaacgatatggattcatcaaggggagtcttgtctggaaccatggatcgtttcaagacggtatttgagaccaagtcaagccggagaatgtttacacttgtggcatcatttgttgtcattttccttgtcatatactatctcactaggtaatcgatctgtgatggatttgatacaagcttccagctttatgttagaactgggaagactcattttcacttcattgctgtgatcaatgttacttcctgcctgtaagatattctggcatgtccatgtaaagatattttca

SEQ ID NO: 5331 - DNA, 846 bp, Quercus alba
aatgatgtatatctctagactctagttatacttatatgaatctacccctcccaaaactcttcaaaaaaattcagatctgaatttctctctccctctctctctctctataacagaaattacgagatcgaatagctccgttacgagtattcaaagaaacagaaagagtcggccatagaaactgtgatccttttttttttttctctctctctaactgtaaagtctcaaccatgaacgccagaagagactaccgaaacaataaagccgctctttttgatggaattgaggagggtggcatcagggcctcgtcatcttactcttcccatgaaattgatgagcatgataatgaaagagcagtagatggattgcaagatagagtcattttgctgaagagattgtcaggtgatataaatgaagaggtggaaagtcataatcgaatgctggacagaatgggcaacgatatggattcatcaaggggagtcttgtctggaaccatggatcgtttcaagacggtatttgagaccaagtcaagccggagaatgtttacacttgtggcatcatttgttgtcattttccttgtcatatactatctcactaggtaatcgatctgtgatggcattttccttgtcatatactatctcactaggtaattgatctgtgatggatttgatacaagcttctagctttatgttagaactgggaagactcattttcactttattgctgtgatcaatgttacttcctgcctgtaagatattctggcatgtccatgtaaagatattttcatgtatcaaatgtgtcttgaaccaatgggatggttagcagttaatatgtgtttgcatcataatc

SEQ ID NO: 5332 - DNA, 913 bp, Phaseolus vulgaris
gagactgcctttctttcaattttccttatgatttaattcaatttatatatctagaatccttgatagtttatgcgcttatggaaacatcaaataattgaaaatgatcttgcttgtgtattatctgaccatctgggtcacatcaccgtattgtatattattatttttttctgtttcagagatggccgtaacaacagagttgcactttttgatggtattgagaagggtggcatcaaagcatcgtctctttactcaacttcttcccatgaaattggtgaacttgataatgaacaagcattggatggattgcaagatagagtcaatctgctgaaaagattgtcaggtgacataaatgaggaagtggatagtcataaccgaatgttggatcggatggcgaacgatatggattcttcgagaggaatcctctcaggcactatggataaattcaaaatggtatttgaaacaaaatccagccgaagaatgttttcacttgtagcatcctttgttgtggtttttcttataatatactatctgactaggtaatttatctttatcaggtaattgatctttatttgagttgtcagctcaagattagattggaaaggaggccacttgctctattcctctaattagcgatattgttgtaagatgttcctttgtgtttgtataaagattttgacgtttcattttatccaaccagtaatgtccatatctagtttgtataccttccaacaaataaccttttctctttgatgtgattcgagtatccaaaatatatgtgttgttaaagctatgcttagattctttgaaatttgttttgggcttagaattagcttctttgagcaaaattggtgccattggagcaaaattggtgccattggagtggatacaaatgtgttagaaatgttctataagg

SEQ ID NO: 5333 - DNA, 984 bp, Theobroma cacao
gatttcgaaatcattttacgtttttctcttcccaattcgtccggtgctactgtatcagggaactcattccctcttccctccaaagattttgtaagtacccaagggctaaaaggctttcactggtatacgaagcagaccaaaagggcttttgttctcggctttttcacagacatgaatcctagacgagacatgcgtaacaacagagttgctctttttgatggcattgaggaaggtggaataagggcctcatcttcttactcacatgaaattgacgagcatgataatgaaagagcagtggaaggattgcaagatagggtcaatctgctgaagagactgtccggtgatatacatgaggaggtggagagtcacaatcgaatgctggatcgaatgggaaatgatatggacgcatcaaggggaatactctcaggaaccatggacaagtttaagatggtatttgagaccaaatcaagcaggagaatgtttacacttgtggcatcttttgtggttatttttcttgtcatatactatcttactcggtaattggtccatggtgtatttgataagttgcaagctttatatgagaatttgcaagacctttttatgcatggctactgtaaacaatgtgcttcgtacatgtaagatattctgacatgtttgtataaagatgtttggtatatcaaacaggccttgaaggcatgaacttgttagcagttaatgcgccttttgcataatctttcttctattcctctcgcaagttgcaacttaaatggagcaaatggctggctactaaatccagctcggttaatcgttggtttagttacagttttccttacaatttgttgtgtttgatttttacagtgtggtgggaagaagcaggagccaggaggggatattttgttatttagtagcagtaatttgtttggagagatgatagagaaagtattggttggtgcatgattcctgtttagaagtgctgggttcaaa

SEQ ID NO: 5334 - DNA, 1497 bp, Theobroma cacao
gatttcgaaatcattttacgtttttctcttcccaattcgtccggtgctactgtatcagggaactcattccctcttccctccaaagattttgtaagtacccaagggctaaaaggctttcactggtatacgaagcagaccaaaagggcttttgttctcggctttttcacagacatgaatcctagacgagacatgcgtaacaacagagttgctctttttgatggcattgaggaaggtggaataagggcctcatcttcttactcacatgaaattgacgagcatgataatgaaagagcagtggaaggattgcaagatagggtcaatctgctgaagagactgtccggtgatatacatgaggaggtggagagtcacaatcgaatgctggatcgaatgggaaatgatatggacgcatcaaggggaatactctcaggaaccatggacaagtttaagatggtatttgagaccaaatcaagcaggagaatgtttacacttgtggcatcttttgtggttatttttcttgtcatatactatcttactcggtaattggtccatggtgtatttgataagttgcaagctttatatgagaatttgcaagacctttttatgcatggctactgtaaacaatgtgcttcgtacatgtaagatattctgacatgtttgtataaagatgtttggtatatcaaacaggccttgaaggcatgaacttgttagcagttaatgcgccttttgcataatctttcttctattcctctcgcaagttgcaacttaaatggagcaaatggctggctactaaatccagctcggttaatcgttggtttagttacagttttccttacaatttgttgtgtttgatttttacagtgtggtgggaagaagcaggagccaggaggggatattttgttatttagtagcagtaatttgtttggagagatgatagagaaagtattggttggtgcatgattcctgtttagaagtgctgggttcaaattcttcttcttccaattaaaaaaaaaaaaacaaaaatgtaaaaaatggaggaaaatgggagatgacattattgggggaaaagacaattgaacagttaatgcggttggggttgggttgtgtgtcgtttcttttctttgtggtagtaatgatagacataattgggtaaagaaaatagagcatgggtaaatgacgagtaaatgtttttccttccaacaagtaaagcgaatggctcttcctttcctcatttaaccttcagccactgccaaattcttgtcgtaagttgttgccctgttgacacgtccgaaagataataaaagagaagcaagttttcctcgttttgtttcttcatctactcatgttctgtttgagcttcaaggtccgaagagcatgcatcaaacaatcacacttggcattgagtatttgtcttctggtttagaccagaatgacatcacgcggatctgagacctttaattacggccgttaacttgggttgattaaacctttcacttttca

SEQ ID NO: 5335 - DNA, 959 bp, Citrus clementina
acatttgataaaatctccctccggctagccgctagcctttgtgtataaaatccgagcggcatttcatcgccgtctcctttctcccaccagcttgtctgctgctgcaagcgaattcctgcttcacaccaaaggaacacaattgagaatatcgcgaggctgagcttaatttatctagaagcgaagaaaggctgtgatctttgagtcatgaattctagaagggactaccgtaatagtaaagtcgcactttttgatggcattgaggagggtggcatcagagcctcctcttcttactcccatgaaattgacgagcatgataatgaaagagcattggaaggattgcaagatagagtcaatcttctgaagagactctcaggtgatataaatgaagaggttgacacacacaatcgcatgttggaacggatgggaaatgatatggatgcttcaagaggagtcctatcaggaaccatggataagtttaaaatggttttcgagaccaaatcgagcaggagaatgtttacccttgttgcatcatttgtggtcattttcctaattgtatactatctcactaggtaaatgatctatgatgtatttgataacgccagcagctttatgttagaattgggatgaccccatttttatgtggttatgtaatcaatcttacatgttgcatgtaaggaactcgtttgtggttgtataaagagtttgtattctatggaattgttattaaaagcttgaaacaagatactacatattattcagtatgtatgcattatcgcctccccaatgtatggctgagtcaaattactaggctgtacttgttgttagctgggaggtatgccgtgagcaactttaaaaagcatgtaatgccatctactcagctttaagaaatagtccgttagttcaggttcttaatgagagttttccatttctttgcaagaccataaacttactcttggcct

SEQ ID NO: 5336 - DNA, 706 bp, Gossypium hirsutum
gacgatacagaagaagaacgaacgaagtgagagccgggggcaggaaagaagaaatccagtccatcttccttttcaaacacagaaaaaagggatttgattctcctattctgaagaaccatgaatcctcgaagggacatgcgtaacagcagagttgcactctttgatggcatcgaggaaggtggcataagggcctcatcttcttactcacatgaaatcgatgaacatgaaaatgaaagagcaatggaaggattgcaagatagagtcaatctactgaagagactgtcaggtgatatacatgaggaggtcgatagccacaatcgcatgctggatcggatgggaaatgatatggatgcatctaggggaatactctcaggaactatggacaagtttaagatggtatttgagaccaaatcaagcagaagaatgtttacactggtggcatcttttgtggttgttttccttatcatatactatcttactaagtaactggtctacggtgtttttgatacagctgagaactttatgtgacaatttgtaagaccctttttatatatggttactgaaatgtgcttccgacatgtaagatattttcgtatgtttatatgaagatttcttggtatatcaaaacacaggccttggtgggcatggactatagttaggagctaaatgtctctttagcatcctccaaacataaaataatttgcat

SEQ ID NO: 5337 - DNA, 991 bp, Gossypium raimondii
ccaaaatccatctggttgggttttaccatcctatttagtattcagcaacgtaaaatgtaaatcatcaaatcagtatatttatttatttatatcttactattttgctaccatagccgggaaggaaagaaatccagtccatcttccttttcaaacacagaaaaaagggatttgattctcctattctgaagaaccatgaatcctcgaagggacatgcgtaacagcagagttgcactctttgatggcatcgaggaaggtggcataagggcctcatcttcttactcacatgaaatcgatgaacatgaaaatgaaagagcaatggaaggattgcaagatagagtcaatctactgaagagactgtcaggtgatatacatgaggaggtcgatagccacaatcgcatgctggatcggatgggaaatgatatggatgcatctaggggaatactctcaggaactatggacaagtttaagatggtatttgagaccaaatcaagcagaagaatgtttacactggtggcatcttttgtggttgttttccttatcatatactatcttactaagtaactggtctacggtgtttttgatacagctgagaactttatgtgacaatttgtaagaccctttttatatatggttactgaaatgtgcttccgacatgtaagatattttcgtatgtttatatgaagatttcttggtatatcaaacacaggccttggtgggcatggactatagttaggagctaatgtctctttagcatcctccaacataaataatttgcatatatcttcttcctttcctgtctatggcctaagatccgaatctccggctatctgtaactgtcttttaagttccaaactctgacttggatctgggctaatgattggcgactaaaagttaaccaaggttaacatttatttaagttatacaacatggtttttcaagagtttaactattggaagaagcagcgaaattgcaacaaagaagtgcattacag

SEQ ID NO: 5338 - DNA, 958 bp, Citrus sinensis
acatttgataaaatctccctctggctagccgctagcctttgtgtataaaatccgagcggcatttcatcgccgtctcctttgtcccaccagcttgtctgctgctgcaagcgaattcctgcttcacaccaaaggaacacaattgagaatatcgcgaggctgagcttaatttatctagaagcgaagaaaggctgtgatctttgagtcatgaattctagaagggactaccgtaatagtaaagtcgcactttttgatggcattgaggagggtggcatcagagcctcctcttcttactcccatgaaattgacgagcatgataatgaaagagcattggaaggattgcaagatagagtcaatcttctgaagagactgtcaggtgatataaatgaagaggttgacacacacaatcgcatgttggaacggatgggaaatgatatggatgcttcaagaggagtcctatcaggaaccatggataagtttaaaatggttttcgagaccaaatcgagcaggagaatgtttacccttgttgcatcatttgtggtcattttcctaattgtatactatctcactaggtaaatgatctatgatgtatttgataacgccagcagctttgtgttagtattgggatgacccctttttatgtggttatgtaatcaatcttgcatgttgcatgtaaggaactcgtttgtggttgtataaagagtttgtattctatggaattgtcattaaaagcttgaaacaagatactacgtattattcagtatgtatgcattatcgcctccccagtgtatggctgagtcaaattactaggctgtacttgttatcagctgggaggtatgccgtgagcaactttcaaaagcatgtaatgccgtcttctcagctttaagaaatagtccgttagttcaggttcttaatgagggttttccatttctttgcaagaccataaacttactcttggcct

SEQ ID NO: 5339 - DNA, 1006 bp, Populus trichocarpa
gtaagtttcgtgttgctttcactctcttaattttccatgttattagttcattatcagatctgtactctctctctcgccctcgatctcactcactcttgatcaatctgttataactccgtgaactcaactgcaattcgacttttaatctgtttagatctgatattttcactctcagtgccgttatttattttttgaatatttgagttgcagcatcttcaaaagctgtgtgagattgttgctgtaagagaagcagagaaggtactgtgatcttgaagtcatgaattcgaggagggacatccgtaacaatagagctgctctttttgatggaattgaggagggtggcatcagagcctcatcctcttactcctcccatgagattgatgagcaagataatgaaagagctttggaaggattgcaagatagagtcattctgctgaagagactgtcaggtgatataaatgaagaggtggacaaccataatcttatgctagacagaatgggcaatgatatggattcttccaggggagtgctgtcaggaaccatggatcgctttaagatggtatttgaaaccaaatcaagccgtagaatgtttacactcgtggcatcatttgtggtcctattcctaattatatactatctcactaggtaatattcctctgatggatttggtatagctgtgggccttatgttagaaccgggattgccccatttaacgtttttactataatcaatgttcctgcttgtgatagactcacccaggcatgctttgtgtaaagatgtttcatgtcttaaacgtgtgttgaattcacggaatggatgtaaagtcgttgctcgtgtttttgttttcagttgcatgaaatcagccagttgcttaatcttctgaggtaaaacacttgaccgcaaattgcttagtgattgatattgtgttagaggttgttttttaaaatgtttttttttggacattaaaataatatatattttttaaagaattatttttaacatcaac

SEQ ID NO: 5340 - DNA, 699 bp, Populus trichocarpa
tcttccttccccatccactacctgccgcagcgtaaattcctgtttccctccaaaagcattttcaaaagctgagtaagattgttgctacaagagaaggtacacgttctgtgatcttctagccatgaattcgcggagggatgttcgtaacaatagggctgctctttttgatggcattgaggagggtggcatcagagcttcatcctcatactcctcccatgagattgatgagcaagataatgaaagagctttggaagggttggaggatagagtcagtctgctgaagagactgtcaggagatataaacgaagaggtggacagccataatcttatgctagacagaatgggcaatgatatggattcttccaggggagtgctgtcaggaaccatggatcgctttaagatggtatttgaaaccaaatcaagccgtagaatgcttacactcgtggcgtcatttgtggtcatattcctaattatatactatctcactaggtaatattgctacgatggatttgatacagctgctggccttgtgttagaactgggaacaccccattttacatgctcactgtaaccaatgtccctgtatgtgatatactctcccaggcatgctttgtgtaaagattgttccatttcttaaaactgtgttgaaagcatggaatggatgtaaagtcctcgcaccgcaccccttgtttttgtttt

SEQ ID NO: 5341 - DNA, 684 bp, Gossypium raimondii
tttatttatttatatcttactattttgctaccatagccgggaaggaaagaaatccagtccatcttccttttcaaacacagaaaaaagggctttgattctcctattttgaagaaccatgaatcctcgaagggacatgcgtaacagcagagttgcactctttgatggcatcgaggaaggtggcataagggcctcatcttcttactcacatgaaatcgatgaacatgaaaatgaaagagcaatggaaggattgcaagatagagtcaatctactgaagagactgtcaggtgatatacatgaggaggtcgatagccacaatcgcatgctggatcggatgggaaatgatatggatgcatctaggggaatactctcaggaactatggacaagtttaagatggtatttgagaccaaatcaagcagaagaatgtttacactggtggcatcttttgtggttattttccttttcatatactatcttactaggtaactggtctacggtgtttttgatacagctgagaactttatgtgacaatttgtaagaccctttttatacatggatactgaaatgtgcttccgacatgtaagatattttcgtatgtttatatgaagatttcttggtatatcaaacacaggccttggtgggcatggactatagttaggagctaatgtctctttagcatcctccaa

SEQ ID NO: 5342 - DNA, 725 bp, Ipomoea nil
gatcatttaacctcaagtttcctactcctcatctccgccaccgcgagccgctcaccggcacagagttgcagtttgccgcggggattcacgtcaccggagcgtgatcttctgaaaatcctgtctgcatagcgccatgaattctcggagggatcgcaatactagaactgctctgtttgatggtattgaggaaggtggcattagggcttcatcatcatactcttctcatgagattgatgaacatgagaatgaaaaagcactggatggactgcaagatagagtcaatctgctgaaaagattgtcaggtgatatacatgaggaggtagacacccataatcgcatgctggacagaatgggcaatgacatggatgcttcaaggggagtgttatctggaaccatggacaaattcaagatggtattcgagacgaaatcaagccggaggatgttcactcttgtggcatcttttgtggttctctttctggtggtgtactatctcaccaggtaaatagtgacgagcgttcggatatctactggttttatagctgttgataccagattcacattgatcatataatgctgtctacatcaccctctcacagccttaatatccgaacgtatctgtaaagatgtttgatgaaaaatttaaatactttttgaatagtatgccttctggttctggaatggatataatgacaacactagtggttgttaccttgttatacatacca

SEQ ID NO: 5343 - DNA, 931 bp, Prunus mume
cgcgagatcagtccttcagaatataaatcccagcgactcactctcatttcccctctttcttactccgcggggagaactcctcggcttccctccaaacgtagctcaaaattcaaagatcaaagaagcagcgatagggtcgaattgttctggtccttgtgagccatgaatgctcgaagggactaccgtggcaacaaagttgctctttttgatggcattgaggagggtggcatcagggcctcggcttcctactcccatgaaattgatgaacatgacaatgaaagagcagtggacggattgcaagatagagtcaatttgctgaagagattgtcaggtgatatacatgaggaggtggagagtcacaatcacatgttggacagaatgggaaacgatatggattcatcaaggggagtgctatctggtaccatggacaagtttaagatggttttcgagacgaagtcaagccagagaatgtttacactagtggcatcttttgtggtcattttcctagttatatactatctcactaggtaactgatccatgatggattgcatacagccactagttttaagttgaatatggaagaccttgctcttgactgtaatcaatgtttaccttgtgcttgtaagatattctggtatgtttatatttaaatgtatgaaatagaggagttaaatgcctgaaccgcctcataaacccccaccccaagccaaagccaagccagaagttattgtttttcgagttatatttaactacggaggtgaacgaagcttgtaatgtaggcacaaaattcgtgaggttgaaacaattgttttgaaacctaactttatgtgccgttgcctaattgtatggcataaatgggtttctatatcaagttggcctactgttcattgtgatcggaaattatacctcgtgtcgtgaggcacttcaaag

SEQ ID NO: 5344 - DNA, 820 bp, Prunus persica
cgcagggaaaactcctcggcttccctccaaacgtagctcaaaattcaaagatcaaagaagcagcgatagggttgaattgttctggttcttgtgagccatgaatgctcgaagggactaccgtggcaacaaagttgctctttttgatggcattgaggagggtggcatcagggcctcggcttcctactcccatgaaattgatgaacatgataatgaaagagcagtggacggattgcaagatagagtcaatttgctgaagagattgtctggtgatatacatgaggaggtggagagtcataatcacatgttggacagaatgggaaatgatatggattcatcaaggggagtgctatctggtacaatggacaagtttaagatggttttcgagacgaagtcaagccagagaatgtttacactagtggcatcttttgttgtcattttcctagttatatactatctcactaggtaactgatccatgatggattggatacagccactagttttaagttgaatatggaagaccttgctcttgactgtaatcaatgtttaccttgtgcttgtaagatattctggtatgtttatatttaaatgtatgaaatagaggagttaaatgcctgaaccgccttatcaacccccaccccaagccaaagccaagccagaggttaactgcagaggtaaacgaagcttgtaatttaggcacaaaattgaggttgaaacaattgttttgaaacctagctttatatgccgttgcctaattgtatggcattgccaaatgggtttctatatcaagttggccaactgttcattgtgatcagaaattat

SEQ ID NO: 5345 - DNA, 588 bp, Fagus grandifolia
agattacatcatcaaaactattcaacaaacatatacaatctgtgatcctctcagccatgaatgccagaagggactaccgtaacaataaagctgctctttttgatggaattgaggagggtggcatcagggcctcatcttcttactcctcccatgaaattgatgagcaggacaatgaaagagcaatagatggattgcaagatagagtcattctgctgaagagattgtcaggtgatataaatgaagaggtggacagtcataatcgaatgctggacagaatgggcaatgatatggattcatcaaggggagtcttgtcaggaaccatggatcgcttacaagatggtgtttgagaccaagtcaagccggagaatgtttacacttgtggcatcatttgtgtcattttccagtcatatattatctcactaggtaattgatctatgatggatttaatacaagcttctagctttatgttagagctgggaagactcattttcacttcattgctgtgatcaatgttacttcctgcctgaagatgttctggcatgtccatgtaaagctatttcatgtatcaaatgtgtcttgaaccatggg

SEQ ID NO: 5346 - DNA, 885 bp, Cannabis sativa
cttcccgttttaccctttccttttcagctcggaaacaaagagagcttcctcactctcatccttccctccaaacagataattaatcaatctcgaagatcgtaatattcggggttttggagttcgattaagcttggagaatatcgtgttcttatcaactgtgtcaagttatgaatactagaagggacattcgtggtaacagagctgctctttttgatggcattgaggagggtggaatcagagcttcatcatcatactcctcccacgaaatcgatgaacatgataacgaaagggccatggaaggattgcaagacagagttattctgctgaagagattgtcaggtgatatcaacgaggaagtggataatcataaccgcatgcttgaccggatgggcaatgatatggattcgtctaggggagtgctatcaggaaccatggatcgatttaagacggttttcgagaccaaatctagccggagaatgtttacgctagtggcatcattcgtggttgtttttctagtcatatactatctcaccaggtaaaatccatatgatgaatttgatgcacaacacaactactagattcatattgaagctaagttggagaagaaaaaccttacctcttttctatttgcaaaaatcaatctttaccatccttgcttgtaagataaatcattctggcttggcatatgtaaaaaggatatttcagaatgtaatgaatggatttgaatgaatgcataaaaaaaaattggtattgagttttttctgctcgtcttctcaactcccccaaagcaaccaatcctttttacttggagtgtttttggttgctttttgacgctgaaaatacaagcattagttttttggtcaaatagacaggcttatgtttaag

SEQ ID NO: 5347 - DNA, 807 bp, Humulus lupulus
taaatccgaggtttccttcccgatataccctttcctttctgatcggaaacaaagatcttcctcactctgcttccctccaaacagataatcaatatcgaagatcgcaatattagggtttttgagttcgattaagcttctaggagcatatcgtgttcttatccccttcaagtcatgaatcctagaagggacatccgtggtaacagaactgctctttttgatggcattgaggagggtggaatcagagcttcatcatcatactcctcccatgaaattgatgaacatgataacgaaagagccatggagggattgcaagatagagttattctgctgaagagattgtctggggatatcaatgaggaagtggataatcataaccgtatgcttgaccgaatgggcaacgatatggattcatctaggggagtgctgtccggaactatggatcgatttaagacggtttttgagaccaaatcaagccggagaatgtttacactagtggcgtcattcgtggttgtttttctagtcatatactatctcactaggtaaatccgtgatgagtttgatacaactaccagatttatgttgaagctggagaagaaaaccttgccatttctatttgcaaatcaatctttaccatccttgcttgtaagataatcaatctggcttgtcatatgtaaaatgtaacgaatggagttgaatgcataaaaagttggtatcgagtttttctgctcgtctctcaactcccaagcgaccaatcctttatgcttggagttttgagtgctgcttttgatgattctgtttaaggcaatt

SEQ ID NO: 5348 - DNA, 716 bp, Carica papaya
gtctgctattatcgaaggaaaattttcagcttccctctccggtgaatatttgtagggtttcgagaagctgatattagtactcaaagaggcctgtatcatctttaagccatgaattccagaagggatacgcgtaacagcagagttgctctttttgatggaattgaggagggtggtattagggctgcatcttcttactctcatgaaattgatgagcatgataacgaacgagcaatggaaggactgcaagatagagtcaatctgctaaagagactgtcaggtgacgtacatgaggaagtggagacccataaccgcatgcttgaccgaatgggcaatgatatggattcatcaaggggaattctctcggggactatggacaaattcaaaatggtgttcgagaccaaatcaagcaggagaatgtttacacttgtggcatcatttgttgtcattttcctaatagtatactatctcactaggtgataaaagataaatacatggttgccagctttatgttagaactggtaagggtgaagagttttttctttgttttttccttgtttttactgtaaacaatgttggttcttgtctttgcatgtttttgtatagagatttttctttcagacagttgaatctaagaatgtgcctctttgtattggtcgactttagatgactctttcaaagtaaatactcagtatataaatccaataaagaacaattac

SEQ ID NO: 5349 - DNA, 1033 bp, Eucalyptus grandis
atcctagacgcgggggttcctcttgagttcccagcttcagcgctctcgaaggagctctccagcttccctccaaagggaccgggaatcgtaaggtttgaaccgcggtgataagcagtctccgagtagcggcggcggtggcggcggcggctttttttcttggaagcaatgaataccagaagggacgtccgtggcaatagagcagctctctttgatggcattgaagaaggtggcattagggcatcatcttcttactcttctcatgagattgatgagcatgagaatgaaagagcaatggatgggttgcaggatagagtcaatcttctaaagagattgtctggtgatataaacgaagaagtggagacacataaccgcatgttggatggaatgggcaatgagatggatgcttcgaggggagttctgtcgggaacgatggatcgttttaaaatggtgtttgagacaaaatcaagccggagaatgttttctcttgttgcatcatttgtggtgattttcctagttgtctactatctcactaggtaatggatcgcaataggttgaaggctgaaagctgctagagattaaaactgggggggttactgtgaacttcttactgtaagtaaatactgtttctggcttgtaagttcgtgttcctctgtttaaagatctctggacgtgtttgaactgttgtcaaaggcttcgatgttgtgtggtaataatagtagtaatagtaactgcctaactaatccacaccgtcttttccttcacaatctatatataaatatgtaaatgacggtctttacattggtaaggatgacctggggtttgccatttcctccaagtttgtggcgtcagatttaactgaagtgtttcaagtgcttatcctcattctgactgtaaatcaagttatggaaataagcgacaacaaatgatttcaggaaaggattaagtacctctgccatgaatcatgaaggtgcagggcacatcgggaagttcgaacggcatcgctagccactcataaagcccatcgggcgtctcg

SEQ ID NO: 5350 - DNA, 1062 bp, Vitis vinifera
gtccttgttgtggggattctcaccttccctccaaagacacacaaatcacaagtccgagggctgaggttgctattcgaataggcggacaaggggaatctgtgatctcaatccatgaattccagaagggattaccgtggcaatagaattgccctttttgatggcattgaggagggtggtatcagggcctcatcttcctactcctcccatgaaatagatgagcatgataatgaaagagcagtggatggactgcaagatagagttaatctgctgaagcgattgacaggtgatatacatgaggaggttgagagtcataaccgcatgctggatcgagtgggcaatgatatggatgcttcaaggggaatcctatcaggaactatggatcgatttaaaatggtatttgagacaagatcaagccggaggatgtttacacttgtggcatcattcgtggttattttcctaatcatatactatctcactaggtgaaaaacctatggtggatgtgatacagctgctagctttctgttagaactggggagacttttccatctgtttttactgcatgtaagatactccgatttgagagagtttgtgtaaaaaaaatgtttcaatgtattagatgggtattggatgcatcatgcacaaagcaggtagtagtttactagtttatatgccattggagcatacctgcaatttggacggaagcatcatcctcacctttccggtttattacttttgggtgtatttctttggggcagttaagtcatgcagagcccaaatgggacaggccttgttctatttacaccagttaccggtttgtttgagtttagtcgaagttagaatggtgtgcagtctgggcttacccctagcctgatctcagcaatttgatccgcttaattatgtatatcagtggggcttaccattacattggctgtgaactttctaggtaaatatatatggacaagatctgcaaataaccaaaggtcttttttaacacctttggcttctctttttacaagtttagaattcctgactgaatttatgcagaaagttggaacttgggca

SEQ ID NO: 5351 - DNA, 676 bp, Hevea brasiliensis
agaattcggcacgagccactgtctactcagtaggggaagctccctccaaaggtgccttcaagcttcttcgccctcattttcctatcgaagtgtccttcctaaaaaaggtgtttcaattttgcttcatcggaacataggcaattcagcaaacagaaatctgtgatatctagaccatgaattccaggagagatgtccgcaacaatagagctgctctttttgatggaattgaagagggtggcatcagggcctcatcttcttattcccatgaaattgatgagcaagataatgaaagagctgtggaaggattgcaagatcgagtcaatcttctgaagagattgtcgggtgatatacatgaggaggtggagactcataatcacatgctggacagaatgggcaatgacatggattcatccaggggtgtcctatcaggaactatggatcgatttaagatggtttttgagacgaaatcaagccggagaatgtttacccttgtggcttcctttgttgtcatattccttattgtatactatctgacaaggtaatcaatataagttgatactgttgctattgtcatgttagaaccggatccttttatgtggttactgtaatcaatggtacttcctgtttgtgagatattcaggcatgtttataaactttatataaagatgttgaaata

SEQ ID NO: 5352 - DNA, 627 bp, Lotus japonicus
cagctgtattgtggagcaagatcacaaggcccaccgtcacatccacagaatcagagatagattgcacacgatctcgcaacaagccatgaattctagacgagacatccgtaacaataaagttgcgctgtttgatggtattgaggagggtggcatcagggaatcagctctttacccctcttcccatgaaattgatgaacacgacaatgagcaagcaatggatggattgcatgatagagtcaatctgatgaaaagattgtctcgtgatattcaagaggaggtggatggccataaccgcatgctggatcgtatggggaacgatatggattcatcaagaggagtcctctcaggcactatggacaaatttaaaatggtattcgagaaaaaatccagccagagaatgtttacgcttgtagcatcctttgttgtgctttttctcataatatactacctaactaggtaatttgatctttcattggaactgtcagctttatgttagttctgagaggaagctgttttctctattcctgtaattaaagctgctgctacatgtatgatactgttatgtataaggttttgacgtttttaaacaggtaagaacccaatgagaatgtccatatccgatctgcg

SEQ ID NO: 5353 - DNA, 547 bp, Heritiera littoralis
acaatctgtctggtgccactgtaacagggaaatccatccgatcttccctccaaagggctaaaagactgattataactccaagcagagaagaagtgctttgattctcccttttgaagaagtatgaattctagacgggacatgcgtaacaacagagttgcactttttgatggcattgaggaaggtgggataagggcctcgtcttcttactcgcacgaaattgatgagcacgagaatgaaagagcagtagaaggattgcaagatagagtcaatctgctgaagagactgtcaggtgatgtacatgaagaggtggatagccacaatcggatgctggaccgaatgggaaatgatatggacgcatcaaggggaatacttcaggaaccatggacaagtttgagatggtattcgagaccaaatcaagcaggagaatgtttatgcttgtggcatcttttgtggttattttccttgtcatatactatcttactaggtaaactaggtctatggtgtatttgatacagatgcgagcattatatgggaattgagaccttac

SEQ ID NO: 5354 - DNA, 460 bp, Platanus occidentalis
attagtcaagccatgaattccagaagggactttcgttaacaatagaactagctctttttgtattggcattgaggaaggtggtatcagggcctcctcgtcatactcttctcatgaaattgatgagcatgacaatgatagagctcttgatggattgcaggatagagtcattttactgaagagattgacgggggatgtacatgaggaagttgagagtcataaccgtgtgctggaccggatgggaaatgatatggatgcatcaaggggaattttgtcgggaactatggatcgatttaagatggtttttgagacaaaatcgagccggagaatgtttacacttgtggcatctttcgttgtcatctttctaatcatatactatctgactaagtgatcaatctgtctatggaattactagggtacaactactagattgaactggaaggactgttttctccttgacaca

SEQ ID NO: 5355 - DNA, 691 bp, Arachis hypogaea
atctcttctcttctcttctcttcgattcgatttacgtaccttcaccaccgcaacgttttccaccttctagaatcttcttctatctccttccggattattcctcagatctgagatcgcaccgtccagagtagtggaatctgttgatctggtgaaccatgaattctagaagagacgcccggaacagcagagttgctctgtttgacggcattgaggagggaggcatccgagcatcatcactttactcctcctataatgaaattgatgaacaagataacgagcgagcaatgggtggattgcaagatagagtcagtttgttgaaaagaatctcaagtgatatacacgaggaggtggatagtcataaccggatgctggaccgcatggggaatgacatggattcttcaagaggagttctttcaggaactatggacaaattcaaaatggtctttgagaaaaaatccagccgaagaacgttttcacttatagcatcctttgttgtgcttttccttataatatactatttgactaggtaattgatctatattagaccccgtaggaggtttacttgctctatcactgtaattaatgttgctactttttaagatgttatttgtttgggtttttttggacgtttgaaaatggtatcgaaacaaatgagaaatgtgcatatcaatcaagtttgtgaatatttccc

SEQ ID NO: 5356 - DNA, 861 bp, Euonymus alatus
cgcatccatggtcccacaccacgacacggccttgtacacccagattcgtcgatcgctcgatgtttataagtctctggtcactccctctccttcctttcatcatcactttgtctgcttccagaggtttccctccacagaaaaggtttggattgttgaattctgagattggtcgtgtgagagcagtcaagcagaggaagggcgtagatcctgtaatgaatcaatccatgaattctaggagggatttccgtggcaataaagctgctctttttgatggcatcgaggaaggtggcatcagggcatcagcttcttactcccatgaaattgacgagcatgataatgaaagcgcattagaaggattgcaagatagggtcattctgcttaagagactgtcaggtgacataaatgaggaggtggatagtcataaccggatgctagacagaatgggaaatgatatggatgcatctagaggaatcctgtcaggcacaatggatcggcttaagatggtattcgagaccaaatctagccggagaatgtttacgcttgtggcatcctttgtggtgattttccttatcatatactatataactaggtaatgttgtgtaatctatgccccatggattggatacagctgcttgctttatattagcactgtgactgtgactgggtctgcgactgctgtattcaatttatctcatgcttgtaagatagtttggcatgtttgtataaatacgttatgatatgtcaaatttgtgttgaattaatgaatgaagaacataatagcgcaccaattagtgcatgtaaatgattacagcctcaccttgtagtagcagatgtttcgggtttcttctgtgtttttcgtgt

SEQ ID NO: 5357 - DNA, 702 bp, Linum usitatissimum
ggccgaaggcttaacaagaatcccattttctgccgtctcgttctcaacagctgaagaagaagcgaccttccagagaaagagggttctagagctgtaccagcagccgtgtccgtgtcaattgagcgatgaattccagaagggatataaggaacaacaggactgctctcttcgatggcatagaggagggtggcatcagggcgtcttcttcttactcccatgaaattaacgagcaagctaatgaaagtgccctggaaggtttacaagacagagttaatctgctgaagcggctgtcgggtgatatacatgaagaggtggaggggcataatcgcatgctggatggaatgggcaatgatatggattcatcaagaggagtcctttcaggaacaatggatcgtttcaaaatggtattcgagacgaaatcaagccggagaatgtttacgctggtggcatcatttgtggtggtattcctaatcatatactatctgactcggtgatttcaaaataccgggtcggattatcaagtctcaactcagccactgctacctccggctgtaaaatacaacgaatgtgtgccttcagtttgggttttgttaattcgtttcataattgtgctaagtaaaaatctaaactgagttgtgacttgtgagatggatggtcaatatttccaacttagttgtgtatcaaattgcaaaaagttttaag

SEQ ID NO: 5358 - DNA, 776 bp, Orobanche aegyptiaca
ttctgagatctgaacgttttccatcgtgaatctagctgcagtcttatagcgtaattcattgattaggattagggtgcttagcagcgcgtttgttgtctggttcagttagctgcatccgagtaattcagtcttctcggctatgaattccagaagggaccgtaatgctagatctgctcttttcgatggtattgaggaaggaggtattagggcatcttcctcatactcgtctcatgagattgacgagcaagagaatgatggagcaattgatggactgcaagatcgagttaatatgctgaaaagattgtcaggtgatatacacgaggaagttgagtctcataaccttatgctggaccgaatgggaaatgacatggatgcctcacgaggagttttatctggaaccatggataaatttaagatggtgtttgagaccaaatcaagccgaaggatgtttactctagtggcatcttttgtggttattttccttgtcatatactatcttactaggtagatgtttgctggtgatggaaataggaggatatgataattgtgtggaaactggaatgttctatcctatgtatgccttacttgtcaaatcacacgatgactgctgtcataagcctgtgcaaaaatgccggtatacaatatacgctcgaaatcacttggtcctccattttgtaaattattcgattgagttaccatatcaactacagataaaaagatacctcaagtgttttccacgagaaattatttaattgttatctacaaaaaaaaaaaaa

SEQ ID NO: 5359 - DNA, 655 bp, Capsicum annuum
tgcacagtatcctcagtgaagttggcgatcagctacagcctgcaggtttcgtctgtgatccatcagaacaaaagtttcaaatcactagccatgaattctcgaagggaacgtagcaacagagtagcactatttgatggtattgaggaaggtggtataagggcttcatcatcatatggctcacatgaaattgatgaacaagagaatgagaaagcaatggatggactgcaagatagagttaatctgctgaaaagattatcaggtgatatacatgaggaagtggagactcataataggatgctggacagaatgggcaatgacatggattcttcaaggggagttttatctggaacaatggataaatttaagatggtatttgagacaaaatcaagccgaagaatgtttacacttgtagcctcatttgtggttctctttttggtggtatactatctcactaggtaattagcattggaaactaggacgtgtagtaaattagtttgcagaagatgatgctgtgtttactcaaaattctgctgtcaattcgtcagtgtaagaatctcgtgacttgtgggtctgtgtaaagatgtttttggttgaaacagatacttttcagtattttgaatggaatatcagtccaacatagttatttcaggcacct

SEQ ID NO: 5360 - DNA, 602 bp, Salvia sclarea
ctactagaccttggctgtcactcaattgatttctttcagatctataatttttcaatcggaatttctttccccgtttctgacgccttcagattgtaatccgataattcagcggattgcgtttatagctgctgcgtgatcttcacttgtgttggcgatctctgtaaagtcgcatctcctcaattatgaatcctagaagggatcgaaatgctagagttgctctttttgatggtattgaagaaggaggtataagggcatcgtcatcttactcctctcatgagattgatgagcaagagaatgaccgagccatggaagggctacaagatcgagttattatgctgaaaagattgtctggtgatatacacgaggaggttgattcccataaccgtatgctggacagaatgggaaatgacatggatgcctcgagaggagttttatctggaaccatggataaattcaagatggtgttcgagaccaaatcaagtagaaggatgtttacacttgtggcatcttttgtggttgtttttctcattgtatactatcttactagataagttgtcagtccagttagttaaattggacaaagcctttgaaaatttgtgtgg

SEQ ID NO: 5361 - DNA, 534 bp, Chenopodium quinoa
atcccaattttctctctcctccatttctaattaaactcttctctgattacttcgatcactggaagcttgatcccttgtaaactgcgttaattgatttaccatgaatccgagaagggattatagagggtctagaacttctgcttttgatggcattgaggagggaggtatcagggcctcatcctcgtattcctctcatgaaattgatgaacacgacaatgatacagcacttgatgggttgcaagatagagttaatcttctgaaaagattaagtggtgacataaatgaagaagttgatgctcataaccggatgttggacagaatgggcaacgaaatggatgcatcacgaggattcttgtcaggaactgtggatcggtttaagcaggcattcgagaccaaatcaagcagacgaatgttcactcttgtggcctcatttgtggttcttttccttattatctactatcttactagataatccaaatagctaaaattgatactccgtacaactccaggctttttatctgaagtgagtcgctg

SEQ ID NO: 5362 - DNA, 532 bp, Chenopodium quinoa
aaaaggagaattctcaggttcagatcactggaagcttgatcacttgtaaactgcgttaattgatttaccatgaatccgagaagggattatagaggatctagaacttctgctttcgatggcattgaggagggaggtatcagggcctcatcctcgtattcttctcatgaaattgacgaacacgacaatgatacagcacttgatgggttgcaagatagagttaatcttctgaaaagattaagtggtgacataaatgaagaagttgatgctcataaccggatgttggacagaatgggaaacgaaatggatgcatctcgaggattcttgtcaggaactgtggatcggtttaagcaggcatttgagaccaaatcaagcagacgaatgttcactcttgtggcctcatttgtggttctttttcttattatctactatcttactagataatccaaatagctaaaaattgatacaactccaggctttgtatctgaaatgggtcgctgcctcaagtcttttctttctcagttgccgtgttttc

SEQ ID NO: 5363 - DNA, 631 bp, Hevea brasiliensis
gtcgtttcctagtgtctgtgccaaaaaagtgtttcaatttttcttcatcggaacagaagcatttaagcaaaaagatattggtgatctttagatcatgaattccaggagagatctccgtaccaatagagctgccctttttgatggcattgaagagggtggcatcagggcctcgtcttcttactcccatgaaattgatgaacaagataatgaaagagctatggaaggattgcaagatcgagtcaattttttgaaaagattgtcaggtgatatccatgaggaggtggagactcataatcgcatattggacagaatgggcaatgacatggattcatccaggggagtcctttcaggaactatggatcgatttaagatggtttttgaaacaaaatcaagccggagaatgtttacacttgtggcgtcctttgttgtgatattccttattgtatactatctgactaggtaatcaatcgaagatgatgatacagttgctagcatcgtgaaactggatcattttgtggttactgtaatcaatggtacttcctgttgttagattttaggcatgtttatatgaagaagttgaaatatgtcaaaatgcgttgaatgtatggaatgggtgtgaaaaatctttgct

SEQ ID NO: 5364 - DNA, 871 bp, Phalaenopsis aphrodite
gcattgaagagggtggaatcagagcatcatcctactcttctcatgagattgatgagcatgacaatgatcttgctgcgatggtccttcttgaattcgatgattcctcttttctggttttcgagatctcgaagcgttctggtttctccatctgcgacaagacaggttatccattgcttctttcaaattgcttactactctgccagaaacaagaagaatcatgaattcaagaagggaccatcgcagcaacagagctgcattgtttgatggcattgaagagggtggaatcagagcatcatcctactcttctcatgagattgatgagcatgacaatgatcttgctgtggatgggctccaagatagggttaatattctgaagaggctaacaggtgatatacacgaggaggttgaaagccacaatcgcatgctggatagaatgggaaatgatatggattcttcaagaggagtcctatctggaaccatggatcgtttcaagatggtgtttgaaaataaatcaagccgcagaatggttacacttgttgcttcatttgtggcgctcttcttacttatatattatcttacaaagtaaccaaccatccatgtgctaagaacatatgactcgcatgcatatcctttcttggatgttgggagtacatataatacattatcttgtgctcagctaaccatgcaatattgtatatttgtgaagtttaagttttttgtttcttgtttgtattttatgttgagtatatcatagctgacaaaaaacatggggattgtttggttttctcgtatgcaatagtatacgaactttattaaattagtagtatcgaatgtgaaataaagacattgcattttgatcatcgtttttagt

SEQ ID NO: 5365 - DNA, 889 bp, Phalaenopsis aphrodite
atcagtcctctttttctggttttcgagatctcgaagcgttctggtttctccatctgcgacaagacaggttatccattgcttctttcaaatttcttactactctgccagaaacaagaagaatcatgaattcaagaagggaccatcgcagcaacagagctgcattgtttgatggcattgaagagggtggaatcagagcatcatcctactcttctcatgagattgatgagcatgacaatgatcttgctgtggatgggctccaagatagggttaatattctgaagaggctaacaggtgatatacacgaggaggttgaaagccacaatcgcatgctggatagaatgggaaatgatatggattcttcaagaggagtcctatctggaaccatggatcgtttcaagatggtgtttgaaaataaatcaagccgcagaatggttacacttgttgcttcatttgtggcgctcttcttacttatatattatcttacaaagtaaccaaccatccatgtgctaagaacatatgactcgcatgcatatcctttcttggatgttgggagtacatataatacattatcttctgctcaactaaccatgcaatattgtatatttgtgaagtttaagttttttgtttcttgtttgtattttatgttgagtatatcatagctgacaaaaaacatggggattgtttggttttctcgtatgcaatagtatacgaactttattaaattagtagtatcgaatgtgaaataaagacattgcattttcatcatcgtttttagtagcatgttgtgagcgaaagggtaatgtagattcaattgttggtctccatgattattttggagagattattggtgtaacatttcataattgaaatcattgtctagtttacatca

SEQ ID NO: 5366 - DNA, 722 bp, Triphysaria pusilla
gggagacaatttgctcaaggtaggcgtacgcctgtttcctttttttatatgatcagatctgaatattttgtccccagagagagtctagctgcaatctgatagttcatcgtttaacttattgattagggttctcagctgcggcgtgatttctgtttcagttagctgtatctgaatcattcgatctcatcggctatgaattccagaagggatcgtaatgctagaagtgctctttttgatggcatcgaggaaggaggcataaaggcatcgtcgtcttactcatctcatgagattgatgagcaagagaacgataatgcagttgatgcactaaaagacagagttaatatgctgaaaagattgtcaggtgatatacacgaggaggttgagtctcataaccttatgctggacagaatgggaaatgacatggatgcttcaagaggagttttatctggaaccatggataagttcaagatggtgttcgagaccaaatcaagccggagaatgtttagtcttgtggcatcttttgtggtgattttccttgtcatatactatcttactaggtaagtggttgggaaatatgaggatctgcaactcgcggaactggaacatgattgtaaaaaaattgttggtacacaatatacgcttgaatcactccgttttccattttgtaaatattgtgttggtgttttttcatcgagttgccatggatatacaaagtacatttc

SEQ ID NO: 5367 - DNA, 671 bp, Manihot esculenta
atgctgtctactcagtaagggaagctcccctccaaaggtgtatcaattttgcttcactggagataggcaattgagtaaactgatatcggtgatcattagatcatgaatcctaggagagatgttcgcaccaatagagctgctctttttgatggcatcgaagagggtggcatcagggcctcatcttcatactcccatgaaattgatgagcaagataatgaaagagctatggaaggattgcaagatcgagtcaatcttctgaagagattgtcaggtgatatacatgaggaggtggagactcataatcacatgttagacagaatgggcaatgacatggattcatctcgaggtgtcctatcaggaactatggatcgatttaagacggtttttgagacgaaatcaagcaggagaatgtttacacttgtggcgtcctttgttgttattttccttgtagtgtactatctgactaggtaataagtcttatgagatggtgatacagttgcttgcagtcatgttagaactggatcctttaatgtggtttccgtaatcaatggtacttcccgtctgctagataatcgggcatgtttatataaagatgtccaaatatgtcaaacatgttttgaatgtatggtatggatataaaaaaaaaaaaaatctttgctcctttttcactt

SEQ ID NO: 5368 - DNA, 1110 bp, Ricinus communis
caccgggacccaatccacaaagtttcactctctatctatataagaaaaagtataaaaatcctaccaagccacttcatcttccgtatttttccccattcactgtctactcagcaggagaaagtttccagcttccctccaaagaacggaatagaagcagataaataacagattatcgtgatctttcggccatgaattctagaagagatgtccgtaccagtagaactgctctatttgatggcattgaggagggtggcatccgggcctcatcttcttactcccatgaaattgatgagcaagataatgaaagagctatggaaggtttgcaagatcgagtcattcttctgaagagattgtcaggtgatattcatgaggaggtggagggtcataatcgaatgctagacagaatgggcaatgacatggattcatccaggggagtcctatcaggaactatggatcgatttaaaatggtgtttgagaccaaatcaagcaggagaatgtttacactcgtggcatcgtttcttgtcatattccttattgtatattatctcactaggtgataaaatttaagatggtgatacaggtactagtcctaagtttgaactgtactcgattttatgtggttgctataatcaatggttattcctgctcgtgagatgtgcaggggtttatgtaaagatgttgcaatacatcaaacgcttgttgactgtatggaataggtgcatgttcaatctcatgtttcatttcagtctgcttaaccttcaatgttaaatgcccagctgcacagttcagtcaagcttatccagtttaggctttagctgacgcgagtctggtgaaatcaatagctgtatggtttagctcatattgtctttggagtatcgtcaatggtttgaggttgagcatcatcaataaatgaaacaattatgtgtttcttttgctggttctcaggtgggaggaaaactgaatattaaacagagttggttcggttattttataattttagttggattgattttgcattttgaaaagttaaaataattttagtatgcttcgactttgatcaaaactctaatactgctgtaactgaaattctatattttgcagtaaaatata

SEQ ID NO: 5369 - DNA, 615 bp, Catharanthus roseus
tttgcgctaatcttcgggccaatagtcatcggaaaacaccaactgcgccactttttcaccgccgcagtggcaccaaagttctgtaaccttgaagctgttttttcggtgttgttggtgtaagagtgatctgctgatttagctatcaagagctatgaactctcgaagggatcgtaatggtagagctgcactttttgatggtattgaggagggtggcattcgtgcttcatcttcttactcctctcatgagattgatgaacatgagaacgaaagagcagtggatgggctgcaggatcgagttaatctgctgaaaatgatatcaggggatatacatgaggaggtggagaatcataaccgtatgttggatagaatgggtaatgacatggattcttcaaggggaattctggccggaacaatggacaaatttaagatggtattcgagaccaaatcaagcagaaaaatgtttacacttgtggcatcttttgtggttatttttctggtcgtatattatctcactaggtaatagctggtcgggacttgtacatctgccctgttcttatgcatgtagtgtgctcctattcactttgttaccataatcagtatcattgccagttgtaa

SEQ ID NO: 5370 - DNA, 753 bp, Coffea canephora
ggtagccggtcggttcttcttccgtgtcaagtctccgtgctgaattactaaccgtaccataggataagaagaaaaaggggcaattagttgcttcaaactcgtgagctgctgggcattatctgaatctccatgaattctcgaagggagcgtaatgctagagctgcactttttgatggcattgaagaaggtggcatcagggcttcatcttcttactcctctcatgaaattgatgagcaggagaatgaaaaagaaattgatgggttacaggatcgagttaatctgctgaaaagattgtctggtgatatacatgaggaagtggacaatcataaccgcatgctggacagaatgggtaacgatatggatgcttcaaggggaatcttagcaggaacagtggacaaatttaaaatggtatttgagaccaaatcaagcaggagaatgtttacactagtggcatcatttgtggtcattttcctggttgtatactacctcactaagtaattggggttgagagccggtgcattttctagaaccatgcatagaacttcctggcatctttcctgatcatatgtacttgtatacaagaatagcagtgctttcttcactttgttaatgtaatgaacaccagcaccagttgtaagatgttgccatatgcatgcctatgtaaaaaatgttttggtgcactgacctttgaacgtgtgcaatgactattactatcctgcgctacacctttgatggaatatgcacgcatttttc

SEQ ID NO: 5371 - DNA, 746 bp, Euonymus alatus
gcatccatggtcccacaccacaacacggcctttcacacccagacggacaggcagactcgtctctcgcctggtgtttataaatctctcgccactccctctcctttcctcctttgtcagtctgcttccagaggtttccctccacagactaggtttggatcgttgacatctgaggttggttgcgtgacaagcagtggaagggtgtagatccggtagtgaatcaatccatgaattctaggagggatttccgtggcaataaagctgctctttttgatggcatcgaggaaggtggcatcagggcatcagcttcttactcccatgaaattgacgagcatgataatgaaagggcattagaaggattgcaagatagggtcattctgcttaagagactgtcaggtgatataaatgaggaggtggatactcataatcggatgctagacagaatgggaaatgatatggatgcatctagaggaatcctgtcagggactatggatcggtttaagatggtatttgagacgaaatctaacaggagaatgcttacgcttgtggcatcctttgtggtaattttccttatcatatactatataactaggtaacgttgtatgtgcaatcaatccacgattgattggatgctgctgctagctttatattaggactgtgactgtgactgccgtataaaactaatctcatgcttgtaagatgctttggcatgtttgtataaatacgttccaatatgtcaaacgtgtgtt

SEQ ID NO: 5372 - DNA, 475 bp, Euphorbia peplus
ccatatatgattcccagaagagaggtccgtaccaatagagctgccctctttgatggcattgaggagggtgggatcagggctgcaccttcttactctcatgaaattgacgagcaagataatgaaagagctttagaaggactgcaagatcgagtcaatctactgaaaagattgtcaggtgatataaatgaggaggtggacagtcataatcgcatgctggacagaatgggcaatgacatggatgcatcacggggaatcctatcaggaactatggatcggtttaagatggtgtttgagaccaaatcaagtcggagaatgtttacactcgtggcttcttttctcgccatatttcttattgtgtactatctgactaggtgatgaaagtaacggtgatacagctggttgcctaatgttagaactggaccctgttttatatggtttatgttaacaataggacttcctgcttatgagataattt

SEQ ID NO: 5373 - DNA, 792 bp, Linum usitatissimum
gacgaagagataaactgtcctcatcagtagataaaggatcacatacgaaaaccctcaagtgttcggtgttcccctgtaaaattccatcgtgcctctgccttcaagttttccgtcaattctttagcagctaaattgttcattttctggaaccgtgatcgtccgtttgagccatgaattccagaagagatgtccgaaacaacaaagtagctctctttgatggcatcgaggagggtggaatcagagcttcttcttcttactcccatgaaattgatgagcaagacaatgaacaagctctcggaggtttgaaagacagagtcaatctgctgaaacggctatctggtgatatacatgaagaggtggaggggcacaaccggatgcttgatggaatgggcaatgatatggatgcatccagaggagtcctgtcaggaacgatggatcgtttcaagacggtattcgaaacgaaatcgagcaggagaatggctacgctggtggcatcatttgtggtgttattcctgattgtgtattatctaactcggtgatgttagcattatgggagggtttgaaatcggagcacctgtataataatatatcgtttctttgtggttacctcctgtcgttccaaacttggcttgttttgtgcagatatgttgtgttctggctaggcttgttttgtgcagatatgttgtgttctggctagctgtaaaaacgaagaaaaagaaacagcgtttgcttctggactttggctgtgttctgttcataatcctcttgtaaagaaagtgaaatttatgtgtc

SEQ ID NO: 5374 - DNA, 696 bp, Fraxinus spp
gactgttgactggagttacatttctgtacttttgctgcttccctccgtcggcacgcaattataactagtgaatcgccgcgatattttcataatcccagagtattctacagatatttgccacagccatgaattctagaagggaccgtaatgctagaactgctctgtttgatggtacagaggaaggtggtataagggcttcatcttcatattcctctcatgaaattgatgagcaagagaatgatagggcagttgatggattgcaagatcgagttaatctactgaaaagactttcgggtgatgtacaggaggaggttgagactcataatcgaatgttggaccgaatgggcaatgacatggatagttcaagaggagttctatccggaaccatggataaatttaagatggtgtttgaaaccaaatcaagccgcaggatgtttacactcgtggcatcttttgtggttattttccttgtcgtatactaccttattagataagagattaaataaattggctagaggatgctcaatgtcgttacatggctgtgagatgtcatatccttcttgtgtttgtagagatgtttcggaatgcaacatgcacttgaatgtatgggatggacagagagacattttagtatatcttttggaaaacatgtaattgttcaattttatgtcagttgatatggctttacctattcgc

SEQ ID NO: 5375 - DNA, 637 bp, Tropaeolum majus
tggaaataggccaggattttttttttataaccacttctgcaatcgaaacgactaaccaaactacatattcagatcctcactacattttaccatttcctgatttccctgctaatctgcttaccaagagaaaatccatcttccctcccgagacactatttgtaaagcatcggataattggaagtaaaagccatgaaccctagaagggacttgcgcaacaatagagctgctctttttgatggcattgaggagggtggcatcaggcagtcatcttatgcttctcatgaaattaatgagcatgataacaatcaggcaatggaaggactacaagatagagtccttctgcttaagcgactatctggtgacatacacgaggaggtggaaacccacaaccgcatgctggaccgcgcgggaaatgatatggactcatcaagggggattctgtcaggaactatggaccgttttaagacggtttttgagacaaaatcaagcaggagaatgtttacactggttgcatcgtttgtagtaattttcttagttatatactacctcactcgttaagaatgtacataatatcattcaagaatcggtttttatgtgattactgtaaacaatatgtgtttcaaatatgctcaatgta

SEQ ID NO: 5376 - DNA, 785 bp, Nicotiana benthamiana
tttggttttcctaatcttcccgttataagcaaaaggattttagagtcctatttcacccctcaaaaactacagtgtctccgtttggcgataatctgcaggcattttccacctaaatttccagcagatctgaaattcttcgttttcgataattcgctgtatacttcatttttgtgtttcgaagtttcacatcattcctagtgcgacctccaatctctgctagccatgaattctcgaagggaacgtagcaacagagcagcactatttgatggaattgaggaaggtggtataagggcttcatcgtcatatgcttcacatgaaattgatgaacaagagaatgagaaagcaatggacgggttgcaagatagagttaatctgctgaaaagattatcaggtgatatacatgaagaagtggagacacataataggatgctggacagaatgggtaatgatatggattcttcaaggggagttttagctggaacaatggataaatttaagatggtattcgaaaccaaatcaagccgaagaatgtttacacttgtagcctcatttgtggtcctctttttggtggtatactatctcactaggtaattagcattgtgaactagaatatgttagtggttttgtgtgcagaaagaaatgctgtttttactcaaaattctgctgccaattcctcaatgtaagaattttgtgacttgtgggtctgtgtaaaagatgtttttggtgcaacagatgcttttcagcgtgtcaaatggaatatcagtgctatgcagttaaacatttta

SEQ ID NO: 5377 - DNA, 944 bp, Solanum tuberosum
tgaatactgtttcaactaatttatccaaaaataaaataaaatgtcaatttctgtaatcagctaggtatttatagtgtcagtaattcttctccggccctttcacctcctagtgctactcctctccgccgtcgccgccgccgccaccggcgttgttattcagctccagaatattttgatctatttttgcgattaacttgaggattagtgattcctgatccaccggaaaaaaattcacatcaaccggagtttcaaattgaatagattgatcattggcagatatgaattcacgaagggaacgtggcaatagagctgctctatttgatggaattgaggaaggtggcataagggcttcttcatcatactcttcgcacgaaattgatgaacaagagaatgagagggcaattgatgggctgcaagatagagttagttttctcaaaaaattgtcaggtgacatacatgaggaagtggatactcataatcggatgctcgacagaatggggaatgatatggattcttcaagaggtgttttatctggaaccatggataaatttaagatggtatttgagacaaaatcaagccgaaggatgtttacactcgtggcctcgtttgtggttctttttctggtggtatactatctcactagataatatgctctggtcttatgttatgttgttcagactctccaaaaatgctaccacaaccatgtcggatccgctaaaaatgcaccattttgtaggatccgacacacatttttgaagagtccgagcaacataggttttatgtgcaaagttgctgagattctgatattagaattactctcactgtaagaatgttccgacgtgtgtatctgtgtcaagatgtttaaatacaacatatagttttgaagatgtggatctgtataacactatcattcacatatattgatatgcaatgcaacttttgtt

SEQ ID NO: 5378 - DNA, 603 bp, Rosa hybrid cultivar
cctccaaacgtgactcaaatccaaagatcaaagcagcagcgaagggattgggtcgctatcgttcactgtgagccatgaatgctcgaagggactaccgcaacaacaaagtcgctctttttgatggcattgaggagggtggcatcagggcctcatcttcctattcccatgaaatcgatgagcaagataatgaaagggcagtggaaggattgcaagatagagtcaatttgctgaagagattgtcaggtgacatacatgaggaggtagagagtcataatcacatgctggaccgaatgggaaatgatatggattcatcaaggggaatgctatccggtacaatggacaggtttaagacggtttttgagaccaagtcaagccagagaatgtttacactggtggcatcatttctggtcgtctttctagttatatactatctcactaggtaattgatccatgatggaattgatacagccaccggatttaccttgaacatggaagatgcttgcttttcactgtaatcaatgttttactttcttctgtcttgtaagatattctggtattttactgtaaagagatttaagatgtatgacatagaagttggttgcc

SEQ ID NO: 5379 - DNA, 801 bp, Fragaria vesca
gtaactgaaagtgaaggatcaaagcaggagcgaagggactgggttgttatcgttcactgtcagccatgaatgctcgaagggactaccgcaacaacaaagtcgctctttttgatggcattgaggagggtggcatcagggcctcagcttcctattcccatgaaattgatgagcaagataatgaaagggcagtggatggattgcaagatagagtcaatttgctgaagagattgtcaggtgacatacatgaagaggtggagagtcataatcatatgctggaccggatggggaatgatatggactcatcaaggggaatgctatctggtacaatggacaggtttaagacggtttttgagaccaagtcaagccagagaatgtttacactggtggcatcatttctggtcgtctttctagttatatactatctcaccaggtaattgatccatgatggaattgatacagccaccagctttaccttcaacatgaagatgcttgctttcactgtaatcaatatttactttcttctgcctgtaagatattttggtattttactgtaaagagatttaagatgtatgaaatagaagttggttgccttatcactaggttatttcggacaaactctgggttcctgtagtacttgcttgagttgtacagttagtcgaagtttagtaacggtttatggatgtctagaaccctaggtgcagtagctaatttaaggtttgtaaaagcttcgcccccggtgagcttacctcatcatcttaagagtcattcaagcaccttggtggattctagacctccggtcat

SEQ ID NO: 5380 - DNA, 1216 bp, Vitis vinifera
ggaaatgggaaactgtatcattcatcatttttgagattcatcttatcaatttgaaaaggctgtctgcatcttgcaatgctggaaagacacaaacttccattgaaagttaatctatttataattgtttcagtttcttgaacaacaggatgaaaataaaccatgggattaccgtggcaatagaattgccctttttgatggcattgaggagggtggtatcagggcctcatcttcctactcctcccatgaaatagatgagcatgataatgaaagagcagtggatggactgcaagatagagttaatctgctgaagcgattgacaggtgatatacatgaggaggttgagagtcataaccgcatgctggatcgagtgggcaatgatatggatgcttcaaggggaatcctatcaggaactatggatcgatttaaaatggtatttgagacaagatcaagccggaggatgtttacacttgtggcatcattcgtggttatttttctaatcatatactatctcactaggtgaaaaacctatggtggatgtgatacagctgctagctttctgttagaactggggagacttttccatctgtttttactgcatgtaagatactccgatttgagagagtttgtgtaaaaaaaatgtttcaatgtattagatgggtattggatgcatcatgcacaaagcaggtagtagtttactagtttatatgccattggagcatacctgcaatttggacggaagcatcatcctcacctttccggtttattacttttgggtgtatttctttggggcagttaagtcatgcagagcccaaatgggacaggccttgttctatttacaccagttaccggtttgtttgagtttagtcgaagttagaatggtgtgcagtctgggcttacccctagcctgatctcagcaatttgatccgcttaattatgtatatcagtggggcttaccattacattggctgtgaactttctgggtaaatatatatggacaagatctgcaaataaccaaaggtcttttttaacacctttggcttctctttttacaagtttagaattcctgactgaatttatacagaaagttggaacttgggcaaaatatatcatcttgccaattggctgactgaatcgatgcatcatcttcccaattggcagaattggaaaaagggtaccaaaataaatctccttcccagttggcagagttggaaaaagg

SEQ ID NO: 5381 - DNA, 629 bp, Chenopodium quinoa
attcctcttaattttggtgtgcatttgtttaatggataaacagagtatcaatctcaaaaggagaattctcaggttcagaccactggaagcttgatcacttgtaaactgcgttaattgattcaccatgaatccgagaagggattatagagggtcaagaacttctgcttttgatggcattgaggagggaggtatcagggcctcatcctcgtattcctctcatgaaattgatgaacatgacaatgatacagcacttgatgggttgcaagatagagttaatcttctgaaaagattaagtggtgacataaatgaagaagttgatgctcataaccggatgttggacagaatgggcaacgaaatggatgcatctcgaggatttttgtcaggaactgtggatcggtttaagcaggcattcgagaccaaatcaagcagacgaatgttcactcttgtggcctcatttgtgttcttttcttattatctactatcttactagataatccaaatagctaaaattgatactccgtacaactccaggctttttatctgaagtgagtcgctgcctcaagtcttttctttctcagttgccgtgttttctaatttctatatgaaattggtacagcagattgtaaaaa

SEQ ID NO: 5382 - DNA, 955 bp, Arachis hypogaea
taatgcatttctaactttctcatctcttctcttctcttctcttcgattcgatttacgtaccttcaccaccgcaacgttttccaccttctagaatcttcttctatctccttccggattattcctcagatctggtttctctttcactcttctctgcattctcctcgtttcttccatttcctctcttaattttttcacttaatttcactgataattagctctcattccttctgtttcatttatatcattcattctgaacagagatcgcaccgtccagagtagtggaatctgttgatctggtgaaccatgaattctagaagagacgcccggaacagcagagttgctctgtttgacggcattgaggagggaggcatccgagcatcatcactttactcctcctataatgaaattgatgaacaagataacgagcgagcaatgggtggattgcaagatagagtcagtttgttgaaaagaatctcaagtgatatacacgaggaggtggatagtcataaccggatgctggaccgcatggggaatgacatggattcttcaagaggagttctttcaggaactatggacaaattcaaaattctttgagaaaaaatccagccgaagaacgttttcacttatagcatcctttgttgtgcttttccttataatatactatttgactaggtaattgatctatattagaccccgtaggaggtttacttgctctatcactgtaattaatgttgctactttttaagatgttatttgtttgggtttttttggacgtttgaaaatggtatcgaaacaaatgagaaatgtgcatatcaatcaagtttgtgaatatttccctatatcagtgcaccataatcaagtttgtacgtttctttttcttcgggtatgaattttcattgtgtattagaaggtcgagtataattagttatgaattatgaataaaagtagcaatgtc

SEQ ID NO: 5383 - DNA, 769 bp, Mimulus guttatus
tccgtcttcttttcatctctctgcattttccccatttcttgtggttaagttcagcagtttaattgttctgaggattacggtgtttttagctgcggcggtgtgatcgttgtttcagttagctgaatccggatactccgatccccaacagcaatgaattccagaagcttcagggatcgtaatgcgagagctgctctttttgatggcattgaggaaggaggtataagggcatcatcttcttactcgtctcacgagattgatgaacaagaaaacgagagggctattgatggactacaagaccgagttaatctgctgaaaaggttgtcaggtgatatacatggggaagtcgagtctcataaccatatgctggatggaatggggaatgacatggatgcctcgagaggagttttatctggaacaatggataaatttaagatggtgttcgagaccaaatcaagccggaggatgtttactcttgttgcatctttcgtggttattttccttgttgtatactatcttactaggtaagtggtcatttttggtgatgagtaggaccgacgtacttgtgtagtactgcaattttaaaactgctttactagcaattcatctatgctatgcctggtcgacagtgctcgtgtacaacatgcactcgaaaattgaaatgatataccattgtaaaggaggttcaagcatagagtatgttttttttttaaataataagcatagagtatgttggcgtatatctggagatatataaatcgaactttggtgt

SEQ ID NO: 5384 - DNA, 772 bp, Olea europaea
aattacgacaagtgagtcgccgcaagattctctatcatccctgaacattcttcagatatcccgatcgtcatagccatgaattctagaagggaccgcaatgctagagttgctctgtttgacggtatagaggaaggtggtataagggcttcatcttcttattcctctcatgaaatcgatgagcaagagaatgatagggacgttgatggattgcaagatcgagtgaatatgctgaaaagactgtcaggtgatatacatgaggaggttgagacccataaccgaatgctggaccgaatgggcaatgacatggatagttcaagaggagttctatccgggaccatggataaatttaagatggtgttcgaaaccaaatcaagccgcaggatgtttacactcgtggcatcttttgttgtcattttcattgtcgtatactaccttattagcaagtaaaagaaaatggaagaaggaaaaagaagtatctgcactgcagctgtaatttggtgaagcttaagaatggatggatttgttccaagcagcagtttctactgaatctgttattagtgttttttgtggtaatagctttggtagagtcgttgaaacatttcagtgctaaaggtccagaacctctctgatgcttcatgctcgtgtgtttgtatatgtgtgcgcacgtgtttatagattccgtattgtcttttggaacagacgaaaatctgtgtaatggtacatattaagtgcataatctgaaatgctggcactaaagtgccccttttctaga

SEQ ID NO: 5385 - DNA, 846 bp, Amorphophallus konjac
tccaacgctgcaatcggcttccgccgccgatctccggcgcccggcgaccatccgccgccgcagcagagagtgagaggggacagccgagcgtgctgtttcacttgttcggcaaccgaggcggtgtttccaggaaggagacaagtctccggtcccaggatctggaccttgcgacgaggaaatgaattccaggagagattatcgcagcaatagagctgctctgtttgatggtatcgaagagggtggaatcagagcctcctcatcctacagttcacatgaaatcgatgagcatgagaatgacagagctcttgatggcttgcaagatagagtcaatatactaaagagattgactggagatgtacatgaagaggttgagagccataaccgtgtattggatcgcatgggcaacgacatggatgcatcaaggggagttctctctggaactatggatcggttcaagatggtgtttgagaccaagtcaagtcggagaatggctacactcgtgggatcttttgtggtacttttcttgctcatatactatttgaccaagtagctgctgcaagtgaaactagacaggctgcaacatgtggcctcgtgtgactttaaaggtccttgcggttcaacttcttcccgtctcctatgcgaatattttcagtgtgactggcaaatatatgattgtatgtggcctcgcgttgttcgtggctcaaagagtactaaatagtagaattgctatattgtgctggaactagaaaaagtaattaagatgatcctggaaacgactaccaggtgaacttgtattgattgcttgcatgtggtggtctatggcacccactaatctctttttcatgg

SEQ ID NO: 5386 - DNA, 884 bp, Amorphophallus konjac
cggccgggggactcctctcggggaaatctgcgggaaacccaacagttcgttctcaccggcattaccccggggcccccttcccgccctcgatctccgcaatcagcctctgccgatcgatgtctgtcgccggcggcgaccgccactgaatcagcggaggtccgcgatttgaaagtcgggctgccgttgaatgataattgggagagaggtatctaggtcctgaatgatcgaagaacaagaggggagatccaagtttgatgcttaacttctttaggatctgagtgggaaggaaaattaccagctacataatctttcagcgagaagatgaattcaaggagagactatcgcggcaatagagctgctctctttgatggcatcgaggaaggtggaatcagggcctcctcatcctacagttcccacgaaattgatgagcatgaaaatgatagtgctcttgatgggttgcaagatagagtaaatatactgaagagattgactggtgatgtacatgaagaggtcgagagccataaccgggcattggatcgaatgggcaatgacatggatgcatcaaggggagttctttctggaaccatggatcgattcaagatggtgtttgagaccaaatcaagtcggagaatggctacactcgtggcatcttttgtcgcactgttcttgctcatctactatttgacgaagtagcagcgcgtggaactttaagctacagaatttgatcacctaatacttaagggcctgtcgttctgttaatatgtgcattcggatgctttcttcagtatgatcgctttctatgtgaattaatacctgtttgaataggggttttgcatgtgtagcacatatactactactagaaatgaaggtacagacttgccgtt

SEQ ID NO: 5387 - DNA, 1064 bp, Amorphophallus konjac
cggccgggggactcctctctagggtaaatctgcgggaaacccaacagttcgatctcaccggcattcccccggggcccccttcccgccctcgatctccgcaatcagcctctgccgatcgatgtctgtcgccggcggcgaccgccactgaatcagcggaggtccgcgatttgaaagtcgggctgccgttgaatgataattgggagagaggtatctaggtcctgaatgatcgaagaacaagaggggagatccaagtttgatgcttaacttctttaggatctgagtgggaaggaaaattaccagctacataatctttcagcgagaagatgaattcaaggagagactatcgcggcaatagagctgctctctttgatggcatcgaggaaggtggaatcagggcctcctcatcctacagttcccacgaaattgatgagcatgaaaatgatagtgctcttgatgggttgcaagatagagtaaatatactgaagagattgactggtgatgtacatgaagaggtcgagagccataaccgggcattggatcgaatgggcaatgacatggatgcatcaaggggagttctttctggaaccatggatcgattcaagatggtgtttgagaccaaatcaagtcggagaatggctacactcgtggcatcttttgtcgcactgttcttgctcatctactatttgacgaagtagcagcgtgtggatctttaagctacagaatttgatcacctaatacttaaggggctgtcattctgttaatatgtgcattcggatgctttcttcagtatgatcgctttctatgtgaattaatacctgtttgaataggggttttgcatgtgtagcacatatactactactagaaatgaaggtacagacttgccgttgtgagaaaggcgtctgcatatgcatcatcattccaagtatgcgccgatctgatgcctatatcaaattgtcacccggttttgataatagaacacggtaaggcaggttagggtaagcctgagaaaggtattcgagggtaaccaagtttaaccatgaatcatcggacatgttctttttctg

SEQ ID NO: 5388 - DNA, 732 bp, Manihot esculenta
tcaccttcctctttcccttattcctactgtctactcagcaggggggaatttcccagcttcgcctccaagtgtttcaatttcaattttgcttcatcggaacagaagcaatcaagcaaatagatacccgtgatcgttagaccatgaattccaggagttacatagatcatttatgagggtgtatggtgcaaaagaaggtgaatacagtgggattgcaccgatggactgcatgcctattgaatacattctcataccggtaaactagaccagttaacctctgtgtctgttgggagcagagtagaattgctctattcagcatgatgaagaaagatctccgtaccaacagagctgctctttttgatggcattgaagagggtggcataagggcctcatcttcatactctcatgaaattgatgaacaagataatgaaagaggtatggatggattgcaagaccgagtcaatcttctgaagagattgtcaggtgatatacacgaggaggtggagactcataatcgcatgctggacagaatgggtaatgacatggattcatctaggggagtcctatcaggaaccatggatcgatttaagatggtttttgaaacgaaatcaagtcggagaatgtttacccttgtggcgtcctttgttgtgatattccttattgtatactatctgactaggtaatcaatcaaagatgatacagttgctagcgttgtgtcactacttggatccttcc

SEQ ID NO: 5389 - DNA, 825 bp, Cleome spinosa
gggatctgcgcttgtaaaggtgacatttccttctccgctttggaagaattttcaaattccggaagcttcttagttctccatctcatcctcgcgttcttgcgccgtttgcgtgctgggaaccgcagatccaggtgaaattcgggagagccagagatttctacgtcttcgttcgattgatccatgaatcctagaagggaccatcgtgggacaagaagttccgtcttcgatggaatcgaagagggtgggatcagggctgcaccatcgtactcccacgaaatcgatgaacacgataatgaacgagccttggatggattgcaagaccgagtcaatcttctgaaacggttatctggtgatataaatgaagaggtggagacccacaaccgcatgcttgacagaatgggaaatgatatggattcgtcaaggggaatcctctcaggaaccatggaccgattcaaaacggtgtttgagacaaaatcaagcagacgaatgttgacactcgtggcgtcgttcgtggctctattcctagtcgtatactatcttacccgttaatccgcagcgtaaaaagggctcttgatcttcatcgtgcttttgaagctgaatgatagttgttcactcggttcacggctcttacaagatatatacatatcatatatatccgttttgtaatggctattatgctttcagtgttagatagatatagtcgtgggggatgataatacagtggtgttcatacgaatggaaaagaacataagacccgtttcgagtttttcggagatatatctgtatattgtccaaacatttacgaggaataaaaacaatagtggg

SEQ ID NO: 5390 - DNA, 683 bp, Cynara scolymus
  misc_feature (12)..(12): n is a, c, g, or t
  misc_feature (56)..(56): n is a, c, g, or t
  misc_feature (479)..(479): n is a, c, g, or t
  misc_feature (618)..(618): n is a, c, g, or t
  misc_feature (635)..(635): n is a, c, g, or t
tggttctcttcngttttcccacagaatctaaacactgacggttgcgtccaccgatntggtatcgttagctatgaatactcgaagggacttccgtggaaacagatctgctctctttgatgaaattgaagatggtggtattagggcctcttcttcttactcctcccatgagatagatgaacatgagaatgaaagagcaatggatgggctgcaagacagagttcttatgctgaaaaggttgacgggagatatccatgaagaagtggagggtcataaccgcatgctggatagaatgggcaacgatatggattcatcaagaggtatcctctccgggacgatggataaattcaagatggtattcgagacaaaatcaagccggaggatgtttacgcttgtggcctcgtttgtggtgggtttcctagtcatatactatctcactaggtaactcgatgatcggttgagccatgtttcaaaacctaccnatgatgctcttatgatctgtggttctttatgtaaagaaatcttgatgaaatagagtttcgtgtactggataaaaatcgttgtttgtatactgtttcttgtgtttttcgttatcgttctctctttcatgttctccatatnttgtactcgcaattctntatttttccgtctcaatggtatagtttctcgattttgttcgtgtttgc

SEQ ID NO: 5391 - DNA, 646 bp, Petunia hybrida
accagtcccgttttagagatcaggtgcaggatactaagtaacagtgggtttcgtcttgtgatccaccacaacctccaatcatgaattctcgaagggaacgtagcaacagatcagcactttttgatggtattgaggaaggtggtataagggcttcgtcatcatatgcctcacacgaaattgatgaacaagagaatgagaaagcaatggatgggttgcaagatagagttaatcttctgaaaggattatcaggtgatatacatgaggaagtggagactcataaccggatgcttgacagaatgggtaatgatatggattcttcaaggggagttttatctggaacgatggataaatttaagatggtattcgagacccaatcaagccgaagaatgtttacacttgtggcttcatttgtggtcctctttttagtggtatactatctcactaggtaattagttttgagaactgggatttgtagtggttttgtgtgcagagagaggatgctgtttttactcaacattctactgtcatctctgtgtaagactcttgtgacttgtggttccgtgtaaaaatataatgccacagatacttctcacttgtgaggttaagcctttgaaagttttatttcaggcacctaacttgattgaca

SEQ ID NO: 5392 - DNA, 821 bp, Lippia dulcis
cgttggtttacggcggcgtgatttttgttacagttgtctgtatccggatatttcgatctcctcagccatgatgaattccagaagggatcgtaatgcaagatctgctctttttgatggtattgaggaaggaggtataagggcatcatcttcttactctcatgagattgatgagcaagagaacgatagagcaatggatggactgtcagaccgagttaatctgttgaaaagattgtctggtgatataaacgaggaagttgaggctcataaccatatgctggatagaatgggtaatgacatggattcctccaggggagttttatctggaaccatggataaattcaagatggtattcgagacaaaatcaaaccagaggatgtttactcttgtggcatcttttgtggttcttttccttgttatatactatcttactaggtaagggttttggtgatggataatggacacttgtgtagaactggaacgctctatctgcttgtgaaatcacatcatcgttgctataagatgccatgttaagcctgtgtgaaaggtttgtatacaacctgtaccagaacacttggttttccatcttgtaaatattgatgtttttcatttagttaactttatggtgaaaaagattagctggtaaaatggttgtcaaaaaaatttagaggttggctgttatataactagttggtctaatttgcatacatatttaataagattcccaacccactataccaaattaagagttgtatcctttcctcctcaatatctaacccctaccatcacggcgtggagtatggtttgtctttgaacaatctgga

SEQ ID NO: 5393 - DNA, 586 bp, Plantago ovata
acttagctgtttcgtgatccaatacaccgatctcctcagatatgatgaattctagaagggatcgaaatactagaatggctcttttcgatggaattgaagaaggaggaatacgagcatcagcatcttattcccatgagattgatgagcaagagaatgagagagcagttgatgggctccaagaccgtgtcaatctactgaaaagattgtctggtgatatacacgaggaagttgagtctcataaccacatgctagacagaatgggaaatgacatggatgcttcccgaggaattctgtctggaaccatggacaaatttaaaatggtgtttgagactaaatcgagcaggaggatgtttacgcttgtggcatcatttgttgttgttttccttgtcgtatactatcttactaggtaagttttcaatagttgatggcaggtcaatcttgaaacttctgtataactggaacaatgagcagtccttaaagtggaagtcgtatactgtggttgtaagatgtttgtgcgtgcaaatatatgttccaaggcaacatataatcaaatgatttgtccttcaatgatatatagtaacagtta

SEQ ID NO: 5394 - DNA, 615 bp, Tripterygium wilfordii
ctttacaatcggactcgtagatcgcttgatgtttataaatctttcgccactccctctcctttcctactcttcacgttgtctgcttccagaggtttccctccacagacgaggagaggattgttgaaatctgagattggttgcgtgagaagcagaggaagggcgtagatcctgtaatgaatcaatccatgaattctaggagggatttccgcgccaataaagctgctctttttgatggcatcgaggaaggtggcatcagggcatcagcttcttactcccatgaaattgacgagcatgataatgaaagggcattagaaggattgcaagatagggtcattctgcttaagagactgtcaggtgatataaatgaggaggtggatagtcataatcggatgctagaaagaacgggaaacgatatggatgcatctagaggaatcctgtcaggcaccatggatcggttgaagatggtattcgagaccaaatctagccggaaaatgtttacacttgtggcatcctttgtggtcattttccttatcatatactatataactaggtaatgttgtgtaagactgtaatcaatgaacgatggattggatacagctgctagctttatattag

SEQ ID NO: 5395 - DNA, 1142 bp, Vigna unguiculata
gggtcgtggtgatgatgaattattagaaacatttcagcttccataatccgcgaggtaaacgacggtgccggttggtaggtgacgcctcattgcactcatcgccatcgtcaccttcctaaaacgacgtcgcaccgatcacccctttcccttccccctctctcacagtcctaattttccaaaaaggagggccaatggcatcttcttcaaactcatggatgaaggaatataatgaagcactgaaacttgctgaggatatcagtggtatgatttctgagcagagttcatttcctgcatctggaccagaaatccagcgtcattcatctgctataaggaggaagattactatattgggtacccggcttgatagcttgcaatcgctattgtccaagcttcctggaaagcagccgcccatatctgacaaggagatgaatcgtcgcaaggacatgctcgcaagtttgagatcaaaagttaatcaaatggcttccacattgaacatgtcaaacttttcaaatagagatagtttgcttggaccagaaggaaaaccagatgctatggccagaactgttggcctggacaacaatggacttgttggatttcaacggcaaataatgaaagaacaagacgagggccttgagcaattggaagatactatagcaagcacaaaacatattgctttggcagtgaatgaagagctgactctacacaccagactcatcgatgacttggaccagcatgtagatgtcacagattctaggcttaggcgggtgcagaagaacttagcaattttaaacaagcgaaccaggggtggttgttcctgcctgtgcatgcttttatcagtgattggtatagtgtttttggttgttgtcatttggctattggtcaaatatttgtgatgacataatgaattacccaacttgtcaagcttctccttttgtctttgtttctgacgtgtgcactgaagtgtcataaccaagtttcccgatttcccttgctacttcctcaatgacatggaatttgttgaggtcgtgaaaggcgttgtattgcaattgacatatttaactgtttgtatatcgtgtgtttttctcttgtaaaatatgaaagatttattgctgtaatgttaatgtgccccactaccgcttcgt

SEQ ID NO: 5396 - DNA, 1253 bp, Glycine max
atgtgtttctagttcctaagataaagaaaatgctcgagaaaatgacaccgaaaatgacgtcgtggtgaatgaattattcgaaacctttcatcttccataatcccgcaaggtaaacgacggtgacgattggtgggtggcgccgtacgcctcatcccatccatcgccatcggcaccttccttaaacgacatcgcgtccatcaccccttttctcttcctcacagtcacagcagtggtagcttcccaaaaaagagtgccaatggcatcttcttcagactcatgggtgaaggaatataatgaagcactgaaacttgctgatgatatcagtggcatgatttctgagcagagttcatttcctgcatctggaccagaaacccagcatcattcatctgctataaggagaaagattacaatattggggaccaggcttgatagcttgcagtcccttttgtcaaagcttcccggcaagcagcccatatctgagaaggagatgaatcggcgcaaggacatgctttcaaatttgagatcaaaagttaatcagatggcttccacgttgaacatgtcaaactttgcaaatagggatagtttgcttgggccagaaagaaaaccagatgcaatgaccagaatggttggcctggacaacaatggacttgttggacttcagcggcaaattatgaaagaacaagacgatggccttgagcaattggaagagaccgtggcaagcaccaaacatattgcattggcagttaatgaagagctggatctacacactagactaattgatgacttagaccaacatgtagatgtcacagattctcggcttaggcgggtgcagaagaacttagcggttttaaataagcgaaccaagggtggttgctcctgcatgtgcatgctattatcagtggttggtatagtggctttgattgttgttatttggctattggtcaaatatttgtaatgtataaatacccaacttggcttgagtctgcttttcatctttgtttctgccgtgtgcactaaagaatcataatcaggtttccccatttctcttggtacttttccaatgcaatggaatttgttgaggtcgtgaaaggcgatgtattgtaattggcatacttggtgttttatatatcgtgtgtttttctcttttacaaatatgaaagtgaatgctactggctggagtatcaatgtggttgagttttcacacatttctctgttagattgtgctcaagtattatgtacgtgatttgcattaa

SEQ ID NO: 5397 - DNA, 1153 bp, Glycine max
gaaaatgacgtcgtggtgaatgaattattcgaaacctttcatcttccataatcccgcaaggtaaacgacggtgacgattggtgggtggcgccgtacgcctcatcccatccatcgccatcggcaccttccttaaacgacatcgcgtccatcaccccttttctcttcctcacagtcacagcagtggtagcttcccaaaaaagagtgccaatggcatcttcttcagactcatgggtgaaggaatataatgaagcactgaaacttgctgatgatatcagtggcatgatttctgagcagagttcatttcctgcatctggaccagaaacccagcatcattcatctgctataaggagaaagattacaatattggggaccaggcttgatagcttgcagtcccttttgtcaaagcttcccggcaagcagcccatatctgagaaggagatgaatcggcgcaaggacatgctttcaaatttgagatcaaaagttaatcagatggcttccacgttgaacatgtcaaactttgcaaatagggatagtttgcttgggccagaaagaaaaccagatgcaatgaccagaatggttggcctggacaacaatggacttgttggacttcagcggcaaattatgaaagaacaagacgatggccttgagcaattggaagagaccgtggcaagcaccaaacatattgcattggcagttaatgaagagctggatctacacactagactaattgatgacttagaccaacatgtagatgtcacagattctcggcttaggcgggtgcagaagaacttagcggttttaaataagcgaaccaagggtggttgctcctgcatgtgcatgctattatcagtggttggtatagtggctttgattgttgttatttggctattggtcaaatatttgtaatgtataaatacccaacttggcttgagtctgcttttcatctttgtttctgccgtgtgcactaaagaatcataatcaggtttccccatttctcttggtacttttccaatgcaatggaatttgttgaggtcgtgaaaggcgatgtattgtaattggcatacttggtgttttatatatcgtgtgtttttctcttttacaaatatgaaagtgaatgctactggctggagtatcaatgtggttgagttttcac

SEQ ID NO: 5398 - DNA, 1312 bp, Cajanus cajan
gtgttggaatccaacagaacaaaattcattgagaaaatgtccgaaaaggacagcgaaaacgacgccgtggtgaatgaagtatcagaaacctttcaccttccacaatcccaccaggtaaacggcggtgacagttggtgggtggcgccgtacgcctcattccatcaatcgccgtcgccaccttcctaaaacgacgtcgtatccaccaccctttcctattccaaaagaaaaacaggaccaatggcgtcttcttcagactcgtgggtgaaggaatataatggagcactgaaacttgctgatgatgtcagcggtatgatttctgaggggggttcatttcctgcatctggaccagaaacccagcgtcattcatctgctataagaaggaagattactatattggggaccaggcttgatagcttgcaatctcttttgtccaagcatcccggaaagcatcccataactgataaggagatgaatcgtcgcaaggacatgcttgcaaatttgagatcaaaagttaatcaaatggcttccacattgaacatgtcaaactttgcaaatagagatagtttgcttgggccagaaagaaaaccagatgcaatgaccagaactgttggcctggacaacaatggacttgttggacttcaacgtcaaattatgaaagaacaagacgatggccttgagaaattggaggagactgtagcaagcacaaaacatattgcattggcagtgaatgaagagctggatctgcacactagactcattgatgacttggatcaacatgtagatgtcacagattctcggcttaggcgggtgcagaagaacttggcagttttaaataaacgaaccaagggtggttgctcctgcctgtgcatgcttttatctgttgttggtatagtgcttttggttattgtcatttggctattggtcaaatatttgtaatgtataaagtacccaacttgtcaagcgtctccttttgtctttgtttctgatgtgtgcactgaagcatcataaccgggtttccgggtttcctgatttctcttggtacttttccaatgtcatggaatttgttgaggtggtgaaaggtgttgtattgtaattggcatattcaagtgtttgtatatcttgtgttcttcccttgtacaaatatgaaagttaatgtgttactgactggagtgatgatgtggtcgagttttcacacattgctatgttagattgtgctaaagtattatgtgtttgacttccattaatatcttgcaacttcaatgtgcaaccaccatgaagtactaaagttaaatttattacgagtcccattata

SEQ ID NO: 5399 - DNA, 1447 bp, Cicer arietinum
tctagacacacctcagtgcttaatattttaatctcaatatattctaaataagccaatctttttcatagatatttttatatatttttaatactaataaaaaatgaatattttccctttccttcctttttttcactttgtttccatttcaatttccaacaaacaaaaccaatgtggattctagtattctactagaccgagtgaacagaggtagaaaaaaatgataggtactaaaagaacagcgaaaacgacgccggattaattaattaattattcgaagcctttcaacattgcaacgtaaacgacggtgccgtttactggtggcgtcacgctaccttccatcgtcttccaaaacgacgtcgcatccttcagcttactcccactcacgatcgattcctctttaccccccttccaattatttacctctatcaacacaattcgacttctgaatcgtcaatggcttctaattcagaccagtgggtgaaggagtataatgaagcactgaaacttggtgatgatattagcagcatgatttctgagcagagttcctttcctgcatctggaccggaggctcaacgtcaatcatctgctataagaaggaagattacaatattagggactaggcttgatagcttgcagtcccttttgtcaaagcttcctggaaagcaacctttatctgagaaggagatgaatcgtcgcaaggacatgcttgcaaacttaaggtcaaaagttaaccaaatggcttcctcactgaacatgtcaaattttgcaaacagggatagcttgcttggtccagaagtaaaaccagatgtaatgaacagaattgttggcctggacaacaatggacttgttggatttcaacgacaagttatgaaagaacaagatgagggccttgagagtttggagcagactgtaatcagcacaaaacatattgcattggcagtgaatgaagagctgggtctacatacaagactcattgatgacttagaccaacatgtagacgtcacagattcccggcttaggcgtgtgcagaagaacttggcaattttaaataaacgaaccaaaggtggttgttcttgcttctgcatgctcttgtcagtcatcggcattgtggttttggttgttgtgatttggctgttagtcaaatatttgtaaccataaaataccctacttgccatgcaacttattgttcatgtttctgtatgtatgcactgaaacattgcaaccggtttgaaaggtgctgtattgtaattggcacatgcaagtgtttatataacgtgtgcctcttgtaaaaatgtgaatgtcgaaaactactgtgcttaagttatatgtaagcaaatgtgtgatttgggagtgaagaaatgttatgccgtgttatgttatgaatgtattgtattataactgcaaaagatggccacagcctgttcagcatgtatatgcaaggatgatg

SEQ ID NO: 5400 - DNA, 1228 bp, Lupinus angustifolius
aagttgcaaacagcaaatgacggaagacagatccagtaatccgtgtaacgcaagggacagcaaaaccgacgccgtgctttcgtagtctcgcgtggtagacgacgactcgctcaaactaacggtgccgtttcatccaccgccgtacgctatacttcacacctcgcgatcttcctgaaacgacgtcgttatcaatcatccacaactctcttcagaaacttactttccccaaaacgaatagttattttcaggccaatggcatcttcttcagactcatggatgaaggaatacaatgaagctgttaaactctctgatgatatcagtggcatgatttctgagcggaattcatttcctgcatctggaccagaaacccagcgccatgcatctgctatacgaaggaagattacgatattagggaccagacttgatagcttgcaatcccttctatcaaagaaccctggaaaatctgagaaggatatgaatcgtcgcaaggacacccttcaaaatttaagatcgaaagtcaaccaaatggcttcaacattgaacatgtcaaactttgcaaatagggatagtttgcttgggccagatataaaatcagatgcaatgagcagaacggttggcctggacaacagtggacttgttggacttcaacggcaaattatgaaagagcaagatgaaggccttgagaaattggaggagactgtaataagtacgaaacatattgcactggcagtgaatgaagagctgggtttacacacgagactcattgatgacttggatgaacatgtagatgttacagattctcggctgaggcgagtgcagaagaacttggccgttttgaacaaacgtacaaaaggtggttgctcgtgcttgtgcatgcttttatcggtggttggtatagttgtcttggttcttgtcatatggctgttggtcaaatatttgtaataatgataaaaatgccaactcttcatgcttctgtcttggatatgtgctttgaaacatcataactttgtttcatttttattcctgcttggctaatgacacggaatttattgaagtcttgaaagactttttttatcttaattgtcaaatttgaaggttttatatctgtgtggtcttgtaaagtatggaatcggaagtgactttccgttaatgcatagttataacaatttatttcgatggggatgggagaatagtcataatacttatggtatgtactttatatttatcc

SEQ ID NO: 5401 - DNA, 1255 bp, Cicer arietinum
aaagtgtgacactttttacctgtcacagagatacacgaacagacaagaaaataacccgcgtaggcgtagcacaaggtacatccataaacgacgctgcattcaacgacttttttccgtctctttcacatttcgtaaacgaccacccttcagacaaacggtaccgctcggtggtgccgccgttacgttgattccttcttaaaacgacatcgtatcgatcaatctcatcgaagatcatcttttctaacattcacgaaaccctaattcagataaagttattttctcctaaattagcaggtcaatggcatcttcttcagactcatggatgaaggaatataatgaagcaatgaaactcgctgatgatatcagtggcatgatttctgaacatacatcatttcctacatctggaccagaaacccagcgtcacgcatctgctataagaaggaagatcacaatattgggaaccagactagatagcttgcaatcccttttgtcaaagctccctgtaaagtctgaaaaggagatgaatcgtcgcaaggacaaccttgcaaatttgaggtcaaaagttaaccaaatggcttcaacattgaacatgtcaaactttgcaaatagggatagtttgcttgggccagaaattaaaccagatgcaatgagcagaaccgttggtttggataacagtggacttgttggtctacaacggcaagtcatgaaagagcaagatgagggccttgagaaattggaggagactgtattaagtacgaaacatattgcgttggctgtaaatgaagagctgactctacacactagactcattgatgacttggatgaacatgttgatgttacagattctcggctgaggcgggtgcagaagaacttagcaattttaaacaaacgtacaaagggtggttgctcatgcttgtgcatgctattatcagtgattggtatagtggttttggttgttgtcatatggcttctggtcaaatatttgtagttatgaaaatacccagctcctgaactttgtcccttttgtttatgtttttaaatatgtgcctttaaacatcatatataaccaggtttctttgattgttcttggtgctttgccaatgacatggaatttattgtggtcttgaaaagctatgatttgtaattgtcagattatttttaagtgtttatatctttgtgctttcttttgttaatatatgaattttttagtgatttatgataatgccttagataatctattaatgagttgtcgttc

SEQ ID NO: 5402 - DNA, 1125 bp, Glycyrrhiza uralensis
taaaggtggacaatactgatggctcagcacgcgagaagaaaatgattggtaaagggacagcgaaaacgacgccgcggtgaatgaatcatttgaagcctttcaaccccgcgaccgcgaggtaaacgacggtgccggttggcggtggcgccgttacgctaccttccatccatcgccgtcttcctaaaacaacgtcgcatccatcaccaccccttccctcttcctcacagtcacgttcgtagcttcctagaaaaataatagtcaatggcatcttcttcagacccatgggtgaaggaatataatgaagcaatgaaacttgctgatgatatcagcggcatgatttctgagtggagttcgtatcccgcatctggaccggaaacccagcgccattcatctgctataagaaggaagattacaatattagggactaggcttgatagcttgcaatcccttttgtcaaagcttcctggaaagcagcaagtatctgagaaggagatgaatcgtcgcaaggacatgcttgcaaatttgagatcaaaggttaaccaaatggcttccacgttgaacatgtcaaactttgcaaataaggatagcttgcttgggccagagataaaaccagatgcaatgagcagaaccgttggcctggacaacaatggacttgttggacttcaacgacaaattatgaaagaacaagatgagggccttgagaatttggaggagactgtaacaagcacgaaacatattgcattggcagtgaatgaagagctgactctacacacaagactcattgatgacttggacgaaaatgtagaggtcacagattctcggcttaggcgggtgcagaagaacttggcaattttaaataaacgaaccaagggtggttgctcttgcatgtgcatgcttttatcagtgattggtatagtggttttggtcgttgtcatttggctgttggtcaaatatttgtaatgataaaatgaccaactcgtcaagcttctctttttgtctctgtttctgtatgtatactatgcactgaaacatcatacccggttttcctgatttctcttggtgctttgtcaatgatgtggaatttgtttgaggtcttgaaaggctttgtattgtattgtaagtggc

SEQ ID NO: 5403 - DNA, 1582 bp, Lupinus angustifolius
ggagttgtaattcaattctctatttttcaattaaaaccatgacagcttggtagacgacaacgcggtcaaaccaacggggtggttacttctaccgccgtaggttattccacacatcacgatcttcctgaaacgacaccgtttctttcacccacatacataaccctcttcacaaacttagtttccccaaaaccaaaaggctaatggcatcttcttctgactcatggacgaaggaatacaatgaagcagttaaacttgctgatgatatcaatggcatgatttctgagcggagttcctttcctgcatctggaccagaaacccagcgtcattcatctgctataagaagaaagattacgatattagggaccagactcgatagcttgcagtcccttttatcaaggaaccctggaaaatctgagaaggagtttaatcgtcgcaaagacactctttcaaatttaagatcaagagtcaaccaaatggcttccacattaagcatgtcaaactttgcaaatagggatagtttgcttggaccagatataaaaccggatgcactgagcagaaccgttggcctagacaacagtggacttgttggacttcaacggcaaattatgaaagaacaagatgaaggacttgaaaaattggaggatactgtgataagtactaaacatattgcactggcagtgaatgaagagctgggtttacacactagactcattgatgacttggatgaacatgtagatgttacagattctagactgaggcgagtgcagaagaacttggcagttttgaacaaacgcaccaagggtggttgctcctgcttgtgcatgcttttatcggtgattggtatagttgttttggttgttgtgatatggctgttggtcaaatatttgtaatcaactcagatgagcctctacgcaatgataaggttgttgcttagtaattgtgaggtcacaggtttaaattacggagacaatgtctctgctttatggggtcagattgcttacatttatcattactagactttactaagtgggcatcttgtgttctgagctatctttttatttatttataaaaatatcaactcatgaagcttctctcctattttgatgtgtgcagacatcaataatcttgttgtgctttgctaatgacaatgaacttattgaagtcttgaaaatatttatatcataattgtcagattttatgtgtttatatctttggttggtagtaaaaaagttgaaatgatttctccgttaatggctagtcattgcatctcatcctttcttttttttttcctttgcgtcgaagggagagcaaatagtgtaacaccatgactttgttgaaatagaagaaacaaatacaatgtgaaatgaaaattccaaaaaaataatttttttcaaaaccagaagactattttcataaatattctaaaataaaattctcaaccgtactaaaattataatattataatcacaggagtttgattcaaatgatacattctattgcaaggcattatctatgcatagaaatacataacaatcagataaagcatttttaaatcagtcatacaataagacatgtaatatta

SEQ ID NO: 5404 - DNA, 1118 bp, Pisum sativum
atacacaacacaacaaacaaaaataacccgtgtaagcgtagcgcaaaggtggtatacactacaccataaacgacgctgcgttcaacgacttttttcgttcccttcagatttcataatcgacgacagcgtcagactaacggtgccgcttcgtggtgccgtcgttacgcttctatctgttaccttccttatacgccatcgtatcgatccatctcatcaacgatcgttcctctttcatctcaattaccaaaccctaattcagacgaagttattttctcctaaatttccaggccaatggcatcttcttcagactcatggatgaaggaatataatgaagcaatgaaacttgccgatgatatcagtggcatgatttctgaacataattcatttccttcatctggacctgaaacacagcgtcatgcatctgctataagaaggaagataacaatattggggaccagactggatagcttgcaatcccttttgtcaagggtccctgtaaagtccgagaaggagatgaatcgtcgcaaggacaaccttgcaaatttgaggtcaaaggttaaccaaatggcttcaacattgaacatgtcaaactttgcaaatagggatagtttgcttgggccagaaataaaaccagatgcaatgagcagaaccgttggcttggataacaataaacttgttggtctgcaacggcaagttatgaaagagcaagacgagggccttgagaaattggaggaaaccgtattaagtacgaaacatattgcgttggcagtgaatgaagagctgactctacacactaggctcattgatgacttggacgaacatgttgatgtcacagattctcggctgaggagagtgcagaagaatttggccattttaaataaacgtacaaagggtggttgctcatgcttgtgcatgctattatcagtgattggtatagtggtcttggttgttgtcatatggcttctggtcaaatatttgtagttacgaaaatactcaacttgggagctgtttcccttttgtttatgtttctgaatgtgtgccatgaaacatatcatatataacctggtttctttgattgttattttgctttgccaatgacatggaatttattaaggtct

SEQ ID NO: 5405 - DNA, 1344 bp, Cajanus cajan
ctcgcgtagcgcaaggaacagcataaacgacgccgcgttcaacaacgaccctttccttgccactcgcctttcgtatacgacgacgctctcggaaaaacggtgcccattggtggtgccgccgttacgctaatctcgcacacgacgtcgtatccatcaccctcgtcaaatcctctcttccgcttgatttcgaaaccctaattcggaaaacaaaaagttactttatccggaattagcgcgtaaggccaatggcatcttcttcagactcatggatgaaggaatataatgaagccgtgaaactcgcggatgatataagtggcatgatttctgagcgcagttcattccctgcatctggaccagaaactcagcgccatgcatctgctataagaaggaagatcacgatattagggaccagacttgatagcttgcaatctcttttgtcaaagttccctgcaaaaactgagaaggagatgaaccgtcgcaaggacatgcttgcaaatttgaggaccaaagtcacccaaatggcttcaacattgaacatgtccaactttgcaaatagggatagtttgcttggcccagaaataaaaccagatgcaatgagcagaaccgtaggcctggacaacagtgggctagttggtctacaacgccaaattatgaaagagcaagacgatggccttgagaaattggaggagactgtaatcagtacaaaacatattgcattggcggtgaatgaagagctggatctacacaccaggctcattgatgacttggatcaacatgtagatgttacagattctcggctgaggcgagtgcagaagaacttggcaattttgaacaaacgtaccaagggtggttgctcctgcttgtgcttgcttttatcagtgattggtatagtggtcttggttgttgtcatatggctattgatcaaatatttgtaaagataaaaatatccagcttatgaagtttctctttttcatgtttcgaatgtgtgcattgaaacatgatagtgtttttcttcgatttttttttatggtgctttggcaatgacatggaatttactaaggtattgaaaggctgtgctttgtaattgtcagatttcaagtgttgttacctttttgagtgttcgtgtataaatcagtaaatttacattaatgacttgggtgggaagtgagagaatttatgtcatgcgcgctgtctttcgaattaatcagattcttcatcagtattgggttggaattcttccttattgtttatgcattccagaagctatgataaaaaatacttggttttttgaatatatgtatctctcagaagtaatgaaggagtaggttcttgggtgtacttaaa

SEQ ID NO: 5406 - DNA, 1314 bp, Glycine max
ccactatataaaaactcgtaaatacaactctcacttttgcaactgtttacaacaataataagttaataactcgcgtagcgcaaggaacagcataaacgacgctgcgctgaacaacgacggtgtcagacaaacggtgccggttggtggggccgccacgctattacgcctaatcgtatccatcaccctcatcaaaacccctcctttctcttaatttagaaaccctaattcagaagataaaagttactttctccagaattagcgcgctaatggcatcttcagactcatggatgaaggaatataatgaagctgtgaaacttgctgatgatatcaatggcatgatttctgaacgtagttcgtttcctgcatctggaccagaaacccagcgacatgcttctgctataagaaggaagatcacgatattagggaccagacttgatagcttgcaatctctgttgtcaaaggtccctgcaaaaactgagaaggagatgaatcgtcgaaaggacatgcttgcaaatttgaggacaaaagttaaccaaatggcttcaacattgaacatgtctaactttgcaaatagggatagtttgctagggccagaaataaaatcagatgcaatgagcagaactgttggcctggacaacagtggactagttggtcttcaacggcaaattatgaaagagcaagacgatggccttgagaaattggaggagactgtaatcagtactaaacatattgcattggctgtgaatgaagagctgaatctacataccagactcattgatgacttggaccaacatgtagatgttacagattctcggctgaggagagtgcagaagaacttggcagtgttaaacaaacgtaccaagggtggttgctcctgcttgtgcatgcttttatcagtgattggtatagtgggtttggtggttgtcatatggctgttggtcaaatatttgtaaagataaaaaatacccaactcgtgaagtttctctttttttcatgtttctgaatgtgcattgaaacatgataacgtgtttctttgttttttcttggtgctttggcagtggcatggaatttattaaggtattgaaaggcttttttatgtaattgtcagatttcaaatgttgatacccttgagtgttgttctctttgtaaaaatcagtaaaattgaggtgacttccatttatgtattccagaagctgcaatttcgtttgcgtgggtgggaagagaaataatattttatgtattccggaagctgcaagttcgtttttctttttgtttcagaacctctgataaaatgctgaggttcttgaatatgca

SEQ ID NO: 5407 - DNA, 1211 bp, Glycine max
ttttgcaactgtttacaacaataataagttaacaactcgcgtagcgcaaggaacagcataaacgacgctgcgctgaacaacgacggtgtcagacaaacggtgccggttggtggggccgccacgctattacgcctaatcgtatccatcaccctcatcaaaacccctcctttctcttaatttagaaaccctaattcagaagataaaagttactttctccagaattagcgcgctaatggcatcttcagactcatggatgaaggaatataatgaagctgtgaaacttgctgatgatatcaatggcatgatttctgaacgtagttcgtttcctgcatctggaccagaaacccagcgacatgcttctgctataagaaggaagatcacgatattagggaccagacttgatagcttgcaatctctgttgtcaaaggtccctgcaaaaactgagaaggagatgaatcgtcgaaaggacatgcttgcaaatttgaggacaaaagttaaccaaatggcttcaacattgaacatgtctaactttgcaaatagggatagtttgctagggccagaaataaaatcagatgcaatgagcagaactgttggcctggacaacagtggactagttggtcttcaacggcaaattatgaaagagcaagacgatggccttgagaaattggaggagactgtaatcagtactaaacatattgcattggctgtgaatgaagagctgaatctacataccagactcattgatgacttggaccaacatgtagatgttacagattctcggctgaggagagtgcagaagaacttggcagtgttaaacaaacgtaccaagggtggttgctcctgcttgtgcatgcttttatcagtgattggtatagtgggtttggtggttgtcatatggctgttggtcaaatatttgtaaagataaaaaatacccaactcgtgaagtttctctttttttcatgtttctgaatgtgcattgaaacatgataacgtgtttctttgttttttcttggtgctttggcagtggcatggaatttattaaggtattgaaaggcttttttatgtaattgtcagatttcaaatgttgatacccttgagtgttgttctctttgtaaaaatcagtaaaattgaggtgacttccatttatgtattccagaagctgcaatttcgtttgcgtgggtgggaagagaaataatattttatgtattccg

SEQ ID NO: 5408 - DNA, 1240 bp, Trigonella foenum-graecum
cggccggggtgtcacttttttacctgtcacatagatagatagatacacaacaaaacaaaataacccgcgtagacgtagcacaagccacaaggtacatcataaacgacgctgcgctcaaacgactttttccgttccattcagatttcgtaaacgacaacagcgtcacacaaacggtgccgctcggtggtaccgcgccgttacgctactaccttcctgaaacgacatcgtatcgatcaatctcatcgacgatcctctttcatctcaattaccaaaccctaattcagagaaagttttttttcttctaaattagcaggcaaatggcatcttcttcagactcatggatgaaggaatataatgaagcaatgaaacttgccgatgatatcagtggcatgatctctgaacataattcatttccttcatctggaccagaaacacagcgtcatgcatctgctataagaaggaagatcacaatattggggaccagactggatagcttgcaatcccttttgtcaaagctccctgtaaagtctgagaaggagatgaatcgtcgcaaggacaaccttgcaaatttgaggtcaaaggttaaccaaatggcttcaacattaaacatgtcaaactttgcaaatagggatagcttgctcggtccagaaattaaaccagatgcaatgagcagaactgttggcttggataacaataaactagttggtctgcaacggcaagttatgaaagagcaagacgagggccttgagaaattggaggagaccgtattaagtacaaaacatattgcgttggctgtgaatgaagagctgactctacacacaagactcattgatgacttggacgaacatgtagatgtcacagattctcggctgaggagagtgcagaagaatttggcaattttaaacaaacgtactaagggcggttgctcatgcttgtgcatgctattagcagtgattggtatagtgggtttggttcttgtcatatggcttctggtcaaatatttgtagttatgaaaatggccaactaagcaaactttttcccttatgtttatgtttctgaaagtgtgccttgaaacatatcatatgtaacgggtttctttgattgttctggggtgctttgccaatgacatggaatttactgaggtcttgaaagtctatgatttgtaattttcagatctattttatatgttgatatctttgtgctatagtttgttaaagtattaaagtttaagtgacttgtg

SEQ ID NO: 5409 - DNA, 1189 bp, Medicago truncatula
acaagagacatcataaacgacgctgcgttggacgactttttcagtttcatccacatttcgtaaacgacaacagcgtcacacaaacggtgccactcggtgctaccgcgccgtcaagctgatttcttcctatcctaaaacgacatcgtatcgatcaatatcatcgacgatcctctttcatcccaattaccaaaccctaattcagagaaagtttttttctccttaatttgaaggcaaatggcatcttcttcagactcatggttgaaggaatataatgaagcaatgaaacttgctgatgatatcagtggcatgatttctgaacataattcatttccttcatctggaccagaaacacaacgtcatgcgtctgctataagaaggaaaatcacaatattggggacccgactagatagcttgcaatcccttttgtcaaagctccctgtaaagtctgagaaggagatgaatcgccgcaaggacaaccttgcaaatttgaggtcaaaggttaaccaaatggcttcaactttgaacatgtcaaactttgcaaatagggatagtttgctcgggccagaaattaaaccagatgcaatgagcagaactgttggcctggacaacaatggacttgttggtttgcaacgacaagttatgaaagaacaagatgagggccttgagaaattggaggagactgtattgagtacaaaacatattgcgttggcagtgaatgaagagctgactctacacactagactcattgatgacttggacgaacatgtagatgtcacagattctcggctgaggagagtgcagaagaacttggcaattttaaacaaacgtactaagggcggttgctcatgcatgtgcatgctattagcagtgattggtatagtgggtttggttcttgtcatatggcttctggtcaaatatttgtagatatgaaaatacccaactcaccaaacttctccccttgtgtttatgtttctgaatgtgccttgaaacatatcatatatataaccgaggttctttgattgttttttgtactttgccaatgatggaatgtattgaggtcttgaaaagctatgatatgttgtaatcttcagatctttcaagtgttgatatgtttgtgctttcgtttgttaaagtatgaaagtttaagtggtttgtgataaactgataatgccttaagtcgcctattatt

SEQ ID NO: 5410 - DNA, 1225 bp, Glycine max
ttttccaactgtttacaacaataacttgtaactggcgtagtgcacgggacagcttaaacgacgccgcgctgatcaacgactccttacgtaaacgacgacggtgtcagacaaacggtgccggttggtggtgccgccacgctattacgctaatcgtatccatcaccctcatcaaaacccctcctttctcttaatttagaaaccctaattcagaagaaaaaagtcaccttctccagaatttgcgcggtaatggcatcttcttcagactcatggatgaaggaatataatgaagctgtgaaacttgctgatgatatcactggcatgatttctgaacgtagttcattccctgcatctggaccagaaacccagcgacatgcatctgctataagaaggaagatcacgatattggggaccagacttgatagcttgcaatctcttttgtcaaaggtccctgcaaaaactgagaaggagatgaatcgtcgcaaggacatgctttcgaatttgaggacaaaagttaaccaaatggcttcaacattgaacatgtcaaactttgcaaatagggatagtttgtttgggccagaaataaaatcagatgcaatgagcagaactgttggcctggacaacagtggactagttggtcttcaacggcaaattatgaaagagcaagacgatggccttgagaaattggaggagactgtaatcagtactaaacatattgcgttggctgtgaatgaagagctgaatctacataccagactcattgatgacttggaccaacatgtagatgttacagattctcggctgaggagagtgcagaagaacttggcagtgttaaacaaacgcaccaagggtggttgctcctgcttgtgcatgcttttatcagtcattggtatagtgggtttggttgttgtcatatggctgctggtcaaatatttgtaaagataaaaatacccaaactcgtgaagtttctctttatgtttctgaatgtgtgcactgaaacatgattgatttttcttggtgctttggcaatgacatggaatttatcaaggtattgaaaggctttattatgtaattgtcagatttgaaatgttgatacccttgagttctctttgtaaaaatcagtaaattgaggtgacttccattaatgacttgagctcttgcactctgagcgtttgcgtgggtgggaagggaaataatatgtattgcagaagctgcaatttcgttttcc

SEQ ID NO: 5411 - DNA, 1223 bp, Lotus japonicus
gacgcacaaggtacagcaaaaacgacggtgtgcagaacaggaccgtttcctttccaattccataccatttagacgacgacgaagagatcagacaaactgtgctgcttttcggtgccgccattattctactctccacacctttctttaaacgacgtcgttcaatcaccctcatcaattcccttccttctcaaaccctaattcagaagctccaaaattaacgaacgggtcaatggcatcttcttcagacacatggatgaaggaatataatgaagcaatgaaacttgccgatgatatcaacagcatgatttctgagcggagttcatttcctgcatctggaccagaaacccagcgtcacgcatctgctataagaaggaaaatcacaatattggggaccagacttgatagcttgcaatcccttttgtcaaagctccctgtaaagtctgagaaggagatgaatcgtcgcaaggacacgcttgcaaatttgaggtcaaaagttaaccaaatggcttcaacattgaacatgtcaaactttgcaaatagggatagtttgcttgggccagaaataaaaccagatgcgatgagcagaactgtgggtttggataacagtgggctcgttggtcttcaacggcaaattatgaaagagcaagacgatggccttgagaaattggaggagactgtaataagtacaaaacatattgctttggcagtgaatgaagagctgactctacacactagactcattgatgacttggatgaacacgtagatgttacagattctcgtctgaggcgtgtgcagaagcacttggcagttttaaacaaacgtaccaagggtggttgctcctgcttgtgcatgcttttagcagtggttggtatagttattttggtggtcgtcatatggctcttggtcaaatacttgtaatgataaaaatacgaaattcacaaagtttctcctttcatgtttctcgatgtgtgcatttaaacatcgtattcgactttctttggttgttcttgatgctttgccaatgagatggaatgtattgaggtcttaaaaggccatgatttgtaattgtcagattttaagtgttgatatctttgtctgctaaagtaagaaagtgaagtgacttctgttaattcctatgagcgattgcgctcttaggaagaaagaatatgtataccgtacattgttcttcaaataaattagatgcctcatcactcatcctaac

SEQ ID NO: 5412 - DNA, 1787 bp, Medicago truncatula
gtaaccctagcatgttgctactgctaatgacaataaacagccgccaccaacttgcaactttctctctagtattgtatccttcaatttttcttctatttttaatataacggttcttcaccatttgttatcgcctgcatctgtggttattctttttgaaccaaatgttcgattctcttttcatcttcttgcggttttgtttgaatactttgattctatgaatgagggtttctctttgtgctgtctgtgtgtgaaaaaacgccaaggaagaacgaaactgagattttggccatctttttcgtttaccaaaacgcggtccaacctgtcaaacctccggttcagccggttttctggttcgtttcccagtttcatgacatagcggtttacaggccattccgaaccggacatataaccggttcacggttgaaccggccggtccggtccggttttaatcaccttgcttttacggttttacctgtcatcgtagagatatacaacaaaacaaaataacccgcgtagacgtaccacaagagacatcataaacgacgctgcgttggacgactttttcagtttcatccacatttcgtaaacgacaacagcgtcacacaaacggtgccactcggtgctaccgcgccgtcaagctgatttcttcctatcctaaaacgacatcgtatcgatcaatatcatcgacgatcctctttcatcccaattaccaaaccctaattcagagaaagtttttttctccttaatttgaaggcaaatggcatcttcttcagactcatggttgaaggaatataatgaagcaatgaaacttgctgatgatatcagtggcatgatttctgaacataattcatttccttcatctggaccagaaacacaacgtcatgcgtctgctataagaaggaaaatcacaatattggggacccgactagatagcttgcaatcccttttgtcaaagctccctgtaaagtctgagaaggagatgaatcgccgcaaggacaaccttgcaaatttgaggtcaaaggttaaccaaatggcttcaactttgaacatgtcaaactttgcaaatagggatagtttgctcgggccagaaattaaaccagatgcaatgagcagaactgttggcctggacaacaatggacttgttggtttgcaacgacaagttatgaaagaacaagatgagggccttgagaaattggaggagactgtattgagtacaaaacatattgcgttggcagtgaatgaagagctgactctacacactagactcattgatgacttggacgaacatgtagatgtcacagattctcggctgaggagagtgcagaagaacttggcaattttaaacaaacgtactaagggcggttgctcatgcatgtgcatgctattagcagtgattggtatagtgggtttggttcttgtcatatggcttctggtcaaatatttgtagatatgaaaatacccaactcaccaaacttctccccttgtgtttatgtttctgaatgtgccttgaaacatatcatatatataaccgaggttctttgattgttttttgtactttgccaatgatggaatgtattgaggtcttgaaaagctatgatatgttgtaatcttcagatctttcaagtgttgatatgtttgtgctttcgtttgttaaagtatgaaagtttaagtggtttgtgataaactgataatgccttaagtcgcctattattgagtgaaaagagaaataatatttatgtcatgcattgttcaaatatattagatgctccggtggcactagattgcaa

SEQ ID NO: 5413 - DNA, 1362 bp, Glycine max
taatcgctaccactatataaaactcgtaaatccaactcttacttttccaactgtttacaacaataacttgtaactcgcgtagtgcacgggacagcttaaacgacgccgcgctgatcaacgactccttacgtaaacgacgacggtgtcagacaaacggtgccggttggtggtgccgccacgctattacgctaatcgtatccatcaccctcatcaaaacccctcctttctcttaatttagaaaccctaattcagaagaaaaaagtcaccttctccagaatttgcgcggtaatggcatcttcttcagactcatggatgaaggaatataatgaagctgtgaaacttgctgatgatatcactggcatgatttctgaacgtagttcattccctgcatctggaccagaaacccagcgacatgcatctgctataagaaggaagatcacgatattggggaccagacttgatagcttgcaatctcttttgtcaaaggtccctgcaaaaactgagaaggagatgaatcgtcgcaaggacatgctttcgaatttgaggacaaaagttaaccaaatggcttcaacattgaacatgtcaaactttgcaaatagggatagtttgtttgggccagaaataaaatcagatgcaatgagcagaactgttggcctggacaacagtggactagttggtcttcaacggcaaattatgaaagagcaagacgatggccttgagaaattggaggagactgtaatcagtactaaacatattgcgttggctgtgaatgaagagctgaatctacataccagactcattgatgacttggaccaacatgtagatgttacagattctcggctgaggagagtgcagaagaacttggcagtgttaaacaaacgcaccaagggtggttgctcctgcttgtgcatgcttttatcagtcattggtatagtgggtttggttgttgtcatatggctgctggtcaaatatttgtaaagataaaaatacccaaactcgtgaagtttctctttatgtttctgaatgtgtgcactgaaacatgattgatttttcttggtgctttggcaatgacatggaatttatcaaggtattgaaaggctttattatgtaattgtcagatttgaaatgttgatacccttgagttctctttgtaaaaatcagtaaattgaggtgacttccattaatgacttgagctcttgcactctgagcgtttgcgtgggtgggaagggaaataatatgtattgcagaagctgcaatttcgttttcctttttggctcagaacctctgataaaatgctaaggttctttaatatgcatctattcgaagttatggagtaggttctaattacaaattgtggaaata

SEQ ID NO: 5414 - DNA, 980 bp, Medicago truncatula
tcgcaaacctgaacaaagaaacggcaagcagaacgaacaagaagcaagaaacggcaacaccagaatcgcaagtcgcaagcaggaagagaagccaatggcatcttcttcagactcatgggtgaaggaatataatgaagcaatgaaacttgccgatgatatcagtggcatgatttctgaacataattcatttccttcatctggaccagaaacacaacgtcatgcatctgctataagaaggaagatcacaatattggggacccgactagatagcttgcaatcccttttgtcaaagctccctgtaaagtctgagaaggagatgaatcgtcgcaaggacaaccttgcaaatttgaggtcaaaggttaaccaaatggcttcaactttgaacatgtcaaactttgcaaatagggatagtttgctcgggccagaaattaaaccagatgcaatgagcagaactgttggcctggacaacaatggacttgttggtctgcaaaggcaagttatgaaagaacaagatgagggccttgagaaattggaggagactgtattaagtacaaaacatattgcgttggcagtgaatgaagagctgactctacacactagactcattgatgacttggacgaacatgtagatatcacagattctcggctgaggagagtgcagaagaacttggcaattttaaacaaacgtactaagggaggttgctcgtgcatgtgcatgctattagcagtgattggtatagtgggtttggttcttgtcatatggcttcttgtcaaatatttgtaattatgaaaatacccaactcagcgaacttctccccttgtgtttatgtttctgaatgtgtgccttgaaacatatcataaatataaccgaggttctttgattgttttttgtactttgccaatgacaaggaatgtatgaggtcttgaaaggctatgacatgttgtaatcttcagatctttcaagtgttgatatgtttgtg

SEQ ID NO: 5415 - DNA, 1204 bp, Phaseolus vulgaris
agaatgaatcgatgacaaatagtatatagttgggaagggacaccataaacgacgctgcgctcagcaacagactttttccgtcccacactatccttaaacgacgaccgtttcagacaaacggtgccggttggtggtgccgccgttacgccaatctcacacacgttctattctcatcaaaaccaaacccctccttcctcttcactcccaaaccctaattcagaagacagaaggtcgctttcttcaccatcataaacgcgcaaatggcatcttcttcagactcatggatgaaggaatataatgaagctgtaaaacttgctgatgatatcactggcatgatttctgaacgtagttcatttcctgcttctggaccagaaacccagcggcatgcatctgctataagaaggaagatcacaatattagggaccaggcttgatagcttgcaatctcttttgtcaaaggtccctgcaaaaactgagaaggaaatgaatcgtcgcaaggacatgcttggaaatttgaggactaaagttaaccaaatggcttcaacattgaacatgtcaaactttgcaaatagggatagtttgcttggtccagaaataaaatcagatgcaatgagcagaactgttggcctggacaacagtggactagttggtcttcaacggcaaattatgaaagaacaagacgatggccttgagaaattggaggagactgtaatcagtacaaaacatattgcgttggcagtcaatgaagagctggatctacacaccaggctcattgatgacttagacgaacatgtagatgttacagattctcggctgaggcgagtgcaaaagaacttggcagttttgaacaaacgtaccaagggtggttgctcctgcttgtgcatgcttttatcagtgatcggtatagtggttttggttgctgtcatatggctgttaatcaaatatttgtaaagataaatataccctactcgtcaacgttctctcttttttatgtttctgaatgtgtgcattgaaacatggcaacgtgtttctttgttttggcaatgacatgcaatttgctaaggtgttgaaaggctttgttttgtaattctaagttttaaagtgttgatgcctttgagtgtttctgttgtaaaaatcattatatcgaaagtgacttccattaatgacttgttaacccattttgagcatttgcatgggtctgtatg

SEQ ID NO: 5416 - DNA, 1184 bp, Phaseolus vulgaris
agtatatagttgggaagggacaccataaacgacgctgcgctcagcaacagactttttccgtcccacactatccttaaacgacgaccgtttcagacaaacggtgccggttggtggtgccgccgttacgccaatctcacacacgttctattctcatcaaaaccaaacccctccttcctcttcactcccaaaccctaattcagaagacagaaggtcgctttcttcaccatcataaacgcgcaaatggcatcttcttcagactcatggatgaaggaatataatgaagctgtaaaacttgctgatgatatcactggcatgatttctgaacgtagttcatttcctgcttctggaccagaaacccagcggcatgcatctgctataagaaggaagatcacaatattagggaccaggcttgatagcttgcaatctcttttgtcaaaggtccctgcaaaaactgagaaggaaatgaatcgtcgcaaggacatgcttggaaatttgaggactaaagttaaccaaatggcttcaacattgaacatgtcaaactttgcaaatagggatagtttgcttggtccagaaataaaatcagatgcaatgagcagaactgttggcctggacaacagtggactagttggtcttcaacggcaaattatgaaagaacaagacgatggccttgagaaattggaggagactgtaatcagtacaaaacatattgcgttggcagtcaatgaagagctggatctacacaccaggctcattgatgacttagacgaacatgtagatgttacagattctcggctgaggcgagtgcaaaagaacttggcagttttgaacaaacgtaccaagggtggttgctcctgcttgtgcatgcttttatcagtgatcggtatagtggttttggttgctgtcatatggctgttaatcaaatatttgtaaagataaatataccctactcgtcaacgttctctcttttttatgtttctgaatgtgtgcattgaaacatggcaacgtgtttctttgttttggcaatgacatgcaatttgctaaggtgttgaaaggctttgttttgtaattctaagttttaaagtgttgatgcctttgagtgtttctgttgtaaaaatcattatatcgaaagtgacttccattaatgacttgttaacccattttgagcatttgcatgggtctgtatg

SEQ ID NO: 5417 - DNA, 1129 bp, Arachis hypogaea
acgacgactctgtccgacgaaacggttacgctttagtgctccttcctggtgccgctcttgtacgctactttcctttgtacatcgccatcttcccgagaaacgacgtcgtatccatcaccctccatcggaagaaacccgatcccttcctcttaattccgaaaccctacttataattcgtcccaaatttagtagaccaatggcatcgtcatcagactcatggatgaaggaatataatgaagcagtgaaactcgccgatgatatcaatggcatgatttctgagcggagttcattatccacatctggaccagaagctcagcgtcatgcatctgctataagaaggaagattactatcttagggaccagacttgatagcttgcaatcccttttatctaaagtccctggaaaatctgagaaggagatgaatcgccgcagggaaacacttacaaatttgaggtcaaaagttaaccaaatggcttcaacactgaacatgtcaaactttgcaaatagggatagtttatttggtcctgaaataaaaccagatgcaatgagcagaactgttggcctggataacagtggactcgttggacttcaaaggcaaattatgaaagagcaagatgaaggccttgaaaaattggaggagactgttgtaagtacaaagcacattgcattagcagtgaatgaagagctgagtctacacactagactaattgatgacttggacgaacatgtagatgttacagattctcgtctaaggcgtgtccagaagaacttggcagttttaaacaaacgtaccaagggtggttgctcctgcttgtgcatgcttttagcagtggttgggatagtggttttggtggttgtgatatggttgttggtcaaatatttgtagacacaaaaataccctacttataaagcttttcctttcttcttgtgtgtactgaaacagcataatcaagtttctttgattcttggtgtcttgaaatggcattgtatctcaattttcgttttctaagtggttgatgtctgggttttctcacttgtaaaaatatgagcttcctatgtgacagattgctcgtgtgcaaagagaatattagtgccacgtattgcctatcaatcaaaatctaatgcttca

SEQ ID NO: 5418 - DNA, 1112 bp, Arachis hypogaea
agtggggtggacaccaaaaacgacgctgtgcagaacgaccttttcggctttcttaacatcgcgacgtagacgacgactctgtccgacgaaacggttacgctttagtgctccttcctggtgccgctcttgtacgctactttcctttgtacatcgccatcttcccgagaaacgacgtcgtatccatcaccctccatcggaagaaaacccgattccttcctcttaattccgaaaccctacttataattcgtcccaaatttagtagaccaatggcatcgtcatcagactcatggatgaaggaatataatgaagcagtgaaactcgccgatgatatcaatggcatgatttctgagcggagttcattatccacatctggaccggaagctcagcgtcatgcatctgctataagaaggaagattactatcttagggaccagacttgatagcttgcaatcccttttatctaaagtccctggaaaatctgagaaggagatgaatcgccgcagggaaacacttacaactttgaggtcaaaagttaaccaaatggcttcaacactgaacatgtcaaactttgcaaatagggatagtttatttggtcctgaaataaaaccagatgcaatgagcagaactgttggcctggataacagtggactcgttggacttcaaaggcaaattatgaaagagcaagatgaaggccttgaaaaattggaggagactgttgtaagtacaaagcacattgcattagcagtgaatgaagagctgagtctacacactagactaattgatgacttggacgaacatgtagatgttacagattctcgtctaaggcgtgtccagaagaacttggcagttttaaacaaacgtaccaagggtggttgctcctgcttgtgcatgcttttagcagtggttgggatagtggttttggtggttgtgatatggttgttggtcaaatatttgtagacacaaaaataccctacttataaagcttttcctttcttcttgtgtgtactgaaacagcataatcaagtttctttgattcttggtgtcttgaaatggcattgtatctcaattttcgttttctaagtggttgatgtctgggttttcttacttgtaaaa

SEQ ID NO: 5419 - DNA, 1209 bp, Arachis hypogaea
gcgtaacgcaagtggggcggacaccaaaaacgacgctgtgcagagcgaccttttcggctttcttaacatcgcgacgtagacgacgactctgtccgacgaaacggttacgctttagtgctccttcctggtgccgctcttgtacgctactttcctttgtacatcgccatcttcccgagaaacgacgtcgtatccttcaccctccatcggaagaaaacccgattccttcctcttaattccgaaaccctacttataattcgtcccaaatttagtagaccaatggcatcgtcatcagactcatggatgaaggaatataatgaagcagtgaaactcgccgatgatatcaatggcatgatttctgagcggagttcattatccacatctggaccagaagctcagcgtcatgcatctgctataagaaggaagattactatcttagggaccagacttgatagcttgcaatcccttttatctaaagtccctggaaaatctgagaaggagatgaatcgccgcagggaaacacttacaactttgaggtcaaaagttaaccaaatggcttcaacactgaacatgtcaaactttgcaaatagggatagtttatttggtcctgaaataaaaccagatgcaatgagcagaactgttggcctggataacagtggactcgttggacttcaaaggcaaattatgaaagagcaagatgaaggccttgaaaaattggaggagactgttgtaagtacaaagcacattgcattagcagtgaatgaagagctgagtctacacactagactaattgatgacttggacgaacatgtagatgttacagattctcgtctaaggcgtgtccagaagaacttggcagttttaaacaaacgtaccaagggtggttgctcctgcttgtgcatgcttttagcagtggttgggatagtggttttggtggttgtgatatggttgttggtcaaatatttgtagacacaaaaataccctacttataaagcttttcctttcttcttgtgtgtactgaaacagcataatcaagtttctttgattcttggtgtcttgaaatggcattgtatctcaattttcgttttctaagtggttgatgtctgggttttcttacttgtaaaaatatgagcttcctatgtgacagattgctcgtgtgcaaagagaatattagtgccacgtattgcctatcaatcaaaatctaatgcttca

SEQ ID NO: 5420 - DNA, 1175 bp, Lotus japonicus
aagtccgctagcttccacattcccgcgaagtaaacgacggtgccggtggttggcgccgtacgcaacttccatccatcgccatctccctgaagcgacgtcgcatcgatcacaccgttctctctctacctcacagtcgtagcttccaaggtccatggcatcttcttcagactcatgggtgaaggaatacaatgaagcagtgaaacttgctgatgatatcagcaccatgatttccgagcggagttcgtctgtggaatctggaccggaagcccaacgtcattcatctgctataagaaggaagatcacaatattagggaccaggcttgatagcttgcaatcccttttgtcaaagcttccagctgggaagcagcctgtatctgagaaggagctgaatcgtcgcaaggacatgcttgcaagtttgagatcaagagttaacgagatggcttccacgttgagcatgccaaatttttccaacagggatagtttgtttgggccagaaataaagccagatgcaatgagtaggaccaatggcctggacaacaaaggagttattggacttcaacgacaaattatgaaagaacaagatgagggccttgagaaattggaggaaagtgtaacaagcacaaaacatattgcattagctgtgaatgaagagctggatctacacacgagtctcattgatgacttggaccaacatgtagatgtcacagattctcggcttaggcgtgtgcagaagaacttggcagttttaaataaacgaaccaacggtggttgctcctgcttgtgcatgcttttatcagtgattggcatagtggttttggttgttgtcattgggctgttggtcaaatatctgtaatgataaaatgcctaactcgtcaagcttctgtttttgtctacgtctctgtatgtatgcactgaaacatcataacctagtttcctgatttctcttggtgctttgtcaatggcgtgcaatttgttgagtttgtaatgtaatggacatgtgtaagtgtttatatggtgtgtttgactcttatatgtagtgtaatgaaaggctttgtatgtacatggaaaaaatggaaggctttgtattgtaactggctggagtttaagacattgctctagctatatgttgcacaaaacaacagcaatgttatatgttactgaggtaaagttgtaag

SEQ ID NO: 5421 - DNA, 1292 bp, Arachis hypogaea
aatacaacaatcagcgtaacgcaagtgggcggacaccaaaacgacgctgtgcagagcgaccttttcggctttcttaacatcgcgacgtagacgacgactctgtccgacgaaacggttacgctttagtgctccttcctggtgccgctcttgtacgctactttcctttgtacatcgccatcttcccgagaaacgacgtcgtatccttcaccctccatcggaagaaaacccgattccttcctcttaattccgaaaccctacttataattcgtcccaaatttagtagaccaatggcatcgtcatcagactcatggatgaaggaatataatgaagcagtgaaactcgccgatgatatcaatggcatgatttctgagcggagttcattatccacatctggaccagaagctcagcgtcatgcatctgctataagaaggaagattactatcttagggatcagacttgatagcttgcaatcccttttatctaaagtccctggaaaatctgagaaggagatgaatcgccgcagggaaacacttacaactttgaggtcaaaagttaaccaaatggcttcaacactgaacatgtcaaactttgcaaatagggatagtttatttggtcctgaaataaaaccagatgcaatgagcagaactgttggcctggataacagtggactcgttggacttcaaaggcaaattatgaaagagcaagatgaaggccttgaaaaattggaggagactgttgtaagtacaaagcacattgcattagcagtgaatgaagagctgagtctacacactagactaattgatgacttggacgaacatgtagatgttacagattctcgtctaaggcgtgtccagaagaacttggcagttttaaacaaacgtaccaagggtggttgctcctgcttgtgcatgcttttagcagtggttgggatagtggttttggtggttgtgatatggttgttggtcaaatatttgtagacacaaaaataccctactaagcttttcctttcttgttgtgcgtactgaaacagcataatcaagtttctttgattcttggtgtcttgaaatggcattgtatctcaattttcgttttctaagtggttgatgtctgggttttctcacttgtaaaaatatgagcttcctttgtgacagattgatcgtgtgcaaagagaatattaatgccacgtattgcctatcaatcaaaatctaatgcttcatcagttccagcttcgttgtacgtctgaatccgaatttcatactcgttttggttatataaatactattttcaattag

SEQ ID NO: 5422 - DNA, 1057 bp, Vigna unguiculata
acaccttaaacgacgactgtttcagaccaacggtgccggttggtggtgccgcctttacgccgatctcacaaaccacgttctatccattattctcatcaaaaccaaacccctccctcctctttacccacaaaccctaattcagaagacaggaggtcgctttcttcaccatcattagcgcgcaaatggcatcttcttcagacacttggatgaaagaatataatgaagctgtaaaacttgctgatgatatcactggcatgattgctgaacgtagttcatttcctgcatctggacccgaaacccagcggcatgcatctgctacaagaaggaagatcacgatattagggaccaggcttgatagcttgcaatctcttttgtcaaaggtccctgcgaaaactgagaaggagatgaatcgtcgcaaggatatgcttggaaacttgaggactaaagttaaccaaatggcttcaacattaaacatgtcaaactttgcaaatagggatagtttgcttgggccagaaataaaatcagatgcaatgagcagaactgttgggctggacaacagtggactagttggtcttcaacggcaaattatgaaagaacaagacgatggccttgagaaattggaggagactgtaatcagtactaaacatattgcgttggcagtgaatgaagagctggatctacacactagactcattgatgacttagacgaacatgtagatgttacagattctcggctgaggcgagttcaaaagaacttggcagttttgaacaaacgtaccaagggtggttgctcctgcttgtgcatgcttctatcagtgatcggtatagtggttttggttgtcgtcatatggctgttgatcaaatatttgtaaagataaaaatacccaactcgtgaactctcttttttatgtttctaaatatgtgcattgaaatatggcaacgtgtttctttgtttttatcactcgttgttttggaaatgacagggaatttactttgttgaaaggttttgttttgtaattctcagttttaaagttttgccttggagtgtttctgttgt

SEQ ID NO: 5423 - DNA, 1149 bp, Citrus clementina
aggtcgataaggaattattggagcttttttggcctttattttttttattattattctacaattcttgtgaagtaaaacgaggacgggccgtacaaaaccggcagtgttgacgctaattcacgtcttttagctcgttaatgcgacttagctttgctccatcctaaacttctccaatccaatccctctctcagtctagaatccgaaatctacccataatctgttcaatggcttctgcttcagactcgtggataaaggaatacaatgaagcaataaaactggcagatgatattaatggcatgatatcagaacgaagttcgatgcccgcatctggacctgaatcccagcgtcatgcatctgccatacggaggaagattaccatattaggaaccagattggatagcttgcagtcccttttatctaagcttcccgggaagcagcccatttcggagaaagagatgaatcgtcggaaggacatgcttgctaatttgagatccaaagtgaatcaaatggcttccacgttgaacatgtcaaactttgctaatagggatagcctgcttggaccagagataaagtcagccgatgtcatgaaccgagcaactggcttggacaatcagggccttgttggttttcaacgacaaattatgagagagcaagatgaagggcttgagaaactggaggagacagtagtcagtacaaagcatattgcattggcagtcaatgaagaacttgacctgcacactagacttattgatgacttggaccagcatgtggatgttacagattctcgcctacggcgagtgcagaagaacctggcaattttgaataagcgcacaaagggtggttgcacgtgtatgtgcatgcttttagctgttatcggaatcgttgttctggttgtggtcatatatatgttgatcaaatacttgtaaaactcacaatggtgaatgcaactgtttcccccttgctgtctgtcttttggtgtgctggctgggtttcgctcttattgttgtgtgcaaacttttcgtttgattttcttgttttctttgtctgctttgtaagtgaagtcaaaaggttgaggcattcaacaactcagtaaattgttagtaaatttgtcgtgctcatattgccatattaatctttttatcctctcgt

SEQ ID NO: 5424 - DNA, 1148 bp, Citrus sinensis
aggtcgataaggaattattggagcttttttggcctttatttttttattattattctacaattcttgtgaagtaaaacgaggacgggccgtacaaaaccggcagtgttgacgctaattcccgtcttttagctcgttaatgcgacttagctttgctccatcctaaacttctccaatccaatccctctctcagtctagaatccgaaatctacccataatctgttcaatggcttctgcttcagactcgtggataaaggaatacaatgaagcaataaaactggcagatgatattaatggcatgatatcagaacgaagttcgatgcccgcatctggacctgaatcccagcgtcatgcatctgccatacggaggaagattaccatattaggaaccagattggatagcttgcagtcccttttatctaagcttcccgggaagcagcccatttcggagaaagagatgaatcgtcggaaggacatgcttgctaatttgagatccaaagtgaatcaaatggcttccacgttgaacatgtcaaactttgctaatagggatagcctgcttggaccagagataaagtcagccgatgtcatgaaccgagcaactggcttggacaatcagggccttgttggttttcaacgacaaattatgagagagcaagatgaagggcttgagaaactggaggagacagtagtcagtacaaagcatattgcattggcagtcaatgaagaacttgacctgcacactagacttattgatgacttggaccagcatgtggatgttacagattctcgcctacggcgagtgcagaagaacctggcaattttgaataagcgcacaaagggtggttgcacgtgtatgtgcatgcttttagctgttatcggaatcgttgttctggttgtggtcatatatatgttgatcaaatacttgtaaaactcacaatggtgaatgcaactgtttcccccttgctgtctgtcttttggtgtgctggctgggtttcgctcttattgttgtgtgcaaacttttcgtttgattttcttgttttctttgtctgctttgtaagtgaagtcaaaaggttgaggcattcaacaactcagtaaattgttagtaaatttgtcgtgctcatattgccatattaatctttttatcctctcgt

SEQ ID NO: 5425 - DNA, 1067 bp, Humulus lupulus
atgaaaaagtaattgttaaaggtccggtcatataactcaaaagcctcactcagccgtgcgtgagagagagaatccagccgtccgccgtcgtacctctctgtcaattccctcgccggcaaagaccaaggcaactgagactcccaaattcttccgtcaattgcatgaaataacaagatcgaaatttatataaaattttgtttttgtcaaccccattatccgatcgaacctcaattttagccctaaaccaggtttgatggcatcttcttcggattcatggatgaaagaatataatgaagctgtgaagcttgctgatgatatcaatgggatgatatcggaacgaagttcactgcctgcatcaggcccagaactgcagcgtcatgcctctgctattaggaggaagattacaatcttagggactagacttgatagtttacagtcccttttatttaagcttcctgggaagcagcctatatcagagaaagagatgaatcgccgcaaagacatgcttggaaatcttaggacaaaagtgtcccaaatggcttcagcattaaacatgtcaaactttgctaatagagacagcttgcttggtccagaaataaagcctgctgatgccatgagcaaggcagctggcttggacaataatggccttgtcggtttccagcgacaagttatgaaagagcaagatgaaggccttgagaagttggaggaaactgtaataagcacaaagcatattgcactggcagttaatgaagaactagatctgcacaccagacttattgatgacttggactaccatgtggatactaccgactctaggctgcggagagtgcagaagaccttggcaattatgaacaagcgcaccaagggtggttgctcctgcatgtgcatgttgttgtctgttgttgggattgtggctttggctgctatcatatatctgctagtcaaatacctctagtagaatcacgagattataacaaaaacagggcctgcattttctatgactgtgcttctttgtgtggtttgactttgacaattgccataatggttgtaatatagtatatggtttt

SEQ ID NO: 5426 - DNA, 1161 bp, Tropaeolum majus
attcggccattacggccgggggggaccgtaaagacattgccgtgtagacggtggcctgatgtctgtctttttcccccactaatacgacaccgttgtagtccgcaactcttcagctaaactcgatcttactcaggaccagagtcagaaccttatgagactacaattcccagagaattaggacaatggcatcttcttctgactcatggtcgcaagaatataatggagcgttaaagcttgtggatgatatcaatggcatgatatcagaacggagttcattctctacctcagggcccgaagctcaacgtcacgcgtctgctataagaagaaagataacaattttgggtactagactagatagtctagaatcacttttgtctaagcttccaggaaagcagcaaatttcagagaaagagaagaatcgtcgcaaggacatgttgggaaatttgagatcaaaaacaacccaaatggcttccacgttgaacatgtcaaatttcgcaaacagggatagcctgcttgggccagatgtaaaacaacccgacctcatgagcagagcaactggaatggacaatcaaggccttgttggttttcaacgccaaattatgagagagcaagacgagggactcgagaagttggaagagaccgtgataagtacaaagcatattgccttagcagtcaatgaggagcttgaactgcataccagacttattgatgacttagaccaacatgttgatgtcaccgattcccgcctacggcgagtgcagaagaatctagcgtttttgaacaagcgcactaaaggaggttgttcttgcttgtgcatgctgttgtctgtaatcgggatcgcggttctagtggttgtgatatggcttctggtcaagtacttgtgatacaaatcaaacaacaaacaacaaacgacaagctctactcgtgtacatgtgtgtctggtttgaagaactgctttcgattatcgaatgtcatgtttggaacatatctatttggcttggcttgttttttctcttcttttcaatcaggcttttgttgtgtggtgaaaaaagattctggttttaaaacattgtttgtaaatttatgagcagtttcaagtgtctttttcccttgaagtattcactgattctctttctttagttgtttttatgtaattattta

SEQ ID NO: 5427 - DNA, 1169 bp, Malus domestica
ggactggggcggatagaccgatggagaagcctttgggaaccacgacaataacgacgccgtatgcgacacacagccaccagctaaataaattataattccgacgtcggggtcggacaaagattccgccctctctctctctctctccctctccctctccctctcccctttgttgttggttggttgtgccgccctacggcgtcgtctccttccgttaaagttaagccttttccattaatcaaatcaaatttaatcaaactatctcccattctccacgaccctcaatcgtaatccctaattcagtacaatggcatcttcttcggactcatggataaaggaatataacgaagcaacaaaacttgctgatgatatcagtggtatgatatctgaactgagtacattgcctgcaggtcctgacacccagcgtcatgtctctgctatacggcggaagattacaatattggggactagacttgatagcttacagtcccttctgtcaaaactccctggaaaacagcacatatcagagaaagagatgaatcgtcgaaaggatatgataggaaatttaagatcgaaagtgaagcagatggcttcaacattgacgtccaactcttccaaccgagatagcttgctggggccagaaataaataaaactgatgccatgggaagaacagttggactagacaactacggccttgttggtttgcaacgacaaattatgaaagagcaagatgaggggcttgagaaattggaggagactgtaataagcacaaaacatattgcattggcagtcaatgaagaacttgacctacacactagacttattgatgacttggatgatcatgtggaagttacggactctcggctacggcgggtgcagaagaacttggcagttttgaacaagcggacaaagggtggttgctcttgcatgtgcatgcttttatctgtcgtcgggatcgtagttctgattgctgtgatatttttgctgatcaaatacttgtaataatgccaactataagtgtataccgagtctcatgatttccagtttgtgtgtgtttgatgtggattgctgtcttcgttgtgatgatggtgtgttttcttgctttgaagcatgtttttcaaggctttgaaatgaggtgaaaagaatcagtcactaagcaaaattgttgaca

SEQ ID NO: 5428 - DNA, 1165 bp, Carica papaya
gctgtaatcaaaactaattgaattggaaaggacgacgcgaccggacaggagctgccctgcaatgcgtgttgatggttgcgttgtctttttgcccattaaatccactttctttttgaccctccaaccctaaatttaatcctgatttttcttctgcaaaaacctcgtttgcaatccggatttccaaaatctacgagttaatggcgtcttcttcagattcatggatgaaagagtaccatgaagcagtaaaactcgcagatgatatcaatggcatgatatcagaacggggttcttttcctgcatcagaacctggcagtcagcggcatgcatctgcaatacggaggaagattaccattcttggaactagattagacagtctgcagtctcttctatctaagcttccaggaaagcagcccatttcagagaaagagatgaaccgtcgcaaagacatgcttgctaatttgaagtcaaaaacaaatcaaatggcttccacgttgaacatgtcagggtttgctaacagagacagcttgcttggaccagaacagaaatcagaagatgtcatgagcagaacaactggcttggacaaccaaggccttgttggtcttcagaggcatattatgagggagcaagatgagggccttgagaagctggaggagacagtaataagtaccaagcatattgcgttggcagtcaatgaggaacttgacctgcacacaaggcttattgataacttagaccaacatgtggatgttactgattcgcgcctacggcgagttcagaagaacctggcaattttgaacaagcgcaccaaaggtggttgctcctgcatgtgcatgctcttatccgttattgggattgtgggtctgattgttgtgatatggcttttgatcaaatatttgtaattccaacaacaatgatgagaacaacaagaacaaacaaaaggcagcgagaagcttctcttgtgtttcatgtgtgtgtttgtgtctgtgtaatggttttcgattgttggtaccatgttcggaagtactcatttggctggcttgttttctttacacaccgtcttgtatgaagtgaaggattttctgaggtgtttaaacaactcctgtaaattgttatgatgagtaattttaagtgtcgtggtacagtaagtactgtacttgaagtatta

SEQ ID NO: 5429 - DNA, 1100 bp, Vitis vinifera
ggaggatgtcatttccgaaaggagattgaaaggctgaccaaaacgacatctgcgtgggacaaactctgccggttcatggtggcgcccgccctctcccctctcgctctctatcgtattcctccactcaatctaaagcccccccaatctcattccttctcgactcttctccacgttctgcttctttttgttacagaccaatggcttcttcagactcgtggatgaaagaatataatgatgcagttaaacttgctgatgatatcaatggaatgatttctgaaaggatttcattttctgcaccgggagttgatgcccaacgtcatgcatctgcgatccgaagaaagattacaatattagggactagacttgacagcttacagtcccttttgtcaaagcttcctggaaagcagcccttaactgagaaagagatgaatcgacgcaaagacatggttgcaaatttgaaatcaaaagcaaaccagatggcatcaacattgaacatgtcaaactttgcaaacagagacagcttgcttggcccagagataaagcctgctgatgccatgaacagaacaacaggtttggacaactatggccttgtgggccttcagcggcaaattatgaaagaacaagatgagggacttgagaaattggaagagacagtatatagtacaaaacatattgcattggcagtcaacgaagagcttgacctacatactagacttattgataacttggaccaacatgtggatattacagactctcgtctaaagcgagtgcagaagaatctggcaattttgaacaagcgcaccaagggtggctgctcctgcctgtgcctgctcttatcagttgttggcattgtgattctgattgttgcgatatggttgctggttaaatacttgtgatacaaacattctggagaaaacccgtctttcccctgcgtgtgttggatcaaaattgggttttgttagtctcattgtttgtctttcctgattttcttgtgctttgatcatgccatggtatggcttggtgtttactgatcaactttgtaatcgtcggattatgtagcatcatggatgcctccttttttaagcagtgatcaattcgca

SEQ ID NO: 5430 - DNA, 1327 bp, Vitis vinifera
aaagcagcgacccatttattacttccacctggtgctatcaaagggaggatgtcatttccgaaaggagattgaaaggctgaccaaaacgacatctgcgtgggacaaactctgccggttcatggtggcgcccgccctctcccctctcgctctctatcgtattcctccactcaatctaaagcccccccaatctcattccttctcgactcttctccacgttctgcttctttttgttacagaccaatggcttcttcagactcgtggatgaaagaatataatgatgcagttaaacttgctgatgatatcaatggaatgatttctgaaaggatttcattttctgcaccgggagttgatgcccaacgtcatgcatctgcgatccgaagaaagattacaatattagggactagacttgacagcttacagtcccttttgtcaaagcttcctggaaagcagcccttaactgagaaagagatgaatcgacgcaaagacatggttgcaaatttgaaatcaaaagcaaaccagatggcatcaacattgaacatgtcaaactttgcaaacagagacagcttgcttggcccagagataaagcctgctgatgccatgaacagaacaacaggtttggacaactatggccttgtgggccttcagcggcaaattatgaaagaacaagatgagggacttgagaaattggaagagacagtatatagtacaaaacatattgcattggcagtcaacgaagagcttgacctacatactagacttattgataacttggaccaacatgtggatattacagactctcgtctaaagcgagtgcagaagaatctggcaattttgaacaagcgcaccaagggtggctgctcctgcctgtgcctgctcttatcagttgttggcattgtgattctgattgtcgcgatatggttgctggttaaatacttgtgatacaaacattctggagaaaacccgtctttcccctgcgtgtgttggatcaaaattgggttttgttagtctcattgtttgtctttcctgattttcttgtgctttgatcatgccatggtatggcttggtgtttactgatcaactttgtaatcgtcggattatgtagcatcatggatgcctccttttttaagcagtgatcaattcgcatctctgtccctatacaatgacaagtttacaaccatggaagcttttaacctagtgaaggtgattgacttcatgtttggaatgaaaacggttttctttagaacaaaaaatagttttctaaactcaaaaaacacattggataaacttatgacagaaaacaattcttaaagagtttttctccaaaaaa

SEQ ID NO: 5431 - DNA, 1249 bp, Quercus alba
gagagagagagagagagagagagtgaaatgagagaaaagattaataataatttacaattccaactttcatttcattcattgtcgtgtgtttttgaccggagccggacatatttattttagttttattaaaaatatttacttccggttctatcctaggtggtgctgctgccgtacgtcatttccaaattcctccaatcctacacgctccttcacgtatacgacctcgtttcgatcaccatcaaattcccaaaacacaggtcaatggcagcttctgcagactcatgggtgaaggaatacaatgaagcagtaaaacttgccgatgatatcaatggcatgatttctgaacgtagttcattgcctgcaacaggaccagatgctcagcgtcatgcatcttctatacggaggaagatcacaatattagggactagacttgatagcttacagtcccttttgtcaaagattcctggaaagcagcccataacggagaaagagatgaatcgtcgcaaggacaatcttgcaaatttgagatcaaaagttaaccagatggcttcaacattaaacatgtcaaattttgctaacagagacagcttgattggcccagaaataaagccagctgatgctgtgagcagaacagttggcttggacaactctggccttgtcgggcttcaacgacaagttatgaaagagcaagatgaggatcttgagaagttggaggtgactgtagtaagtacaaaacatattgcattggcagtcaacgaagaacttgaccttcacactaggctgattgatgacttggaccaacatgtggatgttacagactccaggttacggcgggtgcaaaagaatttggctattttgaacaagcgcaccaaaggtggctgctcttgcatgtgcctgcttttgtcagttattgggatcgtggttctggttgctgtcatatacttattgatcaaatatttgtaataacaacaatggcaatcactgctttctttttgtattatgtggttcttggtgtgaattggcttttgttgctcctgtcatggttgttaacaatatttggcttccgtgttttcctttggtgattttttgtttgcgaaatgcaattggtgaggtgttaagatgcttttgtaaatcgcatttgtaatcggcctatttgtatatttatcttttcttgcctattttgcacaatgaggaaagaaagaagcatttatcatgctactatatccattggcgaagtaagtgttgtcaa

SEQ ID NO: 5432 - DNA, 1089 bp, Fagus grandifolia
aaacgacaccgtgttgggaaacaataattccaacttcattcattgtcataacactcgtgtgacaacattagacgacgacggagctggccattcacattccatacgcacacacacttccggttctaggcggtgccgtaggtcgttgtcaattccaattctaatcctacacgcttccccaatacgacctcgtttcgatcaccatcaaattaatcatcagatcaatggcagcttctgcagattcatggatgaaggaatataatgaagcattaaaacttgccgaggatatcaatggcatgatttctgaacgtagttcattgcctacaacaggaccagatgctcagcgtcatgcatctgctatacggaggaagatcacaatattagggactagacttgatagcttacagtcccttttgtcgaagcttcctggaaagcagcccgtaacagagaaagagatgaatcgtcgcaaggacaatcttgcaaatttgagataccaaagttaaccaaatggcttcgacattgaacatgtcaaattttgctaacagagacagcttgcttggcccagaaataaagccagctgatgccatgagcagaacagttggcttgggcaactctggtgttgttgggcttcaacgacaagttatgaaagagcaagatgaggatcttgagaagttggaggagactgtagtaagtacaaaacatattgcattggcagtcaacgaagaacttgacctacacactaggctgattgatgacttggaccaacatgtggatgttacagactccaggttacggcgggtccagaagcatttggctgtcttgaataagcgcaccaaaggtggctgctcttgcatgtgcctgcttctgtcggttattgggatcgtggttctggttgctgtcatatttttattgatcaaatatttgtaattaccaacaatggcaaactctgccattgttctccttgtatgtgcttcttggtgtgaattggcttttgctgtcatggttataacaatacctggcttttgtgttttcctttgctgcttttgtttgcgaaatggaattggtgaggtggtcagatgctttgtaaatcgc

SEQ ID NO: 5433 - DNA, 1257 bp, Panax ginseng
tgaccacaggtaagacatgcggccaggccaaaatccctggacactacccgcaggacctgcgaccagtgtccagagaattggcctattgccctaacctgttaacaacaacaacacaacaacaataccattcttgcaactttacattcttggtcccttaaaagaagcagtggtatcaacgcagagtacatggggacgacgacgacgaggaggtcggacaaagtttgccggttgatggtggcgccgtgcgtcgctttttcaatagcgttcaaccctattaaatcatccaaaacccaacaattcgatcgcctcatcaattccatttccaatcgaacaaaattcagatcgttgattcaaagccaaagagataaatggcgtcatctgcagattcatgggcaagggaatataacgaagcagtaaaacttgctgatgatataactggcatgatatctgaaaggacttcgttgccatcagggccagaagcgcaacgtcattcatctaccattcgaagaaaaattacgatattaggaactagacttgacagcttacagtctcttctatcgaagcttcccggaaaacagcctttaacagacaaagagatgaatcgccgcaaggacatgcttgcaaatttgagatcaaaagtaaatcagatggcttccacgttgaatatgtcaaactttgccaatagggacagcttgctcgggccagaaagtaaacctgttgatgctatgagcagagcaactggattggacaactatggagttgttggtcttcaacgacaaattatgaaagaacaagatgaggggcttgagaaattggaggagactgtattaagtaccaaacatattgcactggcagttaacgaggaacttgacttgcacacaagactaattgataacctggacgatcacgtggatgttacaaattcccgtctacagcgagtacagaagaacctggctatcctgaataaacgcaccaagggtggttgctcctgcatgtgcctactgttgtcagtaattgggattgtcgttctggttgttgctatatggttgttggttaaatatttataagccaaaccagtaaactcgagcaacttgcgtatatttgtgtgctttgtatctttgtcttggtcgatgtatctttctgtgcgttgggttttaaacatcttgcctacctgatgttgtcaaaactttaatgaaatgatgtgttaagttgctaagactgttgtgaattgcagataacccagtttcaccgagtatt

SEQ ID NO: 5434 - DNA, 940 bp, Amsonia hubrichtii
tgcttgcgccctgtgtctctcttcgctttaattttctccatctcttctcccacgctccgttaacaatcattctttcggtctcacctcacctcaagaagagcttcaatctacatcgccgattcgaatccaaacagtcgcagataaatggcatcctctggagatccatgggtgaaggaatataatgaagcagtgaaacttgcagatgatattactggcatgatctctgaaaggagttcagtgccagcaacaggcccagaagcccagagacattcatctgccataagacggaaaatcacaattttaggaaccagacttgatagcttacagtctcttctttcaagggttcctggaaagcagctaacggagaaagaaatgaatcgtcgcaaagacatgcttatgaatttgagatcaaaagtaaaccagatggcaactgcattgaacatgtcaaactttgcaaatagggatagcttgcttgggccagaaattaagcctgttgatgccatgagcagaacaacaggccttgataacaatggtgttgttggtcttcaacgacaagtcatgaaagaacaagatgagggcctggagaaattggaggagacagtgataagcaccaagcacattgcattggcagtcaatgaggaacttgacctgcatacgagactaattgataacctggaccagcatgtggacgttacagactcccgtctactgagagtccagaggaagcttgcctttttgaataagcggacgaagggtggttgctcctgcatgtgtatgcttttatctgtaatcggcattgtggttctggttgctgttatatatttcctggtcaaatatttgtaatacaaaaagttgaaaactgaaactttatcctagtctttgttgtgtgtgttggcaatggaactgaactcagcattggtgactgaaaaagaggtgtgaa

SEQ ID NO: 5435 - DNA, 1557 bp, Cannabis sativa
aaaaatgaaataaaaagacaaccttcattctcaaccgttcagatatattatgagacttaatcttggccgtccatttacacatccttttgctataaatagagccccctgacgaagtttccaggtcttctgatcatttttttatgggtaccgaacttccgattagattggattggtgttgatcttcttccaatttagggtttatcatcatccgaagaagaatcggtttgtacattaatggttgaaacctggacttaatttcctcactaggcaaattcttgtttgcaactccgcgtttggctttgttaccctaatttctcaaatcgtttgatggcatcttcttcggattcatggatgaaagaatacagtgaagcagtgaagcttgctgatgatatcaatgggatgatatcggaacgaagttcactgtctggatcaggcccagaaatgcagcgtcatagctctgctataaggagaaagattacaattttaggcactagacttgatagcttacactccctcctatcaaagcttcctgggaagcaccctttatcagataaagagatgaatcgacgtaaagacatgcttggaaatcttaagtcaaaagtgtcacaaatggcttcatcattgaacatgtcaaactttgctaatagggacagtttacttggtcctgaaataaagcctgctgatgccatgggcaaggcagctggtttggacaataatgggcttgttggtttccaaagacaagtgatgagagagcaagatgaagggcttgagaagttggaggagactgttataagcacaaaacatattgcattggcagttaatgaagaacttgatttacacactagacttattgatgatttggactaccatgtggatgttacagactctagactgcggagagtgcaaaagaccttggcaattatgaacaagcgcaccaagggtggttgctcctgcatgtgcatgttgttatctgttgttgggattgtggctttggctgctgtcatatttcttctagtcaaatacctttaataagaaagaatcacgagattacaacacttgtgcttctttgtgtggtttgacttttactataatggatgtgatatatattatatggtttttgtgcatttgtgaagatttgtggataattcaaattacttgtttggtgtgtcatttggcaccattttctcaattgaattttcaggttgtgttgatttgataaactgcggcctttcttccttgtgggtttgacatagtatcatcttccctgcttttatctctcctattgttcatcatgactccagttttgaatttctttatgactccattctttctttaaggaatttatttataagctgtccatcttagtatatgcattttgttcactaatttcaggttctcgactagttttaccgggtctattttaacaagaatctaaccttggaagggagttgttctggactagtgttttcttataactttagcttcggtctttgtgagatttttggttcatgaatcatgttgttttgtttgaaacttctttcacggcttcaattgttt

SEQ ID NO: 5436 - DNA, 1064 bp, Castanea mollissima
cgacgacggagccggacatatttattttagttttattaaaaatatttacttccggttctatcctaggtggtgctggtgccgtacgtcatttccaaactccaattcaacacgctccttcaccaatacgacctcgtttcgatcaccatcaaattcccaaaacacaggtcaatggcagcttctgcagattcatgggtgaaggaatacaatgaagcagtaaaacttgctgaggatatcaatggcatgatttctgaacgtagttcattgcctgccacaggaccagatgctcagcgtcatgcaactgctatacggaggaagatcacaatattagggactagacttgatagcttacagtcccttttgtcgaagattcctggaaagcagcccataacagagaaagagatgaatcgtcgcaaggacaatcttgcaaatttgagatcaaaagttaatcagatggcttcaacattaaacatgtcaaattttgctaacagagacagcttgattggcccagaaataaagccagctgatgccgtgagcagaacagttggcttgaacaactctggcgttgtcgggcttcaacgacaagttatgaaagagcaagatgaggatcttgagaagttggaggtgactgtagtaagtacaaaacatattgcattggcagtcaacgaagaacttgaccttcacactaggctgattgatgacttggaccaacatgtggatgttacagactccaggttacggcgggtgcaaaagaatttggctattttgaacaagcgcaccaaaggtggttgctcttgcatgtgcctgcttttgtcagttattgggatcgtggttctggttgctgtcatatacttactgatcaaatatttgtaataacaacaatggcaaacactgctttctctttgtattatgcggttcttggggtgaattggcttttgttgttcctgtcatggttgttaacactgctttctatttggcttccgtgttttcctttggtgattttttgtttgcgaaatgcaattggtgaggtgttaagatgcttttgtaaatcgcatttgtaatcggcc

SEQ ID NO: 5437 - DNA, 1090 bp, Fagus grandifolia
acccccatatatattggagtaaattattgaacaataaagaggaaaacgaaagaattattccaacttcattcattgttgtgagcccgagatctatatttcatatgatacacacttccggttctaggctcgttttcaatacgacctcgtttagatcgccatcaaattaataaacaggtcaatggcagcttctgcggactcatggatgaaggaatataatgaagccttaaaacttgctgaggatatcaatggcatggtttctgaacgtatttcattgcctacaacaggaccagatgctcagcgtcatgcatctgctatacggaggaagatcacaatattagggactagacttgatagcttacagtcccttttgtcgaaacttcctggaaagcagcccgtaacagagaaagagatgaatcgtcgcaaggacaatcttgcaaatttgagatcaaaagttaaccagatggcttcaacattgaacatgtcaaattttgctaacagagacagcttgcttggcccagaaataaagccagctgatgccatgagcagaacggttggcttgggcaactctggccttggttggcttcgaacgacaggttatgacagagcaagatgaggatcttgagaatttggagacgactgtagtaaagtacaaaacgctattgcattggcagtcaacgaagaacttgacctacacactaggctgattgatgacttggaccaacatgtggatgttacagactccaggttacggcgggttcagaagaatttggctgtcttgaataagcgcaccaaaggtggctgctcttgcatgtgcatgcttctgtcagttattgggatcgtggttctggttgctgtcatatttttattgatcaaatatttgtaaataccaacaatggtgaactatgccattgttctcctagtatgtgcttcttggtgtgaattggcttttgttgttcctgtcatggttataacaatatttggctttgctacttttgtttgtgaaatggagttggtgaggttttaagattgctactttgtaaattagctattttgtaaacagactattattttaaatatttaacaaactagt

SEQ ID NO: 5438 - DNA, 1268 bp, Vigna unguiculata
gatggaagaaaacaacacactcatgcgcacactcaggtagccctagctctgaacatcgaacacaaacacagtcgaaggtgttgccttgaccaaagatggtgcagtggcagagacacattttccccttccttcgccaccttcacaagcgagttgtggatccccaccatgccaatccttcagctccaagccttgtcatttctcgcttagcctcttctctttcacaaggtcaggtagggaggagagcgtggacaattacgacaccaactttgccctgtttctcaagacccatttttcttggtttccaacatcagggaatttcaagtactgctccattactagcaaattcatctgaggaaacacctgttttgtcacctttagtcccagtttcttctttgggtagttcaaaaggtgaagaccagaagcagaaagctgttactaagccagaaaaggttcaagcaatattaaagggaataaagcagagtccgaagaaggtcaacctagttgctgctctggttcgtggcatgcttgtcaaagatgcattgatgcagctggaattgacaataaaaagagcatcaaaaactgtttatcaggttattcattcagcccgagcaaatgcctctcacaatcatgggttagatccagaacgtctcatcgtagcggaagcatttgtagggaagggatatttcaaaaggagaattgcctaccatgccaaaggaagatcaggaatcataatgaaaccagaatgcaggctaacagttgtagtgagagagataactccagaagaagaggctgatattgctaggttgagagttcacaactttaagaaactaactaagcgggagagacgacttgtgcctcatcaacttattgagaccactcctgtttggggccgaaaaaacaaatctagtgctcaaaacttgagtgctgcacctgcatgagcctcactttgtttccaagttttcatgcctcatggcattttttgtgtaatagattattcttcttggccatcacataatatggaaacagttgagagctttgtctggcccttgttgcaaatgatagaagtttgtgctggatcatgttcagtattattctcatttagtagcttatttctcttcctgataggtactaaaagggatatgccctgttcaattagcagcatgaatctcctcttgtttggagttgaagtataaccctgtgatttacaagataagggtattctttcatcatttttataaaatgtgctttaattaaaaaaaaaaaaaaaa

SEQ ID NO: 5439 - DNA, 2778 bp, Glycine max
tttcactccatcagtacagtcacctagcgtttaaccctagagttttggtttggcctttcttctcttctcttcttatttcccacaaaatcatttcacaaagagaagagacagtggatcgcggtttcatttcagaccaaagatggtgcagtggcagagacacgttttcccctttcttcgccacattcacaagcgagcagtggaaccccacgccacccattctgctccaagccttgtaatttctcgcttagcctcttctctttcacaaggtcagttaggaaggagaacatggacaacaacaactttgccctgtttctctagacccatttttctcggtttccaacatcagggaatttcaagttctgctaacttgctggcaaattcatctgaggaaacacctgttttgtcacctttagtcccagtttcattattgggtagttcaaaaggtgaagaccagaagcagaaagttgttactaagcaagaaaaagttcaagcggtattaaaggcaataaaacagagtccaaagaaggtcaacttggttgctgctctggttcgtggtatgcttgttaaagatgcattgatgcagttggaattgacaataaaacgagcagcaaaaactgtatatcaggttattcattcagcccgagcaaatgcctctcacaatcatgggttagatccagaacgactcattgttgcggaagcatttgtaggaaaggggttttacaaaaagagactttggccccatgctaaaggaaaatcgtcgcttagagtaagaccagaatgcaggctaacagttgtagtaagagagataactgctgaagaagaggcagagattgctaggctgagggtccacaacttcaagaaacgcaccaagcgtcagcaacgacttgtgcctcatcagctcattgtgtccaatcctatttggggccgcaaaaacaaatctagtggtaaaaacttgagtgctacacctgcataagctgagcttttgcttgtttccatgcttatgtcatttttcgtgtatggaaacagttgagaaatatatgtctgtcccttgttgcagatgatagaattttgtactggatcatgtttagtattgttctcatttattagcttatttttcttcctactaggtactataaagaatgtcttgttcaatcaccagcatgaatctcctcttgttttgtggggaagtataaacatatgttttttttatttttatttttaaataaaggcgtattcttgcaagttgcatcatttaacgtggtgtgctttgattatttgctaaatgttacttagtcttatgtttaggttttaatacattaagttcttcaaaagtatcatttttcattttggtgttttcttcaagtttttgttaaatactgttcacactgttgttgttttgatttttaaccgtcattatttttttttcctattcatcttgttggaaccacattaacaattacgatgcgggcaccctccaccccacaaacccagatctgtgaccacctcccccaactctgacggcctctccttgctggctctcaaagtcacggtggattccaaccccgccgacgttctttcttcctggtcggaaactggcccggattgtcttgcttcggcgacaaagtgacccaaatttctcttccaaacaagacctcatcggttacatcccaaccggactaggcttcttaacatccctcagaagaccaaaccttccctacaacaacttctcaaacgcgattttcccatctttcttcaacgtccttgacctctctcacaacactctttcccggttccctccctacagtcaaaagcttaatatgctaaaataacatttaaccttaattatttataatatccggattcttgagcgttgaaatgagtggtatgaagtgtaagtttggtttcataatagataaatagtaggatgagtgtgtacaagacctacaagcccgttctgttgttctcatgcaagccgacaaacttgaaccgcctttgttttgtgagattatgatatctgttatttatctctgtctgcattttaaggctttcagagttcaggccattttcattacggcattacccataaaaaatgcacatttctatttcttttcacctgcatctgatatgtggcaattgaatctaatagtaaagttacttgaagcagtaacacaatattctcttcttttattttattaataaaattatctttggtgttagttaaaatgtgtttaatggatatttggtaacttcaatagatattaacgttataagagtgtttcagtataagggataaatctgtattgtttacctaaaattttgtctatattttacctataaaatgatttatttgtatgatcttttgattttggaagtgagttgctatttttttttatcagcagctagctctacgttagcattacatagatatcttacttcaatatatatatacatgcaatctgcaccaacatatatttcaccaaaaaatgaagtggctagtaattgatgtaaatacttaatgtggcaaaaattaaaatacacaaaggtctaggaaaataaaagttaggatactcaaatagtagtgatacaatttgttaattctataatatatagaaaatgaaaagaaaaatctgcacgcccttatctagttatcttcttgaatttaggaaacatatttctggcaataatagagtagctgtctcaattttatcttctttctttttttgtgcaatctcagtagacaaatcaagccggcaaactaaaaaggcatcagagaattaa

SEQ ID NO: 5440 - DNA, 1344 bp, Glycine max
catttttttaaaatacgtctatttcagactatcggttcttcttatttttctttcatttgatttcactccgttaggaccgtcaccgtttaaccctagaattttggcctttcttctcttttcttcatttttttccccctaaaagcatttcacaaagagaagacacagtggatcgtggtttcacttcatttcagaccaaacatggtgcagtggcataggcacgtttttccctttcttcgccacattcacaagcgagtattggaaccccaggccactcattcagctccaagccttgtaatttctcgcttagcctcttctctttcacaaggtcagttggggaggagaacatggacaacaacaactttgccctgtttttcaagacccgtttttctcactttccaacatcagggaatatcaagttctgctcagttgctggcaaattcatcagaggaaacacctgttttgtcacctttagccccagtttcattattgagtagttcaaaaggtgaagaccagaagcagaaagttgttactaagccagaaaaagttcaagcgatattaaaggcaataaaacagagtccaaagaaggtcaacttggttgctgctctggttcgtggtatgcttgttaaagatgcattgatgcagttggaattgacaataaaacgagcagcaaaaactgtatatcaggttattcattcagcccgagcaaatgcctctcacaatcatgggttagatccagaacgtctcattgttgcggaagcatttgtaggaaaggggttttataaaaagagactttggccccatgccaaaggaaaatcatcgcttagagtaagaccagaatgcaggctaacagttgtagtaagagagataactgctgaagaagaggcagagattgctaggctgagggtccacaacttcaagagactcaccaagcgtcagaaacgacttgtgcctcatcagctcattgagtccaatcctatttggggccgcaaaaacaaatctagtggtcaaaacttgagtgctacacctgcatgagctgagcttttgcttgtttccaagtttccatgcttatggcatttttcgtgtaatagaagattcttcttggccatcacataatatggaaacagttgagaaatatgtctgtcccttgttgcaaatgatagaattttgtactggatcatgcttattagcttattatttttcttcctactaggtgctataaaggatatgtcctgttcaatcagcagcatgaatctcctcttgttttgtggggaagtataaacctatgattttttattttaaaaataagtttacacttgcatcattttattagttgtgctttaatta

SEQ ID NO: 5441 - DNA, 1319 bp, Glycine max
gtttaaccctagaattttggcctttcttctcttttcttcatttttttcccccgaaaagcatttcacaaagagaagacacagtggatcgtggtttcacttcatttcagaccaaacatggtgcagtggcataggcacgtttttccctttcttcgccacattcacaagcgagtattggaaccccaggccactcattcagctccaagccttgtaatttctcgcttagcctcttctctttcacaaggtcagttggggaggagaacatggacaacaacaactttgccctgtttttcaagacccgtttttctcactttccaacatcagggaatatcaagttctgctcagttgctggcaaattcatcagaggaaacacctgttttgtcacctttagccccagtttcattattgagtagttcaaaaggtgaagaccagaagcagaaagttgttactaagccagaaaaagttcaagcgatattaaaggcaataaaacagagtccaaagaaggtcaacttggttgctgctctggttcgtggtatgcttgttaaagatgcattgatgcagttggaattgacaataaaacgagcagcaaaaactgtatatcaggttattcattcagcccgagcaaatgcctctcacaatcatgggttagatccagaacgtctcattgttgcggaagcatttgtaggaaaggggttttataaaaagagactttggccccatgccaaaggaaaatcatcgcttagagtaagaccagaatgcaggctaacagttgtagtaagagagataactgctgaagaagaggcagagattgctaggctgagggtccacaacttcaagagactcaccaagcgtcagaaacgacttgtgcctcatcagctcattgagtccaatcctatttggggccgcaaaaacaaatctagtggtcaaaacttgagtgctacacctgcatgagctgagcttttgcttgtttccaagtttccatgcttatggcatttttcgtgtaatagaagattcttcttggccatcacataatatggaaacagttgagaaatatgtctgtcccttgttgcaaatgatagaattttgtactggatcatgcttattagcttattatttttcttcctactaggtgctataaaggatatgtcctgttcaatcagcagcatgaatctcctcttgttttgtggggaagtataaacctatgattttttattttaaaaataagtttacacttgcatcattttatttgttgtgctttaattatttatagtatctggagcgttgaacttattagcaacatatcaaacagcaaatgagtttgt

SEQ ID NO: 5442 - DNA, 1242 bp, Glycine max
tacagtcacctagcgtttaaccctagagttttggtttggcctttcttctcttctcttcttatttcccacaaaatcatttcacaaagagaagagacagtggatcgcggtttcatttcagaccaaagatggtgcagtggcagagacacgttttcccctttcttcgccacattcacaagcgagcagtggaaccccacgccacccattctgctccaagccttgtaatttctcgcttagcctcttctctttcacaagttcagttaggaaggagaacatggacaacaacaactttgccctgtttctctagacccatttttctcggttcccaacatcagggaatttcaagttctgctaacttgctggcaaattcatctgaggaaacacctgttttgtcacctttagtcccagtttcattattgggtagttcaaaaggtgaagaccagaagcagaaagttgttactaagcaagaaaaagttcaagcggtattaaaggcaataaaacagagtccaaagaaggtcaacttggttgctgctctggttcgtggtatgcttgttaaagatgcattgatgcagttggaattgacaataaaacgagcagcaaaaactgtatatcaggttattcattcagcccgagcaaatgcctctcacaatcatgggttagatccagaacgactcattgttgcggaagcatttgtaggaaaggggttttacaaaaagagactttggccccatgctaaaggaaaatcgtcgcttagagtaagaccagaatgcaggctaacagttgtagtaagagagataactgctgaagaagaggcagagattgctaggctgagggtccacaacttcaagaaacgcaccaagcgtcagcaacgacttgtgcctcatcagctcattgtgtccaatcctatttggggccgcaaaaacaaatctagtggtaaaaacttgagtgctacacctgcataagctgagcttttgcttgtttccatgcttatgtcatttttcgtgtatggaaacagttgagaaatatatgtctgtcccttgttgcagatgatagaattttgtactggatcatgtttagtattgttctcatttattagcttatttttcttcctactaggtactataaagaatgtcttgttcaatcaccagcatgaatctcctcttgttttgtggggaagtataaacatatgttttttttatttttatttttaaataaaggcgtattcttgcaagttgcatcatttaa

SEQ ID NO: 5443 - DNA, 1475 bp, Cajanus cajan
ggaagacactagagtgcactcaggtagccctagctctgaacaacacaacacaacacaagacagttttgggttcttctatgttgttgatctggtgtgcacttcttctttttcttcactacagcgttgtttttttctttgcccaaacaccaaaaccgcttcattcatttccccaactgagtaaccaactattccgttgtacagaacaaagatggtgcagtggcagagacacattttcccctttcttcgccacattcgcaagggagttgttgacgccaatcattcttctcccaaccttgtaatttctcgcttagcctcttctctttcacaaggtcagttagagaggagggcgtgtacgaccccttttccctggttctcaaggcccatttatctcgctttccaacttcggggaatttcaagttctacttggttgctggcaaattcatctgaagaaacacctatttcgtcacctttagtcccagtttcattgttgggtagttcaaaaggtgaagaccagaagcagaaagctgttactaagccagaaaatgttcaagcggtactaaagggaataaagcagagtcccaagaaggtcaacttggttgctgctctggttcgtggtatgcttgttaaagatgcattgatgcagttggaattgacaataaaacgagctgcaaaaactgtatatcaggttattcattcagcccgagcaaatgcttctcacaatcatgggttagatccagaacgtctcattgttgcggaagcatttgtaggaaaaggtaatttcaaaaagagaatttggtaccatggcaggggaaatgcagggatcagagtgagagcagaatgcaggctaactattgtagtaagagagataactgcagaagaagaggcagagattgctaggctgagggtccacaactttaagagactcactaagcgccagaaacgacttgtgcctcatcagcttattgagaccaatcctgtttggggtcgcaaaaacaaatctagtgctcaaaacttgagtgctgcacctgcatgagccttacttttttctaagtttccattttttatggcattttttgtgtaatagattcttggccatcacattctatatggaaactgttgagaaatttatctgccccttggtgcaaataatagaattttgtactgaaccatgttagtatatttctcatttattagcttattttccttcctaccgggtactactataaaggatgtgttctgttctatcagcagtatgaatctcctcttgttttgaggggaagtgtaaaccgatgattttttctttttaagataggggtattcttgcatcatttacaagttgtgctttaactattttttagcatttgatgcattgcatttatttgctagcatatatatcaatcaactgagtttggtatctaatgttactttgattacatatgtcaaatctacaatacatgaaatagaatgacgagttt

SEQ ID NO: 5444 - DNA, 872 bp, Glycine max
acccacccaacagggagtggataagcacaaacattattcccaatccttatcctgtttgcttcaatggaagtgatttccgcttcgagcttgaatcccaacgctccgatgttcgtgcctctcgcctatcggacggtggaggatttctccgaccaatggtgggacctcgtccactcctccccctggttccgcgactactggctccgcgagtgcttccaagatccccagtaccaatacgacgacgttttcgacttcgactttgacctagatctccaagataaagatgaaaatgaagggaaggaagggaaagaggtggtgtcgttgggggtgctcaaatggcgaagctgtggaggaggatgggccgaagcgccgaggtatgtggaaaaggcccctaagtttgtgaagcccaaggtgagcccacgggctattcaccagcccaggtagacgccacccggcccattcccccagcaccaccagctatgtacataaaaaaaaaaaagtgtcaagcgcaatgacttcgtctttagagctttctttacattttccagattttaattttcgtgttgatcttcttgttactctgatgttccataaagataaactcaagtttctttgatgatgatatttgcgacgctgtaagttctaaattttatttcgccaaattttaataccgatataacataatcgtagtatgatttatgggcgtggcaaattaattcgattattttcaaggcttcaaaaagttttattttcttgattgagatgagtttattttttacacgttacactaaaaggaaaggaactttctatccgtctattccgggggttagaaacggacgaagggatcggacaaatgggttggcttcagatctttt

SEQ ID NO: 5445 - DNA, 1232 bp, Glycine max
acccacccaacagggagtggataagcacaaacattattcccaatccttatcctgtttgcttcaatggaagtgatttccgcttcgagcttgaatcccaacgctccgatgttcgtgcctctcgcctatcggacggtggaggatttctccgaccaatggtgggacctcgtccactcctccccctggttccgcgactactggctccgcgagtgcttccaagatccccagtaccaatacgacgacgttttcgacttcgactttgacctagatctccaagataaagatgaaaatgaagggaaggaagggaaagaggtggtgtcgttgggggtgctcaaatggcgaagctgtggaggaggatgggccgaagcgccgaggtatgtggaaaaggcccctaagtttgtgaagcccaaggtgagcccacgggctattcaccagcccaggtagacgccacccggcccattcccccagcaccaccagctatgtacataaaaaaaaaaaagtgtcaagcgcaatgacttcgtctttagagctttctttacattttccagattttaattttcgtgttgatcttcttgttactctgatgttccataaagataaactcaagtttctttgatgatgatatttgcgacgctcgttttcctgtccgtccattcttccttccttgagaagcttcaacaacggtggcacgcctccttcttcgatgatgagtttcccgtaacggtcgttgtcgcgagcaagggagacgagggaagcggctgcgtcggaacgttcgtccaaggaagcaccggggagaagaatggcgacctgttcccagatgaggcagagaatgggctcgttggcggcgatgggagggaggcccaggtactcgtcgtagcgctcgtcggcggaggcacgtgggacgctcgtagaggtcgttgctgttcctggcggcctggcggaggaggcccgccaacttctcagttttggatttcagctccagacattcctgtcggaaattctgggcctcttccgcaagcttcgaaacctggtccgccatttgtatcgggctcgccaggatctccttgacgatgctcgacatgtttgcagcggaccctcactaggctatttcggattgattaatgattggattatattgttggagattattgttccagtcttaaatcaaaggttattatggcgtgcttgggttgatttgtgggacatggaggggagaggctgacggtgagggtggc

SEQ ID NO: 5446 - DNA, 639 bp, Vigna unguiculata
atttgacaactattcttcttcggtggtcactttgatccttatcctgtttgcaatggaagtgattttccagtcctcaacctcctccaggttgaatcccaacgctccaatgttcgtgccgcttgcctatcggacggtggaagatttctccgatgaatggtgggatctggttcattcctcttcgtggttccgtgactactggctccgcgagtgctaccaagatccccaattccaaaacgaagtttttgacttcgagttcgacctagatctggaagaatatgagaatgaagggaaagaggaaaaagaggtggtgtctttggaggtgctgaaatggcgaagctgtggaggaggttgggccgaagtacctagatatgctgaaaaggctcccaagtttattaagcccagagtgagtccacgggctattcaccagcccaggtagatcagcccggtccagtaccagctccagcactaggcttatgtacatacataaaaatttctgtctttattgcagttttaggatttctttactttctgcacaggttgtttgtaatgttttcatgagatgaatttggttttcttgacaattatgaacttgtatcaactaagatattttactctttataatctaattaacttatagag

SEQ ID NO: 5447 - DNA, 750 bp, Glycine max
cccacccactaggtagtggataagcacaaaccttattcaacactcatatccttatcctgtttctttcaatggaagtcatttctgcttctagcttgaatcccaacgctccgatgttcgtgccactcgcctatcggacggtggaggatttctccgaccagtggtggaacctcgttcactcctccccctggttccgcgactactggctccgcgagtgcttccaagatccccagttccaaaacgacgacgctttcgacttcgactttgacctagatctccaagatgaagatgaaaaggaacgaaaggaagggaaggaggtggtgtcgttgggggtgctgaaatggcgaagctgtggaggaggatgggcccaggcgccgaggtatgtggaaaaggcccccaagtttgtgaagcccaaggtgagcccacgggctattcaccagcccaggtagacgcaacccggcccattccccaccagctatagctgtgtacataagcgcaaatgacttcagagctttctttctttacattttccagattttaattttcgtgttgacttgttgctctgatattttccataaagataaagtcagtttctttgttaatgataattgcttggcttgtgtccgtgttacagatcttaatatctgctgtaatttcagaattttatgtttacgagtttggctaagagataacaaaattgtgtatggcttgtgggcgtggcaaatcaattcgattattttcaaaaggcttcaa

SEQ ID NO: 5448 - DNA, 631 bp, Vigna unguiculata
aactattcttcttcagtggtcactttgatccttatcctgtttgcaatggaagtgatttctcagtccacaacctcctccaggttgaatcccaacgctccaatgttcgtgccactcgcctatcggacggtggaagatttctccgatgaatggtgggatctggttcattcctcttcgtggttccgtgactactggctccgcgagtgctaccaagatccccaatttcaaaacgaagtttttgacttcgacttcgagttcgacctagatctggaagatgagaacgaaggaaaggaggaaaaagaggtggtgtctttggaggtgctgaaatggagaagctgtggaggaggttgggccgaagtacctagatatgctgaaaaggctccaaagtttattaagcccaaagtgagtccacgggctattcaccagcccaggtagatcagcccggtccagtaccagttccagttccagcaccaggcttatgtacatacataaaagtttccgtctttattgtaattttaggatttctttacattctgcacaggttgtttgtaatgttttcatgagatgaatttggttttcttgacaatgataaacttgtatcaactaagatatcttaacttttataatctaatta

SEQ ID NO: 5449 - DNA, 1434 bp, Glycine max
aagcacaaaccttattcaacactcatatccttatcctgtttctttcaatggaagtcatttctgcttctagcttgaatcccaacgctccgatgttcgtgccactcgcctatcggacggtggaggatttctccgaccagtggtgggacctcgttcactcctccccctggttccgcgactactggctccgcgagtgcttccaagatccccagttccaaaacgacgacgctttcgacttcgactttgacctagatctccaagatgaagatgaaaaggaacgaaaggaagggaaggaggtggtgtcgttgggggtgctgaaatggcgaagctgtggaggaggatgggcccaggcgccgaggtatgtggaaaaggcccccaagtttgtgaagcccaaggtgagcccacgggctattcaccagcccaggtagacgcaagccggcccattccccaccagctatagctgtgtacataagcgcaaatgacttcagagctttctttctttacattttccagattttaattttcgtgttgacttgttgctctgatattttccataaagataaagtcagtttctttgttaatgataattgcttggcttgtgtccgtgttacagatcttaatatctgctgtaatttcagaattttatgtttacgagtttggctaagagataacaaaattgtgtatggcttgtgggcgtggcaaatcaattcgattattttcaaaaggcttcaattttattttcttgattgggatgagtctatgccttgggttaaaaacagaccaaaaggatcgtataaatgagttgggctacagatcttttttacatttctcatgatatttttctctacgtcttaagaaaacacaatgataaaatgattttttttaataattaattttaatttatgatataatcttaatttcttctcctaatttatgattgtcgccgaaaagtttatatacaaagaagcaatggaactactagtagtatgactttaatttatataatatcttcataggattattatttttctgtcttttttgttacagtaatggttttatcttattttatttctattgcataacatttttatagaaaaaattctactagatactttttccatcgttttcaatgcgtaatatattagagaccaaaacaaaatgccaattgtgttgacaagtaattgtacctaaaggaggcaaatgagacaccacgaattctttcccataggtggcctaagtccagaagacaaaaatatcaaaaacatcaaacacaattacacaatcctataagatcatgttactagtcaattggcgcaaaagtttacttgacgaaagtcagatcgaaactaatattttactagttcttatttatacagctgtgcttggaatctgctacagctcagtcaaacgtagattttttcgcttttctaatgtgca

SEQ ID NO: 5450 - DNA, 1234 bp, Vigna unguiculata
gggagtgacgatagcttttacgttagaaattcgcgttggcatttcactcaccagcaaccaaaaccagaaataactgcacagcttaagcttctgtattgtattgtattgttttgcatcgcccagccccatgttggtgttcttcatttgcgtattgcttttcttcatctttgtatacaaattcctcactgcttatggcgatttcactttgatgtctaagaagcaacctaaacgcgaagaaattgaagacaaggttgtttggattacgggcgctagccgtggaattggggagattttggctaaacagcttgcaagtttaggggccaagcttataatctctgcaaggaatgaagttgagctaaaccgagtaaggacacaactgaaaggtaagcatgcacctgatgaagtcaagattttaccattggatttatcgtctggagaggattctctaaggatagctgttgagaaagcagaatccttttttccggattccggtgttgattacatgatccataatgcagcttttgagcgtcctaaaacatcaattttagatgtaactgaggaaggtcttaaggctacatttgatgtcaatgtttttgggacaataactcttacaaagctcttgacacctttcatgttaaagagggggcatggtcattttgtggtgatgagtagtgcagcaggaaagacacctgccccaggtcaggctgtatactctgcttccaaatatgcgctcaatggttactttcataccttgcgttcagagctctgtcagaaagggatccgagtaactgtggtctgtcctggtccaatagaaacgtcaaataatgctggatcaaaggttccatctgagaagcgtgtgtcatctgaaaagtgtgtggagctgactatcattgctgcaacccatggcttaaaggaagcttggatatcatatcagcctgtgcttgctgtcatgtatcttgttcagtacatgccatctgttggttattggctcatggacaaggttggcaaaaatcgagtagaagctgctgaaaagaagggaaacacatattctttgagcttactgtttggaaaaaagaaggccccatgatgcccatctgtgcatggttttcaaagatctgtatcaaatatattttagttaaaggttctctatcaaaatgaatgacaccctttctgacaattgacagaatagagttatatgttattccaaaatgaacaatgaaagtttataaatttt

SEQ ID NO: 5451 - DNA, 1429 bp, Glycine max
gaaaaaagtttactaatgtagtttgaaataatcagctttgttgtaagtagcttataggctttccgttccggttcaaaaatcgcgaaggcatttgacgccgcagcaacgaaaacacgaaaataactgcacagcataagcttgtagaattgtactgcatcgcaaagccccatgttgatcgtgttcatttgcatcttccttttcttcatctttctttacaagttcctcatcgcttatggcgatttcactttgatgtctaagaagcaacctaagcgccaagagattgaagataaggttgtttggattactggtgctagccgtggaattggggagattctggctaaacagtttgcaagtttaggggccaagcttattatctctgcaaggaatgaagctgagctaaaccgagtaaggacacagctgaaaggtaagcatgcacctgatgacgtcaagatcttaccattggatttatcatctggagaggattctcttaggatagctgttgagaaagcagaatccttttttccggattctggtgttgattacatggtccataatgcagcttttgagcgtcctaaaacatcaattttagatgtaactgaggaaggtcttaaggctacctttgatgtcaatgttctggggacaataactctcacaaagctcttggcacctttcatgttgaagagggggcatggtcattttgtggtgatgagtagtgcagcaggaaagacacctgccccaggtcaggctgtatactctgcttctaaatatgcgctcaatggttacttccataccttgcgttcagagctttgtcagaaaggaatccaggtaactgtggtctgtcctggtccaatagaaacatcaaataatgctggatcaagggttccatctgagaagcgtgtgccatctgaaaggtgtgcagagctgactattattgctgcaactcatggcttaaaggaagcttggatatcatatcagcctgtgcttgctgtcatgtatctcgttcagtacatgccaactattggttattgggtcatggacaagattggcaaaagtcgagtagaagctgctgaacagaagggaaacacatattctttgagcttactgctcggaaaaaagaaggccacttgatgcccatctgttcatgttctccaaaaatttgtatcaaatatttttagtcggaggttctctatcaaattgaataacaccctttctgacaattgacagaaaagttatatggatttcctaattgaacaattaaggtttacaaatatccaatgggcgctgccatgtgacaaaaactccacattactagtaaatacagaacaatcaatctgctaataaactattgtctgttaaaggaagtagtgaaacctacagcatatgactataggtccgccagagcaggtgatactctcaattttcaagtatg

SEQ ID NO: 5452 - DNA, 1308 bp, Glycine max
gtaagtagcttataggctttccgttccggttcaaaaatcgccaaggcatttgacgccgcagcaacgaaaacccgaaaataactgcacagcataagcttgtagaattgtactgcatcgcaaagccccatgttgatcgtgttcatttgcatcttccttttcttcatctttctttacaagttcctcatcgcttatggcgatttcactttgatgtctaagaagcaacctaagcgccaagagattgaagataaggttgtttggattactggtgctagccgtggaattggggagattctggctaaacagtttgcaagtttaggggccaagcttattatctctgcaaggaatgaagctgagctaaaccgagtaaggacacagctgaaaggtaagcatgcacctgatgacgtcaagatcttaccattggatttatcatccggagaggattctcttaggatagctgttgagaaagcggaatccttttttccggattctggtgttgattacatggtccataatgcagcttttgagcgtcctaaaacatcaattttagatgtaactgaggaaggtcttaaggctacctttgatgtcaatgttctggggacaataactctcacaaagctcttggcacctttcatgttgaagagggggcatggtcattttgtggtgatgagtagtgcagcaggaaagacacctgccccaggtcaggctgtatactctgcttctaaatatgcgctcaatggttacttccataccttgcgttcagagctttgtcagaaaggaatccaggtaactgtggtctgtcctggtccaatagaaacatcaaataatgctggatcaagggttccatctgagaagcgtgtgccatctgaaaggtgtgcagagctgactattattgctgcaactcatggcttaaaggaagcttggatatcatatcagcctgtgcttgctgtcatgtatctcgttcagtacatgccaactattggttattgggtcatggacaagattggcaaaagtcgagtagaagctgctgaacagaagggaaacacatattctttgagcttactgctcggaaaaaagaaggccacttgatgcccatctgttcatgttctccaaaaatttgtatcaaatatttttagtcggaggttctctatcaaattgaataacaccctttctgacaattgacagaaaagttgtatggatttcctaattgaacaattaaggtttacaaatatccaatgggcgctgccatgtgacaaaaactccacattactagtaaatacagaacaatcaatctgctaataaactattgtc

SEQ ID NO: 5453 - DNA, 1255 bp, Cajanus cajan
ctggtaacaaaaaaaggctttgttaagctgagtaactgtaagcattcttccccattcgaaactcgcccaggcatttcactgcacagcttaagctccaacatgtttgttgtgctgttcatttgcctcttcgttttcttcatctttctctacaaattcctcaccgcttatggcgatttcactttgatgtctaagaagcaacctaaacgccaacaaattgaagataaggttgtttggattactggtgctagccgaggaattggggagattctggctaaacagcttgcaagtttaggggccaagcttataatctctgcaaggaatgaagtagagctaaaccgagtaagggcacagctgaaaggtaagcatgcacctgatgaagtcaaggttttaccgttggatttatcatctggagagggttctcttagggaagctgtcgagaaagcagaatctttttttccggatggtgttgattacatgatccataatgcagcttttgagcgtcctaaaacatcaattttagatgtaactgaggaaggtcttaaggctacatttgatgtgaatgttctggggacaataactctcacaaagctcttggcacgtttcatgttgaagagggggcatggtcattttgtggtgatgagtagtgcagcaggaaagacacctgccccaggtcaggctgtatactctgcttctaaatttgcactcaatggttacttccataccttgcgttcagagctctgtcagaaaggaatccaggtaactgtggtctgtcctggtccaatagcaacatcaaataacgctggatcaagggttccatctgagaagcgtgtgtcagcagaaaggtgtgctgagctaactattattgctgcaacccatggcttaaaggaagcttggatatcatatcagcctgtgctgtttgtcatgtatctcgctcagtacatgccaactgttggttattgggtcatggacaaggttggtaaaaatcgtgtagaagctgctgaaaagaagggcagcacatattctttgagcttacttcttggaagaaagaagactgcttgatgcccatttggacacgtttttctaagatttgtatcgaatatgatgtagtaggactcttagacccttataccaattgacgaaatactcctaagtagtagacaaaaatatactttattttttaccaaggagggtgacatgtttgctgaattagtaaatttattcatcttgtggtaattgaacctgtacattcacaatt

SEQ ID NO: 5454 - DNA, 1196 bp, Glycine max
aaaaatggcgaagcatttcacgccccagcaacgaacgaaaaccagaaaataattgcacagcttaagcttgtattgtactgcatcgcaaagcctcatgttggtggtcttcattttcgtcttccttttcttcatttttctatacaagttcctcaccgcttatgccgattttactttgatgtctaagaagcagcctaaacgccaagagattgaagatatggttgtttggattaccggtgctagccgtggaattggggagattttggctaaacagcttgcaagtttaggggccaagcttataatctctgcaaggaatgaagttgagctaaaccgagtaaggacacagctgaaaggtaaacatgcacctgatgaagtcaagattttaccattggatttatcgtctggagaggattctctttggatagctgttgagaaagcagaatccttttttccagattctggggttgattacatgatgcataatgcagcttttgagcgtcctaaaacatcaattttagatgtaaccgaggaaggtcttaaggctacatttgatgtcaatgttctgggaacaataactcttacaaagctcttggcacctttcatgttgaagagggggcatggtcattttgtggtgatgagtagtgcagcagcaaaggcacctgccccaggtcaggctgtatactctgcttctaaatatgcagtcaatggttacttccataccttgcgctcagagctctgtcagaaaggaatccaggtaactgtgatctgtcctggtccaatagcaacatcaaataacgctggatcaagggttccatctgagaagcgtgtgccatctgaaaggtgtgcagagctgactattattgctgtaacgcatggcttaaaggaagcttggatatcatatcagcctgtgcttactgtcatgtatctcgttcagtacatgccaactattggttattgggtcatggacaagattggcaaaagtcgagtagaagctgctgaacagaagggaaacacatattctttgagcttaatgcttggaaaaaagaaggccacttgatgcccatctgtgcatgttctccaaagatttgtataaaatatttttagttggaggctctctatgaaactgaataacaccctttcagacaattgacagaaaacttgtatggatttcctagttgaaaaattaaggtttagaaatg

SEQ ID NO: 5455 - DNA, 1619 bp, Cicer arietinum
aagtgattctaaacgcttgttgtcatttcatttgatttcaatcctaacgcaagcggaaactctaatcaagcttgtattgtagcagcaatgttggtgctcttcctttgtctcttcctcttgttactcttcttattcaaattcatcaccgcctatggggatttcactttgatgtcaaagaagcaaccaaaactcgaaaaaattgaagataaggttgtttggattactggtgctagccgtggaattggcgaaattctagctaaacagcttgcaagtttaggggccaaattaataatctctgcaagggatgaagctgagttaaaccgagtaaagtcacagctgaaaggtaagcatgcacctgacaaggtaaagattttgaagttggatttaacttctggagaagatgctcttcgggaagctgtcgatttagcagaatgcttttttccagagtctggcattgattatatgatccataatgctgcttttgagcgccctaaaacatccgttttagatgtaaccgaggatggtctcaaggcaacatttgatgtcaatgttattgggacaataactctcacaaggctcttgacacctttcatgttgaagagggggaaaggtcattttgttgtgatgagtagtgcagcaggaaagacacctgccccaggtcaggctgtatactccgcttctaaatttgcactaaatgggtacttccattccttgcgttcagagctctgtcagaaaggaatccaggtaactgttgtctgtcctggtcccatagaaacaaaaaataacgctggatcaagggttccatctgagaagcgtgtgtcagcggagaagtgtgcagagctgactattattgctgcaacccatggcttaaaggaagcttggatatcatatcagcctgtgcttgcggtcatgtaccttgttcagtacatgccaactattggttattggctcatggacaaggttggtaaaaatcgagtggaggctgctgaacagaagggaagcacttattctttgagcctacttcttggaaaaaataaggctgcgtgatgcctatagattcatgtttttcaaaatatttttatcaaatacaatttacttgaaggttattttatcaaactgagcaacaccctttctgacaattgacaaaatacaccatacagaatatctaattgaacaataaaaggataatgtggtacttcaaatttcctgccatagctaaaactaaggaacgtttagaccttgcatttgcatgagatgaattccaaaggtgcaacatgtgatagtgttatctcctctatggacaatgaagttttaaaaaggagaatatgaatggaaaaccttttaatctttaaatatttcttatttttttaatattatcgtttttgaagaatatcaatgtatgtattgcaatcgtttgtaattgtatgcattttatgtcacaaatagcgtgactattgaattctaatgggtgcctctacatgtataaactaaactccaaattgattccaatatacaacagtatatttggtagtctgtacataaactagtgaatcttaaaggtagttttgatacttaggacataatttttgtatataaaaatgtttactttatgataataa

SEQ ID NO: 5456 - DNA, 1188 bp, Arachis hypogaea
actcgcggaacaagatggtggtggcgctactcttcctcggccttatcgtcttattcctattcagattcgccaccgcttatggcgatttcactttgatgtctaagaagcacccgaaacgacaagaaattgaagacaaggttgtttggatcactggtgctagccgtggaattggtgagattctggctaaccaacttgcaagtttgggggccaagctaatcatctctgcaaggaatgaagctgaactagagcgagtaaggacacagctgaaaggtaaacatgcacctggtgaagtaaagattttgcctctggatttagcatctggggaagaatctcttaggaaggctgttgagaaagcagaatccttttttcccggttctggtgttgattatatgatccataatgcagcttttgagcgccctaaatcatcagctttagatgtaacggaagaaggtctcaaggcaacatttgatgtcaatgttctggggacaataacactcacaaagctcttggcacctttcatgttgaagagggggcgaggacattttgtggtgatgagcagtgctgcaggaaagacacctgcgccaggtcaggctgtgtactctgcttctaaatttgctctaaatgggtacttcagttctctgcgttctgagctctctcagcaaggaataagggtcactgttgtctgtcctggtccaatagcaacatcaaataatgctggatcaagggttccatctgagaaacgtgtgcctgcagaaaagtgtgcggagctgactattattgctgcaacccatggcttaaaggaagcttggatatcatatcagcctgtgctcaccgtcatgtatctcgttcagtacatgccaactgttggtcattgggtcatggacaaggttggaaaaaatcgagtagaagctgctgtttcagagaagggaagcacatactctatgagcttactctttggaaaaaagaaggcatcgtgatggccatggttaagtttgtgaatgtgcttcagttatttgtatcaaataataaatttgatttttactactggctacgtgtatatttggttcataatttgcaaaatcatacttacatagaaagttaacttacctttcaaaccatatatgcaaggcattcaaactgatatccaaaagtattatttctctcaaagtgaataacagtcttagacaa

SEQ ID NO: 5457 - DNA, 1137 bp, Medicago truncatula
gttgattctaataatttctaaacgcctggtatcatccttggtttgcagtgtattgtagcagttgagcagcagcaatgttggttctgttcctctttatcttcctcttgttactcttcttattcaaattcgccactgcctatggtgatttcactttgatgtcaaagaaaaaaccaaaacatgaactaattgaagataaggttttttggattactggtgccagtcgtggaattggggaaattctagctcaacaacttgcaagtttaggggccaagttaatactatctgcaagggatgaagctgacctaaaccgagtaaagtcacagctaaaaggtaagcatgctgacgaggccaagattttaccgttagatttaacatctggtgaagattctcttaggaaggttgtcgatgaagcagaatcccttttcccagattctggggttgattatatgattcataatgctgcttatgagcgtcctaaatcatccgtcttagatgtaaccgaggagagtctcaaggcaacatttgatgtcaatgtttttgggacaataactcttacaaggctcttgacacctttcatgttgaggaggggcaaaggtcattttgtggtgatgagtagtgcagcaggaaagacacctgccccaggtcaggctgtatactcagcttcaaaatatgcactaaatgggtacttccattccttgcgttcagagctatgtcaaaaaggaatccaggtaaccgttgtctgtcccggtcccatagaaacagcaaataactctggatcgcaggttccatctgagaagcgtgtgtcagcggagaagtgtgttgagctgacgattattgccgcaactcatggcttaaaggaagcttggatatcatatcagcctgtgcttgctgtcatgtatcttgttcaatacatgccaactattggttattggctcatggacaaggttggtaaaaatcgagtggaggctgctaaagagaagggaaacgcttattctttgagcctactatttgggaaaaagaaggcagtgtgatgcctatagatgcatgtttttcttttaaaaattatcaaatacaattttcttggtggttattttatcaaactagtaacaccttttttaacaaatgacaaatcaaagc

SEQ ID NO: 5458 - DNA, 1309 bp, Medicago truncatula
ttcaaaagttgattctaataatttctaaacgcctggtatcatccttggtttgcagtgtattgtagcagttgagcagcagcaatgttggttctgttcctctttatcttcctcttgttactcttcttattcaaattcgccactgcctatggtgatttcactttgatgtcaaagaaaaaaccaaaacatgaactaattgaagataaggttttttggattactggtgccagtcgtggaattggggaaattctagctcaacaacttgcaagtttaggggccaagttaatactatctgcaagggatgaagctgacctaaaccgagtaaagtcacagctaaaaggtaagcatgctgacgaggccaagattttaccgttagatttaacatctggtgaagattctcttaggaaggttgtcgatgaagcagaatcccttttcccagattctggggttgattatatgattcataatgctgcttatgagcgtcctaaatcatccgtcttagatgtaaccgaggagagtctcaaggcaacatttgatgtcaatgtttttgggacaataactcttacaaggctcttgacacctttcatgttgaggaggggcaaaggtcattttgtggtgatgagtagtgcagcaggaaagacacctgccccaggtcaggctgtatactcagcttcaaaatatgcactaaatgggtacttccattccttgcgttcagagctatgtcaaaaaggaatccaggtaaccgttgtctgtcccggtcccatagaaacagcaaataactctggatcgcaggttccatctgagaagcgtgtgtcagcggagaagtgtgttgagctgacgattattgccgcaactcatggcttaaaggaagcttggatatcatatcagcctgtgcttgctgtcatgtatcttgttcaatacatgccaactattggttattggctcatggacaaggttggtaaaaatcgagtggaggctgctaaagagaagggaaacgcttattctttgagcctactatttgggaaaaagaaggcagtgtgatgcctatagatgcatgtttttcttttaaaaattatcaaatacaattttcttggtggttattttatcaaactagtaacaccttttttaacaaatgacaaatcaaagcatttacaaaatacagtatataattgaacaataaaagggtaatatggttctataaatttcctgccaactaagagccagaccttgcatttgcttaagttgaattccaaaggggctacatgcgatcttctctctgaacaatgacgttttaaaaaagagaatcaatttt

SEQ ID NO: 5459 - DNA, 1022 bp, Lupinus angustifolius
cagggcgatacgttcatggtgttcgttctcatttgcctcttcctatttttatttttattcaaattcgtcaccggttatggtgatttcactttaatgtccaagaagaaaccaaaactggaactaattgaagataaggttttttggattactggtgctagccgcggcattggggagattctagcaaaacaacttgcatctttaggagctaagctaataatctctgcaaggaatgaagctgagctagaacgagtgaagagtcagctgaaaggtaaacatgctcctaatgacgtccaggttttaccattggatttagcatctggagaggattctcttaggaaggctgttgagaaagcagaatccttgtttcccggttctggtgttgattatatgatccacaatgcagcttttgagcgtcctaaagtatcagttctggatgtaactgaggatgaacttaagacaacatttaatatcaatgttctggggacaataactctcacaaggctcttggcacctttcatgttgagtagagggcatggtcattttgtggtgatgagcagtgctgcaggaaagacacctgccccaggtcaggctatatactctgcttccaaatatgctctgaatgggtacttccattccttgcgatcagagctttgtcagaagggaatcaaggtaactgttgtttgtcctggtccaattgacacatcaaataattctggagcgaaggtttcaaaagagaagcgtgtatcatcagaaaagtgtgcagagctgactattattgctgcaacccatggcttaaaagaagcttggatatcaaatcagcctgtgcttggggtcatgtatcttgttcagtacgttccaaccattggttattggctcatggacaaggttggcaaaaatagagtagaagctgctaaacagaatggaaacacttattccttaggcctactctttggaaaaaagaaggcataatgattcattctatcaaggacactttaaagtagttgcatgttactgtatttgat

SEQ ID NO: 5460 - DNA, 1148 bp, Lupinus angustifolius
catttcatgggcctaggaacaatgggagtatgagaaatcgctagagtggaacagtaaatttatacaccagccgctaattatcattcaccacaccacacacgcacctggagagacaaacagagatatacgaacatgttcatcgttctcatttccatcttcctatttttatttctattcaaattcgtcaccggttatggtgatttcactttgatgtccaaaaagaaaccaaaactagaacaaattgaagataaggttttttggattaccggtgctagccgcgggattggggaggttctagctaaacaacttgcatctttaggagctaagctaataatctctgcaaggaatgaagctgagctagaacgagtgaagagtcagttgaaaggtaaacatgctcctaatgacgtccagattttaccattggatttagcatctggagaggattctcttaggaaggctgtagagaaagcagaatccttgtttcccggttctggtgttgattatatgatccataatgcagcttttgagcgtcctaaagtatcagctttagatgtcactgaggatgatcttaaggcaacaattaatatcaatgttctggggacaataactctcacaaggctcttggcacctttcatgttgagtagggggcatggtcattttgtggtgatgagcagtgctgcaggaaagacacctgccccaggtcaagctgtatactctgcttccaaatatgctctgaatgggtacttccattccttgcgatcagagctttgtcagaagggaatcaaggtaactgttgtttgtcctggtccaattgatacatcaaataattctggagcgaaggtttcagagaagcgtgtatcatcagaaaagtgtgcagagctgactattattgctgcaacccatggcttaaaagaagcttggatatcaaatcagcctgtgcttggggtcatgtatcttgttcagtacgttccaactattggttattggctcatggacaaggttggcaataatcgagtagaagctgctaaacacaacggaaacacttattccttgggcctactgtttggaaaaaagaaggcagtatgattcattctattaaggacactttaaagtattcgcatttacttgtatttgatattttttgttga

SEQ ID NO: 5461 - DNA, 664 bp, Vigna unguiculata
agaggcagtagtgaagtgactcaaggcgatccattttccatttccacaggttgttaggtcatcctagatcgtattgatggagtcacagaacagtccaaaccctaacccacttcatcggaattcgttaccatcatcgatgccggtgtggcctacgatcgatgggtccttggggttgtctgaggaagaatcggtgacctacgcgcggaggttttacaagttcggcttcgctcttctgcctctcctttgggccgtcaattgcttctacttctggcccgttcttcgccattctcactccttccctcgcattcgcccatatattgttagatcagcatttgggtttgcagtatttgcaactgttctctgttcttgggctctaacatttgcaattggaggggaaggcctcttcggacctgtttgggatcagttggttatgtataatcttgctgataggttaggcctaacaagctggagctagttgtgtgacacctctgatacttatattttgatattttattaccacatttatcttcttccatgcctcatgagtgcacttacatatgcattttactatattctgtcattgaactggtagcaaatttcatcttgttgacactgttgatagataagcaatgatttggaagtagatatagatcttggtttctcc

SEQ ID NO: 5462 - DNA, 631 bp, Cajanus cajan
gcagagatggaggcatcagagagcaacaatccaaaccctaaccccattcggaattcgctagcgtcatcggtgccgctgtggccaaccatcgatggcccattgggcctgtcggaggaagaatcggtcagctacgctcgccgcttctacaactttggcttcgctcttctccctctcctttgggccgtcaattgcttctacttctggcccgttcttcgccactcccactccttccctcgcattcgcccctacgttctgggatccgcagttgggtttgcagtgtttgccacacttctctcttcttgggctctaacttttgccattggaggggaacgcctcttcggtcctgtttgggatcaattggtgatgtacaatcttgctgataggttaggcttaacaggctggagctagttctgaatttgaatttggtagatatattttcattttattaccacacttaccttcttcccctgcttcgtctatgcatcttttttacctacacatttgactttattctgtcattcaattaatggtgaattttaccttactggcacacttgatagatcaaagaacaatgttttagaagaggatatagatattggtgtgctgtttttactgcattcatttttgtgtg

SEQ ID NO: 5463 - DNA, 719 bp, Glycine max
ggttttaggcaaacagattaatctgaattagttatctaacactagaagaagattgaatctcaactttttgtttcttacctgatcgcatagatggaggcatcacagggcaaccatccaaaccctaaccctaaccctaaccggaataattccgttgcgtcgtcggtgccggtgtggccaaccatcgacggcccattgggcctgtcggaggaagaatcagtgggctacgctcgcaggttctacaagttcggcttcgcccttctccctctcctatgggccgtcaattgcttctacttctggcccgcccttcgccactctcactccttcccccgcattcgcccctatgttgttggatctgcaattgggtttgcagtatttgcgacacttctcagttcttgggctctaacatttgccattggaggggaacgtctcttcggccctgtttgggatcaattggttatgtacaatcttgctgataggttaggcttaacaggctggagctagttttgttgtgtggcacctctgatacaaaatattttgatcctttattaccagacttaccttcttccctgctctgcttcgtgaatttcatctgcattacttatatacatttgactatattctgtcattgaattagtagtgaattttatcttcctgtcacagttgatagataacaagcaatgttttggaagatgatatagatcttggtgtctttactgcat

SEQ ID NO: 5464 - DNA, 1486 bp, Glycine max
tttttatttccttttcggttttaggcaaacagattaatctgaattagttatctaacactagaagaagattgaatctcaactttttgtttcttacctgatcgcatagatggaggcatcacagggcaaccatccaaaccctaaccctaaccctaaccggaataattccgttgcgtcgtcggtgccggtgtggccaaccatcgacggcccattgggcctgtcggaggaagaatcagtgggctacgctcgcaggttctacaagttcggcttcgcccttctccctctcctatgggccgtcaattgcttctacttctggcccgcccttcgccactctcactccttcccccgcattcgcccctatgttgttggatctgcaattgggtttgcagtatttgcgacacttctcagttcttgggctctaacatttgccattggaggggaacgtctcttcggccctgtttgggatcaattggttatgtacaatcttgctgataggttaggcttaacaggctggagctagttttgttgtgtggcacctctgatacaaaatattttgatcctttattaccagacttaccttcttccctgctctgcttcgtgaatttcatctgcattacttatatacatttgactatattctgtcattgaattagtagtgaattttatcttcctgtcacagttgatagataacaagcaatgttttggaagatgatatagatcttggtgtctttactgcattttttgtgttatattatgttatttatgcaagattcatcatctcattttggtatgttgaggaagagaagacatcatacagggattggaagtttaccccttccccccttagctgtcactttgtcctacaaaattcatacctcactaagcaaacagaatttgtacgttggttgtcaaatatcactaaacaaaatgaaaaggaaatccaaattaatgatcaaccaaccgagttttatcttacttttatagaaatatagaatagaatgctgcagccgtgtttgtttttagttttttaaaactaatttttcaaactttagttatgaccacaaaactatggcctcaaacaaaagttgcaagaggtcacgtgaaagctccaccacattatgcaagttgagttccaatgagccagaacaatcagaacctcttaatctcaagcaaaatggtgtttccttcatatagactttcttggagtgggaagttcttcaacccatgatgatgacaattagtggaccatgacagactttaacacacaattaactattatagttagtgccgttttgaggagaaaattgcaacatgcgtattacaaggcctattcagaatttacagttcattttgctgttgttttcaatatgtttcctttgtgaagaattatgtctttacttttgccttttctttgttctaataattgttccatcgaattccctttaaagaacaagttttttgttactgcaacgtgtcctatgatatttgt

SEQ ID NO: 5465 - DNA, 679 bp, Trigonella foenum-graecum
gggttggtgctgacacgtcacgcgtgaatctaatcgaaaatttaaacaaagagcaagattagagaagagaagagaagagaagaggggaagaaaagaaagagtgtagttttgttcaattcaatttgataatcgattattaggttagcaatagcaatagtatatagatcggagttgagatggaggcatcacaatcacacaccaacaacccgaatccgctggcttcatcaattccggtatggccaacgatcgacggtccactgggattgtcagaggaagaatcagtgaagtacgcaagaagattctacaaattcggattcgcacttcttcctcttctttgggccgttaattgcttctacttctggcccgtcattcgtcactcccactccttccctcgcattcgcccctatgttgttgggtctgcagttggatttactcttttcgcggcagttctttgttcttgggctcttacattttccattggaggggaacgtctctttggccctgtctgggatcagttggttatgtacaatctcgctgataggttaggcttaacaggctggagctagttgatcttggacccttttagatgaaaatttcaccttatttacttctagggtgaatggatgtgtgtattactgatacaataaactatgtattctgttattgaattagtggattt

SEQ ID NO: 5466 - DNA, 605 bp, Glycyrrhiza uralensis
ggcttctgagcttaggttaggttagggcaggtcgatcgcggtgatggaggcctcacagtcacagagcaacaacccgaatcagaatccgctagcgtcgtcggtgccggtgtggccaacgatcgatgggccacttggggtgtcggaggaagaatcggtgaagtacgctcgaaggttctacaagttcggcttcgccctcctccctcttctttgggccgtcaattgcttctacttctggcccgtcctccgccactcccactccttccctcgcattcgcccctatgttgttgggtccgcagttgggtttactgtattcacaacgcttctctgttcttgggctcttacttttgccattggaggggaacacctctttggccctgtttgggatcaattggtcatgtacaatcttgctgataggttaggcttaacaagttggagctagttgtgcttggacccctgatatagaataaataaatatctagcttctttcctggttcaattgagtggatgtgtgttactaatacaattaactatgtatcctgtcattgaatcagtggattttatcctgaagtcccaactcacagttgatagacacagatagtgttttt

SEQ ID NO: 5467 - DNA, 993 bp, Medicago truncatula
agatgaataacgaagaagtacaaccttccacaattaggcacgtgaatctgatctcaaatttaacaagaacaagattagagaaagaagaagaagaagaagaagaagaaagagtgtagatttgttgagaatagcatagatcggaagtgatggagtcttcacaatcacacaccaacaaccctaatccgaaccccaatccgctggctttatcggttccggtatggccaacgatcgacggtccactaggactatcagaggaagaatcagtgaaatacgcacgaagattctacaaattcggattcgcacttcttcctcttctttgggccgttaattgcttctacttctggcctgtcattcgtcactcccattccttccctcgcattcgcccctatgttgttgggtctgccgttggttttactgtatttgcgacgcttctttgttcctgggctcttacattttccattggaggggaacgcctcttcggccctgtctgggaccagttggtcatgtacaatcttgctgataggttcggcttaacaggctggagctagttgtacttggacccttgtagatgaaaatatcaccttatttacttatagggtgagtggatgtgtattactgatacaataaactatgtattctgttattgaattagtggatttcatcctggagcaatgtttcaagaggatggttatgtgtctttattgctttttgggctgggggtggatataatgtacaacttagcttttagattcattgttttatttcttcctggttttgcatcttgatataatatgttgaggaaggaaactagtgaccatatgctgcaagacatcatacagatattggaagttcacccccttagactttgtttaggaatttggggggaaagggagggggaaggttttgatgataaaggaaggagtaaagagaatgggagtagtctctccaccttatatgagaattttatagttgtccattggactaaaccctcta

SEQ ID NO: 5468 - DNA, 1214 bp, Lupinus angustifolius
gaatacattcatctttcgttttttatcaattgatagagagatttataatgacgttattcagtctttaattaattaagatagcgaaggagtagaatcgtgtaggcagattgtagtgactatggaacacaacaacaacaatccgaatccaaatcgaaaccctaacccgattcggaatccgctgtcatcatcggcgcccgtttggccaacgatcgacggagcattgggactgacggaggaagattcagtgagctacgctcgcaacttctacaacttcggtttcgctcttcttcctcttctttgggctgtcaattgcttctacttctggcccgttctccgccactcccgctctttccctcgtattcgcccttatgttgtcggatcagcaattggtcttactgtgttcacagctcttctctgttcctgggcgctaacattttcccttggaggggaacgcctctttgggcctgtttgggatcaattagttatgtacaatcttgctgataggctaggcttaacaacctggagctagttgtatggcaccacctgagctttgaccatgatacatgaaatattttgatgctgtaattacctttcttcttctttcatcgcacgtcaattgatgcatattactaatacatgtgtcaatgaatatatttatgatagggcaatataatgccattcaatctatgtagccgatcttacttagtggagtgggataacagcttggctgttcatgtcctctatacctctttttcttctttttgtttgtatatataatgcacaagcagtaattagtttctacagtcattatatcattattcccaatctttcttgtaggtatgcatgcttacagaactttaataagagagtataagggaagcagggattgagcactaagcatgaatcagcaaattataattcacgagttaatttgtcttcaatatggagttggagattataggtccttcgcagtacctatgctattgataattctcatacaagttttctgtagtttctggattaatagttgagaaaaaaatttatacactgacagagtgaatgagttttatacattattgctccattatttattaatcatatttaattatcattgatttttttttaaaaagtaattcaaacgaatagtgaattacacaatgattgtgtataaattcttacatagacattacatatatattccactcttaatttat

SEQ ID NO: 5469 - DNA, 943 bp, Vigna unguiculata
atgatgggttgaagggagatgcagagatggagagtgtaagaagaaatgcagaggctcttgtggagaagatgatgaaagggaacgatgcttctcatgacgcagctcatgtttggagagttcgtgatcttgctctctcacttgctgaagaggaaggcctctcttccgatcctcactccatgcaaatcgttgaacttgctgcactgctccatgacatagctgactacaaataccttagggacccatctgaggaaaaaattgttgagaattttcttgaccaagagggagttgaggaggagaagaaattaaaaattttgaagatcatcagagaaatgggtttcaaggaagaggtgactggaaatggaagtaatgattggtttccagaatttggagttgtgcaagatgctgatcgacttgatgctattggtgctataggaattgcacgttgcttcacctttggagggagtaagaagaggttgctgcatgatcccgccattctgccacgttctgatttgtccaaggagcaatacatgaacaaagaggaacagactactatcaatcattttcatgagaagcttctcaagctcaaagatatgatgaaaaccaaggctgggaaaaggagggctgaaagaaggcataagttcatggaggagtttgtgaaagagttctatgatgaatggaatggcttaaactgataaacatttttcatattttctttccttgaagtatagggtcagagcttcttaaaaatgaagctcaagcgagatgctgggaaatgttcaaatattgttattaacagtccatgacatatgcgtttcattctcagcatgttagactatatagtgagcttgtttgttggttacaaactttgtggtggatttcaagtatgtttagaaagatagaacttgtttattgtatagccccagcataaggtgtttgatcctag

SEQ ID NO: 5470 - DNA, 1168 bp, Cajanus cajan
gaattggggtgtaaatcgtaatttgggcaaaggcggctgaagggaagactatgatatgtgatgtgatgagatgagaagcatagagggaagaagcatggatatggagagtgtaagaagaaatgcagaggcgctggtggagaagatgatgaaagggaacgatgcttcccacgatgcagcacatgtttggagagttcgtgatcttgctctctccctcgcccaagaggaaggcctttcttctcatcctcactccatgcaaatcgttgagcttgctgcattgctccatgacatagctgattacaaatacctcagggacccatctgaggaaaaagttgttgagaattttctcgaccaagagggggtcgaggaggacaaaaagatcaaaattttgaacatcatcaaaggaatgggtttcaaagaagaggtaacaggaaatggaaatagtgaatggttcccagaatttggagttgtgcaagatgctgatcgacttgatgctattggtgctataggaattgcacgttgcttcacctttggtgggagtaggaagaggttgctgcatgatcctgccattcctccacgatctgatttatccaaggaacaatacatgaacaaagaggaacaaactactattaatcattttcacgagaagcttctcaagctcaaagatatgatgaaaaccaaggctgggaaaagaagggccgagagaaggcataagttcatggaggagtttgtgaaagagttttatgatgaatggaatggtttaagctgataaacatttctcatgtcgttaactcattatccattttctacgcttgaagtatatgattttagcttcttaaaatgtagtgcccacaagctggttcaaaatgcggggaattgttcaaatcttgcaactagcaatccatgactcatttgtgtttcattctctgagcatgattttcattctctgaacatgttatctgttatttcttttccacctcatccgtagaggttccatatattgtgactggctatacaaatcctttccaggatcatccataagtacggtagtactgattcaattttgttaaggaacctagatattttgtttaatgcgtaccccaataaagaggcttttgatcctagagcaagaataagtatctcgttgtacataataaaaaaaaatggaaac

SEQ ID NO: 5471 - DNA, 1204 bp, Glycine max
aatttttgggcggaggtagagttggatagcaaattgtaagtttgggaaaggcagcgggagtggaagatatttatggtgagtctgagggcttggaggcagagaagagatagagatggaaatagagaggctaagaagaaatgcagaggcgctggttgagaagaccatgaaagggaacgatgcttctcatgatgctgctcatgtttggagagttcgtgatcttgctctctcccttgccaaagaggaaggcctctcttccaatccccactccatggaaattgttgagcttgctgcgcttctccatgacatagctgactacaaatacctcagggacccatctgaggaaaaaattgttgagaattttctcgatgaagagggagttcaggaggacaacaagttcaaaattttgaagatcatcaaaggaatgggtttcaaggaagaagtgtcaggaagtggaaatagtgaagggtttccagaatttggagttgtgcaagatgctgatcgacttgatgctattggtgctataggaattgcacgttgtttcacctttggtgggagtaggaagaggttgctgcatgatccagccattctaccacgatctgatttgtccaggcagcaatacatgaacaaagaggaacaaactactattaatcattttcatgagaagcttctcaagctcaaagatatgatgaaaaccaaggctgggaaaaggagggcagagagaaggcataagttcatggaggagtttgtgaaagagttctacgacgaatggaatggtttaagctaataaaccattccacaacttatggatgctagactatattgtgagcttgttatctgttatttcttttcctcctcacccgcagaggttacatatattgtcactggttatacaattcttcccaggatcgtccgcgtaagcacaatgttttgctgataaattacaatgtacatgtgagtcgtagttcccagtatcagtattcagtagtaatggttccaacttcgtttctacttaataaacttgttgtctgatcgtgcaatgagattttttggatgcaaattatatgtacagtagtacttatgttatggatttcaagtatgttaagaaacaagatatcttgtctaatgcgggccccagtattgattaaagtttcttatcctagccctagagagaatatgtgcgggtttgtttttcgagtcaaattag

SEQ ID NO: 5472 - DNA, 1112 bp, Glycine max
ggaggtagagttggatagcaaattgtaagtttgggaaaggcagcgggagtggaagatatttatggtgagtctgagggcttggaggcagagaagagatagagatggaaatagagaggctaagaagaaatgcagaggcgctggttgagaagaccatgaaagggaacgatgcttctcatgatgctgctcatgtttggagagttcgtgatcttgctctctcccttgccaaagaggaaggcctctcttccaatccccactccatggaaattgttgagcttgctgcgcttctccatgacatagctgactacaaatacctcagggacccatctgaggaaaaaattgttgagaattttctcgatgaagagggagttcaggaggacaacaagttcaaaattttgaagatcatcaaaggaatgggtttcaaggaagaagtgtcaggaagtggaaatagtgaagggtttccagaatttggagttgtgcaagatgctgatcgacttgatgctattggtgctataggaattgcacgttgtttcacctttggtgggagtaggaagaggttgctgcatgatccagccattctaccacgatctgatttgtccaggcagcaatacatgaacaaagaggaacaaactactattaatcattttcatgagaagcttctcaagctcaaagatatgatgaaaaccaaggctgggaaaaggagggcagagagaaggcataagttcatggaggagtttgtgaaagagttctacgacgaatggaatggtttaagctaataaaccattccacaacttatggatgctagactatattgtgagcttgttatctgttatttcttttcctcctcacccgcagaggttacatatattgtcactggttatacaattcttcccaggatcgtccgcgtaagcacaatgttttgctgataaattacaatgtacatgtgagtcgtagttcccagtatcagtattcagtagtaatggttccaacttcgtttctacttaataaacttgttgtctgatcgtgcaatgagattttttggatgcaaattatatgtacagtagtacttatgttatggatttcaagtatgttaagaaacaagatatcttgtctaa

SEQ ID NO: 5473 - DNA, 1611 bp, Medicago truncatula
atttggtgcacatctaccaacaaaactgaagtgtttggatggataggttactccgatttctatacctgcgttttgttttgttttgttattacttctatgctttctctctgtaaggtaaaattcacctcttctactcaagaaattgttgatttccattaaagcctctgtttttatattattcattgtgcaaaagaaataagttgtttatgttattatagagaaagagggatatgcaaacactccaatgattaagtaataatggcttcagggttttagggtatgagttagcctttatagtggtcaattaggatttaaggctcttgaaaacctttgttctggacaaagggttgtgtcacctaggattgcaaatggatgatttagatcgttatgcgcagcagccctgattcaatgtcttaggatttagctagtgacttggggtgagtgacccgctccgttgagaaattggccttggcgcagtctggaacattgccattaaggatactaaagttgcgtttttgttggctggagtgggaaacatagacatacacagaaagacaaactgctttgttgtgaattctaggtgcaaattgttgttttgcgaagatagtagaagatcatatatttcgcgagcgaggtgtgctgttgcaggcgttgtaacaagagagaggatggaaaagaaagagacaataagaaaggctgaggcattggttgagaaagcaatgaaagggaatgacgcttctcatgatgcagcacatgtttggagggttcgtgaccttgctctctcccttgctaccgaggaaggcctctcttctgatccgcattccatggaaattgtagagcttgctgcactgctccatgatataggtgactacaaatacctgagggatccatctgaagaaaaaactgttgaaaattttctagaggaagagggagttgaggagaacaagaaatcaaagattttgaagatcatcaaagaaatgggttttaaagaggaggtgacaggaaaaggaactactgaatggagtccagaatttggtgttgtccaagatgctgataggcttgatgctattggtgctataggaattgcacgttgcttcacgtttggcgggagtaagaagagggcgctgcatgatcctgctattttgccaagatctgatctgtctaaggaaaaatacatgaacaaagaggaacaaactacaattaatcattttcatgagaagcttctcaaacttaaagacatgatgaaaaccaaggctgggcaaaggagggctgagagaaggcacaagttcatggtggagtttgtcaaagagttctacgacgaatggaacggttcaagctaataagtacttgctcttgtcttcatgcagttttacacttaaaattgcattagtacttgtgaaaaagacaaaaatggagcatgtataggctacttcaagatgctgaaaattgttcatatcttgtaagttgcagcatcagtaactaattcatgcttcatgctccgaacatagtttttccaccaaacaatgcccttggttttgcaggccagactatatataatgtcgaatttttatctatttcagtaaacaatgtccttggttttggaggctagac

SEQ ID NO: 5474 - DNA, 1374 bp, Trigonella foenum-graecum
acacttttcactattagacgtcctcatcaatcaatacaataaaatctcatgaaatattttcattcataattcattgttttgtttctctcaatcaaaggttattattgggctttctaaaacgctaaccatacctgcgttttgttttgcatgctgcgtcacactgctacttccatcttgctgtatgtaaggatactaaagttgcgtttttgttagctggactgggaaacattgacatacaaaggaagacaaactactttgctgtaaattcaaggtgcaaattggtattttgcgaagatagtagaagatcatatatttcgcgaacgaggtgtaccgttgcaggggctgaaacaagagacaggatggagaggaaagagacggtaagaaaagctgaggcgttggttgagaaagcgatgaaagggaatgacgcttctcacgatgcagcacatgtttggagggttcgtgatcttgctctttcccttgccaccgaggaaggcctttcttctgatccgcactccatggaaattgtagagcttgctgcactgctccatgatataggtgattacaaatacctgagggatccatctgaagaaaaaactgttgaaaaatttcttgatgaagagggagttgaggagagcaagaaatcaaaaattttgaagatcatcaaagaaatgggttttaaagaggaggtgacaggaaaaggaactacagaatggagtccagaatttggtgttgtccaggatgctgataggcttgatgctattggtgctataggtattgcacgttgcttcaccttcggcgggagtaagaagagggcactgcatgatcctgctatttttccaagatctgatctatctaaggaaaaatacatgaacaaagaggaacaaactacaattaatcattttcatgagaagcttctcaagcttaaagatatgatgaaaaccaaggctgggcaaaggagggctgagagaaggcacaagttcatggaggagtttgtgaaagagttctacgacgaatggaacggttcaagctaataagtacttgttcttgttttcaacacttataaaattgcattagtacttgttataaagacaaatcgagcatgcgtaatcaaattcaagatgctgaaaattgttcacatcttgtaagctgcagcaacaataaccaactaatgcttcatgctctaaacatagtttttccaccaaacaatgtccttggttttggaggctagactatatataacatgaattgttatcaaacaccgtgtgtgggtatcagattcacacgtcaaaaagcgattttttttttttctcctaacaaacgctgaagaatcagattctggagaagaaacaaaacaaaaaaaagggtaagtttcag

SEQ ID NO: 5475 - DNA, 1129 bp, Arachis hypogaea
cttggggtcaagggatggagttgcaaagtcaacagttctgtgtcttgagacaaaaacggtgtcggttcgtcctctctctcattttctcagttcctctgctcattttcccttttgagttttgaggtagcaaaacgacgtgccgttggttccaagtgaggatggcgagcagagagacggtgagaaaggcagaggctctcgtagagaaagccatgaaaggaaacgacgcttcacacgatgcgtcgcacgtttggagggttcgtgatctcgctctctccctcgcctccgaggaaggcctttcttccaaccctcactctctccaaatcgtggagttagcggcactgctccatgatatagctgattacaagtacttgagggatccgtctgaggaaaaaattgttgagaatttcctcgaagaagagggaatccaggagactatcaagtctaagattttgaagatcatcaaaggaatgggtttcaaggatgaggttacaggaaatggcagtactgaatggtttccggaattcggagttgtgcaagatgcagatcgacttgatgctattggtgctataggaattgcgcgatgcttcacctttggtggaagcaggaacagggttctgcatgaccctgcaattttaccgcggactgatttatccaaggaacaatacatgaagaaagaggagcaaactactattaaccattttcatgagaaacttctgaagctcaaggatatgatgaaaaccaaggctggaaagaggagggcagagagaaggcataagttcatggaggagtttgtgaaagagttttatgatgaatggaatggtgtaagctaattgcatgttccaagcatgattatctccttgatttggatgctatgcataatgcaaatacaatatatatacataacgtggagagcagatattgttgggtcatcctttcttgaattatgtgagctgatagatatcaatgacactttatgctgtgagaagccctacttgaacaatttaatgatacagctttcttaaacaattccaagttacaatgccgttttgttctttcaagtatgtaatcattctccctcttaaagtacattcggaattgaagtggtgcaataaagtactgtctttattct

SEQ ID NO: 5476 - DNA, 1136 bp, Arachis hypogaea
aagaaaaagaagataacagtgagcactaagcagccagcggcccctagtcttggggtcaagggatggagttgcaaagtcaacagttctgtgttgagaacaaaaacggtgtcggttcgtcctctctctcattttctcagttcctctgcttttgagttttgaggtagcaaaacgacgtgccgttggttccaagtgaggatggcgagcagagagacggtgagaaaggcagaggctctcgtagagaaagccatgaaaggaaacgacgcttcacacgatgcgtcgcacgtttggagggttcgtgatctcgctctctccctcgcctccgaggaaggcctttcttccaaccctcactctctccaaatcgtggagttagcggcgctgctccatgatatagctgattacaagtacttgagggatccgtctgaggaaaaaattgttgagaatttcctcgaagaagagggaatccaggagactatcaagtctaagattttgaagatcatcaaaggaatgggtttcaaggacgaggttacaggaaatggcagtaccgaatggtttccggaattcggagttgtgcaagatgcagatcgacttgatgctattggtgctataggaattgcgcgatgcttcacctttggtggaagcaggaacagggttctgcatgaccctgcaattttaccgcggactgatttatccaaggaacaatacatgaagaaagaggagcaaactactattaaccattttcatgagaaacttctgaagctcaaggatatgatgaaaaccaaggctggaaagaggagggcagagggaaggcataagttcatggaggagtttgtgaaagagttttatgatgaatggaatggtgtaagctaattgcatgttccaagcatgattatctccttggtttggatgctatgcataatgcaaatacaatacacatgaagagcagatattcttggatcatcctttcttgaattatgtaagctgatggataatatgcagtgacactttatgctgtgagaagccctacttgaacaatttaatgatacagctttcttaaacaattccaagttacaatgccgttttgttctttcaagtatgtaatcattctccctcttaaaagtacattcggaattgaatat

SEQ ID NO: 5477 - DNA, 2995 bp, Cicer arietinum
tacaagagcctaccaagagaatcaattttatcctttcccaagccactcccaccaccacgccctcttgttctttctctatcatttctcgtatcaaaagcccttcctctgccattgccagaactgccaacaaaatatcaaaaaacataaaactctcagcttgactctgtattggaagctactgatatgtgaataaaatgcaaagcaattaatgacacaaacttatcctcagtattgagtcgctagaataaacaggaaattccaatacataatggttggtatgcatgattaaaacagaaaagcgattacgaactatagtaaggagatttaaaagtaatttcgtatgcaaattaattctcgccgcgacgaccgcaattcgtaaagcaacattcgtattagccaaactcgggaaatccttaatgcggccgcgatcacagtagcaacattcgtatttaaaaccttggttagatcaacaaaaaagtttgtgagaattgaggagcaaaggtgaagaagcaattaattaccttggagtggcgcgagcgtacgaagggacaaagttgttgttgtccattgaagaaggtgaggaaaagaagctgagagatggaattgaaaaacgaagaggaaggagagtgcagtggcgtagaacaatgacgctgctgttggctacagaagataacaacaacattacaattagaattagaatttagaattgagattgttcgattcaaattgaagaaagaaataaagaggatgagagagaagaaaaagggaacgaactcactgcaaccacaaaacgacgtagcataaggattctgtttttaactttttgacccgaaaactgaattaaaaaaaaaaaaacttgtagatgcattgattttatcacgaccaattaattttgtaaatggaaggaaagatcgttggtgaataaatgataatcaagcatcactaattagtaattactggtaggtgtggagttggtggaagagagcagaggatggagaaggtaagaaaggctgctgaggctttggttgagaaaacgatgaaagggaatgatgcttcacacgatgctgctcatgtttggagagttcgtgaccttgctctttcacttgcttctgaggaaggtctctcttctcatccccattccatggaaatcgtagagcttgctgcactgctccatgatattgctgactacaaatacctgagggatccatctgaggaaaaaactgttcaaaattttcttgaggaacaaggagttgaggagaacaacaaatccaaaattttggagatcatcaaagaaatgggtttcaaagaggaggtggcaggacaaggaaatactgaatggtctccagaatttggggttgtgcaagatgctgatagacttgatgctattggtgctataggaattgcgcgttgcttcacctttggtgggaataagaagaggatgctgcatgatcctgcaattttgccaagatctaatttatccaaggaacaatacatgaacaaagaggaacaaacttcaattaatcattttcatgagaagcttctcaagcttaaagatatgatgaaaaccaaggctggacaaaggagggctgagaaaaggcacaagtttatggaagagtttgtgaaagagttttacgatgaatggaacggcttaatctaataagttcttgttcttgtcttaatgcaattttgcacttacaagttgcatccggacttggtaaaattacaaaaatggagcttgaataagctagttcaagatggtggaaatttttcacatcttgtaagttgcaattagtaaccaagtcattgctccaagcatagttttttccaccaaacaatttttgttttggaagctagactatatttaatgtaaattgttatctatttcagtaaacaaatgctcttggtgttgtagtctagattatatatataactagagctgttcaatttgacaagcccatatttgcctcagcctacatgttggaggggctaaaaggtttcttagttaaaaaggccccaaaacaagaagccccaacactaaaaagcctttgtggggcctatagccctatttttcaaaaagaaatttcgacttttatttttttaaatttgacaaattttttttatttttttcaatttttccttaaaattttccaataagaaatgatttacaattttttttcttgaaattttttgagaaaaaaatgtttttgtatttcttttgagaaaaataaattttgaaaatttttcaaaaacaaaatctcaaaattaacaaattagtggccctatgagcccccttctttaaatctacaaaaaataataaaataataggtcggaattttaaaaaaaattattttaataggggctttgaagtttggggctttattgacagctctatgtatatcgagtattagatttatcataaacttaacctttgtattttcaagtgttggacttagtttttatcagcttggcagataaaaacatttacacgttattaggcactcatttctttccctttcttccctttctttccctgttgctccaagtcatttcagttacttagttagtgactaataactgactggttgttagaatcagttgtttgttgttcaagttatttaataagtttgttttttaaatttctataaattgaaatgagtcatcaattcttaaatcaactttggtaatcaatattgtatcttttcatttttcatcaattcagaaagaggaatttcaggttactacattttttcgtttttcttcaccatcaaactacacatagttttccacgctgcaaatttttcttcattcttctttttctttcacccatggttgaactcatggatatgaacaataatgccaatccttttttaattgcgaattcagacaatcctagattggttcttgtatcttaccccctcactggtgagaattatggttcatggtgtcgtgccatgggtcttgctcttacaggccgcaacaagctcggttttgcata

SEQ ID NO: 5478 - DNA, 907 bp, Lupinus angustifolius
gtacatgacattcaggcttatttgccaccctcatagcaaaacggtgagagacatggggaggagagaagaaagggtaagaaaagcagaggaaattgttgagaaagcaatgaaaaatcaggatgcttctcacgatgcttctcacgctcttagagttcgtgaccttgctctctcccttgcctctgaggaaggcctctcttcagattttgattctatgcatatcattgaactcgctgcacttttccatgatatagctgatcacaaatacatcagggatccatctgaggaaaaaattgttgagaattttctcaatgaagaaggagttgaggagaacatcaagtcaaagattttgaagattataaagggaatgggtttcaaagaggaggtggatggaaatggaaatactgaatgttttccagaatttggagttgtgcaagatgctgaccgacttgatgctattggtgctataggaattgcgcgatgcttcacctttggtggcagtaggaagaggctcttgcatgatcctgccattctcccacggtctgatttatctaaggagcaatacatgaactcagagcagcaaactactattaatcattttcatgagaagcttttcaagctcaaagatatgatgaaaaccaaggctgggcagaggagggctgagagaaggcataagttcatggaggaatttgtaaaagaattctatgaggaatggaatggtataagctaatgtataagcagttgttcttatccactatattagtactaagactcttggagtaagagtaagctttctgtatgagactcttccttaaatgtagcttgcaaactatttaagctacttcaagatgctgacaattgtttacattctatacaataagtatttgtattcattagttgttgcttggta

SEQ ID NO: 5479 - DNA, 1134 bp, Vigna unguiculata
ggagtttaagaaatttgtttccgcagtcaccgactctgctctttttcttgaagcttccattgtctgcggttgcttttgcctttgcttcgcatcggaatggatggtgcaaagaaacacggtgctgtcctggctttcacagatggagcagttcttccagtcagtcaagtgtttgaggcaattagagaacttggcaatgaaggggttcaggaatcggatcctctagttcttacatctgcctcgctcttaagcaatttgccagtggagtcttcctctgttgattctgctattttaatctggttgtcaagtgattgtcctggggcccaactgattcaagaaatccttagagtgttaaaagtgggtggtataattctcattcgcaagtcacctcagtctactgtggggtcatttgataagataatatctgatcttcagggcaagttattgctggcagggttttcagaaacccaaattttacaatcaactggtgtcaaagctaaaaagccctcatggaaagttggttcatcattttccttaaagaaggtgataaagagttcacctaaaatacaaattgatgttgattcggatcttatagatgaagatagtcttttgactgaagaagatttgaagaaacctcagctaccaccaggtgattgtgaaattgggagtactagaaaagcctgcaaaaattgcacctgtgggagggccgaagaagaggaaaaagttttgaagttaggattgacagcagaacagattaataatcctcaatcagcttgtggcagttgtggactcggagatgcattcagatgcagtacctgtccttacaagggattgcctccctttaaattgggcgagaaggtagcactgtccggtaacttccttgctgcagacatataaatggataagattgcagtacgatttgtcatggaaatcctattattataggattacttatgtagtatttgtcaaacccgagttatgttaatactactaccagagattcatgttttccagctatttgagctgtaatgtcatttgtctctttaactcttgtatttccttgataaatcccttcatgcttaataataagcttggagacagtggttttatcaaccaacgtataaatttaatattcta

SEQ ID NO: 5480 - DNA, 1073 bp, Glycine max
ataattttctgcagtcggcaacttgaagcttcgattctgtgttgttgcttttacttcccatcagaatcagaatggatggtgcaaagacacatggtgctgtgttggcatgtacagatggagcagttcttcccgtcagtcaagtgtttgatgcaattagagagcttgggaatgaaggagttgagcaatgggatcctctagttcttacttctgcctcactcttgagcaagttgccagtggattcttcctctgttgattttctgattttaatttggctgtcaattgattgtcctgtggaccaactgattcaagaaattcttagagtgttaaaagtagatggtacaattcttattcgcaagtcatctcagtctgctgtgggttcatttgataagataatatctgctcttgagaacaagttattgttggcagggtttacagaaacacaagttttacaattaactgggatcaaagctaaaaagccttcatggaaaattggttcatcttttgcgctaaagaaggtgataaagagttcacctaaaatgcaaattgattttgattcggatctaattgatgaggatagtctcttgactgaagaagatttaaagaaaccccagctgccacctggtgattgtgaaattgggagcacaagaaaagcctgcaaaaattgcacctgtgggagggctgaggaagacgaaaaagtattgaagttaggattgacaacagaacagattaataatcctcaatcagcttgtggcaattgtgggctaggggatgctttcaggtgcagtacctgcccttacaagggactgcctgctttcaaattgggcgagaaggtagcactgtccggtaacttccttgctgctgacatataaatggataaagttgcagtacgctttgtcatgggaatgatattattatagaatttaattatttagtatggaattgtcatcagttatgttaatgctagcagaaccattcatccaagttgtggttttgatacaattttacatatgaccatacgagagattcaagttttccagctattgaagagctgtaatgtcattgtctgatttgtc

SEQ ID NO: 5481 - DNA, 1523 bp, Glycine max
aaaagaaagaaaataaaaataaataggttaagtaaaaagcaaaccctggtttgattacacctaactaagaggtcacgtgatttgcatgtgtggttgatttccttcccctgtttaaaaaccaaaactgcatcgtctctgtttcataattttctgcagtcggcaacttgaagcttcgattctgtgttgttgcttttacttcccatcagaatcagaatggatggtgcaaagacacatggtgctgtgttggcatgtacagatggagcagttcttcccgtcagtcaagtgtttgatgcaattagagagcttgggaatgaaggagttgagcaatgggatcctctagttcttacttctgcctcactcttgagcaagttgccagtggattcttcctctgttgattttctgattttaatttggctgtcaattgattgtcctgtggaccaactgattcaagaaattcttagagtgttaaaagtagatggtacaattcttattcgcaagtcatctcagtctgctgtgggttcatttgataagataatatctgctcttgagaacaagttattgttggcagggtttacagaaacacaagttttacaattaactgggatcaaagctaaaaagccttcatggaaaattggttcatcttttgcgctaaagaaggtgataaagagttcacctaaaatgcaaattgattttgattcggatctaattgatgaggatagtctcttgactgaagaagatttaaagaaaccccagctgccacctggtgattgtgaaattgggagcacaagaaaagcctgcaaaaattgcacctgtgggagggctgaggaagacgaaaaaatattgaagttaggattgacaacagaacagattaataatcctcaatcagcttgtggcaattgtgggctaggggatgctttcaggtgcagtacctgcccttacaagggactgcctgctttcaaattgggcgagaaggtagcactgtccggtaacttccttgctgctgacatataaatggataaagttgcagtacgctttgtcatgggaatgatattattatagaatttaattatatagtatggaattgtcatcagttatgttaatgctagcagaaccattcatccaagttgtggttttgatacaattttacatatgaccatacgagagattcaagttttccagctattgaagagctgtaatgtcattgtctgatttgtctcttcctctcttctattttccttgtttgaatcacatgaactagtataagttattggagcatgagtagatgtaaatatatattaaaaacatgtaattgtgtctcaattgtagggtaggaggtttttgcagtgtggactttactaatttagtgtgagagacgtgtatggaaagggtgtgggtgggaaaagttaaaggattgtgctaatttatttttgtcaatgtaccatagatttgctggagccatcgcttaattaggacaatgtacgtataaatgagcactattatatgcataaagaatcatatttgcc

SEQ ID NO: 5482 - DNA, 1228 bp, Cajanus cajan
ggtttaatttctgcagtcggcaactcagccttcgtcttcaagcttccttcgatttcgtgctgtcgcttttgcttcccatcggaatggatggtgcaaagacacatggtgctgtgttggcatgtacagatggggcagttcttcccatcagtcaagtgtttaatgcaattagagagcttggaaatgaggggattgagcaatgggatcctttagttcttacatctgcaaccctcttaagcaagttgccggtagattcttcatctgttgattttgtgattttaatctggctgtcaattgattgtcctgtggaccaactggttcaagaaatccttagagtgttaaaagtaggtggtacaattcttattcgcaagtcttctcagtcttctgtgaattcgtttgataagataatatctgatcttgagaacaggttattgttggctgggttttcagaaacacaagttttacaatcaactgggatcatagctaaaaagccttcatggaaaattggttcgtcttttgcactaaagaaggtgattaagagttcacctaaaatgcaaattgatgttgattcagatctgattgatgaagatagtcttttaactgaagaagatttaaagaaaccccagctgccacctggtgattgtgaaattgggagtacaagaaaagcctgcaaaaattgcacttgtgggagggctgaagaagaggaaaaagtattgaagttaggattgacagcagaacagattaataatcctcaatcagcttgtggcaattgtgggctcggggatgcttttaggtgcagtacctgcccttacaagggactgcctgccttcaaattgggcgagaaggtagcactgtccggtaacttccttgcagcagacatataaatggataaagttgcagtacgcttgggaatggttattatagaatttttttttttaatgtagtatgggatttttatcagttatgctaatgctagaaaaaccattcatcctagttgttcgatacaatttttacgcttgacagtgcgagagatccaagttttccaggtagctattatagagttgtaatgccactgttgcttgctcttgtatatgcttttgatataatatcgtttattattagaaactatagctttggaacagatgattataagaaatcatgatcccttttaaatgtagtagatatactatatactatatactattttgtgtaatttttaaaaagatattta

SEQ ID NO: 5483 - DNA, 1244 bp, Glycine max
gaatgagagagaagctggttggttgctatttatacttaagagaaagagcgcacgcaccatctctctctgtttcttcaatttctgcagtcggcaactcttccctttctcttgaagcttctattctgtgctgttgctgaatcagaatggatggtgctgtgttggcatgtacagatggagcagttcttcccgtcagtcaagtgtttgatgcaattagagagcttgggaatggagggcttgagcaatgggatcctcttgttcttacttctgcctcactcttaagcaagttgcctgtggattcttcctctgttgattttgtgattttaatctggctgtcaatcgattgtcctgtggatcaactgattcaagaaattcttagagtgttaaaagtagatggtacaattcttattcgcaagtcatctcagtctgctgtgggttcatttgataagataatatcttctcttgagaacaagttattgttggcagggtttacagaaccacaagttttacaatcagctgggatcaaagctaaaaagccttcatggaaaattggttcgtcttttgcgctaaagaaggtgattaggagttcacctaaaatgcaaattgattttgattcagatctgattgatgaagatagtcttttgactgaagaagatttaaagaaaccccagcttccacctggtgattgtgaaattgggagcacaagaaaagcctgcaaaaattgcacctgtgggagggctgaagaggaggaaaaagtattgaagttaggattgacaacagaacagattgataatcctcaatcagcttgtggcaattgtgggctaggggatgctttcaggtgcagtacctgcccttacaagggactgcctgccttcaaattgggcgagaaggttgcactgtccggtaactttcttgctgcagacatataaatggataaagttgcggtaacgatttgttatgggaatggtattatataattttttatttagtatggaattgtcatcaattatgttaatgctagcagaacaattcatcagagttgttttgatacaattttacgtatgacaacacgagggattcgagttttccggatattatagagctgcaatgtcattgtctcttcctctcttctattttcttgataaaatcataagcatgaagacagtgttcttgtcaaccaacttataaattaaagagtaatcacataaaatattgcatagtgtaaaaaacttaaggttgcagtcttg

SEQ ID NO: 5484 - DNA, 8112 bp, Glycine max
catattggcgatttatgggcaaaggttttgatgttgaagtataggggatggaaaaacttagatgaggcaaggaggaatcacaaggagttgatatggtggcgagacttgtgttttgtgtgcggttctgagggaaaaggtgggtggcttaatgaaggtgtgaagtggaaaataggatgtaggtcgcaggtaaattttttggaagataggtggaggcaggataggttatctttgatggagaagtactagagactatattgtatatcttgactacaacatcacactatttagtagatgggcttcgaggtgggggaattgtgggaatggaattttgtgtggcggagaatgatgccagaaagggagatggaactagtagctagctttatggaggatattaaggagttgggggttcagcctaatcaacaagacaaataaatttggaagttgtactcagtgggaaagggatatcatttgcttaatgaagttgtggcggatgagaacgaagacaaggcattcaaactaatttggaaaatgaaaattttaagcaaggtagcacactttgtttggaggttggttaagagtagactaccaacaaaagcaaacctaaggagaaggaatgtgcagctagatgactaccattgcccattttgttcgtgtcatgaggaggaagcgtcccacatattttttggctgccaaagaataatgcctttatggtgggagagccttgcatggacagaggttgtaactgtgttccttgcatcacctaggaaacactttctacgacattcatactgtaaggcatcaggaatagtccaaaacagatggtggatgtggcgggctgccctcacgtggtgcatttggaatcatagaaatagaattgcattctcaaatgacaattttaatggacagaaattgatggaggatgcaattttcttctgttggacgtgacatagatatttagacaatgacttaaagctgtcactctacttttggtccaataatattaaatctggattcttgtataggggagggattagaccatagatactttttgtaatgggtattccagtgtgcccagagatgggggttatggtattctaatatctcaagtatattttgattccataatcttacatagataacacacaaactgggatatgcagatattagtactacttgtactgatttcatacttaaaagatcaaccatgcaaccataatgtttgatatcatgcataattttgtattgttttgccatatgatcaaaataccatcttgctttatctaccaaacccttacgactacaagcaatcaaaacaccaaggaatgtcaccccgatttggcctaactgtacaaagcctgctttccatctttgaaaacaattgcagatcttcctcacagtaaccatggacatccaaaccaacaatcatagcattccaacaactaacagtttttatcctctctccatgaaggagttgtgcttggaagtttgtaggaagagggaatgagcatggaagaggtttcccattggagaaagtgcagaaaagaagattaacttgacagtgaagggaaggtgagagtgaaggctagctttggtgataatggattgaacttatttcagttccaacatggaacaaaggtgttgaaccatgcagcttatgcgtgaatatgttcctgacattggtttcgtggtgtttcactgtcactgctagtattcatatgatcaacatattaagaatgcgttggttatggtcatttagggatgtgaggaggtttggaagagtcttcagttttcgttagggacaaatgatcaaacacttgatgagcatttctgtatggaaatgtcacgagtaaattatattctttttatattctacatcactttccagcctttctatttgtttattctcataaatttaaacatggcttaactttacaaatcgtgctgaagagtgtttaaatctagtaattaatttgtaattaaatgataatataaaatctctatgttattagtattttcaattaaactgtttattaaaaatgatagtaatgaatatttttttattcttgcatcaacgatatttgagctgactttgtgcaaatgaatctaaatcactctttatccttaagctggctctaataatttttaatcataaatattatactttattataagaacataaagaaaaagatatgaaaaaaagaaatataaaaaaaaagcgagaaagaaatataaaagataaaaacgaaaaaggataaaaaaaaacatatttaaatggatacaaaatactagaaaagaaaaagtgagaaagaaatatttcttcaatttttttcccatttcagaaggaagaaaataaataggtcaagtataaagcagattccagtattactaaccgtgaaaatggtctggctaaggcccatgcaggccaagggaaagaaagcccacaagaccaaaggcccatatcataacgcctttagagccgaaaacatccacagggccttgttaattagggtcagcccatggatcctgaattttaaatttaaaagacttttttgttcactttttcttcttattatcatattggtataaaatagacgaattgggatcgatctggccagcccattgggccaaatagtgaaaataaaacagtctagacttggtttatattctttcaagttgaaatttcttaggaccaactcaactctatgtcaagctgttggccaccaagcctattcgagtcaatttaaaaataataataataagggttaaaaaattgattataggtaaaaaaaaatcaaaggcaataaattatttattatgtatttatttcgactaactagtattggtaaagtcatttaaattatgtttaataaatacccaaattaataatattgctttggggttgttacttcttatggacatttattttatgtttaatgaatatgttttgtccttttaaaaaaatataaattgtaatttaaaattaaaaattacattaatgatttattatattttatttaatatttattatatattactaattaggctagcccaacccgaatccatttgatctgtcaggctatatgggtcaaccaaaaaagacttatttctattcaaactatcttttttagtccagtgtaaccctaactgtgggtcgaataggttgatccatcaaaacaaatccattttgtttgctctagtacaaagtaatattgcaaactattgattccaagccacctatcgcaatgaatcaacaattcaaaatgtttttcttgcgtattcttgaaaaatcaatgtttatatataggtgtaggaagatttgtttgggaagtaagaagttctattgagatctcttcatcggtaaagaattgtctatgtgaaaacacaaaaacaaaagattgatctttaaataggaaaaaaagtgaatttgcgggtccgagatgaattggcttattcgaaaaaagccctattctttgaaagtgatgactaattttcattatccgtgaacgcatacaatatatataaattaaactataactaaaattgataatagataagtattttttcataaaaattatatttcaccccttaaaaatattttagacttagataaccaatttttatcattttattttatcaacaaagtgttagtttgtaatttgttaaaacattaagttttgtaattttgttagcaaaaatgatcaaattcgtgcaactttttttttctcttaatcattgaaataatcttacatctccaatttttattgtgataataaataaatgttatgttaaaaatattagtatcattaaagaaaaaaatgatagtatttaataatcatcacaaatgaagtgaataaaaaaaataagctaatttctctcccttgttttaaccttagttttagtttgtgttttgttaaaattaaaccgagtattttctttcttcaactaatacaccaatcaatctcattatttatttattataaattttaattatataaaataaaatttattctgtttaatgtacggtctaaaatactatttattaattattatgacgagcggccgcctgcaggaaagagaagctggttggttgctatttatacttaagagaaagagcgcacgcaccatctctctctgtttcttcaatttctgcagtcggcaactcttccctttctcttgaagcttctattctgtgctgttgctgaatcagaatggatggtgctgtgttggcatgtacagatggagcagttcttcccgtcagtcaagtgtttgatgcaattagagagcttgggaatggagggcttgagcaatgggatcctcttgttcttacttctgcctcactcttaagcaagttgcctgtggattcttcctctgttgattttgtgattttaatctggctgtcaattgattgtcctgtggatcaactgattcaagaaattcttagagtgttaaaagtagatggtacaattcttattcgcaagtcatctcagtctgctgtgggttcatttgataagataatatcttctcttgagaacaagttattgttggcagggtttacagaaccacaagttttacaatcagctgggatcaaagctaaaaagccttcatggaaaattggttcgtcttttgcgctaaagaaggtgattaggagttcacctaaaatgcaaattgattttgattcagatctgattgatgaagatagtcttttgactgaggaagatttaaagaaaccccagcttccacctggtgattgtgaaattgggagcacaagaaaagcctgcaaaaattgcacctgtgggagggctgaagaagaggaaaaagtattgaagttaggattgacaacagaacagattgataatcctcaatcagcttgtggcaattgtgggctaggggatgctttcaggtgcagtacctgcccttacaagggactgcctgccttcaaattgggcgagaaggttgcactgtccggtaactttcttgctgcagacatataaatggataaagttgcggtaacgatttgttatgggaatggtattatataattttttatttagtatggaattgtcatcaattatgttaatgctagcagaacaattcatcagagttgttttgatacaattttacgtatgacaacacgagggattcgagttttccggatattatagagctgcaatgtcattgtctcttcctctcttctattttcttgataaaatcataagcatgaagacagtgttcttgtcaaccaacttataaattaaagagtaatcacataaaatattgcatagtgtaaaaaacttaaggttgcagtcttgcagaatgtatgaaatatttaaataaatatttcgaatagaattgctttagaaaaaaatacatttaattataagtactattaatgaataaatggtgtatataagaaaagtactgctattaattatagcaaattatttaattataatttatttttattttagttttaattttgatatattgttattgtaaattgtaaagtatcactttcatatttaaattttaattcttaatcttgattattttgttcagattttattgattgtaaagggctgtcgtaatgcaacaacatgagtcatgtttgaatcattcactagttggaacaatgagtcatgttaaaatcacatgaactcgttaaattataggagcatgaatagatgtataaatatattaaaaacttgcaattgtgtctcaattgtagggcaggaggtttttttgcatgtggatcatagttgtgaaatctggttaggttattgacccggtcgaggtagtggatcagtgagttaatggtctaatcggtgcattaataattagtctgatttgatctggtctatattaaaaaatataaaattatatgtgtatatattatatataaatatataactaacattatttgattaagaaaagttaattcataatttcatattctaaaatttaaagtaacaattgaagtattaaaattgataacacaagtgaagtgtattagtaataaagagaacataaatagtaattacctaaattaaaacacacaagtccagtttttcagtaaacaaaatgagaagtctattttttcaataaacaaaaagagtgcaaataaattttctgcatttctatttttttttaacgtacacaacctagtccgagtttttaaaagggtttccacaaaacagatctggtttggttggaccatctcgagtcacatacatgagtggtctaatagtgaaatcggtccagttatgccaccaaatccctattggatcagtctaatcaacggggtcgaatcaaattttacaattatgatgtggactttactattgtagtatgagagatgtataccaaaaaggtgagtggaaaaagttaaaggactatgttaatttatttttgatatatcatagattcgctggagccaacacttaattagggacaatgtacgtagaaatgagcactattatatgcataatgtatcatttttgccaataaatacatggaaggtagaaagttatacaatggaagaaacaaatagaaatgttgttcacggagaagcacgttagtatttcttcctgtctcaattataagtaataaatggttttttttatctcaaatataagtaaattttacttgcctatttttatttaatgaaattttcttcaaaatatttttcatttaataagattaaaatattttttatgtttgatattaagtttcaagatagtttaagaaaactgtttgtttttttaattaaaaataatactatttaataaaattaactaatcttctttaaaagtgtaaaatatgtccttttttcttcttcttataataaagatcatactttgaaatcaaattaagtatgatcactttataaacggaattcacgggagcatgctcatccagatgtgccccatcatgattaaaaataatttttcttcaaagatgttatctctcattcattaacgaattttaaggtaattattatgaaaattaataatttttttatatataatgatgtgattagttgatgataaaatatatttaactaataagattagatcaaacaaaagagattattgttcatgcttcgacgaatgaaaatatttttagaaaataaaaaataaggacaaattttgttgttgaaaataataaaataattttaaaaatgtcctgaaaatcgctatgttgttaacttgaattttaaaatttgatttcttgttgtcattttattggtttaaaaaaatatgttaatttgttaccttagtcacaatttattgatttttggactataatgagtgacaattacacttttaaaaatatttttgtcattttatttttagggactaaattagttgtgtctcattttttaagcatcaaattaatcacttgccaacaaaagaaaaatatttagattgttaatagatacatagatatcaattactaccccaaaaaatactacacctatatccttttcaagtgtcttataatttttttcttgacaaaatcttgtattatttttataaaaaaatacaataaattttcataaaataattttaaagtttcttatcatatttttttttcatttttacttcacaataaataaatactagtgataaaagtgtgaactaattcaagttagatgataaataaggatataattaacaaaaatattattttaaactttgaaaatgacaaataaataaataaaattacaaaatcaacaattaaaaagaaacaaagtagtaagtacaacataaaattatgtgagcgctatgttgaatacaaaatttgtgttaattttcacttcaaaattgtttttaacaaaaaataattttctgttaaaaataatatatatatatatatatatatattattttacttaaaattaaattttaataaaaaaatcaatttacaaaattcccatcactcaattcaacatcaagaggggggaattttttaaaatatttatcttttatttggatttctatagataaaaaaaaaaaaaaagagggaaggaaatgatatttatttcgacctaacaaggaagatgaagtgtgctgaaggggaagaggaagagagcagaaactggagaagagaagc

SEQ ID NO: 5485 - DNA, 1176 bp, Glycine max
gtttttcacggtcggatcaaaacaggagctccgagaggttcaagccatggggatctacctagctgaagggttcagcagttaaggaaaagagacgaagattttgagctcggaaccattgcgatggccatggcttccaaccatcttcgaaacctcaatcgcatctccatccaccattttcaggctctcctcaacgatactaccaggttcttctccgacgctgcttcttcattgcctcaaccgcaacctccctcatcatccttgaagcacaatgagctcgccaagttcgccgccatcgccgatacctggtgggattctgaaggcccctttaaaccattgcatgtgatgaatcctacgagacttgctttcatccgttctgcactttgtcgacatttcaagaaggacccttacaatgctaaaccccttgaaggacttaaaattattgatgtaggatgtggaggtggaattctttccgagccactagctcgattgggagctactgtgacgggtgttgatgctgtagagaagaatatcaagattgctcaacttcatgctggtttggatccagcaacttcatctattgagttttgttgcacaacagctgagaagctagttgaagaaggaagaacattcgacgcagttatggccttggaggtgattgagcacgtagcagatcctgcagagttctgcaaatctctgtctgcactaacagtcccagaaggagccactgtgatatccacgatcaatcgatccatgagagcctacgcaactgccattgttgctgcagaatacattctccgctggcttccgagaggcacacatcaatggtccagttttctgactccagaggaactcgtcctgatcctccaacgcgccggtatcaatgtggaggagatggctggatttgtgtataacccagtgacaggacggtggtctttatcagacgatatcagcgtaaatttcatcgcgttcggtaccaaatcaaacaacacggaataaaatacatagataagatacgtgttattgtcattactatgttgaatgctaataaaacaataagggttaagtgcggtggaatcagggagaggatgggcttgggacgcccttcatactttatctgcttacttactagtaattggagaaatactcaaaacacattcatttaaatacgctctaatt

SEQ ID NO: 5486 - DNA, 1396 bp, Glycine max
caaaattatattatgcaattatggaatccaaatccctttctccaaacttaacttgtattaccaatcaaaatatcaattaaaccataatttaaaccaattttaaaataagattctcaatatttttaaatattaatgaaaatcagcccgtttttcacggtcggatcaaaacaggagctccgagaggttcaagccatggggatctacctagctgaagggttcagcagttaaggaaaagagacgaagattttgagctcggaaccattgcgatggccatggcttccaaccatcttcgaaacctcaatcgcatctccatccaccattttcaggctctcctcaacgatactaccaggttcttctccgacgctgcttcttcattgcctcaaccgcaacctccctcatcatccttgaagcacaatgagctcgccaagttcgccgccatcgccgatacctggtgggattctgaaggcccctttaaaccattgcatgtgatgaatcctacgagacttgctttcatccgttctgcactttgtcgacatttcaagaaggacccttacaatgctaaaccccttgaaggacttaaaattattgatgtaggatgtggaggtggaattctttccgagccactagctcgattgggagctactgtgacgggtgttgatgctgtagagaagaatatcaagattgctcaacttcatgctggtttggatccagcaacttcatctattgagttttgttgcacaacagctgagaagctagttgaagaaggaagaacattcgacgcagttatggccttggaggtgattgagcacgtagcagatcctgcagagttctgcaaatctctgtctgcactaacagtcccagaaggagccactgtgatatccacgatcaatcgatccatgagagcctacgcaactgccattgttgctgcagaatacattctccgctggcttccgagaggcacacatcaatggtccagttttctgactccagaggaactcgtcctgatcctccaacgcgccggtatcaatgtggaggagatggctggatttgtgtataacccagtgacaggacggtggtctttatcagacgatatcagcgtaaatttcatcgcgttcggtaccaaatcaaacaacacggaataaaatacatagataagatacgtgttattgtcattactatgttgaatgctaataaaacaataagggttaagtgcggtggaatcagggagaggatgggcttgggacgcccttcatactttatctgcttacttactagtaattggagaaatactcaaaacacattcatttaaatacgctctaattatgtttcataaaacttgataaaattaaatgtttaaatagttgaaaaatataaaataattggagaataatcaaat

SEQ ID NO: 5487 - DNA, 1421 bp, Glycine max
aatttttaatttttaaatattaataaaacatgaacccgttatctagaatcgggtcaaaacaggagctccgacaggttcgccgccatggatctacctggctgaagggttcaggttcaggaaaagagacgaagattttgagcgcggaaccattgccattgccatgtccatggctttcaaccatcttcgaaacctcaatcgcatctccatccaccgcattctccaccatcgttttcagcctctccttaacgctactactaggttcttcatcgatgctgctgcttcttcaatgtctcaaccgcagcccaaacaacaaccctcggccccatcatcatccttgaagcacaatgagctcgccaagttcgccgccatcgccgatacctggtgggattctgaaggcccctttaagccattgcatgtgatgaatccaactagacttgctttcatccgttctgcactttgtcggcatttcaagaaggacccttatagtgctaaaccccttgaaggacttaaaattgttgatgtaggttgtggaggtggaattctttctgagccactagctcgattgggagctactgtgacgggtgttgatgctgtagagaagaatatcaagattgctcaacttcatgctggtttagatccagcaacttcatctattgagttctgttgcacgacagctgagaagctagttgaagaaggaagaacattcgatgcagttatggccttggaggtgattgaacacgtggcagatcctgctgagttctgcaaatctctgtcagcactaacagttccagatggagccactgtgatatccacaatcaatcgatccatgagagcctacacaactgccattgttgctgcagaatacattctccgctggcttccgagaggcacacatcaatggtccagttttctcactccagaggaactcgtcctcatcctccaacgtgctggtatcaatgtggaggagatggccggaatcatgtataacccagtgacaggagggtggtctttatcagacgatatcagcgtaaatttcatcgcgttcggtaccaaataaaacaacaccgaatatcatagatagataaatagataagatccatgttactgttattactataattattattagtattgaatattgaattttgttttgaatgctgaataataaacattgaagttataacagaaagaaataaaggttaagtgtggaatcagggagaggaggggcaaagtttcccgagagtgatagagctgcgtttggattgagtcaatggttgactgtgccatatctgaaactccggtgtgcaattaatctggtgtttccaatggtagggtgcttttccggacaagagaatcaaggaaccaggggtgaacaaaatgggaacggaaagggaagtggagagggtagtgaagtgcatgat

SEQ ID NO: 5488 - DNA, 1134 bp, Glycine max
aatttttaatttttaaatattaataaaacatgaacccgttatctagaatcgggtcaaaacaggagctccgacaggttcgccgccatggatctacctggctgaagggttcaggttcaggaaaagagacgaagattttgagcgcggaaccattgccattgccatgtccatggctttcaaccatcttcgaaacctcaatcgcatctccatccaccgcattctccaccatcgttttcagcctctccttaacgctactactaggttcttcatcgatgctgctgcttcttcaatgtctcaaccgcagcccaaacaacaaccctcggccccatcatcatccttgaagcacaatgagctcgccaagttcgccgccatcgccgatacctggtgggattctgaaggcccctttaagccattgcatgtgatgaatccaactagacttgctttcatccgttctgcactttgtcggcatttcaagaaggacccttatagtgctaaaccccttgaaggacttaaaattgttgatgtaggttgtggaggtggaattctttctgagccactagctcgattgggagctactgtgacgggtgttgatgctgtagagaagaatatcaagattgctcaacttcatgctggtttagatccagcaacttcatctattgagttctgttgcacgacagctgagaagctagttgaagaaggaagaacattcgatgcagttatggccttggaggtgattgaacacgtggcagatcctgctgagttctgcaaatctctgtcagcactaacagttccagatggagccactgtgatatccacaatcaatcgatccatgagagcctacacaactgccattgttgctgcagaatacattctccgctggcttccgagaggcacacatcaatggtccagttttctcactccagaggaactcgtcctcatcctccaacgtgctggtatcaatgtggaggagatggccggaatcatgtataacccagtgacaggagggtggtctttatcagacgatatcagcgtaaatttcatcgcgttcggtaccaaataaaacaacaccgaatatcatagatagataaatagataagatccatgttactgttattactataattattattagtattg

SEQ ID NO: 5489 - DNA, 1968 bp, Cicer arietinum
tagatcttacgtgcatattttttcctctagaattattacccacacaaatatgaattcaatttttttcccaagctatttgtaaatggttaacactgaattcaagttcaaattttggttcaatctttttgacaagattaaattttagttgaatctattctatcaaaaaccggattaaaaaaaaacgtcctcactaatgaagcctaaataaaaattctgaaattttccgaagaagagttgcaaggtgcaagccatgctttttaatccacaagcctgaaaccatttatactgcagcaccgctgtgaaagagaagaagcaagacaccgttgccgctgtgcgcgccgtaaactgagccgccaccgccgtttcgcagccatcttcttacctaattccctggctcaatcggattctccgaaggctcaaggaaagagaagaatcagtaaccatgaaactcttcaatcatctccgaaacctaaacggcaccacaacccaccgcattctccgtaatcgatttcaccctcttttcaacaacaccaaattcttctccgatgctccatttcctcaacaaccaacaacctcacacgttaaaccaccttcgcctccttcttccttgaaccgcaacgaactcgccaagttcgctgccattgctgaatcatggtgggattctgaagggccttttaaaccattgcatgtgatgaatcctacaagacttgctttcatccgctctgcactgtgtcgacatttcaagaaggacccttacagtgctaaaccccttgaaggacttaaaattgttgatgtgggttgtggaggtggaattctttcagagccattagctcggatgggagctactgtgacgggtgttgatgctgtggaaaagaatatcaaaattgctcgacttcatgctgatttggatccaacaacttcaactattgagttttgttgcacaacagctgagaagctagttgaagaaggaagaaaatttgatgcagtcatggccttggaggttatcgagcacgttgcaaatccttcagagttctgcaaatctcttgcagcattaacaattccagatggagctactgtcatatcgacaattaatcgttcaatgagagcctatgcaactgccattgttgccgcagaatacatccttcgatggcttccaatgggaacacatgagtggtccagttttcttactccagaggagctagttctgatcctgcagcgtgccggtatcaatgtggaggagatggcaggctttgcatataacccgatgactggaaggtggtctttatcagacgatataagcgtcaatttcattgctatgggcaccaaaacaaacaacactgaatagagtataggatagataaaaaaattacttaatacttgctcttaatttatttatttatttgtaagaatgatattaaattagtcctgaatgctgaataaatattgaagtttaaaaagacaccagaaaaatattgggttggttatgaactctcaaactgtttcttggttataaatattgctggtttctctggatacaaagggaactcaacatcctcaaagctgaattgctagctattctgcaaagtttttatcaagccaggatgttcacccatgttgtgtgttaccccgattctctgctgtgtcaatctaatgaagtggtaacttctgagtttcacaagtatgctacaccattattccagacatctgggatatgctgcaattgtattaaagtgccaaactgattcacaccgtcagagaaggcaactcctatgcagatttcaaggccaagttttgtgctaccaatgatgactttgtgatgtagttatgacaatccacctcaaatactaagcattataattttttgcttattgttcaaggatcacatttgtgagaacctaatcttttgttcttcttgtctttttcctttcgttactaaactctataagcaaaaaatacaatacctatttg

SEQ ID NO: 5490 - DNA, 1328 bp, Vigna unguiculata
gggagattgaagtgaggaacacaacataaccataccaatctccatggcgttcttacccagttttgctccttttgtgtttctattgcttgttattggttgcactgcaaggcctttttatcctcttcccaacaaaggtgatgggggaagtaggaagcccctacaaacttttcgcccatataacattgcacatcgcggttcaaatggagagcttcctgaagaaacttctgctgcatatacgaaagctattgaagaaggtgcagacttcattgaaactgatatcttatcatccaaagatggtgttcttatatgtttccatgatttcaaccttgataatactactgacattgcaaatcacgaggagtttgctgatcgtaaaagaacgtatgaagtcgaagggaaaaacagcactggattctttactgttgatttcacattaaaggagttaaagtcattgagggtgaaacagaggtttggatacagggatcaacagttcaatggaaagtttcaaatcatcacttttgaagagttcattaacatagcactggatgcaccaagagttgttggaatatatccagagataaaaaatccagtatttatcaatcaacatgttaaatggtcagatggcaaaatatttgaggacaagtttgtggagacacttcagaaatatgggttaaagggttcctacctgtcaaaagattggctgagacaaccagtattcattcagtcatttgctccaacttcactcgtgtatatagcaaataagacggacttgcccaaaattttcttaattgacgatgttgatattccaacgcaagacaccaatcagtcatactgggagattatatctgatgaatacctaaactacataaagcaatatgttgtgggaattggaccatggaaggacacgttggtacctgtggtaaataattatgtggcaactcctactgatcttgtttccagggcacatgctcataatctgcaggtgcatccatatacttaccgaaatgagaacctttttttgcacttcaactttagtcaagatccgtacgtggagtatgattactggatcaacaagataggtgttgatggtctgtttacagacttcactggtagcctacatcgttttcaggaatggacctctaaacatcaagacgatgatgataacaacgcatccaagctattgcataaaattgcattgttgctctcctcttataattgatgtcgaaaattcagacgttgtatttagagttgggattaattttatgtgttcaaaaaagcttataataatatttacaagtgagtttttgactaaaaaataagggaaaaaa

SEQ ID NO: 5491 - DNA, 1497 bp, Glycine max
gtggagtccagcatttcgacgccaatcataaagcctctgaccattaacattcttaagataaaatcgttcacaccaagaccccattatttaataacagttgaaaccaatatattggactcggaaacgatgaagtgagcaacacaacacaaccagacccatcgttatcttatctccttctccatggcttccttacccagttttactccttttgtatttctattgcttgtcattggatgcaatgcaaggcctttgtatccacttcccagcaaaggtgatgatggaaataggaagcccctacaaacttttcgcccttataacattgctcatcgcggttcaaacggagagcttcctgaggaaactcatcctgcatacttgagagctattgaggagggtgcagacttcattgaaactgatatcttatcatccaaagatggtgttcttgtatgtttccatgatgttacccttgataatactactgacattgcaaatcgcacagagtttgctaatcgtaaaagaacatatgaagtccaaggggaaaacatgactggcttttttactgttgatttcacattaaaggaattaaagtcattgagggtgaaacagaggtgtagcttcagggaccaacagtttaatggaaagtttcaaatcatcacttttgaagagttcattaccatagcactggatgcacccagagttgttggaatatatccagagataaaaaatccagtatttatcaatcaacatgttaaatggtcccatggcaaaagatttgaggacaagtttgtggagacacttcagaaatatgggtacaagggttcctacctgtcaaaagattggttgagacaacctgtatttattcagtcatttgctccaacttcactcgtgtatatatcaaataaaacggacttgcccaaggttttcttaattgatgatgttactgttccaactcaagacactaatcagtcatattgggagattacatctgatgaatacctagagtacataaagcaatatgttgtgggaattggaccttggaaggacacagtggtacctgtggtaaaaaattatatgacaaatcctactaatcttgttgccagggcacatgctcataacctgcaggtgcatccatatacttaccgaaatgagttcccatttttgcatttcaacttcagtcaagatccgtatatggaatatgatttctggatcaacaagataggcgttgatggtctctttacagacttcactggtagtcttcatcgttatcaggaatggacctctaaccgtaaagatgatgatgatgacaagactgaatccaatctattacataaaattgctttgttagtctcctcttatgaatgatcttgagaattcagatggtgtataagtgtttggattaatttattgtgttcaaaagacgctaataacaatatttacaagagagcttttgagttttgacttaagtctgaaaattaagcaaaataaaaaatcactaatcac

SEQ ID NO: 5492 - DNA, 1421 bp, Glycine max
cattcttaagataaaatcgttcacaccaagaccccattatttaataacagttgaaaccaatatattggactcggaaacgatgaagtgagcaacacaacacaaccagacccatcgttatcttatctccttctccatggcttccttacccagttttactccttttgtatttctattgcttgtcattggatgcaatgcaaggcctttgtatccacttcccagcaaaggtgatgatggaaataggaagcccctacaaacttttcgcccttataacattgctcatcgcggttcaaacggagagcttcctgaggaaactcatcctgcatacttgagagctattgaggagggtgcagacttcattgaaactgatatcttatcatccaaagatggtgttcttgtatgtttccatgatgttacccttgataatactactgacattgcaaatcgcacagagtttgctaatcgtaaaagaacatatgaagtccaaggggaaaacatgactggcttttttactgttgatttcacattaaaggaattaaagtcattgagggtgaaacagaggtgtagcttcagggaccaacagtttaatggaaagtttcaaatcatcacttttgaagagttcattaccatagcactggatgcacccagagttgttggaatatatccagagataaaaaatccagtatttatcaatcaacatgttaaatggtcccatggcaaaagatttgaggacaagtttgtggagacacttcagaaatatgggtacaagggttcctacctgtcaaaagattggttgagacaacctgtatttattcagtcatttgctccaacttcactcgtgtatatatcaaataaaacggacttgcccaaggttttcttaattgatgatgttactgttccaactcaagacactaatcagtcatattgggagattacatctgatgaatacctagagtacataaagcaatatgttgtgggaattggaccttggaaggacacagtggtacctgtggtaaaaaattatatgacaaatcctactaatcttgttgccagggcacatgctcataacctgcaggtgcatccatatacttaccgaaatgagttcccatttttgcatttcaacttcagtcaagatccgtatatggaatatgatttctggatcaacaagataggcgttgatggtctctttacagacttcactggtagtcttcatcgttatcaggaatggacctctaaccgtaaagatgatgatgatgacaagactgaatccaatctattacataaaattgctttgttagtctcctcttatgaatgatcttgagaattcagatggtgtataagtgtttggattaatttattgtgttcaaaagacgctaataacaatatttacaagagagcttttgagttttgacttaagtctgaaa

SEQ ID NO: 5493 - DNA, 1656 bp, Cajanus cajan
ggtggcatatgtatttaggtcgtgaatcttattctggaaagacagactcatctaaaaagaaaacaaagtcaactacaaaatgcggagaatattcctagtttccactgcttcggggataagccaacgactttgatcaataatttaccatcattcgttcattcattcactcattcataggataacctcgttacgttgaagactttaaatcaacacaacgcaaccgcacctatcattttcgtctccatggcttcctcaatcagttttgctccttttttacttctattgcttgttattgggtgcactgcaaggcctttgtatcgacttcctagccaaggtcatgatggaagtcggaagcccctacaaacttttcgcccgtataacattgcacatcgtggttcaaatggagagcttcctgaagaaactcgtcctgcatacttgagagctattgaagaaggtgcagacttcattgaaactgatatcctatcatccaaagatggtgttcttatatgtttccatgatgttacccttgataatactactgacgttgcaaatcataaagagtttgctgatcggaaaagaacatatgaagtccaaggggaaaacatcactggcttttttactgttgatttctcattaaaggaattaaagtcattgagggtgagacagaggtttagcttcagggaccaacaatttaatggaaagtttcaaattatcacttttgaagagttcattaccatagcactggatgcacccagagttgttggaatatatccagagataaaaaatccagtatttatcaataaacgtgtgaaatggttgcatggcaaaagttttgaggacaagtttgtggagacacttcagaaatatgggtacaaaggttcctatttgtcaaaagattggttgagacaacctgcatttattcagtcgtttgctccaacttcgctcgtgtatatatcaaataaaacagacttgcccaaagttctcttaattgatgatgttactgttccaacgcaagacactaatcagtcatattgggagattacatccaataaatacctagactacataaagcaatatgttgtgggaatcggaccttggaaggacacgttggtacctgtggtaaacaattatatgataaatcctactgatcttgttactagggctcatgcacataacctgcaggtacatccatatacttaccgaaatgagaacaggtttttgcacttcaacttctctcaagatccgtatatggagtatgattattggatcaataagataggtgttgatggtctctttacagacttcactggtagtcttcatcattttcaggaatggaccactaaccgtcaagatgatgataacaaaagtgaatccaagttattgcataaaattgctttgttggtctcctcttataaaaaaccttgaaaagtcaaatggtgtataaaactatttacaagagatcttttgactaaagtttctgaaaattaagcaaaatcaaacatcactaatcagtcacagtgaggcaaaaccggtatataatctctgcatataatttggggatttttgtttataaggagtgctagcttagcaacacatcctatttggggaattttttaatccgttgtacatttttaattattggttaaactttattat

SEQ ID NO: 5494 - DNA, 1969 bp, Cicer arietinum
gaaaattatatgaaggaaggaaaagaagaatagaaatccggggaatattcgtgcgtggggccttttcccgcagtaagcaacgactttcaacaaataataatttatcaacattttcacattctcaatcgcagaatgttgatatattagtattagtcgttcctagggagactcaattataattgtatcgtaacagcaccatattcatattcatattattattattattatcattattggactttaggaaacaacaatgaactaagtgaggaacacaacacccatcacctccacttcaatacaatggtttcatcacctagttttgcaacttttgtttttcttttgcttgtgattgggggcacgtcgagacctttgtatccgcttcctggaaaaggggatgatggaagtaggaagtctcttcaaacttttcgcccgtataacattgcacatcggggttcaaacggagaacttcccgaagaaactcgtcaggcatacatgagagctattgaggaaggagcagacttcattgaaactgatatcttatcttcctcagatggtgttcttatatgtttccatgatgttacccttgatgagactactgacattgcaaattacaaagagtttgcaaatcgtaaaagaacatatgaagtccaaggtgtcaataccactggattttttattgttgatttcaccttaaaggaattaaagacattgagggtgaaccagaggtatagctacagagatcaacagtttaacggaaagtttcaaataatcacttttgaagagttcattaacatagcattgcatgcacccagagttgttggaatatatccagagataaaaaatccaatatttatcaatcagtatgtgaaatggtcggatggcaaaatatttgaagacaagtttgtcgagacacttcagaaatatggatacaagggttcatacctgtcaaaagattggttgaaacaacctgtatttattcagtcatttgctccgtcttcactcgtatatatatcaaatcaaacggacttgcccaagatttttttaattgatgatgtgactattccaacacaagacactaatcagtcatattgggaaatcacatctgatggatacctagactacataaaacaatatgttgtaggaattggaccttggaaggatacagtggtacccgtggttgaaaattatgcgatgactccttcaaatcttgttgccagggcacatgctcgtaatctgcaggtgcatccatacacttacagaaatgagaacaagtttttgcatttcaactttagtcaagatccgtacaaggagtatgattactggatcaacaagataggagttgatggtctgtttacagatttcacaggcagtcttcataattttcaggaatggacttcccctaaccgtcaagatgacaagattgcatccgagttattacataaaattgctatattggtatctccttttgattgattttgagatgccaaatggtgtgtaaaaagcatgtcattggattgtctaatttttgttttcagaaccttgtatcaagtatcaacacgttcaagaaagcttttgattgaaaagctattgtttagaaaatcttaaggaaaaacaaatagaattctatttacaaagtagtatagtttggggatttttgtccccctcaagtaataagctttcttgtttcagataatgaataaataagttttaagatgtgttgcaattgtagcctgcatttacatgaaaaatattgaagctaggattactgagtggacatctaaccacacaaaaacaaatgtgcctcgatcttagagaaaattcagttgaccatttctcgagcacttgactgtccagtaagatctaagtttctacttggaagcttctggtattctttatgccaccatttcaatgcttgtcttgacaatattacgagcaacacttatcttacaaacaggggatcccacattca

SEQ ID NO: 5495 - DNA, 1489 bp, Medicago truncatula
gggcggggaatattcgtttgtggaccctatttccgcggcaagcaacgactttaatttgtttccacaacaataatttacccattttcacgctcctacgatacgaagacttaacaatgacctgacctgagtgaggaacacaacacatcgaagcacttcttttctatctcaatgtcttcttcattatcgggttttgcaccttttgtttttctattgctcgtgattgggggcacggctaggcctttgtatccacttcctggcaaaggtgaccatggtactaagcagcctcttcaaacttttcgcccatataacgttgcacataggggctcaaatggagaacttcctgaagaaactcgcgaggcatatctgagagctattgaggaaggtgcagacttcattgaaacagatatattatcttccaaagatggtgttcttatatgtttccacgacgttactcttgataatactactgacatagcaaaatacaaagagtttactgatcgtaaaagaacatatgaagtcgaaggggtcaatatcactggattttttgtcgttgatttcacattaaaggaattaaagtcgctgagggtgaatcagaggtactgctttagggatcaacagtttaacggaaaatttcaaataatcacttttgaagagttcattaccatagcattggatgcacccagagtagttggaatatatcctgagataaaaaatccagtacttatcaatcagcatgtgaaatggtcggacggcaaaagatttgaggacaggtttgttgaaacacttcggaaatatggatacaagggttcatacctgtcaaaacattggttgaaacaacctgcatttatacagtcatttgctccaacttcacttgtgtatatatcaaatcaaacggacttgcctaagatttttttaatcgataatgttgatatttcaacacaagacactaatcagtcatattgggaaattacatctgatacatacctagactacataaagcaatatgttgtaggaattggaccttggaaggatactatagtacctgaggttaacaactatgtgatgactccttcggatcttgttgccagggcacatgctcataatctgcaggtgcatccatacacgtacagaaatgagaacaagtttttgcatttcaactttagtcaagatccttacaaggagtatgattactggatcaacaaaatgggaattgatggtctgtttacagatttcactggcagtcttcataattttcaggaatggacaacccctaaccgtcaagatgacaagactgcatccgagctattgcataaaattgctgtgttagcatccgcttatgaataatttttgaggtgtcagattgtgtgtaaaaagcatgtgcttggattaatttattgtgttcagaagcttatatatcaacatgttcaagagaatgtttgactgaaaagctattttgtctacatactaaggaaaaatcgaattcaaatct

SEQ ID NO: 5496 - DNA, 1375 bp, Medicago truncatula
acgatacgaagacttaacaatgacctgacctgagtgaggaacacaacacatcgaagcacttcttttctatctcaatgtcttcttcattatcgggttttgcaccttttgtttttctattgctcgtgattgggggcacggctaggcctttgtatccacttcctggcaaaggtgaccatggtactaagcagcctcttcaaacttttcgcccatataacgttgcacataggggctcaaatggagaacttcctgaagaaactcgcgaggcatatctgagagctattgaggaaggtgcagacttcattgaaacagatatattatcttccaaagatggtgttcttatatgtttccacgacgttactcttgataatactactgacatagcaaaatacaaagagtttactgatcgtaaaagaacatatgaagtcgaaggggtcaatatcactggattttttgtcgttgatttcacattaaaggaattaaagtcgctgagggtgaatcagaggtactgctttagggatcaacagtttaacggaaaatttcaaataatcacttttgaagagttcattaccatagcattggatgcacccagagtagttggaatatatcctgagataaaaaatccagtacttatcaatcagcatgtgaaatggtcggacggcaaaagatttgaggacaggtttgttgaaacacttcggaaatatggatacaagggttcatacctgtcaaaacattggttgaaacaacctgcatttatacagtcatttgctccaacttcacttgtgtatatatcaaatcaaacggacttgcctaagatttttttaatcgataatgttgatatttcaacacaagacactaatcagtcatattgggaaattacatctgatacatacctagactacataaagcaatatgttgtaggaattggaccttggaaggatactatagtacctgaggttaacaactatgtgatgactccttcggatcttgttgccagggcacatgctcataatctgcaggtgcatccatacacgtacagaaatgagaacaagtttttgcatttcaactttagtcaagatccttacaaggagtatgattactggatcaacaaaatgggaattgatggtctgtttacagatttcactggcagtcttcataattttcaggaatggacaacccctaaccgtcaagatgacaagactgcatccgagctattgcataaaattgctgtgttagcatccgcttatgaataatttttgaggtgtcagattgtgtgtaaaaagcatgtgcttggattaatttattgtgttcagaagcttatatatcaacatgttcaagagaatgtttgactgaaaagctattttgtctacatactaag

SEQ ID NO: 5497 - DNA, 909 bp, Vigna unguiculata
ggatgtaagatcttataacataatgtaatgtaatgtatatgcattgcgtgcaagtgagtgctattggtggatttgcttctcccattcccaaatcatcagtttcactttggtcaacaaccatggctgtggcttctcctaactcactccgagttgcagcggcccagatgacatcggtcagcgacctcgccgccaatttcgccacctgctctcgccttgtcaaagaagcagcttcagctggagccaaattgctttgctttcccgaggccttctcttatgtgggtaccaaggatggggacagtgttagtgttgctcaaccattggatggaccaattatgaaccagtattgctctttggccagagaatccagcatttggttgtcacttggaggcttccaagagaaaggatcagatcctacccacttgtgtaatactcatgttatagtagatgagactgggaaaattagaagctcttatagaaagatacacctgtttgatgtagatgttcctggtggaagggtatataaagaaagtaaatttacagaaccaggcaaggatattgttgcagtagacagtcctattgggcgtttgggcctcagtgtatgctatgatttgagatttcctgaaatgtaccaattgttacgtttccaacatgaagctcaggtactgttggtaccttcagcattcactaaagttacaggtgctgcacactgggagattctccttcgtgcccgtgcaattgagactcaatgttatgtcattgctgctgctcaaactggcaaacatggtgataaaagagaaagccatggtgacacattaattatcgatccatgggggacaattgttggtcgattaccagatcgtttgtctacagggattgtagtagctgatatcgatttatcacttgttgatt

SEQ ID NO: 5498 - DNA, 1392 bp, Glycine max
aatacattttccatccctataaaatttgtctgaaatcctgagtcaacacatgatggttggttgatgtaatgtgatgttttgtgtgtcagtgggtgtgaattttattggtggattcgcattcgcctctggaattcccaaatcatcagtttcagcgaccatggcttccaactccgtccgagttgccgccgctcagatgacatccatcagcgacctcgctgccaatttggccacttgctctcgtctcatcaaagaagcagcatcagctggagccaaattgctttgctttccggaggccttttcttacgtgggtactaaggatggcgacagtgttcgtgttgctgaaccattggatggaccaattatgagccactactgctctttggccagagaatccagcatttggttgtcacttggaggcttccaagaaaaaggatccgatcctcaacgcttgtctaatactcatgttatcgtagatgacaccggaaaaattataagctcttatagtaagatacacctgtttgatgtagatgttccgggtggaagggtatacaaagaaagtagttttacagaatcaggcaaggatattgttgcagtagacagtcctgttgggcgtttgggcctcagtgtttgctatgatttgagatttccagagatgtaccaattgctgcgtttccaacatgaagcacaggtactactggtgcctgcagcattcacaacagtaacaggtgaagcacactgggagattcttcttcgtgcccgtgcaattgagactcaatgctatgtcattgctgctgcgcaagctggcaaacataatgataaaagagaaagctacggtgacacattaattatcgatccatgggggacaattgtaggtcgattaccagatcgtttgtctacaggcattgtagtagctgatattgatttatcatttgttgattcagttagggagaaaatgccaattgctaagcaaaggaaaccaattggcttctggaaagctgcatctctataggtcttaattggaccagtcaagaagcggtagcttatttaaatatgggatttctttgtaccaaaagaaaaatgagacttccatattagattccctttaggatggtatctataattatgaatttcagtcttcatggcaataagaactgtcttatcttgtactcatgtgtgcatgctccatgttctgtgtgctgcaagttccacagaatcaagtattattttctacaagttgaggttagattcattgcatcctagtttcctttttgtgcatagcctatcggtgtttaatcttgatgaagggaattattctatactaaattttttacgcttggaaatttgtcaaattataggttaataaaaaataaaaggagcaaaaattaacttaac

SEQ ID NO: 5499 - DNA, 1304 bp, Glycine max
cctgagtcaacacatgatggttggttgatgtaatgtgatgttttgtgtgtcagtgggtgtgaattttattggtggattcgcattcgcctctggaattcccaaatcatcagtttcagcgaccatggcttccaactccgtccgagttgccgccgctcagatgacatccatcagcgacctcgctgccaatttggccacttgctctcgtctcatcaaagaagcagcatcagctggagccaaattgctttgctttccggaggccttttcttacgtgggtactaaggatggcgacagtgttcgtgttgctgaaccattggatggaccaattatgagccactactgctctttggccagagaatccagcatttggttgtcacttggaggcttccaagaaaaaggatccgatcctcaacgcttgtctaatactcatgttatcgtagatgacaccggaaaaattataagctcttatagtaagatacacctgtttgatgtagatgttccgggtggaagggtatacaaagaaagtagttttacagaatcaggcaaggatattgttgcagtagacagtcctgttgggcgtttgggcctcagtgtttgctatgatttgagatttccagagatgtaccaattgctgcgtttccaacatgaagcacaggtactactggtgcctgcagcattcacaacagtaacaggtgaagcacactgggagattcttcttcgtgcccgtgcaattgagactcaatgctatgtcattgctgctgcgcaagctggcaaacataatgataaaagagaaagctacggtgacacattaattatcgatccatgggggacaattgtaggtcgattaccagatcgtttgtctacaggcattgtagtagctgatattgatttatcatttgttgattcagttagggagaaaatgccaattgctaagcaaaggaaaccaattggcttctggaaagctgcatctctataggtcttaattggaccagtcaagaagcggtagcttatttaaatatgggatttctttgtaccaaaagaaaaatgagacttccatattagattccctttaggatggtatctataattatgaatttcagtcttcatggcaataagaactgtcttatcttgtactcatgtgtgcatgctccatgttctgtgtgctgcaagttccacagaatcaagtattattttctacaagttgaggttagattcattgcatcctagtttcctttttgtgcatagcctatcggtgtttaatcttgatgaagggaattattctatactaaattttttacgcttggaaa

SEQ ID NO: 5500 - DNA, 1260 bp, Cajanus cajan
cagagtgatgttgttttgtttggttcataatgatgtaagaacgtaagatgttgtaatgttttgtgcttcggtgaatgtgactgctcccattcccaaatcatcaccactctcagtttcagccaccatgtcccctgtcagagttgcggcggctcagatgacatccatcagcgacgtcgctgccaatttcgccacttgctctcgtctcgtcaaagaagcagcatcagccggagccaaattactttgctttcccgaggccttctctttcatcagtactaacgatggggacagtgttaccgttgctgaaccattggatggaccaattatgaaccactactgctctttggccagagaatccaacatctggttgtcacttggaggcttccaagagaaagcatctgatcctcaacacttgtgtaatacccacgttatagttgatgacaccgggaaaattagaagcacttacaaaaagatacacctgtttgatgtagatgttcctggtggaagggtatataaagaaagtagatttacagaacctggcaaggatattgttgctgtagacagtcctattgggcgtttgggcctcagtgtatgttatgatttgagatttccagagatgtaccagttgttacgtttcaaacatgaagcacagatattattggtgccttcagcattcactaatgtgacaggtgaagcacattgggagatacttcttcgtgctcgagcaattgagactcagtgctatgtcgttgctgctgcacaagctggcaaacataatcataaaagagaaagctatggtgacacattgattgtcgacccttggggaacagttgttggtcgattaccagatcgtttgtctacaggcattgtggtagctgatattgatttatcatatgttgattcagtaagagagaaaatgccaattgcccagcaaaggaagccaattgacttctggaaaagtgcatcactgtagtttctatttggaccagtcaagaaggggtagcttatttaaatatgtgatttctatgtaccaaaagaaatgtatgttccatgttagattccctcaaggatagtatctacaattatgaatttcggtcttcatggtaataaatcctgtcatatctcctactcatttgtgcatgctccatgttatgtgtgttgcaagttccacgggatcaagaattattttccaaaagttgtggttagattcattgcatcctatctttcttgtgcatagcctatcagtgtttaattgagttaaag

SEQ ID NO: 5501 - DNA, 1819 bp, Cicer arietinum
gtttttgaatcgttagattcggagtttcatagctccagtttttgcattcttcaacaaaacgttatttaagctccaatcgataagttaccaacgatccttaaagtgactcatccttaaagtgactcatgacatctttttgtttgttcactttcttaacacagtgcttgattgatattgcagtaatcttgttattatacacaagcaggcattgcagttacaatgttacagttccatctcttttgatgcaatatgtataacacaactcttgaacgcattctacacaaggcaaattgttttatctgtgcaaacatttgatcagacggctcttaatggtctattgcgttacgtccatctttatgtcaaatagtcatttcaccaactaaaaacaaaaggaagaagatgcaatctatgtatggaaaatatttgtgaaattttagaagaaaataccaaaagttttattaaaatataataatatgtgttcagtgaatgagattattaaaatcaatactactaaaattccttcgtctattcatcgaccattattattagcgtcacgccagcgtcatcgattgcgagtctctatctccggcgccggcgagtcaaccatgtctactaactcagtccgagttgccgcggctcaaatgacatccatcaccgatctcgcctccaatttcgctacctgctctcgtcttgttaaagaagcagcatcagctggagcaaaattgctttgttttccggaagcattctcttttgtgggtactaaggatggtgacagtgttagaattgcacaacctttggatggaccaattatggatcaatactgctctttagccagagagtcaagcatttggttgtcacttggaggcttccaagaaaaaggatctgatccacaacacttgtttaatacccatgttattgtagatgatgctgggaaaattcaaagcacttacagaaaaatacacctatttgatgtagatgttcctggtggaagggtatataaagaaagtagttttacagaagaaggcaaggatgttgttgcagtagatagtcctattgggcgtttgggccttagtgtttgctatgatttgagatttccagagatttatcaattgttacgtttccaacatggagcgcagatactattggtacctgcagcattcactaaagtgactggtgaagcacattgggagattcttcttcgtgctcgtgcaatcgagaatcaatgctatgtcatagctgctgcacaagctggcacacacaatgacaaaagagaaagctatggtgacacattaattattgatccgtgggggaccatcgttagtcgcttaccagatcgtttgtctacaggaattgtggtagctgatattgatttatcgttagttgattcagtaagagagaagatgcctattgctaagcaaaggaagccatttgacttctggaaagcagcatctctatagtactgatttggcaaacagtcacaaagaggcagtctttttcaacatgcgacttgtttgtaccaaaacaaaaatatgggactcccttatttgattatcctgaggaccgtgtctctaattatgaatttggttcatttttgttgtatatttattataaattgtactgaataagattattatagtatgtactggcttttgtattaaaatcatttgtgcatactccatttaatgggggtgttacaagctctatttgaccaattgtattcaacttcattatgcgagtagcctattgctgtttagtattgttgaggggtattatactatcctaaaatttgtataataattgattaataagaaaaacagtg

SEQ ID NO: 5502 - DNA, 1196 bp, Medicago truncatula
atgcaatgtaacatgatgcgattgtcgtcatgttgggtgaataataatattagaatcaataacactaacggtacttccattcgccgccgattacgagcctctctctccgtcaccaccggcgagtcaaccatggccactaattcagtccgagttgccgcagctcaaatgacatccatcaccgacctcgcttccaatttctccacctgctctcgtcttgtgaaagaagctgcatcagctggagcaaaattgctttgttttcctgaagcattctcttttgtgggtgctaaggatggtgatagtgttagtattgctcaacctttggatggacctattatggaccaatactgctctttagccagagagtcaagtatttggttgtcacttggtggctttcaagaaaaaggatctgatcctcgacatttgtttaatacacatgttgttgtagatgacactgggaaaattcaaaccacttatagaaaaatacacctgtttgatgtggatgttcctggtggaagggtatataaagaaagtaattttacagaatcaggcaaggatattgttgcagtagacagtcctattgggcgtttgggccttagtgtttgctatgatttgagatttcctgagctttatcagttgttgcgtttccaacatggagcacagatactattggtgcctgcagcattcactaaagtgactggtgaagcacactgggagattcttcttcgtgctcgtgcaatcgagaatcaatgctatgtcatagctgctgcgcaagctggcacacacaatgacaaaagagaaagttatggtgacacattgattatcgatccatgggggaccgttgttggtcgcttaccagatcgtttgtccacgggaattgtggtagctgatattgatttatcattagttgattcagtaagagagaagatgcctattgctaagcaaaggaagccatttgacttctggaaagctgcttctctatagtcacaaaggggtagtctatttcaatatgagatgtgtatgtaccaaaataaaaaatatgggactcccttatttgattatcctgaggatggtgtatacaatgttggctgtgtatttttataaactgtaatgtttaagattattgcagttcttgaaaacatgtattgtcttttatcttcaagtcaattgtgcctgctccatgttaaagggtgttacaa

SEQ ID NO: 5503 - DNA, 1153 bp, Glycine max
gtgaatgttattggtctctggaattcccaaatcatcagagtgagtttcagcgagcatggcttccaacctcgctgcgaatatggccacttgctctcatctcctcaaagaagcagcatctgctggagccaaattgctttgctttcctgaggccttctcttacgtgggcactatggatggggacagcgttcttgttgctgaaccattggatggacctattatgaaccactactgctctttggccagagaatccgacatttggttgtcacttggaggcttccaagagattggatccgatcctcaacacttgtgtaatactcatgttatcgtagatgacaccggcaaaattataagctcttatagaaagatacacctgtttgacgtagatgttcctggtggaagggtatacaaagaaagtagttttacagaatcaggtagggatattgttgcagtagacagtcctattggacgtttgggcctcagtgtttgctatgatttgagatttccagagatgtaccaattgctacgtttccaacatgaagcacaggtactactggtgcctgcagcattcacaacagtaactggtgaagcacattgggagattcttcttcgtgcccgtgtaattgagactcaatgctatgtcattgctgctgcgcaagctggcaaacataacgataaaagagaaagctatggcaacacattaattatcgatccatgggggacaattgtaggacgattaccagatcgtttgtctacaggcattgtagtagctgatattgatttatcatttgttgattcagttagagagaaaatgccaattgctaagcaaagaaagccaattgacttctggaaagctgcatctctatagttcttatttggaccagtcaagaagggggtagcttatttaaatatggaatttctatgtaccaaaagtaaaatatgggacttccatattagattccctttaggatggtatctacaattatgaatttcagtcttcatggtaataagtactgtcttatcttctactcatttgtgcatgctccatgttatgtgtgctgcaagttccacagaatcaagtatcattttccacaaattgaggttagattcattgcatccaattttcttttttgtgcatagcgtatcgatgtttaat

SEQ ID NO: 5504 - DNA, 1220 bp, Trigonella foenum-graecum
cggccgggggaatagtataatcaacaacattaacattaacactacttctattcccttattattattatcatcgtcactccaacgccgcggattccgagcttctctctccgtcgccggcgattcaaccatggcggttaactcagtccgagttgccgcagctcaaatgacatccgtaaccgacctcgcttccaatttcaccacctgctctcgtcttgtcaaggaagctgcatcagctggagcaaaattgctttgctttcctgaagcattctcttttgtgggtgctaaggatggtgatagtgttagaattgcacaacctttggatggacctattatggaccaatactgctctttagccagagagtcgagcatttggttgtcacttggaggcttccaagaaaaaggatctgatccacaacacttgtttaatacacatgttgttgtagaccacactggaaaaattcaaagcacttacagaaaaatacacctgtttgatgtagatgttcctggtggaagggtatataaagaaagtagttttacagaatcaggcaaggatattgttgcagtagacagtcctattgggcgtttgggccttagtgtttgctatgatttgagatttccagagatttaccagttgttgcgtttccaacatggagcacagatactattggtgcccgcagcattcactaaagtgactggtgaagcacattgggagattcttcttcgtgctcgtgcaattgagaatcaatgctatgtcatagctgctgcacaaactggcacacataatgacaaaagagaaagctatggtgacacattgattattgatccatgggggaccattgttggtcgcttaccagatcgtttgtccacgggaattgttgtagctgatattgatttatcattagttgattcagtaagagagaaaatgcctattgctaagcaaaggaaaccatttgacttctggaaagctgcatctctatagtacttatttggaccaattcaatattcacaaaggggtagcctatttcaatattggagttgtatgtaccaaaataaaaatatgggactcctttatttgattatcctgaggatggtgtatacaatgttggctgtgtattattataaattgttaaacattattggaagacaatgttttatttaattacaactcttatatttgaacactccaaaatttcatacattcagtcagcacctttatttcc

SEQ ID NO: 5505 - DNA, 1197 bp, Vigna unguiculata
ataataaatcgtgagtaaggaagcagagggttttgtctaaaaaagcgtgcagacggaagggaagaagatgaaggccatagtgattacgagtccgggaggtcctgaagtgctgcagcttcaagaagttgaagatccccaactccgagatgacgaggttctcatcggagtccacgctactgcccttaacagagccgataccctccagaggaagggcttccaccctccccctaagggtgctagtccctacctgggtcttgaatgttccggaacagtcctatccatcggtaaaaacgtttccaagtggaaaatcggcgatcaggtctgtgctcttctcgccggaggaggttatgccgagaaagttgctgttccctccgggcaagtgcttccgattccaccaggtgtttccctcacggatgcagctagttttcctgaggttgcatgcactgtgtggtctactattttcatgacgagtcgtttatctcaaggggaaaccctgttgattcatggaggttctagtgggattggtacatttgcaattcagatagctaagtatcgaggggcaagagtatatgtcactgcagggagtgaggagaagctagctttttgcaagagtattggagctgatgtggctatcaattacaaaacagaagactttgttgcgagggtaaaggaggaaactggtggacaaggtgttgatgtcattctcgattgtatgggagcatcctactatcaaagaaatattgatagcttgaatttggatggaaggctttttattattggctttcaaggtggagttactactgaagtagatttccgccctttacttgctaagcgtctcacagtacaagcggctggcttgcgtaatagaagtctcgaaaataaagccgtgattattagcgaagtggagaagaacgtttggcctgccattgccgaaggaaaggttaagcctgtggtctacaaatctttccctcttgcggaggctgctgaagctcatctgcttatggaaagcagcgagcatattgggaagatattgcttgtgccatgatcgttgtcataaataatgtagttcatgttatatatttgaatcctatgtttggacttttttgtgatgatctcaggtttctaataagtatttgaatttcttatcatgtatgaagttcattttgatacgtggagcgttccaaatactttgaagtt

SEQ ID NO: 5506 - DNA, 1241 bp, Glycine max
gcagagactagagagatagaattagaattaaaaagcgtgaaggacagtgataggtttggtttggaaggaagaagaaaatgaaggccatagtgataacgaggccaggaggtcccgaagtgctccaacttgaggaagtggaagatccccaagtcggagacgacgagcttctcatcggagtccacgccacttcccttaacagagccgatacctttcagaggaaaggctcctaccctccccctaagggcgccagcccttacctcggtctcgaatgttccggaactgtcctttccctgggtaaaaacgtttccagctggaaaatcggtgatcaggtgtgtgctcttctcgccggaggcggatatgccgagaaagttgcagttccggtaggacaagttcttccggttccagccggtgtttctctcacggatgcagctagttttcctgaggttgcttgcactgtctggtcaactgttttcatgatgagtcgcttatctcaaggggaaaccttgttggttcatggaggttccagtgggattggtacatttgcaattcagatagccaagtatcgagggtcacgagtgtttgttactgcaggaagtgaggagaagctagctttttgcaagagtatcggagctgatgtgggcatcaattataaaacagaagactttgttgcgcgggtaaaggaagaaactggtggccaaggtgttgatgttattcttgattgtatgggagcatcctactatcaaagaaatcttgatagcttgaattttgatggaaggctttttattattggctttcaaggtggggttagtacacaagcagatctacgccctttacttgctaagcgtctcacagtacaaggagctggcttacgcaatagaagtctggaaaataaagctgtgattgttagtgaagtggagaagaatgtttggcctgcaattgccgaaggaaaggttaagcctgtggtctacaaatctttcccgctttctgaggcagcggaggctcaccagcttatggaaagcagccagcatattgggaagatattgcttttgccatgaaaattgtcgtaaatactgaagttcgtgacatacttctggatcctttgtgtttggacttgtttctttgttaagatctcaggattctaatatggttgcggattaaaataacagctaaaggaattgatatggcaagttcatttaaacaatcacaccgtatttatcaattgatatgattgttgaaacaaa

SEQ ID NO: 5507 - DNA, 1431 bp, Glycine max
gaaccgctaaacagaaatatattttagaaaagagaaaaaagaaagaaagatggaagacgcaagtgaggtttattaggggaagcgtggctagcagagactagagagatagaattagaattaaaaagcgtgaaggacagtgataggtttggtttggaaggaagaagaaaatgaaggccatagtgataacgaggccaggaggtcccgaagtgctccaacttgaggaagtggaagatccccaagtcggagacgacgagcttctcatcggagtccacgccacttcccttaacagagccgatacctttcagaggaaaggctcctaccctccccctaagggcgccagcccttacctcggtctcgaatgttccggaactgtcctttccctgggtaaaaacgtttccagctggaaaatcggtgatcaggtgtgtgctcttctcgccggaggcggatatgccgagaaagttgcagttccggtaggacaagttcttccggttccagccggtgtttctctcacggatgcagctagttttcctgaggttgcttgcactgtctggtcaactgttttcatgatgagtcgcttatctcaaggggaaaccttgttggttcatggaggttccagtgggattggtacatttgcaattcagatagccaagtatcgagggtcacgagtgtttgttactgcaggaagtgaggagaagctagctttttgcaagagtatcggagctgatgtgggcatcaattataaaacagaagactttgttgcgcgggtaaaggaagaaactggtggccaaggtgttgatgttattcttgattgtatgggagcatcctactatcaaagaaatcttgatagcttgaattttgatggaaggctttttattattggctttcaaggtggggttagtacacaagcagatctacgccctttacttgctaagcgtctcacagtacaaggagctggtttacgcaatagaagtctggaaaataaagctgtgattgttagtgaagtggagaagaatgtttggcctgcaattgccgaaggaaaggttaagcctgtggtctacaaatctttcccgctttctgaggcagcggaggctcaccagcttatggaaagcagccagcatattgggaagatattgcttttgccatgaaaattgtcgtaaatactgaagttcgtgacatacttctggatcctttgtgtttggacttgtttctttgttaagatctcaggattctaatatggttgcggattaaaataacagctaaaggaattgatatggcaagttcatttaaacaatcacaccgtatttatcaattgatatgattgttgaaacaaacactttttcgcgtctcttctttgtggcttttgcaagcgactgattttaggaaaattgaatattttaactttccaagtaaatacaataagaatctctagat

SEQ ID NO: 5508 - DNA, 1367 bp, Cicer arietinum
caagtttcatttgcgtgtaagaatggaaggtcgcaatatagtgacttaaattgtaccatttcacaatcacgacacactcctacaaagaggtgattattgttttgctctgagagtgtgtttcagagagataaaagaagcaaagtggtgaaacaagcaacagtgccacaattcaaagaagaagaaaaaagatgaaagctattgtaataacgacaccaggtggacctgaagtgttacaactgcaagaggttgaagaccctcaactcagagacgatgaagttctcatccgagtccatgctactgcccttaacagagccgatacccttcagaggaaaggctcttaccctccccctaaaggtgctagcccttacccaggtcttgaatgttctggaactattgaatcccttggtaaaaacgtttccaagtggaaaattggcgatcaggtatgtgctcttctagctggaggtggatatgctgagaaagtagctgttcctgagggacaagttcttccagttccaccaggggtttctctgaaggatgctactagttttcctgaggttgcatgtactgtatggtcaactatttttatgatgagccggttatctcatggggaaaccttgttgattcatggaggttcaagtggaattggtacatttgcaattcagatagctaagtaccgaggatcaagagtatttgttaccgcaggtagtgaggagaaactagctttttgcaagagtattggagctgatgttggtatcaattacaaaaccgaggactttgttgcaagagtaaaggaagaaactggtggtcaaggtgttgatgttattcttgattgtatgggagcatcgtactatcaaagaaatcttgatagcttaaattttgatggaaggctttttattattggctttcaagggggtgtttctaccgaggtagatctacgtgctttacttggcaagcgtctcactgtacaaggggctggcttgcgtagtagaagtccagaaaataaagctttgatcgttgatgaagtggcgaagaatgtttggcctgcaattgcggaaggaaaggttaagcctgtggtctacaaatctttccctctttctgaagctgcagaggctcaccggcttatggagagcagtcagcatattgggaagatattgcttctgccatgaaaaccgtggcaaatactcgaagtacacgacacaacgtactgtttgatcatttgagtttggacttttgtgtgttgtgacctcaggattaaataaagttgtggtttactattatagctaaatgttttatgaattgtgtactggtgatatcatattttaacttctttaatgctttaatgaaaacatggtgcatggttatacaac

SEQ ID NO: 5509 - DNA, 1319 bp, Cajanus cajan
gacaaaataaaaggaggtggttgtctgaatcggaagcgaagtgaagagcggaaatgaaggccattgtgataagcagtccggggggtcccgaagtgctgcagcttcgagaagttgaagatccccaactccgagacgacgaggttctcatccaagtccacgccacagcccttaacagagccgacacctttcagaggaaaggctcctattctccccctaagggcgccagcccttacctaggtctcgaatgttctggaactgtcctatctgttggtcttcatgtttccagatggaaaatcggcgatcaggtctgtgctcttctcgccggaggaggatatgcccagaaagttgccgttcccgccgtccaactacttcctcttcctcccggtctttccctcaccgatgctgctacttttcctgaggtcgcctgtactgtatggtctactgttttcatgaccagtcgcttatctcaaggggaatctttcttgattcatggaggttccagtggaatcggtacatttgcaattcagatagccaagtatcgaggagctcgagtgtttgtgactgcaggaagtgaggagaagctggctttttgcaagagtatcggggctgatgtgtgcatcaattacaaaacacaagactttgttgagagggtaaaggaagaaacgggtggtcaaggtgttgatgttattcttgattgtatgggagcttcctactatcaaagaaatcttgatagcttgaattttgatggaaggctttttattattggctttcaaggtggggttactacacaagtagatctccgccctttacttgccaagcgccttacagtacaaggggctgccctacgtagtagaagtgttgaaaataaagccgtgattgttagtgaagtggaaaagaatgtttggcctgcaattgccgaaggaaaggttaagcctgtgatctataaatctttccctctttccgaggcagcggaggctcaccggcttatggaaagcagccagcatattggaaagatattgcttgtgccatgaacattgtgataaatactgaagttcgtgacatacatttggatcctatgtgtttggacatctttgtttattacgatctcaggtttgtaataaggttgcgtgcggtttaaaattacagctaaggaattgatatggcatgcaacaatcatatcgtatgtggcaaattggcaattgatatgacaagaagtgaattgttgaaagaaactctttttcgatctccttttggcttttggatggtgtcgtcaattgagccaaccccgaaaggcacactatattatcacttgattacaa

SEQ ID NO: 5510 - DNA, 1308 bp, Arachis hypogaea
agccgtgtcctcaagaaatttctactgactttgattgctgtgagtggaacaaagaaatgaaggctgtagtgataaccactcccggtggccctgaagtgctgcagctccaagaagtggaggaccctcatatcggagacgatgaagttctaattagagttgaagccactgcacttaacagagctgataccctacagaggaagggttcctaccctccacccaaaggtgccagcccttaccctggacttgagtgttccggaaccatcgaatccatcggcaaaaacgtttccaggtggaaagtcggcgaccaggtttgtgctcttcttgccggaggaggatatgctgagaaagttgccgtaccagctggacaagttcttccggttcctcctgggatttctctaaaggatgctgctagttttcctgaagtgtcatgcactgtgtggtcaactgtttttatgatgagtcgattgtcgaaaggagaaactttcttgattcatggaggttccagtggaattggcacatttgcaattcagatagctaaataccgaggagcaagagtatttgtcactgcaggtagtgaggagaaactagctttttgcaaggatattggagctgatgtatgcatcaattacaaaacggaggactttgttgcaagggtaaaggaagaaactggtggtcaaggtgtggatgttattcttgattgtatgggagcatcctactatcaaagaaatctcgatagcttaaattttgatggaaggcttttcatcattggctttcaaggaggcacttcaacacaaacagatctgcgcactttatttgctaagcgtcttactgtacaaggggccggcttgcgaaatagaagcattgaaaataaagctgtgattgttagtgaagtggagaagaatgtttggcctgcaattgcagaaggaaaggtaaagcctgtggtctacaaacacttccctctctctgaggcggcggaggcacaccgcctcatggaaagcagccagcacattggaaagatattgcttgttccatgaacttctttgtactgtactactgaatcaatgtgcatgacaacatggcatggatcatttgactttggttgatctttatgttatatgtatgattatgaactcaagaacctataaagctgtgaataaagggaaaccatgttcttagttgtgtattaggggttgccaaaaggcaccaagaaaatgaatgtttcattgtaagactgaagccaatatccaagttgaagtctttgagacaaaaaaaagaaaaaaaacaaaagtactctgcgttgataccact

SEQ ID NO: 5511 - DNA, 4222 bp, Lupinus angustifolius
atcaacgaatacatggaaaccctagcaccagtgagtgagagtgagagagagagaggcgaagatgaagttcaacccacgtgtctcaagcagccgccgcaagagccgtaaggctcacttcaccgccccctccagcgtgcggcgcgtgctattaagcgctcctctctcccacgaccttcgctcaaagtacaacgttcgctccttgccggtgaggaaagaagacgaagttcaggtcgtaagaggcactttcaagggtcgcgagggcaaagtcgtccaagtctaccgtcgcaaatgggttatccacatcgagcgtatcactcgtgagaaggttaatggcacaaccgtaaatgttggtgttcatccttccaaggttgtgatcacgaagattcgtctcgataaggatcgcaaatcgcttcttgatcgtaaagcgaagggtcgcgccactgctgacaaggagaagggtactaagttcgctcctgaggatattatgcaaactattgattaggtttctatttactaataaacatattcagacatgattttaaagtcttgtaattttggatctttaactattttattttgttatggtttaatcttaattacattatctgttgctcaatgcatgcttcaactgtatgcaattattgttatttagctgttttgtgatgttttaagttgttattgtgatttgatatatatatatgcatagttaattagcatcttgttatttcaatttgtctcagaattttgtttaggtgttgtgtctagaagtgtttgtacagtggtgtggatgatgagattaacaattctacagttatccctggctgattttgcagtgatgataatttgtaatctgacacacactgttaggtttaacttacatgttatatagtgtagtttgatttgtgatatatcttaaatgattagtgtttagtttgtgttagaagggtctttagttaatatgtaatgttgtttagatttgtttgcgcagtggtgtggatgatgagattattaattttacagttatccctggctgatatatcaggtgatgaaattttgcaatccgacgcacactgttatgttcccttaaaatttatgccttgtggttttggattggattaggttccttttaatggagattatatgttttgatctagtgttactttgtctaactttactttttgtagtgcatttgaagtttaatgttttttacataagatacagaggtgatgttctctttctaagtcactgtacattttgtatgactttttttagattagattatattctgtctagttatgtcacaattttcagtttggctcaatagttctctatatgagatgttgaagtttagatctatgtacacatagctgtggatgatgatattgccaattttacagttatccctggctgatatagcagatgctgaaaatttgtaatctgacaccaattgttaggttccatacaagttatagcttagtttattcactgtgttcagtttgtctcactaggtttttcaatttagaagttgagctgtttatatctgtttgcccactgttgtggatgatgagattatcaattttacagttatccctggctgatattgcaggtgctgaaaatttgtgatttgacacacggttaagttttatgtaagctataacatataacgcaaatgcattgccttatgttcttgatttcattcctcttgtatttttaacaaagtcatagttggcttttgtttgaacatgattttgtaaactacgattctaatggaagtgtaaaaagttgattttaatgtgttaatctgtgttttgtaaaattcaatcgaaacttgtttagagttggggtctttttggacaatgtatgtgccatttaaacctgagattttcacgttgcaacatcacaaaatgtggacatgtcacactgtctatcaggtaatgaatgttaccagcatccatcaggaattttttttatccggagttaaatgataacttcagttattaatttatcattttttgaacaatatagctttcaaacctgcagtctattaggcagaatatgtaatattaataacattcaaggttctccccagaagttaacaatgtcttcattttgaagtcgtcatgagattcccattctcttgtggaagatgttgcaatggaggttgtggaaatcgaaagtaaattttgtaacgaatttgcccaggtttcatgattttcttctgtgtgtttgatcttaaattctcaggctggactaatgtacatggtggctttctcatgaaatactggggtaaacctacaagggggcgagtgcttcataatgttaattctgactctgatgtgtacttattctgttactcaatgattggaccttcattcgattgtttgcttcattggcataaatgatgagggcgtagaagcaagaaaatgatgtaagcacaaaaaaagatggtaaagtaaaaattaatagaaatgaataaatctaaaacattaatggaataatttgttgtgctattagcgggttaagatccaagctagtcaatattatatactacatagattagttagggagaagagtaaggtgtaagaggttgccaccgaggtcctgtgacatgagggtaaagaataaagaattccaatcatattaatagttgtcaagttttctctaaaatgaattattttcagaacaattttagctatctcacccactacaattcatcttgcggcaattgaggtaccaactacagttttaaaaaaatgggatggaatcttcttggtcctaaaataagtgtattttgaaaataattaaaggtgcattattgtcttcttgttcgtctcacagagagagagagtttagaattgagaaagcagaaccagaaatgaaagccatagtgataaccaaaccaggtggtccagaagtgttgcagcttcaagaagtagaagaccctcaaatcaaagatgatgaggttctcataagagttgaagccactgctcttaaccgagctgatactgttcaaaggaaaggctcataccctacccctaaaggtgcaagcccataccctggacttgagtgttccggaactattgaatccgttggcaaaaacgtttctaggtggaaaattggcgatcaggtgtgtgctcttctatctggaggaggatatgctgagaaagttgctgctcctgctggacaagttcttccggttcctcctggcctttctttgaaggatgcagctagttttcctgaggtggcatgcaccgtctggtctactatttttatgaccagccggctatctgccggagaaactttgctgattcatggaggttccagtggaattggtacatttgcaattcagatagcgaagtaccgaggatcaagagtatttgttactgcaggtaatgaagagaaacttgctttttgcaagggtattggtgctgatgtgggcatcaattacaaaacagaggactttgttgcaagggtgaaggaagaaactggtggtcaaggtgttgatgttattcttgattgtatgggagcatcctactatcaaaaaaatctcgagagcttaaatttcgatggaagactttttattatcggctttcaaggcggagtttccacagaatttgatctccgacctttagttggtaaacgtcttacagtacaaggggctggcttgcgtaatagaagtcctgaaaataaagctttgatcatcaatgaagtggagaagaatgtttggcctgcaattgcagaaggtaaggttaagccggtggtctacaaatctttccctctttccgaagccgcggagggtcaccgccttatggaaagcaatcagcatattgggaagatactgcttttcccatgaacaccatcttactatgatatggatcctttgagtttggacatctcttttatgatatcatctctggatcctataataaagctgtaatttacaattgcagagaaatatattatgttatcttatgtaaaacaatcttttatatatgagaacaagactgcgtacatttatcttttctaagatcctattagatgggagactctgccttttatctagtgtacatggtgtcctagctaggagggtatgcttaagcttctttttattgtaatttggtttgacattgtttctctatctttcactacttacttgaaccttaaagtggctttatttgggagcaaaattagggaatggaattgtagctttgaaagaatgaag

SEQ ID NO: 5512 - DNA, 1449 bp, Trigonella foenum-graecum
cggccgggggttttcacagctctgctaataataactgaaggttgcaagtactctctttcacaggtgtgagagagaaagagagaagagaacgaaagtggtggaaaaatcaaccaaacacttccacagaaacaaaaaataatgaaggctattgtaataaccacaccaggtggacctgaagttctacagcttcaagaagtagaagaccctcaattcaaagacgatgaagtactcatcagagtccatgccactgcccttaacagagctgatacccttcaaaggaaaggcgcttaccctcctcctcaaggtgctagcccttatccaggtcttgaatgttctggaattgttgaatccgttggtaaaaacgtttccaagtggaaaattggtgatcaggtatgtgctcttctatctggaggtggatatgctgagaaagtagctgttgctgagggacaagttcttccagttccacccgggatttctctgaaggatgcagctagttttcccgaggttgcatgtactgtgtggtcaactatttttatgacaagccggctgtctaagggcgaaaccttgttgattcatggaggttcaagtggaatcggaacatttgcaattcagatagctaagtacctaggatcaagagtatttgttactgcaggtagtgaggagaagctagctttttgcaagaggattggagctgatgttggtatcaattacaaaacagaggactttgtggcaagggtaaaggaagaaactggcggacaaggtgttgatgttattcttgattgtatgggagcatcgtactatcaaagaaatcttgatagcttaaattttgatggaaggctttttattatcggctttcaagggggtgtttctacggaggtagatctacgtgctttatttggcaagcgtctcactgtacaaggggctggcttgcgtagtagaagtcctgaaaataaagctgtgattgttgcagaagtggagaagaatgtttggcctgcaattgcagaaggaaaggttaagcctgtggtctacaagtcattccctctttctgaagctgcggaggctcaccgtcttatggaaagcagtcagcatattggaaagatattgcttgtgccatgaaaaccgtggtaaatactcgatggatgtacacaacacaacatacttttggataatttgagtttagacctttgtgtgttctgacctctcttgaataaagttgtggtttacaaatgcgttattaattgtgtactagtagggactatatttgaacttatttctcttgttttggttttcttagttgtttatctatctttcattacttacttgaaacttgaatgcttttggtagcaaattgtgagagaaaaagaatgaaattggaaagtagaagttcatatactgtgcagatatatgattgaattgggaagaataaaaatgggaaacatatcatttccc

SEQ ID NO: 5513 - DNA, 1401 bp, Lotus japonicus
cggtctactggacaaacaagtgtttgtatatgaaggaaaggagtcgtgtccgtgacaaacaaagttggaaaaatgaaggctgtagtgataaccacaccgggaggcccccaagtgctgcagctccaagacgtggaagacccccacctcggcgacggcgaagtccttatcagagtccacgccaccgcccttaacagagccgatacccttcaaaggaaaggcgcttaccctccccctaaaggtgcaagctcctacccaggtcttgagtgctccggcaccgttgaatccatcggcaaacacgtttcccggtggaaaatcggcgatcaggtttgtgctcttcttgctggaggtggatatgctgagaaagttgctgttcctcaggaacagattcttccggttccgcctggggtttctttgacggatgcagctagtttccctgaggttgcatgcactgtgtggtctactattttcatgatgagtcgcctcactcaaggagaaaccttgttgattcatggaggttccagtggaattggtacatttgcaattcagattgccaagtatcgcggagcaagagtatttgtcactgcaggtagtgaggagaaactagctttttgtaaaggtataggagctgatgtgggtatcaactacaaaactgaggactttgttgcgagggtaaaggaagaaactggtggtcaaggtgttgatgttattcttgattgtatgggagcatcctactataaaagaaatcttgatagcttaaactttgatggaaggctttttattattggctttcaaggggggacttctaccgaagtagatctccggcctttagttgccaagcgtcttactgtacaaggggctggcttgcgtaacagaagtattgaaaataaagctgtgatagttactgaagtggagaagaacgtttggcctgcaattgcagaaggaaaggttaagcctgtgatctacaaatctttcccactttctgaagcagctgaggctcaccagcttatggaaagcagccatcatattgggaagatattgcttttgacatgaaaactatcctaaatacccaagtacatgacatgtttctggatcatttgagtctgtccatgtgtcatgaccacagttctctaataagaagtatgttattatgtactagagatccaagccgtgtatactgtatacttaatcttctttttgttttggtttgactgagattgtctttcactgcttgtttaaaacttgaatttgctttgtttgggagtgaattgagggagcagaatcaaagaatgaaaaatgaaaggtagaatttcaaatgtttcttagatgtgaatcaatcgggaagaataaaaatgcaaaaaaatgtcatttgggacagtaacagagggttgtattttgcttcta

SEQ ID NO: 5514 - DNA, 1353 bp, Lupinus angustifolius
agagtttggacataggagtcgtgtcgctgacaaagtgtaccaagtagtaataatagtacaacactcttctcttcacaacattattgtgttattgttcttctcacatcaacagagagagagaatcagaaatgaaggctatagtgataaccacaccaggggatcctgaagtattacagctccaacaagttgaagaccctcaaatcaacgacgatgaagttctcatcagagttgaagccaccgctcttaaccgcgccgatacccttcaaaggaaaggctcttaccctccaccaaaaggtgctagcccataccctggacttgagtgttctggaactgttgaatccgtcggcaaaaacatttctaggtggaaaattggcgatcaggtgtgtgctcttctagccggaggaggatatgctgagaaagttgctgttcctgctggacaagttcttccggttcctccggggctttctctgaaggatgcagctagttttcctgaggtggcatgcactgtgtggtctactatttttatgactagccggctatctgcgggagaaactttgttgattcatggaggttccagtggaattggtacatttgctattcagatagctaaatacctaggatcaagagtatttgttactgcaggcagtgaagagaaacttgctttttgcaagggtcttggtgctgatgtaggcatcaattacaaaacagaggacttcgttgcaagggtaaaagaagaaactggcggtcaaggtgttgatgttattcttgattgtatgggagcatcctactatcagagaaatcttgatagcttaaattttgatggaaggctttttattatcgcctttcaagggggagtttccacagaatttgatctccgtgctttattcggtaaacgtctcacagtacaaggggctggcttgcgtagtagaagtcttgaaaataaagctgcgatcgttagtgaagtggagaagaatgtttggcctgcaattgcagaaggaaaggttaagcctgtagtctacaaatctttccctctttccgaagccgcggaggctcaccgccttatggaaagcagccagcatatcgggaagatattgcttttcccatgaacaccatcttactaatgaagtacatcacagacttcacttctggatcttatgagtttgaacatctttctatgataggactttggatcctataaagctacggtttttacaattacagataaacactatgtttcaactttctttgtctatctttcactgttaaattgaaccttgaattagctttgtttgatagcaaattgagggaatggaaataaaacattgaaaaaatattacatgattaacgattaac

SEQ ID NO: 5515 - DNA, 1384 bp, Arachis hypogaea
tgattacactaggaaagaggagagccgtgtcctcaagaaatttctactgactttgattgctgtgagtggaacaaagaaatgaaggctgtagtgataaccactcccggtggccctgaagtgctgcagctccaagaagtggaggaccctcatatcggagacgatgaagttctaattagagttgaagccactgcacttaacagagctgataccgtacagaggatgggttcctaccctccacccaaaggtgccagcccttaccctggacttgagtgttccggaaccatcgaatccatcggcaaaaaggtttccaggtggaaagtcggcgaccaggtttgtgctcttcttgccggaggaggatatgctgagaaagttgccgtaccagctggacaagttcttccggttcctcctgggatttctctaaaggatgctgctagttttcctgaagtgtcatgcactgtgtggtcaactgtttttatgatgagtcgattgtcgaaaggagaaactttcttgattcatggaggttccagtggaattggcacatttgcaattcagatagctaaataccgaggagcaacagtatttgtcactgcaggtagtgaggagaaactagctttctgcaaggatatcggagctgatgtatgcatcaattacaaaacggaggactttgttgcaagggtaaaggaaaaaactggtggtcaaggtgtggatgttattcttgattgtatgggagcatcctactatcaaagaaatctcgatagcttaaattttgatggaaggcttttcatcattggctttcaaggaggcacttcaacacaaacagatctgcgcactttatttgctaagcgtcttactgtacaaggggccggcttgcgaaatagaagcgttgaaaataaagctgtgattgttagtgaagtggagaagaatgtttggcctgcaattgcagaaggaaaggtaaagcctgtggtctacaaacacttccctctctctgaggcggcggaggcacaccgcctcatggaaagcagccagcacgttggaaagatattgcttgttccatgaacttctttgtactgtactactgaatcaatgtacatgacaacatggcatggatcatttgactttggttgatctttatgttatatgtatgattatgaactcaagaacctataaagctgtgaataaagggaaaccatgttcttagttgtgtactaggggttgccaaaaggcaccaagaaaatgaatgtttcattgtaagactgaagccaatatccaagttgaagtctttgagactcggagctactcattctaatgtggttatatgtacaaggttatgctatttgatctttggatttgaattctctaaagtttgaattttactttaaagagt

SEQ ID NO: 5516 - DNA, 1281 bp, Arachis hypogaea
gaaggctgtagtgataaccactcccggtggccctgaagtgctgcagctccaagaagtggaggaccctcatatcggagacgatgaagttctaattagagttgaagccactgcacttaacagagctgataccgtacagaggatgggttcctaccctccacccaaaggtgccagcccttaccctggacttgagtgttccggaaccatcgaatccatcggcaaaaaggtttccaggtggaaagtcggcgaccaggtttgtgctcttcttgccggaggaggatatgctgagaaagttgccgtaccagctggacaagttcttccggttcctcctgggatttctctaaaggatgctgctagttttcctgaagtgtcatgcactgtgtggtcaactgtttttatgatgagtcgattgtcgaaaggagaaactttcttgattcatggaggttccagtggaattggcacatttgcaattcagatagctaaataccgaggagcaacagtatttgtcactgcaggtagtgaggagaaactagctttctgcaaggatatcggagctgatgtatgcatcaattacaaaacggaggactttgttgcaagggtaaaggaaaaaactggtggtcaaggtgtggatgttattcttgattgtatgggagcatcctactatcaaagaaatctcgatagcttaaattttgatggaaggcttttcatcattggctttcaaggaggcacttcaacacaaacagatctgcgcactttatttgctaagcgtcttactgtacaaggggccggcttgcgaaatagaagcgttgaaaataaagctgtgattgttagtgaagtggagaagaatgtttggcctgcaattgcagaaggaaaggtaaagcctgtggtctacaaacacttccctctctctgaggcggcggaggcacaccgcctcatggaaagcagccagcacgttggaaagatattgcttgttccatgaacttctttgtactgtactactgaatcaatgtacatgacaacatggcatggatcatttgactttggttgatctttatgttatatgtatgattatgaactcaagaacctataaagctgtgaataaagggaaaccatgttcttagttgtgtactaggggttgccaaaaggcaccaagaaaatgaatgtttcattgtaagactgaagccaatatccaagttgaagtctttgagactcggagctactcatttaaaaaaaaagaaaaaaaacaaaagtactctgcgttgataccactgcttcgctctatca

SEQ ID NO: 5517 - DNA, 1253 bp, Arachis hypogaea
aagcagtggtatcaacgcagagtggccattacggccggggactactgactttgattgctgtgagtggaacaaagaaatgaaggctgcagtgataaccactcccggtggccctgaagtgctgcagctccaagaagtggaggaccctcatatcggagacgatgaagttctaattagagttgaagccactgcacttaacagagctgataccgtacagaggatgggttcctaccctccacccaaaggtgccagcccttaccctggacttgagtgttccggaaccatcgaatccatcggcaaaaaggtttccaggtggaaagtcggcgaccaggtttgtgctcttcttgccggaggaggatatgctgagaaagttgccgtaccagctggacaagttcttccggttcctcctgggatttctctaaaggatgctgctagttttcctgaagtgtcatgcactgtgtggtcaactgtttttatgatgagtcgattgtcgaaaggagaaactttcttgattcatggaggttccagtggaattggcacatttgcaattcagatagctaaataccgaggagcaacagtatttgtcactgcaggtagtgaggagaaactagctttctgcaaggatatcggagctgatgtatgcatcaattacaaaacggaggactttgttgcaagggtaaaggaaaaaactggtggtcaaggtgtggatgttattcttgattgtatgggagcatcctactatcaaagaaatctcgatagcttaaattttgatggaaggcttttcatcattggctttcaaggaggcacttcaacacaaacagatctgcgcactttatttgctaagcgtcttactgtacaaggggccggcttgcgaaatagaagcattgaaaataaagctgtgattgttagtgaagtggagaagaatgtttggcctgcaattgcagaaggaaaggtaaagcctgtggtctacaaacacttccctctctctgaggcggcggaggcacaccgcctcatggaaagcagccagcacgttggaaagatattgcttgttccatgaacttctttgtactgtactactgaatcaatgtacatgacaacatggcatggatcatttgactttggttgatctttatgttatatgtatgattatgaactcaagaacctataaagctgtgaataaagggaaaccatgttcttagttgtgtactaggggttgccaaaaggcaccaagaaaatgaatgtttcattgtaagact

SEQ ID NO: 5518 - DNA, 1181 bp, Medicago truncatula
gagtgtgagagaggagaaggaaatcaaagcaacaaaaatgaaggcaattgtaataacaaaaccaggtgaacctgaagttctacaacttcaagaggttcaagaccctcaaatcaaagacgatgaagtcctcatcaaagttcacgccactgcccttaacagagctgatacccttcagaggaaaggcgcttatcctccccctcaaggtgctagcccttatccaggtcttgaatgttccggaattattgaattcgttggcaaaaacgtctccaagtggaaaattggtgatcaggtatgtgctcttctagctggaggtggatatgctgaaaaagttgctgttgctgagggacaagttcttccggttccacccgggatttctctgaaggatgcagctagttttcctgaggttgcatgtactgtgtggtcaactatttttatgacaagccggctatctaagggcgaaaccttgttgattcatggaggttcaagtggaatcggaacattcgcaattcagatagctaagtacctaggatcaagagtatttgttactgcaggaagtgaagagaagctagctttttgcaagagtattggagctgatgttggtatcaattacaaaacagaggactttgtagcaagggtaaaggaagaaactggtggacaaggtgtcgatgttattcttgattgtatgggagcatcctactatcaaagaaatcttgctagcttaaattttgatggaaggctttttattatcggctttcaaggaggtgtttctacagagctagatctacgtgctttatttggcaagcgtctcactgtacaagcggctggcttgcgaagtagaagtcctgaaaataaagctgtgatcgttgctgaagtggagaagaatgtttggcctgcaattgcagaaggtaaggttaagcctgtggtctacaaatctttccccctttctgaagctgcggaggctcaccggcttatggaaagcagtcagcatattggaaagatattgcttgtggcatgaaaacattgtaaatactgatcgatgtactcgacatgacacacttttggatgatttgagtttagaccttctgtgttctaacctctgtgttgaataaagttgtagtttacaattacatctaaatgcgttattaattgtgtactagtagggatcatattttaatttcatt

SEQ ID NO: 5519 - DNA, 1482 bp, Medicago truncatula
cactgaatgttcaaagattcaagctttcatctattgactcgttaaacaaacatctttcttgttttatacaaacaagagaaggaaagtggttgaacaattccaaagtaaaagcaaaagaaaatgaaggctattgtaataacaacaccaggtggacctgaagttctacaacttcaagaggttcaagaccctcaacctaaagacaatgaagtactcatcagagtccatgccactgcccttaacagtgccgacaccgttcagaggaaaggcttttaccctatccctcaaggtgcaagcccctatccaggtcttgaatgttccggaactattgtatgcgttggtataaacgtttccaagtggaaaattggtgatcaggtatgtgctcttctagctggaggtggttatgctgagaaagtagcagttcctgagggacaagttcttccggttccacctgggatttctctgaaggatgcagctagttttactgaggttgcatgtactgtgtggtcgactatttttatgacgagccggctatctaagggggaaaccttattggttcatggaggttcaagtggaattggaacatttgcaattcagatagctaagtaccaaggatcaaaagtatttgttactgcaggtagtgaggagaagctagctttttgcaagagtattggagctgatgttggtatcaattacaaaacagaggactttgtggcaagggtaaaggaagaaactggcggacaaggtgttgatgttattcttgattgtatgggagcatcctactatcaaagaaatcttgctagcttaaattttgatggaaggctttttattatcggatttcaaggaggtgtttctacagaggtagatctacgtgcgttatttggcaagcgtctcactgtacaagcggctggcttgcgaagtagaagtcctgaaaataaagctgtgatcgttgctgaagtggagaagaatgtttggcctgcaattgcagaaggaaaggttaagcctgtggtatacaaatcattccctctttctgaagctgcggaagctcaccggcttatggaaagcagtcagcatattggaaagatattgctcgtggcttgaaaaaccatggtaaatacttgatcaatgtttgcgacacaacatacttttgaataatttgagtttggacttgtgtgtgttctaaccttaaataaatttgtggtttacaattacatctaaatacgttattaattctgtactagggatcatattttaacttctttcttctcttcaaactctcactagctacttgaaactttaatgttctggtagaaaattgagtgagaggaaatggaagaatgaaaatgggaagtagaatttcacatattgtttagatatatcatatatgtttaaactaggacgaataaaaatgtcattttcttagttgtttgggaaaaaagctaggatcataaataaacaaaagttgcatggcaagtgcttctacgt

SEQ ID NO: 5520 - DNA, 7170 bp, Medicago truncatula
tgcatcgggtaatgttatcattgacgtggtggcaggtgtcgatgttattcttgattgtatgggagcatcctactatcaaagaaatcttgctagcttaaattttgatggaaggctttttattatcggctttcaaggaggtgtttctacagagctagatctacgtgctttatttggcaagcgtctcactgtacaagcggctggcttgcgaagtagaagtcctgaaaataaagctgtgatcgttgctgaagtggagaagaatgtttggcctgcaattgcagaaggtaaggttaagcctgtggtctacaaatctttccccctttctgaagctgcggaggctcaccggcttatggaaagcagtcagcatattggaaagatattgcttgtggcatgaaaacattgtaaatactgatcgatgtactcgacatgacacacttttggatgatttgagtttagaccttctgtgttctaacctctgtgttgaataaagttgtagtttacaattacatctaaatgcgttattaattgtgtactagtagggatcatattttaatttcattcttctgctttggtttatcttggttgtttatatatctttcactacttgaatgctttggtagcaaattgagtgagagtaaatgaaagtggttagtagaatttcgcatactgtttagacatatggtacaattgggaagaataaaaatggcattttcttagtagtttgggaatgattgattgaaaaaaccaaggatcataaaaaaactaaaatgataggtgtgcttctacacgaaccaaattgtaacaaaatctattcttcaaatgtgcacatagtcacagataaagctaaaaggaagttgattaaaatcttcatcacttactccaaatgacatttgtgaccgattaacttgtcacgtctaagaaccgaaaatcacagaagttaattaccagttaacctttgagattcaagctgaagttattgaaggaggagctagaagcctgcaaagtggaaacgaccaccaagatagggatgttcatagttgtgttcatggtttggtgttgttcataaaaaaacattttagtaaaaaagtacttgtaggactaacaccaaaaaccgatataattgtagggattgaagatcatatttaaacctatacttaaaaacaattttggtccacctatttttcttttttgtaaaaaatatatatgaagttttggtctttattaccaaaaaaaatatatatgaagttttggtctcatttttaaaatccgttttcttggttcccctaatttatttttttggcatgctgacatttgaaactatatttttgaatttgcaaggactgatcacataataacgatggatgattaatgaagtgaaactatatttaggaaaagacctctcgtaagtaaaatctgataaaaaatagttatatttaggaatgttgtcctaaacaatttgtctttaatggtacttattaaccatttgagctcaattgtttggtttgagaataagagagggaggaagtttgcatgtatggagtacttactgtgagggagagggaggaagttcttcacttgtttatttaattaattaatctgaaactcaattcaaatcagtgagagtgagaggaagatgcatgcatcttggttcaatgttgagaaatactagtatgttatgtttggttgatactagaattttttattattatttgaattgaattttctgatatgatatatccaagagtaaatagtcaatttcccctctgaaattgtaagtttcatcaattatccccttgaaattttacaacgttagtcaatttatcccctccgtcaaatttttctgttagcgaacatgacgttttgcaaataccccccctgaagttttgcacttatgtgcaaaatgcctcccaaacttaaaaatttatattatttttttcttaaaaacaaacaattaatagttaaatattaaaactaactattaattttggaatttgggaaaactacatgcatatatacatcaaaataggctctaaaatgggagaaaatatgtattttttaaagtgacaataatgggatgatttgtggattaatattgggggttgtgtagtttaaatggtttgagcaaattgttgaaagagttggaggagttaaaagactaagatggtgaaggagaaaatataaatttaaatctgattattaatttgtttataaacctctaaaaataataatttgtctattagaaataaccattattgtcactttaaaaatacatatttttccctattttgatgtatatatgtatgtagtttttccaaactccaaaattaatagttagcttaaatatttaactattaagttttgggggcattttgcacataagtgcaaaacttcaggggggtatttgcaaaacgtcatgttcactaacataaaaatttgacggaggggtaaattgactaacgttgtgaaatttcaggggggtaattgaagttttgttaatttaagaggggtaattgatgaaacttaaaatttcagggggaaattgactatttactctatacccagagagaaaacatcaattaattaaggaaaatgttaactagtgccccaccctggttaaagactttaaatggtaacttttcattaaagttgtaatcagtgcattggaaattgaaaaactttgatattttaaatgaataattacttaatttatcatgcttaaagagtgccccgggggtactcgttaatgacacccattaattaataatagaatgccaaattattgtgtttgtagagttaaatggcctcatgatataattataacctcaaaggtagaggcctcacaacttttctgatcaatgatcacaaaggcaaaatatgaaaatagagtggactaaagtcaccgattatgtatatgtcattcatataatcaattttcacccatattcctaatcaaggaagggaaaaggaaaaatatttacaagtgcgaaaaatgcctattgttataaatgtcactaccaaatgtaagtctctcgcagctgcaggtttatagaccattgaagctagaagtaacatgcaaaaaaacatcttctgtgcaaggaattgtgaggccacccattggatgatcgtatccgaattcttcctctgcccgactcagcaagtattgaaatgaagtttggttcaagtatgacgtagggatcacaaaccgcttcatttcctctccaacgtacaccgcaagatatccctttggcacatttgctactttcaatgacgtttggctgctgctaaatgtcacccttcttatagctgcaggtaaacggaagcccattctaaattaaatgcgtcaaagaacaagctaaagctctcgattaagaaaaaaaatatttatcttttgattatcgagtatgtgaatgacttgtgatggttgtgaaagaatgtagtgtatttatagtcttcaagagtttcttcaaatccatttctttgataaattattgttaaatgatgggctccacgatatcaaggatcagcaagttcaataatggtgcatatctaccccacccaaagaatgaaaagccatcagattacccttaaaagtcaaatgagatggctaggttaaacttaatgtttgatttatagacatgcattaaacatttcacatgttctcttcatattattaacacggctcaatgccgacacatagctagctaccaatccaataattctgctgtagtgtgaattctaaggtagacgatggctagttggctcataaatgttaggaggcaacgtggaacctttatcaaaggcttggtcagcagtcaaaagatagtagtacatgtttgaacccacagatagcagaaaagctgtactctgaaaattgaatttttcaatttcagtcttttgaagatagtagtccatgtgattatggtctcctctaacttcttcaaacattacaagaagaatccaacttaataattaattgttaagaactaagacgttttatcatgtcataaattcatttcatcatcttaatttaacttctactgacttgtttacaaaattctctcatgtgtctatcaagttgaaaatcattacaggttaaagaaaggtttttctgtaaagacttgtttgtttcgagttttgttgtatgtaatagacagtgtccattaaatcagtgtataacttgtgtttgtgcaatgcaagtatttcaggtgacacaaaaaacaaaagataaattcacaagaatatagttttgtacggttctcatttctgatttccactcaagaggaaacatcaaaataaacaaaagaaatttgtgatatgcacaaaagttctctcaactagttaatcctactgtgtaatgttttcgttcatatgacttttttgcagtgtggatttaattctaggccgttcaactgttcaagcagaaagttgtatgtaaaaatagccatttggggcttcctcttgtttgctagatgattgacttgcactaaatgatgatcgtctaataccaggtatgtgctcttctagatggaggtggatatgctgaaaaagttgctgttgctgagggacaagttcttccggttccacccgggatttctctgaaggatgcagctagttttcctgaggttgcatgtactgtgtggtcaactatttttatgacaagccggctatctaagggcgaaaccttgttgaggctgacttgcatagtagaagtccggaatgtgtcttgggtcaaaagtaaaaccaaaacctagtgatggataaagctaagaaggaaattaattactagaatttcttatggtccacttttcgtgcaccttaaggttctataattttacctttataatctaaagtgtgtttacattgtttcggattatagaatccgaatgcatgttgttttcctttctaaagctcttaatttgaattttaagtttaaaatacattttaactcaaggtaaacaatatgcattctaataaaatttatgacctttataataataaattaagagctttaactaaaagttatgttttctcttttaaaaaaaattctatttttttaacaaatttgtttgatggtaaatttctaataaaattcttttctattttttgcacaattatttttttgaataaatgtaatataaattctaatgactggattattttcaaaatgaaacaattcttacaaaaaaaaaaaagaagatatatatatatatatatatatatatatatatataaaccatatataatcaagtcaaataattagttaagatatattttataaacaacatcttaaatagcctttgtaatttgaacgaaacctgaaaatagtcccgtgaaaaatgtaaacacagatttagccctttgttttcagacttcccttgaataataattatatataatttacaaacccaattgcatgatattgtttatgctttttgtggtcccttctgcttgattattcattattggttgaagaaagtgatgagttgggtgacgtcacatccgacaattgctttatatctagtccttctctcatgctgaaaatgatgatgatataagtatatgttctgttctctttatatacagtttagggactattttgttgtttttcatcaataaattttccgaaccgggacaatgtcacgaacttggttgttgacttgtgaaacaaacaagtttatagtaattaatcatcactgaatgttcaaagattcaagctttcatctattgactcgttaaacaaacatctttcttgttttatacaaacaagagaaggaaagtggttgaacaattccaaagtaaaagcaaaagaaaatgaaggctattgtaataacaacaccaggtggacctgaagttctacaacttcaagaggttcaagaccctcaacctaaagacaatgaagtactcatcagagtccatgccactgcccttaacagtgccgacaccgttcagaggaaaggcttttaccctatccctcaaggtgcaagcccctatccaggtcttgaatgttccggaactattgtatgcgttggtataaacgtttccaagtggaaaattggtgatcaggtatgtgctcttctagctggaggtggttatgctgagaaagtagcagttcctgagggacaagttcttccggttccacctgggatttctctgaaggatgcagctagttttactgaggttgcatgtactgtgtggtcgactatttttatgacgagccggctatctaagggggaaaccttattggttcatggaggttcaagtggaattggaacatttgcaattcagatagctaagtaccaaggatcaaaagtatttgttactgcaggtagtgaggagaagctagctttttgcaagagtattggagctgatgttggtatcaattacaaaacagaggactttgtggcaagggtaaaggaagaaactggcggacaaggtgttgatgttattcttgattgtatgggagcatcctactatcaaagaaatcttgctagcttaaattttgatggaaggctttttattatcggatttcaaggaggtgtttctacagaggtagatctacgtgcgttatttggcaagcgtctcactgtacaagcggctggcttgcgaagtagaagtcctgaaaataaagctgtgatcgttgctgaagtggagaagaatgtttggcctgcaattgcagaaggaaaggttaagcctgtggtatacaaatcattccctctttctgaagctgcggaagctcaccggcttatggaaagcagtcagcatattggaaagatattgctcgtggcttgaaaaaccatggtaaatacttgatcaatgtttgcgacacaacatacttttgaataatttgagtttggacttgtgtgtgttctaaccttaaataaatttgtggtttacaattacatctaaatacgttattaattctgtactagggatcatattttaacttctttcttctcttcaaactctcactagctacttgaaactttaatgttctggtagaaaattgagtgagaggaaatggaagaatgaaaatgggaagtagaatttcacatattgtttagatatatcatatatgtttaaactaggacgaataaaaatgtcattttcttagttgtttgggaaaaaagctaggatcataaataaacaaaagttgcatggcaagtgcttctacgt

SEQ ID NO: 5521 - DNA, 1264 bp, Medicago truncatula
aattaattcaaccacacctacctttgatgagtgtgagagaggagaaggaaatcaaagcaacaaaaatgaaggcaattgtaataacaaaaccaggtgaacctgaagttctacaacttcaagaggttcaagaccctcaaatcaaagacgatgaagtcctcatcaaagttcacgccactgcccttaacagagctgatacccttcagaggaaaggcgcttatcctccccctcaaggtgctagcccttatccaggtcttgaatgttccggaattattgaattcgttggcaaaaacgtctccaagtggaaaattggtgatcaggtatgtgctcttctagctggaggtggatatgctgaaaaagttgctgttgctgagggacaagttcttccggttccacccgggatttctctgaaggatgcagctagttttcctgaggttgcatgtactgtgtggtcaactatttttatgacaagccggctatctaagggcgaaaccttgttgattcatggaggttcaagtggaatcggaacattcgcaattcagatagctaagtacctaggatcaagagtatttgttactgcaggaagtgaagagaagctagctttttgcaagagtattggagctgatgttggtatcaattacaaaacagaggactttgtagcaagggtaaaggaagaaactggtggacaaggtgtcgatgttattcttgattgtatgggagcatcctactatcaaagaaatcttgctagcttaaattttgatggaaggctttttattatcggctttcaaggaggtgtttctacagagctagatctacgtgctttatttggcaagcgtctcactgtacaagcggctggcttgcgaagtagaagtcctgaaaataaagctgtgatcgttgctgaagtggagaagaatgtttggcctgcaattgcagaaggtaaggttaagcctgtggtctacaaatctttccccctttctgaagctgcggaggctcaccggcttatggaaagcagtcagcatattggaaagatattgcttgtggcatgaaaacattgtaaatactgatcgatgtactcgacatgacacacttttggatgatttgagtttagaccttctgtgttctaacctctgtgttgaataaagttgtagtttacaattacatctaaatgcgttattaattgtgtactagtagggatcatattttaatttcattcttctgctttggtttatcttggttgtttatatatctttcactacttgaatgcttt

SEQ ID NO: 5522 - DNA, 2655 bp, Medicago truncatula
ttgactcgttaaacaaacatctttcttgttttatacaaacaagagaaggaaagtggttgaacaattccaaagtaaaagcaaaagaaaatgaaggctattgtaataacaacaccaggtggacctgaagttctacaacttcaagaggttcaagaccctcaacctaaagacaatgaagtactcatcagagtccatgccactgcccttaacagtgccgacaccgttcagaggaaaggcttttaccctatccctcaaggtgcaagcccctatccaggtcttgaatgttccggaactattgtatgcgttggtataaacgtttccaagtggaaaattggtgatcaggtatgtgctcttctagctggaggtggttatgctgagaaagtagcagttcctgagggacaagttcttccggttccacctgggatttctctgaaggatgcagctagttttactgaggttgcatgtactgtgtggtcgactatttttatgacgagccggctatctaagggggaaaccttattggttcatggaggttcaagtggaattggaacatttgcaattcagatagctaagtaccaaggatcaaaagtatttgttactgcaggtagtgaggagaagctagctttttgcaagagtattggagctgatgttggtatcaattacaaaacagaggactttgtggcaagggtaaaggaagaaactggcggacaaggtgttgatgttattcttgattgtatgggagcatcctactatcaaagaaatcttgctagcttaaattttgatggaaggctttttattatcggatttcaaggaggtgtttctacagaggtagatctacgtgcgttatttggcaagcgtctcactgtacaagcggctggcttgcgaagtagaagtcctgaaaataaagctgtgatcgttgctgaagtggagaagaatgtttggcctgcaattgcagaaggaaaggttaagcctgtggtatacaaatcattccctctttctgaagctgcggaagctcaccggcttatggaaagcagtcagcatattggaaagatattccatatatacatggtagtaacagaaatgagttcattttctctattgtgtatcttggccttattactcgttattggtcatgtagcaaatgcccaaaactcacgagcagactatgtgaacgcccacaacgacgcaagacgtcaggttggtgttggagatattgtttgggacaatactgttgctagttttgcccaagactatgctaatcaacgcaagggtgattgtcaactgatccactccggtggtggtggccgctacggggaaaatctggcgtggagctctggcgacatgagtggctcagatgcagtgaagttgtgggtgaatgagaaagctgactataattataatagtaacacatgtgcttctggtaaagtgtgtggccattatactcaggttgtttggagaaactcacaacgtgttggatgtgccaaagtgagatgtgataataatagaggaacattcattacatgcaattacgacccaccaggcaactatgttggtgaaaagttcaaagattcaatcttgagttattgtgttgtgatggatctaactcaactcaatcctgcacagattactgtgtatggatctgcattttgtgtcatgctttctatgcatttcactttgcaattattgtctcagcatcttttctattggaagaatccaaaagaacaaaaagctattatcattatcattctcatggctcctatttatgctattgtttcctttgttggtctcttggatattagaggaagcaaagagtttttcactcttttggagtctattaaagaatgttatgaagcttttgttattgcaaagtttttgtctttgatgtatagttacttgaaaatttccattactaaaaatattgtgcctgatgaaattaaaggaagggaaattcatcactcttttcctatgacactttttcagcctcactctgttcggttgaaccaccataatctgaagcttttaaaatactggacatggcagtttgttgtcatccgtccagtgtgctccattttgatgattacactacagctagttgggttctatccaaattggttgagctggataattaccatcattctcaatatttctgtgtccttggcattgtattctctggtgatattttaccatgtctttgcaaaggaactggaaccacacaaacctctagcgaaatttctttgcatcaaaggaatcgttttcttctgcttttggcaggggttggtgctggacggtttagtagcagttggcgtgattcaatctcgtcatttgaagttagatgtagaacatattgaggaagcaatgcagaacattttggtttgtatagagatggtggtattttccgttcttcaacagtatgcttatcacgcttcaccatacagtggggaagttgaaaaaatgttttttttttatgtttggtctcaaccaagaacgatgaatataaaccaattatccgaacattcatttaagcttttagactattttttaaatgtgcgggtaaatcgttcattggtacggagtcaaatgctgcaaaatacatttttaatcgaattttttttaaaaaaactcgatataatatatagttccaattattcctctgattag

SEQ ID NO: 5523 - DNA, 989 bp, Medicago truncatula
gagagaggagaaggaaatcaaagcaacaaaaatgaaggcaattgtaataacaaaaccaggtgaacctgaagttctacaacttcaagaggttcaagaccctcaaatcaaagacgatgaagtcctcatcaaagttcacgccactgcccttaacagagctgatacccttcagaggaaaggcgcttatcctccccctcaaggtgctagcccttatccaggtcttgaatgttccggaattattgaattcgttggcaaaaacgtctccaagtggaaaattggtgatcaggtatgtgctcttctagctggaggtggatatgctgaaaaagttgctgttgctgagggacaagttcttccggttccacccgggatttctctgaaggatgcagctagttttcctgaggttgcatgtactgtgtggtcaactatttttatgacaagccggctatctaagggcgaaaccttgttgattcatggaggttcaagtggaatcggaacattcgcaattcagatagctaagtacctaggatcaagagtatttgttactgcaggaagtgaagagaagctagctttttgcaagagtattggagctgatgttggtatcaattacaaaacagaggactttgtagcaagggtaaaggaagaaactggtggacaaggtgtcgatgttattcttgattgtatgggagcatcctactatcaaagaaatcttgctagcttaaattttgatggaaggctttttattatcggctttcaaggaggtgtttctacagagctagatctacgtgctttatttggcaagcgtctcactgtacaagcggctggcttgcgaagtagaagtcctgaaaataaagctgtgatcgttgctgaagtggagaagaatgtttggcctgcaattgcagaaggtaaggttaagcctgtggtctacaaatctttccccctttctgaagctgcggaggctcaccggcttatggaaagcagtcagcatattggaa

SEQ ID NO: 5524 - DNA, 1092 bp, Cucurbita pepo
aatttattcggcgtgtgatttgagaactccaccagcagacaaacaatgaaggctatcgtgattagcgagcccggcgaggcggaagttcttcaattgcaggaggttgaggacccaataatcaaggacgatgaggttctgatcaaggtggaagccactgccctgaatcgggccgacacgttacagaggaaaggcctctatcccccgcccaagggtgccagtccgtatctgggcctcgaatgctctgggatcgtcgaagccgttgggaaaaacgtctcccgctggaagatcggcgatcaggtatgtgctcttcttgctggaggcggatatgccgagaaagtggctgtcccagccgggcaagtacttccaattccacctggtgtttccttgaaggatgctgctagtattccggaggtggcatgcaccgtttggtcgacggtgtttatgacaagtcgattatcgaggggagagacattgttggttcatggaggctcaagtggaattggtacttttgccattcagatagctaaataccaaggagcaagagtatttgttactgcaggtagtgaagataaattagctgtctgcaaagaccttggagcagatgtatgcatcaattacaaaactgaagattttgttgcacgagtgaaagaagaaacaaatggaaaaggtgtggatgttattctcgatagcattggagccccatactttcagcgcaaccttgaaagcttaaacttagatggaaggctttttattattggaaccatgggaggagcagtaacgcagctagattttcgcagtttgtttgcgaaacgcctcactgtgcaggcggctgggttgcgaaaccgatctcttgagaacaaagcagtcattgttagtgaagttgagaagatagtttggccagccattgcagctggcaaggtgaagcctgtgatcttcaagtatcttccattgtcagcagcagcagaagcccacaagctgatggagagtagcaaacatattgggaagatactgcttgctccatgatggacatggattgtcaaaatatgcaccctgttgttgtttttcctttaattgcactttgttgatccaact

SEQ ID NO: 5525 - DNA, 1270 bp, Manihot esculenta
ggtaactgaccactctgtcatatccatacacaactccattgtcgaacgctagaaaaaggcgaaaacaaaatgaaagcagtggtgataacttcactaggcggcccagaggtgctgcaactgcaagaagtagacgacccacaaatcaaagacgatgaggtcctcatcaaggtcgaagctaccgccgtcaaccgggctgacaccctccaaaggataggcaagcatccgcctcccaagggcgctagcccctaccctggtcttgaatgctccggcaccatcgaagccgttgggaaactcgtttctcgctggaaagtgggtgatcaggtgtgtgctcttcttagtggaggaggctatgcggagaaagtggctgttccagccggacagattcttcctgtcccaccaggcatttccctcaaggatgctggtggtttccctgaggtggcatgtactgtttggtccactgtttttatgatgagtcggttgtctgctggggaaacgtttctggttcatggaggttctagtgggattggtacttttgcaattcagatagctaaatatcaaggggttagggtatttgtcactgcaggcagtgaggaaaaattagctgtttgtaaggaactaggagctgatgtgtgcatcaattacaaaacagaggactttgttgcacgagtaaaggaagaaactggagggaaaggtgtagatgttattttggattgtattggagcatcctatttccagagaaacctagacagcttgaatgttggtggaaggctttttatcattgggttcatgggtggagctgtgacagaattaaatctgtctattttgttggctaaacgcctcacagtgcaagcggccggcttgcgaggtagaagtgcagaaaacaaagcagaaattgtgaatgaggtggagaagaatgtttggcctgccattgttgaaggcaaggtgaagcctgtggtctataaacattttccattagctgaggcagcagaggctcatcgactcctggaaagtagccagcatatcggaaagattcttcttgttccatgatgttatggacggtcaagtaagctttagttgatgagatccgccagtgtcaacatctttggaatgactattgatatctttgctagtgtgcttgtaatttaacgataaaagaagcctgtgagttagactgtttagtttgttaacttgatatttctcaagatggtgtgatgattccccttgaatgaaagaaatgcaaagttgatacccatttagataagttcaattc

SEQ ID NO: 5526 - DNA, 1361 bp, Citrus clementina
tcagctttcaatttttcatgaagacaaaaggggaaatgggaaatgggaaaaacatcatcatttgcattagaattgtataaataaatattttggaatcatttacttctactctggaaagtgtaggcacaatgaaggcaatagtgataactcaacccggtagcccagaagtgctgcagttgcaagaagtagaagaccctcaaatcaaagacgacgaagtgttgatcaaagtcgaagctactgccctgaaccgggccgacactcttcaacgaaaaggctcctaccctccacccaaaggcgccagccctcacccgggtctcgaatgttccggaaccatcctgtccgttggtaaaaacgtctctagatggaaagtcggcgaccaggtgtgtgctctgcttggtggaggagggtatgctgagaaagtggctgttccagctggacaagttcttcccgttccatctggtgtctcactcaaagatgctgctgcgtttccggaggtggcttgcactgtttggtcaacggttttcatgaccagtcacctatccccaggggagtcatttctggttcatgggggctctagtggaattggtacatttgcgattcagatgggaaaatgccaaggagtgagagtctttgttacagcaggaagtgaggaaaagctggctgtttgcaaggatcttggtgcggatgtgtgcatcaattacaagactgaggattttgttgcacgagtgaaggaagaaactggtggtaaaggtgttgacgtaattctagattgcatgggagcatcctactttcagcgtaacctagacagcttgaacattgatgggaggcttttcataattggaacccagggtggagctaaaacagaattaaatataacttctctgtttgctaagcgcctcactgtgcaagcggctggcttgcgaagcagaagtacagaaaacaaagcattaattgtatcggaggtggagaagaatgtttggcctgcaatagcagtggggaaggtgaagcctgtgatctacaagtatcttcctctgtgtgaagcagccgaagctcaccagctcatggaaagtagccagcatatcgggaagattatgcttgttccatgaaccttgtgtcattgtgcatacagttctgtaagttcatgttgttcgtaaaatgctctaaatacttggtgagataaggttatcgaatgaaaatattttcgttaggaagacaattgagagcacggaatcagtttgttaagctttcttgaattacttccttctggttaaaccttcgtgaataaataaatatggcaacttcttgcttaaaacatttatgttgtaatgacgacttgaaaagttacataattcataattcat

SEQ ID NO: 5527 - DNA, 3382 bp, Vitis vinifera
  misc_feature (98)..(196): n is a, c, g, or t
aaataaataacgggggggttagatttcaaaaaaaaatttcaaataccatttaatcgaataacccatatgtatgcatattcttactgtcattcattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttaatcaaataacccatattatgcatattcttactgtcattcattttatccaaaagtagcttcaacagtccggcctgcagtcatgaaagccgtagtgatcaccactcccggcgatccccaagttctccaagtgcaagaagtcgaaaaccctgaaatcggagataatgaagttctaattagagtggaggcctctgctcttaatcgagcggatacgcttcagaggaagggcttgcatcctccccccaaaggcagcagtccctaccccggtctcgaatgttctggaatcatcgaagctgttggaaaggccgtcgtccgatggaaggttggcgatcaggtgtgtgctcttcttgctggaggagggtatgctgaaaaagtgtctgttccagctgggcaagttcttcctgtcccatctggtgtttccctgaaggatgctgctgctattcctgaggttgcatgtactgtttggtcaactgtttttatgatgagccgactaactgcaggagaaacatttctgattcatggggggtcaagtggaattggtacctttgctattcaaatagccaaatacataggagcaagggtatttgttacagcaggaaatgaagaaaaattagctgtttgcaaggatcttggagcagatgtgtgcatcaattacaagactgaagactttgttgcacgggtgaaggaggaaacaggagggaaaggtgttgatgttatactggataatattggaggagcctactttcagcgaaatatcgatagtttaaatgttgatgggaggctttttattattggttttcagggtggaacagttgcagaagtaaatctttcaggtttacttgcaaggcgccttacagtgcaagcggctggtttgcgaaacagaagtctggaaaataaagctgcaattgtgagtgaggtggagaagaatgtttggcctgcaatcgtggccggaaaggttaagcctgtggtgtacaagtattttccattgacagaggcagcagaggctcaccagctcatggaaagcagcaaccatgttgggaagatactgctcattccatgatgttatgggtatgaatggtcttatgccttaaagaggatgacatggttttataactcttagtgtgcatctacactatctgatacaatgtgtgattggcaggtgtagatggtcaatgcttattttcttatgtagccccatcatttgagaataaaaaccagccttctcgtccaaacatttagactactagaattcaaatctttgtcatttacataaaggaacaattccgaaaaattaattttgatttaagggttagagaattaaataaaaaatggagtacatctctaaacacacagagagataagtatgcatcatgatctagattaaaaattaatatgtattaactttcatcatctcctatgggtgtcctttttcttttggcatgtaaatgaccgttaatttgtactttcatacgtacaggaaacaaaatggcctgaataataccatgtcattggtgacggttaaataaaatttaattattcttaactaatttatatttagttattgaaaaaaaaaatctaattttttttaatgaattattgaatttttctgaaagttcttacttttttttaaaaattcgttttccttcaccctgacatgggattcaaggcgaatgaaaaatatgaaaaactttcatagatggaaggtgtgctggttcagtggattatactttgagcaagaaaatttgaagatccagaacatcaaatgcagaatatctgtcaatctgagatcaacaggagtgcatgaatggagtggctatttgctgaatttgtccatgaagaggtttccattaaatggcttaatgaatatacaaaatggtaaaggtagaagtggaactgcatgagaaagtagcttatttactaacacaacattctaaacaaaaccacaatgctcctgtcctccattcgagcaaagcaaggataggaatttcagtaactgcaatgggcttcaattgccaagcttttcagcactccagggcaaaagggtctccatcactccatgcctagctgtagagatgatgataataataataataaaaaacacaagacttgattataaatattgtatagtcttactatgattgatacatcccaacagtagctttgacagtccggcctgcagccatgaaagccgtagtgatcaccactcccggcgatccccaagttctccaggtgcaagaagtcgaaaaccctgaaattggagatgatgaagttctaattagagtggaggccgctgccattaatcaagcagatacgcttcagaggaagggcttacgccctccccccaaaggcggcagtccctaccccggtctcgaatgttctggaatcatcgaagctgttggaaaggccgtcgtccgatggaaggttggcgatcaggtgtgtgctcttctttctggtggagggtatgctgaaaaagtggctgctccagctgggctagttcttcctgttccatctggtgtttccctgaacgatgctgctggtattcctgaggttgcatgtactgtttggtcaagtgtttttatgatgagccgactgtctgcaggagaaacattcctggttcatgggggttcaagtggaattggtatctttgctattcaaatagcaaaacacataggagcaagggtatttgttacagcaggaaatgaggaaaaattagctgtttgcaaggatcttggagcagatgtgtgcatcaattacaagactgaagactttgttgcacgggtgaaggaggaaacaggtgggaaaggtatgttctatggcatcttaactaaaatctcaattgaggatggaattgcgttttttgcaccaaatccactattctggaatgtttggaaagataaataatcatcttctattttattctgattgtcaaaatctaaccccaaaaatgtttaatgacaggtgttgatgttatactggataatattggaggagcctactttcagcgaaatatcgatagtttaaatgttgatgggaggctttttattattggttttcagggtggaacagttgcagaagtaaatctttcaggtttacttgcaaggcgccttacagtgcaaggtaccactttctctatagaagatttttctgtggttttggagttgaatcaacttgattaatctcat

SEQ ID NO: 5528 - DNA, 1290 bp, Humulus lupulus
gagccctgtacggcgattttgggtcgaggcgatgaaggcgatagtgataaccactcccggaggcccagaagtactgcaacttcaagaagttgaagatcctgacctcaacgccgatgaggtccttatcaaggtcgaagccacagcgctcaaccgagccgatacccttcagagaaagggccagtaccctccaccaaagggtaccagtccttatccgggactcgaatgctctggaaccgttgaagccgtcggaaaagacgtttcccgctggaaagttggcgatcaggtgtgttgtcttctcagtggaggtgggtatgctgagaaggtggctgtgcctgctggacaagttcttccattgccgcctggtgtttctctgaaggaagctaccgcttttcctgaagtggcttgcactgtttggtccactgttttcatgaccagtcgcctcactgctggggaatcacttttggttcatggaggctctagtggcattggaacatttgccattcagattgccaaatacataggagcaagagtatttatcacagcaggtagcgaggaaaaactagctttctgcaagaaccttggcgctgatgtttgtataaactacaaaacggaggactttgttgccagagtaaaagaagaaaccggtggtaaaggtgttgatgttattctggatagccttggagcatcctatttcaagaaaaatcttgagagcttgaattatgatgggaggcttttcattattgggttcatgggtggagctgttacagaattagatctccgtgctttgttccccaagcgcctcaccgttcaagcggctggcttgcgaacgaggaccctagaaaacaaagcagtaatcgttagtgaagtggagaagaatgtttggcctgcaattacggctggtaaggtgaaacctgtgatctacaaatcttaccctttatctgaagcagcagaggctcacaggctcatggaaagcagcaaccatataggaaaaatactgcttgttccatgattccataaaatgtttatgtaagacactgtttgatgcgttcatacatactcatgtttaactttctagtatatttccctcaacttcatatactgctcacttaaatgaatactatgctaaacggattcatctcagtctcagcctcaatcttatgtatatgttttgagccctgttgttctataaattctgtagtattttagagctttgtctcctggtcatgttgaactagtagactctgcagcagagctcatattatcttagtcattttcagtaaagataatata

SEQ ID NO: 5529 - DNA, 1371 bp, Citrus sinensis
tcagctttcaatttttcatgaagacaaaaggggaaatgggaaaaacatcatcatttgcattagaattgtataaataaatattttggaatcatttaattctactctggaaagtgaaggcacaatgaaggcaatagtgataactcaacccggtagcccagaagtgctgcagttgcaagaagtagaagaccctcaaatcaaagacgacgaagtgttgatcaaagtcgaagctactgccctgaaccgggccgacactcttcaacgaaaaggctcctaccctccacccaaaggcgccagcccttacccgggtctcgaatgttccggaaccatcctgtccgttggtaaaaacgtctctagatggaaagtcggcgaccaggtgtgtgctctgcttggtggaggagggtatgctgagaaagtggctgttccagctggacaagttcttcccgttccatctggtgtctcactcaaagatgctgctgcgtttccggaggtggcttgcactgtttggtcaacggttttcatgaccagtcacctatccccaggggagtcatttctggttcatgggggctctagtggaattggtacatttgcgattcagatgggaaaatgccaaggagtgagagtctttgttacagcaggaagtgaggaaaagctggctgtttgcaaggatcttggtgcggatgtgtgcatcaattacaagactgaggattttgttgcacgagtgaaggaagaaactggtggtaaaggtgttgatgtaattctagattgcatgggagcatcctactttcagcgtaacctcggcagcttgaacattgatgggaggcttttcataattggaacccagggtggagctaaaacagaattaaatataacttctctgtttgctaagcgcctcactgtgcaagcggctggcttgcgaagcagaagtacagaaaacaaagcattaattgtatcggaggtggagaagaatgtttggcctgcaatagcagtggggaaggtgaagcctgtgatctacaagtatcttcctctgtgtgaagcagccgaagctcaccagctcatggaaagtagccagcatatcgggaagattatgcttgttccatgaaccttgtgtcattgtgcatacagttctgtaagttcacgttgttcgtaaaatgctctaaatacttggtgagataaggttatagaatgaaaatattttcgttaggaagacaattgagagcacggaatcagtttgttaagctttcttgaattacttccttctggttaaaccttcgcgaataaataaatatggcaacttcttgcttgaaacatttatgttgtaatgacggcttgaaaagttacataattcataattcataattcataattctataa

SEQ ID NO: 5530 - DNA, 1014 bp, Citrullus lanatus
agagcatgagcagagcagacaaacaatgaaggctattgtgattagccagcccggcgaggcggaagttcttcaattgcaggaggttgatgacccaataatcaaggaggatgaggttctgatcaaggtggaagccactgccctgaaccgggccgacacattacagaggaaaggcttctatcccccgcccaagggcgccagtccctacctgggcctagaatgttctgggatcgtcgaagctgttggaaaaaacgtctcccgctggaaaattggcgatcaggtatgtgctcttctttctggaggcgggtatgctgagaaagtggctgtcccagctgggcaagtacttccaattccacctggtgtttccttaaaggatgctgctagtcttccggaggtggcatgcaccgtttggtcgactgtgtttatgacaagtcgattatcgagaggagagacattgttggttcatggaggctcaagtggaattggtacttttgccattcagatagctaaacaccaaggagcaagagtattcattactgcaggtagtgaagagaagttagctgtctgcaaagaccttggagcagatgtgtgcatcaattataagactgaagattttgttgcacgagtgaaagaagaaacagatggaaaaggtgtggatgttattcttgatagtattggagccccttactttcagcgcaaccttgaaagcttaaacttggatggtaggctttttattattggaaccatggggggagcagtaacacagctagatttccgcagtttgtttgcaaaacgcctcaccgtgcaggcggctggcttgcgaaaccgatctcctgaaaacaaagcagtcattgtaagtgaagttgagaagatagtttggccagccattgcagcaggcaaggtgaagcctgtgatcttcaagtatctcccattgtctggagcagcagaagctcaccagctaatggagagtagcaagcatattggaaagatactgctgactccatgattgttgtggtt

SEQ ID NO: 5531 - DNA, 1291 bp, Vaccinium corymbosum
gggagagtgacactgccacagtcgtgttgagttctccaacctccctccaatcctgataacctcgcctgatttctccattttcctccttccaacctcccttcagccctgataacctcgcctgatttctccatttcccttcttccgaccaccgtcaaccaccgcaaatgaaggccgtggtgataaccaccccaggcggccccgaagtccttcaattacaagaggtcgaagacccagaatacggggacgacgacgttctgatcagagtcgcagccaccgcacttaacagggccgacactaaccagcgcaaaggctcgtaccccccgcctaagggcgcgagtccattgctgggtctggaatgttctggaaccatcgaggccgttgggaggaacgtctcccggtggaaaatcggtgaccaggtatgcgctcttcttactggaggagggtatgctgagaaggtggctgtaccagctggacaagttcttcctgttccaactggtgtttctctaaaagatgctgctagtttccctgaagttgcgtgtactgtttggtcaaccgtttttatgatgagtaagctatctggtggagaaacattcctgatacaagggggctctagtggaattggtacatttgcaatccaaatagcgaaatatgtaggagccaaagtgttcgtcacagcaggaagcgaggaaaaattagctgcttgcaagaatctgggagctgatgtttgcatcaactacaagactgaagattttgttgcacgtgtgaaggaagaaacgcaagggaaaggtgttgatgttatactggataacgttggaggaccctacttgcaacgaaacattgacagcctaaattttgatgggaggctttttattatcggctttatgggtggaactgttgcagaagtgaatcttcaaggtttgcttgcaagacgcctcacagtgcaagcggctgggttgcgctacaggagtacagaaaacaaagctttgatcgtgagcgaagtggagaagaacgtttggccggcaatagtggcggggaaggtgaaaccagtggtgtacaagtatcttccattgtctgaagcagcagaggctcaccggcttattgagaccagcaaccatattgggaaaatactcctcgtcgcgtgatattttgtatgatctcttgcagcaactgattgaataaagtgatttctcaggagcatatgctgtgataagacagattgtgttagttgcttgaaaggacattcttgtgttatgttgatctccctttgcaatattgtacttatgaactgaaa

SEQ ID NO: 5532 - DNA, 1291 bp, Vaccinium corymbosum
gttctccaacctccctccagtcctgataacctcgcctgatttctccattttcctccttccaacctcccttcagtcctaataacctcgcctgatttctccatttcccttcttccgaccaccgtcaaccaccgcaaatgaaggccgtggtgataaccacccccggcggccccgaagtccttcaattacaagaggtcgaagacccagaatacggagacgacgacgttctgatcagagtcgcagccaccgcactcaacagggccgacactaaccagcgcaaaggctcgtaccccccgcctaagggcgcgagtccattgctgggtctggaatgttctggaaccatcgaggccgttgggaggaacgtctcccggtggaaaatcggtgaccaggtatgcgctcttcttagtggaggagggtatgctgagaaggtggctgtaccagctggacaagttcttcctgttccaactggtgtttctctaaaagatgctgctagtttccctgaagttgcgtgtactgtttggtcaaccgtttttatgatgagtaagctatctggtggagaaacattcctgatacaagggggctctagtggaattggtacatttgcaatccaaatagcgaaatacgtaggagccaaagtgtttgtcacagcaggaagcgaggaaaaattagctgcttgcaagaatctgggagctgatgtttgcatcaactacaagactgaagattttgttgcacgtgtgaaggaagaaacgcaagggaaaggtgttgatgttatactggataacgttggaggaccctactttcaacgaaacattgacagcctaaattttgatgggaggctttttattatcggctttatgggtggaactgtagcagaagtgaatcttcaaggtttgcttgcaagacgcctcacagtgcaagcggctgggttgcgctacaggagtacagaaaacaaagctttgatcgtgagcgaagtggagaagaacgtttggccggcaatagtggcggggaaggtgaaaccagtggtgtacaagtatcttccattgtctgaagcagcagaggctcaccggcttattgagaccagcaaccatattgggaaaatactcctcgtggcgtgatattttgtatgatctcttgcagcaaccgattgaataaagtgattctgtgatttctcaggagcatatgctgtgataagacagattgtgttagttgcttgaaaggacattcttgtgttatgttgatctccctttgcaatattgtacttatgaactgaaaccacgtctctctcctttttttt

SEQ ID NO: 5533 - DNA, 1955 bp, Eucalyptus grandis
gtccaatttgagaacctcgccagcaaggcatgaacgttggcgtactccgttttgctcctaccttcctgacacgtagcgtcgctacccgccgagcagcgcctaccctgctgtccgtttccgcgcggctcgtcactgcgctgctccacacctccgctccccactcccctctcgaaccatctcgccgggaacccacgatgaaggccgtcgtgatcacgacccccggcgacccggaagtgctccggctgcaggaagtcggggacccgaagctcgaggacggccacgtcctcgtcagggtcgcggccaccgcgctgaaccgggccgacacgctgcagcggaggggcatgtacccgcccccgaagggcgcgagcgagtacccgggcctcgagtgctccgggacgatcgaggccgtcgggaagggcgtgtcccgatggaaagttggggatcaggtttgtgctctgcttgctggaggaggttatgcagagaaagtagcggttccagcagggcaagttcttcctgttcctgctggaatttcgcttaaggatgctgcgagtttcccagaagtggcttgcactgtttggtccactgtcttcatgatgagtcacctctctgcaggggaaacattcttgatacatggtggctctagtggaatcggcacatttgctattcagatagcaaaatactatggtgctagggtatttgtaacagcaggaagtgaagaaaagttagctgcttgcaaggatctgggtgcagatgtttgcatcaactacaaaacagaggactttgttgcacgagtgaaagaagaaactgcaggaaaaggtgtcgatgtgattctggactgcgttggtgcatcctacttccagagaaacctggatagcttgaatttggatgggaggctattcatcatcggcactcagagtggagcagtgacacaagtggatctgagaagtattctggccagacgcctcactgtgcaagcggcgggcttgcgtaccagaagcccagagaataaagatgcgatcgtagatgaggtagagaagaaagtgtggccagccatcgagcaaggcaaagtgaagcctgtggtttacaagtatcttcctctagctgaagcggcggagggccaccggctcatggaaagcagcaagcatgtcgggaagattctacttgtcacatgaagttgtggacttgtattgtcctgtccagttgagttgcgtaagagggccgcttgtttatgtgaatgagaacaatgcacagtacctgttacaatcaaatggcagagacaactgaactagactaaataactaccttgttcttgattttgctaagagagataaaagccctttggactttggagggaaaatagaagaaagcttagcaacaagccaagcaaaggaaattactctttatgaattacaaccgttaactgcatagagtttagacggccaaaatctttaggaccagcaggcacggtatacatggaattttattcgttggacataaacaaggcaaataaggagggcgttgggtttttatttttgttaagttttctcgagcgaattattgagttattgtgagataataactgttgatctgttttgggcgtaattggaggctggaaagtacccgattgattaggtgattgtaaactttgaattcttcgaatttgtaggggatttcttggcgtcttgtgcacctaacgtaaaatgggtgtcgacactttgatcgaactatgcaattctattatgtttctcactgttcaatttcttttttggcattcgactcagatgataagatcagataatttccttgttattaatatctaaattttgacttttccataaaattaggaatggacttgacccctaaacatatattacatcccattatatttaggtactaatagcatttaggacgaactcgtttgcatcgcccatgttgcaagggcaaaacagatattg

SEQ ID NO: 5534 - DNA, 1132 bp, Valeriana officinalis
taaactttcttgtctcgcaagataaattggctctccgcttccaatttgtttcatcatatctcgaaatctttgcagatgaaggctatagtgatcacatctccaggaggaccagaagttcttaaattacaggaagttgaagacccccaaattggagaaaatgaagttttgattaaagtagaagcaactgctctaaatcgagcagatactattcagcgaaaaggctcttatcctccacctaaaggttcaagcccttaccttggtcttgaatgttctggaatcatccaatttgctggccctaaagtcactcgctggaaaattggagatcaggtatgtgcacttttgagtggaggaggatatgccgagaaagtcgttgtacctgcaggacaagtacttccgattccgccaggtgtttctttgaaagatgcggcaagtattcccgaagttgcttgcacggtttggtcaactgtttttatgactagccgtctttcaccaggagagacattcttgatacatggaggctctagcggcatcggtacatttgcaattcaaatggcaaaatacataggagttaaagtatttgttactgcagggaatgaggagaaattagctgtttgcaaagatcttggagctgatgtttgcattaattacaaaaccgaagattttgttgcacgagtcaaggaagaaaccggagggaaaggtgttgatgttatactcgataatatcggtgggtcctacttgcagcgaaatcttgatagcctaaacattgacggaaggcttttcattattggatttatgggtggagcagtaactcaagtaaatctcgtaagtttgttgacaaaacgcctcacagtgcaagctgccggtttgagaaacaggagccttgagaacaaagctgagattgtgagtgatgttgagaagaatgtgtggccagcaatagcagaaggtaaggttaaacctgtaatttacaagtacttacctctatctgaagcagccgaagctcaccgaattatggaaagtagcactcatattggaaaaatagtccttgttccatgagtcgaggttcgtttttctgtttaaagtataaaactgtacgactgtaaacgataatgttgaatcagttactcaattaaac

SEQ ID NO: 5535 - DNA, 1102 bp, Amsonia hubrichtii
taagagctatgaaggcaatagttatcacaagcccaggtaacccagaagtcttacaactgcaagaagttgaagacccagaaatcaaagatgatgaagtcttgattaaggttgcagccactgctctcaacagagcagacacccttcagcgccagggcaagcaccctccacctaaaggtgacagcgagtacccgggtcttgaatgctccggaacaattgaggctgttggcaaggatgtcaccaggtggaaaattggtgatcaggtttgcgctcttgttggtggaggcgggtatgcagaaaaggtagctgtacctgctggacaagtccttcctgtaccacctggtgtttctttgcaagatgccactagttttcctgaagtagcttgcactgtttggtcaactgtttttatgatgagccgactatcagcaggggagacattcctgatacatggaggatctagtggcattggtacatttgctattcaaattgccaaataccatggagtcaaagtattcgtcactgcagggagtgaggaaaaactagctgcttgcaaggaccttggtgcagatgtttgcatcaattacaaaactgaggattttgtggcacgtgtcaaggaagaaacgggaggaaaaggtgttgatgttatactagacaacattggagcgtcatactttcagcggaatctagacagcctaaatgttgacggaaggcttttcatcattggctttatgggtgggattaaaactgaagtaaatctttcaactttgcttgtgaggcgcctcacagtacaggctgccggattaagaaatagaagcaaggaaaacaaagctttcattatgagggaggtggagaaaaatgtctggcctgcaattgcagctggcaaggtgaaaccagtgattcacaagtcctttcctttggctgaagctgcagaaggtcacaagctaatggaaagcagccagcatattgggaagatactcctggtcgtctgatttattgtttattcacaagtacattgtttcatgtagcagtgtactggataatccctgttcttataaaggctgcctctttgatccttcttttcttcctcaaccatctctatcctctg

SEQ ID NO: 5536 - DNA, 1406 bp, Vaccinium corymbosum
acaatacgacaggagactgggagagtgacactgccacagtcgtgttgagttctccaacctccctccaatcctgataacctcgcctgatttctccattttcctccttccaacctcccttcagtcctgataacctcgcctgatttctccatttcccttcttccgaccaccgtcaaccaccgcaaatgaaggccgtggtgataaccaccccaggcggccccgaagtccttcaattgcaagaggtcgaagacccagaatacggggacgacgacgttctgatcagagtcgcagccactgcactcaacagggccgacactaaccagcgcaaaggctcgtaccctccgcctaagggcgcgagtccattgctgggtctggaatgttctggaaccatcgaggccgttgggaggaacgtctcccggtggaaaatcggtgaccaggtatgcgctcttcttactggaggagggtatgctgagaaggtggctgtaccagctggacaagttcttcctgttccaactggtgtttctctaaaagatgctgctagtttccctgaagttgcgtgtactgtttggtcaaccgtttttatgatgagtaagctatctggtggagaaacattcctgatacaaggggcctctagtggaattggtacatttgcaatccaaatagcgaaatacgtaggagccaaagtgtttgtcacagcaggaagcgaggaaaaattagctgcttgcaagaatctgggagctgatgtttgcatcaactacaagactgaagattttgttgcacgtgtgaaggaagaaacgcaagggaaaggtgttgatgttatactggataacgttggaggaccctacttgcaacgaaacattgacagcctaaattttgatgggaggctttttattatcggctttatgggtggaactgtagcagaagtgaatcttcaaggtttgcttgcaagacgcctcacagtgcaagcggctgggttgcgctacaggagtacagaaaacaaagctttgattgtgagcgaagtggagaagaacgtttggccggcaatagtggcggggaaggtgaaaccagtggtgtacaagtatcttccattgtctgaagcagcagaggctcaccggcttattgagaccagcaaccatattgggaaaatactcctcgtcgcgtgatattttgtatgatctcttgcagcaactgattgaataaagtgatttctcaggagcatatgctgtgataagacagattgtgttagttgcttgaaaggacattcatgtgttatgttgatctcccttcgcaatattgtacttatgaactgaaaccacgtctctcccttttttcgaataaaattgtactgatgttctgtccattgttgatgaacaaatactcatggcaaacaaacagtgcttttacgaacg

SEQ ID NO: 5537 - DNA, 1411 bp, Fagopyrum esculentum
taggggtatggaccgtatggtgccgacccagacgaaacacttccaaagacgaaattcttcgtcgcaaaatcgaagacaacctctctgattgattgaatttctatttcaacttcgataattctgcaattccatttcaacttcccactacctagcaagtcagtgaagatgaaggcggtggtgatcacttcgccgggagggccagaagtgctgaaagtgcatgaggtcgaagatcctaccatcggcgacgatgaggtgttgatcaaggttgcggccaccgcgcttaacagagccgatactaatcagcgcatgggaagctaccctcctcctaagggcgccagcccttaccttggtctcgaatgttctggaatcatcgaacaaatcgggaagaacgtttcccgctggaagatcggggatcaggtttgtgctcttctttcgggaggaggatatgctgagaaagttgctgtgcctgtagggcaagtactcccaatcccacccggcatctctctcaaggatgctgctagcttccctgaggtggcatgtactgtttggtctacggttttcatgttgagtaagctgaaagcaggagagactttcttgattcatggtgggtctagtggaattgggacgttcgctatccagatagccaagtactatggtgctagagttttgtaactgcaggtagcgaggaaaagctggcgttttgcaagaatctgggggctgatgtaggtataaactacaaaacagaagactttgttgcccgggtgaaagaagaaactggtggaaaaggtgttgatgtcatactggacaacgtcggtgcaccttacttgcaacgaaatcttgaaagcttaaaccttgatgggaggcttttcattatcggttttatgggtggggcaaaaactgaagttgatcttaaaattctgttggcaaggagacttacagtacaagcggctgggttgcgctacagaactcttgaaaacaaagcagcaatagtgaacgaagtggagaagaacgtctggcctgcaatcataacgggtaaggttcgacccgttgtttacaaagagttcccattgtctgaggcagcagaagctcaccagctcttggaaagcagccaacacattggcaagattcttcttattccttgaagtgcatacaatgtgaaatgctagaagttaaaaatccagtttctcgaatcctcccgtgttagctttgttatttccctttctttacaccagaacaatgcatggctacatgtaccaactcatggaacttcttttttataacttcattgtggaaggttagagttaagaaatactagtgtgtatcactgtattgtgtaatgcttggaattggatttgcagcaaagtttccattgatacctctatagtagcatgacaatttgaggttgaggtga

SEQ ID NO: 5538 - DNA, 1337 bp, Momordica charantia
ggcatttgtctgtttgtttttgaagaagcatttgattgggtttggaaaagaaacgatcttccattccttcccttgtagaggaataagatatcttcgatcagctgtgtcgtgtgtgctttggagagtccaaattccagtagcagataaacaatgaaagcaatagtgatcagccaaccgggcgacgcagaagttcttcaactgcaagaggttgaggacccagtaatcaaagacgatgaggttctgatcagggtcgaggccactgcgctcaaccgggccgacacgttgcagaggcaaggcttctatcccccgcccaagggtgccagtccctacctgggtctcgaatgctctgggatcgttgaagccgttggaaaaatgtctcccgctggaaaaccggcgatcaggtatgtgctcttcttgctggtggcggatatgctgagaaagtagctgtcccagctgggcaagtgcttcccattccacctggtgtttccttgaaggatgctgctagtcttccagaggtggcctgcaccgtttggtcaaccgtgtttatgacaagccggttagcgagaggagagacattgttggttcatggaggctcaagtggaattggtacttttgctattcagatagccaaataccaaggagcaagagtgtttgttactgcaggtagtgaggagaaattagctgtctgcaaggaccttggagcagatgtgtgcatcaattacaaaacggaagattttgtcgcgcgagtgaaagaagaaactgatggaaaaggtgtggatgttattcttgacagtattggagctagttacttccagcggaatctcgaaagcttaaacttagatggaagactttttattatcggaaccatgagcggtgcagtaacacagctagacttccgcagtttgtttgcaaagcgcctgactgtgcaagcggctggcttgcgaaaccggactactgaaaacaaagcagttattgttaatgaagttgaggagatagtttggccagccattgcagcaggcaaggtgaagcctgtgatcttcaagtatcttccattgtcaggagcagcagaagcccacaagctaatggagagtagcaagcatattgggaagatactgctggttccatgatgacatagattgtcaagagaccaatatgaaaacatgattgctgattaagctgtggttgaagtttagtttgatcttggtaccatcaaacttggcaattagtaataaaataattaccgtgtagttgtgtttccatggttttggttcggatttaacttgaatgacagtagaaaaggattgttgccgggctgtctaaatttataactgagattt

SEQ ID NO: 5539 - DNA, 1483 bp, Populus trichocarpa
ggagatcaaatatcgatacatagcaggtccttttccttgtatattttctaataaatctgatcagatgcgtagctaatccctgctcctgcaaagtcactgaaaaccgtttattttgtggagtgtatcaagaaaaatgaaagcagtagtgataactacaccaggtggcccagaagtgctgcaattacaagaagttgaagacccacaaatcaacgaagatgaagtcttgatcaaagtagaagccacagccttgaacagggcagatactctccaaagacaaggcaagtatccacctcctaaaggagctagcccatatcctggtcttgaatgttcaggcaccattgaagctgtcggaaaaaatgtctctcgctggaaaattggtgatcaggtttgtgctcttcttagtggaggagggtatgcagagaaagtggctgttccagcaggacaagtacttcctgttccacaaggtgtttcgcttaaggatgctgctgctttgcctgaagttgcatgcactgtttggtctactgttttcatgatgagtcggctgtctgcaggggaaacgttcctggttcacgggggctcgagtggaattggtacatttgcaattcagatagctaaacatcaaggggttaaggtgttcgtgacggcagggagtgaggaaaaactagctgtttgtaaggatcttggagctgatgtatgcatcaattacaagactgaggactttgtggcacgagtgaaggaagaaacgggtgggaaaggtgttgatgttattctggatagtgttggagcaccctattttcagaaaaacgtagacagcttaaatattgatgggaggctttttctccttggcttcatgggtggagctgtgacacaagtaaatctggcttctttgtttgcaaagcgcatcacagtgcaagctgctggcttgcgaactagaactctggaaaacaaagcagaaattgttagtgaggtggaaaagaatgtttggcctgcaattgttgcaggcaaggtgaagcctgtggtgtacaagtatcttccattatctgaggcagcagagggtcaccggctcatggaaagtagccagcatattggtaagatactgcttgtcgcatgatgctactattgatagccatacagcaaagtcgtgaatcatgatgtcgatctgcaacgtttctgtctatggtgcctgtaatgagggaataaataacgagtcattgtatttacgtatgcagtttatgaactcgatgtttcagcaaccgagacatattctcatagaattgaatggaaacctcacaaaatttgatgcgatggcctgatctgaagggtcatccatttgaacttattatttcaaagctcctcttattacaactcattcatggactcattcaaacaacagaaatatggggcagaaagatagatttacagtgcactgttaatgttatttcgcaatcttaataaagagagagagtcacaggaatcatagcat

SEQ ID NO: 5540 - DNA, 1252 bp, Chenopodium quinoa
tttgtgtccaaagctcaaaatcatttcaataaacatttgtagaatctctctcccaatttccatttccctcagaattcagaggagcaaaattaaccatgaaagcagtagttataacaagcccaggaggtccagaagtgctgcaattgcaagaggttgaagacccccaaatcaaagacgatgaagttttaatcaaagttgaagcaactgcccttaatcgagcagataccattcagaggaagggctcctaccctccccctcctggggctagtccttatcctggtctagaatgttctggaaccatccttcaacttggcaacaatgtcactcgctggaaagttggtgatcaggtgtgtgcgcttcttagtggaggaggttatgctgagaaagtggctgttcctgcaggacaggttcttcctgccccagatggtgtttctctcaaggatgctgcaagtttcccagaggtggcatgcactgtttggtcaactgttttcatgacaagccgactttctgcaggagaagcatttttggttcatgggggctctagtggcattggcactttcgctattcaaatagctaaatattatggagccaaagtatttgtaactgcaggtactgaagaaaagctggcatattgtaaagatcttggagctgatgtgtgtatcaattacaagacagaaaattttgttgggagagtgaaagaagagacagctggaaaaggtgttgatgttatattagacaacatgggaggagtttacttgcagcgaaacattgacagcttgaatttagatgggcggctttttattattggcttccaaggtggatctacctcacaaattaaccttgcaagtttagcagcaaagagactcacggtgcaagctgctggcctgcggaatagaactccagagaacaaagcgcttattgtgaaggaggtagagaagaatgtgtggcctgctatcaaagagaagaaggtgaagcctgtagttcacaagtacttttctctctcacaggcagctgaagcccatcagcttatggaaagtagcaagcacattggcaaaatattgcttcttccatgatagatgagatggttctaccaatcagctccgactcagaacaagtgcagtatatatacccgtagaaacaacctaaatggccaattgttctagccatagttcattttttttttgaaattaagttctagccatagttcattgtattatgctatgttggattatttaagttttgagtaagtatt

SEQ ID NO: 5541 - DNA, 1492 bp, Vigna unguiculata
ggattcatcttcttcctctttccacagtcggctatggaagataacaacagccaggcttcatctcctgcttcaacaaccgaaggaaaaccaatacgatgcaaagccgcggtttctagaaaagccggtgagccattggtgatcgaagagataaccgtggcgccaccaatgcccggtgaggtgcgaattcgtgttatttgttcctctctctgccacagtgacgtcacttttcgggaactccaggttcctcctgccatttttccaaggattctgggtcatgaggcaactggggttgtggaaagtgtagggaaggatgtaagtgaacttaaaaaaggtgatgtggttattccagttatcctaccagaatgtggggagtgcatagattgcaaatcaagcaagagcaaccgttgtactaatttccctttcaaggtgtctccctggatgcctcgacatggtagctctaggttcaccgacaagaatggagagatcatataccattttttgtttatttcaagcttcagtgagtacactgtggtggacattgccaatattatcaagattgatccacacattccccctgacagggcatgccttcttggatgtggtgtttcaacaggggtaggtgctgcttggagaactgctggtgtggaaccagggtctacagtagccatttttgggctgggatctattggattagcagttgcagagggagcaagactttgtggagcaactaggattataggtgttgatgtctatccagaaaaatttgaaattggaaaaaaatttggtgtcacagactttgtccatgcaagagaatgtgaggacaaacctgtgagccaggttatcatagagatgactggtgggggagcagattattgcttcgaatgtgttggcatggcatcagtggtgcatgaagcgtatgcttcttgtagaaagggttggggaaaaacaattgttttaggagtggacaaaccaggagccaggataaatatcagttcccatgaggtccttcatgacggcaagtgcctcatgggatccttgtttggaggtctcaaacccaagtctcatgtccctattctccttaaacgttacgtggacaaggaattgcagttggatgaatttgtcactcatgaggtggagtttaaggacatcaacaaggcttttgatttattgagtacaggaaagtgtcttcgatgtgtgatttggatggataagtgagtacattgttaagtattcctagtccttgatgatgatatgcaacatgaaacatttattcctagctcttttgtatttgataaaacatattcaataaaacagagcttctattttactgcactgcaaatgcacttgaagcaccagtgaagtaactaataggggaggtaatggtgatccttgttgctccaaagtgtcttagtctgtacactccagaaacagcaccatctggtatttcccattcgattgtagctaacccatgcaaggaaaaaaaaaaaaaaaa

SEQ ID NO: 5542 - DNA, 2169 bp, Glycine max
tttcactgatgacccggaggcccaagtccgtttatcaaactctatgtgtgagtagcatgttccaacaactcagctttttcagaacagccattactaccactgttcgctatgaaagatgacaaacaggctccagttcctgcttctacaaccgaaggacaacctatacgatgtaaagcggcggtttctagaagagctggtgagccgttggttattgaggacatcattgtggcgccgccaaagcctcgtgaggctcggattcgtattatttgttcctctctctgccacagcgacatcacacttcggaaccttcaggaccctcctgccattttcccaaggattctaggtcatgaggcaactggggttgtggaaagtgttgggaaggatgtaactgaagttacaaaaggtgatgtggtaattccagttatcctaccagaatgtggggagtgcatagattgcaaatcaaccaagagcaaccggtgcactaattttcctttcaaggtgtctccttggatgcctcgagatggcaccacaagattcactggccaaaatggagagatcatataccatttcttgtttatttcaagtttcagtgagtacactgtggtggacattgctaatctgataaagattgatccagaaattcctcctgacagagcatgccttctcggatgtggtgtttcaacaggggtaggtgctgcttggagaactgcaggtgtggaacccgggtcaacagtagctatttttgggttgggatctattggattagctgttgcagagggagctagactttgtggagcaactaggattataggtgtggacatcaacccagaaaagtttgaaattggaaagaagtttggagtcacagactttgtcaatgctggagaatgtgggggcaaacctgttggccaggttatcatagagataactgatgggggagcggattattgctttgaatgtgttggtatggcatcattggtgcatgaagcatatgcttcttgtagaaagggttggggaaaaacaattgttttaggagtggacaagcccggagctaggataaacctcagttcttacgaggtccttcatgatggaaagagcctcatgggatccttatttggaggtctcaaacccaagtctcatgtacccattctccttaaacgttacatggacaaggaattgcagttggataaatttgtcactcatgaggtggagtttaaggacatcaataaagcttttgatttattgagtaaaggagagtgtcttcgatgtgtgatttggatggataaatgagtacattgttatgtattcctagtccttgaatcatgatttgcaacatgaaaatgttgaagtgtgctttttccctttcgtatttgattaaaacttattcaataaagcagagctgctatcgtattgcactgcaaatgcacttgaagccagtaaagtaattaataggggagataatagtggtccttgttgctccaaagtgttttagtctgtataatccagaaacagcatcatttggtatttcccattctatggtagctaaaccatgcaaggaactattatctactttccacctgaaaaacaagcttaaatcatcatcatcgtatacagaaatccatctttcctcttgaagcctctccaccactgcaaatgagccttctgtcagaaggtcatatcttggattggaactccagaatgtagccttggtgtatctccctttgtaaaatagcctctttttggtaaggctttgtcttacttgagtaagaagctgatttgtacagatgagagatcaagtggagaaggaccttttatagtgatgttctctcctttagccattgcctgtgctagtttcttgaattcttggatgtatgctgataatgtgaggaccatacagtgttgaagcagcctgcaaatcatattattacttattagtaataatttagatatagtttgtctcgaaggtaaagcctaaaagctatggtagcatgtgctgcttgcttatgccagatacaagtatggtataatgtcagggtcataaagaacacaagtgcatgtttgcatatgattaattttgggaaataattgttgtttttcctaaaactctttgatttatttcttcataataaactgaagcaaacacattaaattaatccaagctttgataaatta

SEQ ID NO: 5543 - DNA, 9271 bp, Glycine max
atggaagattcatccatgcattccttatgttttgaaggttgtttgtagatccagaaaccaagccaaagatgaagggcaaaagagtaatttttgcaatattttagagcaccattcgcccaggctagtaaccaacttgcctgggctagtgaagtttcttcaaccttaagcatttgactcgtctgggtgagtacaacttgcctgggtgagtggaatgtcttcagccttaagcaaccaactcgtctgggcgagtacagctcgcctaggggagttggtttgacaccttttcactcattttctttaaaagccatgcaaaccaacagcaacaaggtgtgggtgcaaaaactaagaaggattggatgtaatctttgtatccttatgtatttcttttgatattttatgtatgtatgaatcttttctactcattattggtgatttcattctgtttataatgcttgattctatttgactggaaagtactcttagaatttgaactaaatgaatttactctttacgttaggttgctaggaataaagcatgacgttttgattacaaataacacgagattatgattgtaatgctgggatatttatttaatatatgaggaatcaatatttggttaatattcttaggattttcgaatgtgaggaatcgatttggggagatttaatgtgtgcatgagtgatgttagaaaatgattcatatgtattaatattatttggatactgagggtatgaatgatgaaatccaatcctacgtttttcttggattaattaaatcctttttaattatttttgtaattttaaatatttctgacaaattaatttcgttgtttctgttatttccgctattctgtgactttcattattttcgtttaacccatgatatttcgattgaagttgttgtatataactattgaactatttacttttatctggagtatgttcaatgatggttttagtagactccttaaccccgaacgtggttaaaagttcgacgtgaccacggactacaacttgttcccccacaaagtcaatcaagactccatcaaaatagttgcaaaatgtcaatatgtatttgcaatcccacaaatgattcccaaaatattacattggtcgagctcctttgacctactaagatcctcttgacattgcagctcatcattatgattgaaataacaattgaatcatcattgtgaggcattatgcttttacaatcctagtcagaaaagttgataaagtacctgaaacacactagaagggggggtgaatattgtgatggataaaaactttgtcttttaaaaactttgaaagcttttcttaaacagatatcaatggacgataggtttcatccaaggggttcgaaatcactttgtacttaaaaactagttcacaaaacttggacacaataatgtagaagtaaattataggaaaaaaactagttatatagaagtagtaaacaaaacacaaagattttatattggttcaccttaaaacttgaagggttccactaatcaaatatttgattacaaccaagtattctctatgccacttctagctataatgagtactctctaggccactcctgacaccacccttaatctccccttaagattaagacacaagtattttttgtcactaagtcactcttggctttcacaaataatatatgtttgatagaaaatatactctaataactcaaagagtgtttacacaataagctcaaatacaatgaaacttactagcttagtagagctaaggttcacttatttcggtcaagtatctttcgtccaactaaactgatagtgttacaacactttgttcattttttactcaaatgattgtctagtggttcgacctctttatcacaaacatcttcaagttttatatagacttcagagctttgatccattgagagatcccagttagccattgtctaatagcttaagcgctttacatgaggcacattattgtgcaaagcataagtggggggaccacaaacatcttatgtatcaaatcttcatagaagtacaacttgccagtgtcgccttgtgctcaaagatgacatttggcatacaattcaaatacaatgttaaaaacatagaacaaaaggaattaagaatgtcaagacaagacaatttaaaacttcccttttgtgcactatggcatgaattgcttactgaatcatgaatgttactttcagattattacttttagtacttgagaatcaagtaattattctacttcctttggactatgagccaagtgctaaagcacttgtcttcttaggactggatgttgaggtagtattgtccaatgactgattctttagccatcatctaaagcctttctattcatgctttctacttgtatctcatagagatagataaacctgtagcttaagcataaaagataaacacataaaatttatactttgttaacatcaaaaccttagggatttaattatttggtacaatccaatatgacttggacacaacgagacttaatagttgacgattgcccaagaggcacttaaatgtgtcaagatagcatcaggatacccttgagccatcgggtatcattgatactctacatgtgcctaaggcaataactatcgccctttctattccatgcaaccctcaatttggggtaatcccatttttgttttggctttgagttgaatgaccctacttctctatcactatccccaacctccctctttttctcaatgaacttttctacctttatgtggcaagtcacctagaccttatccccaccatcgacttggctcttttgtggaccaaggactccttaagctgactcgcctctagtccttgacaaatgcaatgacaaacatttcattagggtccaacactctaacaatgatgttgttgaacttattcaagtactcctttagtgtttcatcggggtattgctttatgtcgaacaagtcaataacctttggaggttttcacttgtagacaataaattgggtgaggaaaatcttggagaagtcatcaaaagaatggatagagtggttaggaagtctattgaaccagtccaatgttgttgctgccacactgccaacaaacatcttgcatttgatcatgttggacacactattatcaacactaggcactgttagtcgatgaatacgactaacttttgtgtataaaacctgtgtaaattgtatcaaactcctccaatttatggttagtttgcagtgttgtaattactttttgttaaagataggtaatacatacttagtattcacattttgtgtgtttaataatcatttcctctcaatttcaggttaattatgcaagtttgtgaagtgatgattttcatcctctcgctaagccaatcttctggcttagcgagccatccgctgaacgcaacactcctcgactgagcgcaaggaagaatctggaaagaatgatgagttgtgcatttgcgttgagcgaagggtcatcccgctaagcgcaccgcttcattccatccgctgagcgagaaaagcacgcgctaagccgaaatccactaatgtgcgctgagcggtccatagtcacgctaagtgcgctagcacaaacaaagtcacctatttaagcctgaaatcagattttggagaggattttggccatttttctcaaagagcttctgcatgtgagagattctagagagagaaaggtctgaatccagagagttttgagagcttttgctgtgcgaagacctgcagagaactgagcgagaagaggaagtcatcctgagagcataagatgagtctatgagtgattgtgaggttctagaggtggaggagacatccccactacttgtatttcttcaatccttcatttttctcttctctttgttgtaaaggaagcttcccaattatggagagctaaatcctctgttggttcttccttataggtacttgacataaatacttgtatatctatttaatgatgttttatgtgttctctgtgctatcagtacgtcatttcagtgtgcttttgccttgatcacgtagatgcatgatttgttaggatcatttaatagtggaaactggtctgattcttagagcttgataggacaaggctagtttatcgtattatcacgagggattggggtacgataacctagttgtttgtatgtttgtcttaatgcggttctggtcaagtttagtccaacaagaggaatctaaagacgatgcttgatcaggattaggctagactatcatgaggaatcagggtttagcatttcatgagacaccatagaacgcatgagcattgttaagtagagaatatccttttaacatcagacacctaataggaataccaacgtgttgtctacttgtctttacacatcattactcatgtgattttccttttaatagttagtttacatacttgtgcatagttgacacatctcttttcatactagacacctattcactgaatatagctttaccaagtaacacaagttccccgagagttcaatactcaattcttatcgttttatactacttgtgcgatccggtgcacttaccgagttcgaataggcacgaaacatcttgaagtggtcattttgatcctgggtgtttttgcaaggttcctactttggaacgatgtaatgtaggggtatgaattccacatctatatgttgattgaaggctcatccttgtggtttaatttttttttttatcatcaccacatgaaaagatagcacctgaaatcattaggcaaaaaaggacctttacaatctatttcaggatcaaagggttgtaaatcacctggattgcccctagtcatgcactatatgcagcaaataatgtgtttctcaacaagcacctaacaagggggtaaaattacagctatactcaaacgatatccaaataagctgaaattttgtgaggaacaccctaaaatcatgaaaatatagcacaaaaaatttcaaacagaaattcaaagtctaactatgaaaactacctaagcaaagtttagaaaaataagacaaaattacttgaaaaataaaaaaaaaaacttagtaaacagctgatttttggtgtttgggagaccccaaccagctaaagcgggtttccatagtatggggaatttttttctaccccaaatgcatatataataatagtcattttgacacccggagcaaaagttatggccgttttaagttttgctaaaaacaagttcccaaaatttttgtctctctcaaatactgtcacactaagtgctcctagtatttttcacacaaaatatggatcaaaagaagctaccacacaaaaaatctgccaaaaataacaactctaactatcaaaacaaaaattgctaattaaattgcaaaatcagtcgctaattccagtcgttaatcattgttcacagcaaaacacaaggctgaatcagttgctgaaacaatctctaaaatcagttgctaaacaggggacacgactgaaatgcaaaacagaacgctacacaaaacaagacaactaaacactattatgaacctttgacccactgctcctcggcaacaacgccaaatttgatcgaggccgtacccgaatcaaataaacattaaaaatacagtatctaggaagtgatcatagatcatctcccaacgagcaatggccaaccaaatgttcataacagatagtaagaaaatagtaacgaattgggggggattgtttatttttgtaaattaaacagcgaacaaattttaattagaaaataacagaattaagacatgttgtttccccttgatttacaagcaagtctcttatcctaggttacgaggatttatccttcatcagttcaaccacttaatccaaccctaaattaaattactaagcgaaatttaatataaggctgtcattatgtgattaagcaacacatacaccaattaattatgaacgaaactggtcattaagcatgaacgtaaattaagcgcaaagacaattaatcaagcactaagcatgcatggattaatagcaacaaatatagagtaattggtgaagaggaaaaactgatcaacattcaatagtaataataaaacctcaaagagagttgtgtttgatcctcaagagaaaacaacgctggagacttagccttccattaattagtagaaaacgaaattgtaatagaaaacgaagaaaactaaaattattctcctctctccaacgaaaggggagcctaaaactaaaacctttgtgctgttatataagttctcagcccagcctcaaagcttacaaatctgttttaagtccaaacccgtaaataaaataaaatctggacaagataagataagatacttatttaattaatattaatgtaatgacatgattgtataactagcttcattttttttgttatgttaaggtttaagttttttcaaatataagatataaaatttttatgttttatattatttagtcatttgaatttaattagttgcatggaagattcatttttatattatataaaatctaagaacttaaaatatattaaatcctcttcaataatagacttaaatattttttttttcgtgtaatttagtaatttttttaattttgtctatgtaattttttgttttgttttaatcattgtaaaatgtattttttttcttaaagtgttttagataatattttgaacaataaaaaaataatttgaacagtgaaaaatagatttttgatgaaaaaaaaaacatatttttataaagacaaaaacaaaaaaaatgaaaaaatgaaaaaaaaaaaacactaaattggaatggctaaaaatgtatttaagctttaataacatgcactacattacatggcttaaatacatttccgcatggcttaaatacatttccgcaatcttgatttttttgtttttcatacctataattttttttttgttttaatctttacaaaatgattattttacttttcgttcttaaaatatttaatataacgtaaataatcattgttcaaaatattttttttattattcaaagtgttataaaaatattgtaagaagaaaaaacaaaataaatatattttaccagaattaaaataatttattttttcaaggacgaaaataaaaaatattaaattataggaaaaaatatattaaaaacttattaaattaacaattcaaaatattaatgctcgtatattgttagagttgcggtttcactgatgacccggaggcccaagtccgtttatcaaactctatgtgtgagtagcatgttccaacaactcagctttttcagaacagccattactaccactgttcgctatgaaagatgacaaacaggctccagttcctgcttctacaaccgaaggacaacctatacgatgtaaagcggcggtttctagaagagctggtgagccgttggttattgaggacatcattgtggcgccgccaaagcctcgtgaggctcggattcgtattatttgttcctctctctgccacagcgacatcacacttcggaaccttcaggaccctcctgccattttcccaaggattctaggtcatgaggcaactggggttgtggaaagtgttgggaaggatgtaactgaagttacaaaaggtgatgtggtaattccagttatcctaccagaatgtggggagtgcatagattgcaaatcaaccaagagcaaccggtgcactaattttcctttcaaggtgtctccttggatgcctcgagatggcaccacaagattcactggccaaaatggagagatcatataccatttcttgtttatttcaagtttcagtgagtacactgtggtggacattgctaatctgataaagattgatccagaaattcctcctgacagagcatgccttctcggatgtggtgtttcaacaggggtaggtgctgcttggagaactgcaggtgtggaacccgggtcaacagtagctatttttgggttgggatctattggattagctgttgcagagggagctagactttgtggagcaactaggattataggtgtggacatcaacccagaaaagtttgaaattggaaagaagtttggagtcacagactttgtcaatgctggagaatgtgggggcaaacctgttggccaggttatcatagagataactgatgggggagcggattattgctttgaatgtgttggtatggcatcattggtgcatgaagcatatgcttcttgtagaaagggttggggaaaaacaattgttttaggagtggacaagcccggagctaggataaacctcagttcttacgaggtccttcatgatggaaagagcctcatgggatccttatttggaggtctcaaacccaagtctcatgtacccattctccttaaacgttacatggacaaggaattgcagttggataaatttgtcactcatgaggtggagtttaaggacatcaataaagcttttgatttattgagtaaaggagagtgtcttcgatgtgtgatttggatggataaatgagtacattgttatgtattcctagtccttgaatcatgatttgcaacatgaaaatgttgaagtgtgctttttccctttcgtatttgattaaaacttattcaataaagcagagctgctatcgtattgcactgcaaatgcacttgaagccagtaaagtaattaataggggagataatagtggtccttgttgctccaaagtgttttagtctgtataatccagaaacagcatcatttggtatttcccattctatggtagctaaaccatgcaaggaactattatctactttccacctgaaaaacaagcttaaatcatcatcatcgtatacagaaatccatctttcctcttgaagcctctccaccactgcaaatgagccttctgtcagaaggtcatatcttggattggaactccagaatgtagccttggtgtatctccctttgtaaaatagcctctttttggtaaggctttgtcttacttgagtaagaagctgatttgtacagatgagagatcaagtggagaaggaccttttatagtgatgttctctcctttagccattgcctgtgctagtttcttgaattcttggatgtatgctgataatgtgaggaccatacagtgttgaagcagcctgcaaatcatattattacttattagtaataatttagatatagtttgtctcgaaggtaaagcctaaaagctatggtagcatgtgctgcttgcttatgccagatacaagtatggtataatgtcagggtcataaagaacacaagtgcatgtttgcatatgattaattttgggaaataattgttgtttttcctaaaa

SEQ ID NO: 5544 - DNA, 1370 bp, Cicer arietinum
gatattttcatagtatcaaaaagccggttcaaagacgcacgaaaatgaaagtcacgtttccaacttcaactaccccaagtacgagttcactgagtgttattctcaactctaaactaccgttcaaacattgcactgtgacaaaaccagacactccttttgttgttgatgcgccatggaacataaactatcaacaacaagtgatcaaggagagggacaacctataagatgtaaagctgcggttgcaagaaaagcaggtgaagcattggttatagaagaaatcatggtggccccaccaatgcctcgtgaggttcggattcgtattctatgtacatctctctgccacagtgatatcactctctggaagatgcaggaacctcctggttgttttccaagaattctaggtcatgaggcagttggggttgtggaaagtgtagggaaggatgtaactgaagttacaaaaggagatgtggttattccaattttcctacctgattgtggggagtgtttagattgcaaatcaaccaagagcaatctttgtactgatttcccattcaaaatttctccttggatgccaagacacgagagcactagattcactgacctaaatggagagatcatataccatttcatgtttgtttcaagtttcagtgagtacactgtggttgacattgccaatgtaacaaagattgatccagaaatccctcctgacagggcatgtcttctcagttgtggtgtatcaacaggggtaggtgctgcttggagaacagcaggggtggagccagggtctacagtggctatttttgggctgggatctgttggattagcagttgcagagggagctagactgtgtggagcaactaggattattggtgtggatgttatccctgaaaaatttgaaattggaaagaaatttggactcacagactttatccatgctctggaatgtgggaacaaacctgtgagccaggtgatcatagagatgaccaacgggggagcagattattgctttgagtgtgttggtacggcatcattggtgcatgaagcatatgcttcttgtagaaagggttggggaaaaacaattgttgtaggagtggataagccaggagctaagttgagcctaagttctagtgaagtccttcatgatgggaagagcctcacgggatccttatacggaggactcaaacccaaatctcatgttcccattctgcttaaacgttacatggacaaggaactgcagttggataaatttgtgactcatgaggtggagtttaaggacatcaataaagcttttgatttattgaacaatggacaatgtcttcgatgtgtgatttggatggacaaatgagtttgttcttatgtatcctagtcct

SEQ ID NO: 5545 - DNA, 1184 bp, Lotus japonicus
actcatcttgtgttttcgccatggaagataaactagcaagaacaagtgaaggacaacccataagatgtaaagcggcggtttgtcgcaaaccaggtgaaccacttactattgaggagattatggtggcgccaccaatgcctcgtgaagctaggattcgtattatatgtacatctctatgtcacagtgatatcactttttggaagattgaggaccctcctgcaatttttccaagaattctgggtcatgaggcagttggggttgtggaaagtgtaggagaggatgtaactgaagttacaaaaggagatatggttgtcccaattttcatacctgattgtggggagtgtgtggattgcaaatcaaccaagagcaacgtttgttcaaagtttcctttcaaggtgtctccttggatgcctagatatgataataccactagattcacagatctaaaaggagagatcatacaccatttcctgtttgtttctagttttagtgagtacactgtggttgacattgccaatctaaccaagattgatcctgcaattcctcccaacagagcatgcctcctcagctgtggtgtatcaacaggtgtaggtgctgcttggagaacagcaggtgtagagccaggttctacagtagctatttttgggttgggatgtattggattagcagttgctgaaggagctagactttgtggagcaactaggattataggtgtggatgtgaacccagaaaaatttgaaattggaaaaaaatttggactcacagattttgttcatgccggagaatgtgaaaagaaatctgcaagccaggttattatagagatgactggtgggggagcagattattgctttgaatgtgttggtatgacatctttggtgcaagaagcatatgcttcttgtaggaagggttggggaaagacaattgttttaggagtggacaagccaggatccaaattgatccttaacagtagtgaggtccttcatcaagggaagagtctcatgggatccttatttggaggactcaaacccaagtctcatgttcccattctccttaaacgttacatggacaaggaactaaggttggatgagtttgtcacacatgaggtggagtttaaggacatcaataaagcttttgatttattgattaaaggacaatgtcttcgatgtgtgatttggatggacaaa

SEQ ID NO: 5546 - DNA, 1169 bp, Vigna unguiculata
gggatccaatccaaccaaagaagttcagtcaataacggcaacaaaagtctttgcttccattcacgatggcgttgcaggagaagttagacaagttcaagaagcagcaagagaagtgccagacgacactgtcaagcattgcagcaagcaaggccgcagcaagccaaaaatctgcctcacatggctcggccaatggaaaaaacgcgccccatccagttaagttttcgaacgacaccgagaggcttcagcatattaacagcatacgtaaagccccggtgggtgctcagatgaaacgtgttattgatctccttctagagacaagacaagctttaacaccggagcagatcaaccaggcatgctacgttgacataaaggctaacaaagatgtctttgagaatcttaggaaaaacccgaaagtaaattatgatggccaacgattctcttacaagtcaaagtacggtcttaaggacaaaacagaacttcttcaactgatacgtaagtatcccgagggccttgctgttattgacttaaaggatgcttaccccactgtgatggaagacttgcaggctttgaaaggtgcggggcagatttggctgctgtccaactttgattcacaggaagacattgcctaccctaacgaccccaaattgcacattaaggtggatgatgatctaaaacagcttttccggagtattgaattgcctcgtgatatgattgatatagagaaggatcttcagaagaatggaatgaagcccgccaccaacactgcaaaaaggaggagtgcagcacaaattcaaggcatttcttccaagcccaagccaaagaagaagaagagtgaaatcaacaagagaacgaagctgaccaatgctcatcttccagagctttttcaaaacttgaacaattcctgattagctctcgactagtgttggattagttcaaaaatagattagcagactgaaatagtcaggaggttcttgctgctccgtcctactcttatttgtttacaatttttattttttattttatacatcaaggctgcagctaatggactgttgtgtatcaacttgtaataatttgtgaatctttgtatattaaaactgtgttgtatttatttacctagtcttgtaactctatacattaattagtagatctaaagttcaattcctttattc

SEQ ID NO: 5547 - DNA, 1326 bp, Glycine max
ttggaaagtaaaagcttaaagtctatccagaacacaagacaagacagtaacggcaaagtccttgtccttgcttccattcacgatggcgttgcaggagaagctagacaagttcaagaagcagcaagagaagtgccaaacgacactttcgagcattgcagctagtaaggccgcggcaacccaaaaatccgccgctcatggctcggccaatggaagaaacgcggcccctgcggttaagttttcgaacgacacagagaggcttcagcatattaatagcattcgcaaggcccctgtgggtgctcagatgaagcgtgttattgatctccttctagagacacgacaagcttttacaccagagcagataaatggggcatgctatgtcgacatgaaggctaacaaagatgtctttgagaatctgaggaaaaacccaaaagtgaactatgatgggcaacgattctcttacaagtcaaagtatggtcttaaggacaaaacagagcttcttcaactgatacgaaagtatcctgagggcctcgctgttattgacctaaaggatgcttaccccaccgtgatggaagatttgcaggctttgaaagctgcagggcagatttggctgctatccaacttcgattcacaggaagacattgcctaccctaacgaccccaaagtgcacattaaggtggatgatgacctgaaacagcttttccgcagtattgaattgcctcgtgatatgattgatatagaaaaggatcttcaaaagaatggaatgaagcctgctaccaacactgcacagaggaggagtgcagctcaaattcaaggcatttcttccaagcccaagcctaagaagaagaagagtgaaatcagcaagagaacgaagcttaccaatgcccatcttccagagctctttcagactttaaacagttcctgattaactctcagcaagtgttggtgtagttcaaatagatactttatcagccagtctataaactagattagcagagtgaaatattcaggaggttcttgctgctgtgccctacttttaatttctatacatcaaggctgcagctaatggactattgtggtctataacaactcgtcttgtgaatccctgtatattaaaatcatgttgcatttagttttctagtcttgtaactttttatacataaattattagattggaagttcaatttttttcttcaacttatctaatgagcttaagcagctgtatgtttaacatgggatagtaacctacccaatgtttcaaaagtggacttggttaaaaataccccgaattcaacgtaactcggtaatagtcctattaagctttgttta

SEQ ID NO: 5548 - DNA, 1297 bp, Glycine max
ttggaaagtaaaagcttaaagtctatccagaacacaagacaagacagtaacggcaaagtccttgtccttgcttccattcacgatggcgttgcaggagaagctagacaagttcaagaagcagcaagagaagtgccaaacgacactttcgagcattgcagctagtaaggccgcggcaacccaaaaatccgccgctcatggctcggccaatggaagaaacgcggcccctgcggttaagttttcgaacgacacagagaggcttcagcatattaatagcattcgcaaggcccctgtgggtgctcagatgaagcgtgttattgatctccttctagagacacgacaagcttttacaccagagcagataaatggggcatgctatgtcgacatgaaggctaacaaagatgtctttgagaatctgaggaaaaacccaaaagtgaactatgatgggcaacgattctcttacaagtcaaagtatggtcttaaggacaaaacagagcttcttcaactgatacgaaagtatcctgagggcctcgctgttattgacctaaaggatgcttaccccaccgtgatggaagatttgcaggctttgaaagctgcagggcagatttggctgctatccaacttcgattcacaggaagacattgcctaccctaacgaccccaaagtgcacattaaggtggatgatgacctgaaacagcttttccgcagtattgaattgcctcgtgatatgattgatatagaaaaggatcttcaaaagaatggaatgaagcctgctaccaacactgcacagaggaggagtgcagctcaaattcaaggcatttcttccaagcccaagcctaagaagaagaagagtgaaatcagcaagagaacgaagcttaccaatgcccatcttccagagctctttcagactttaaacagttcctgattaactctcagcaagtgttggtgtagttcaaatagatactttatcagccagtctataaactagattagcagagtgaaatattcaggaggttcttgctgctgtgccctacttttaatttctatacatcaaggctgcagctaatggactattgtggtctataacaactcgtcttgtgaatccctgtatattaaaatcatgttgcatttagttttctagtcttgtaactttttatacataaattattagattggaagttcaatttttttcttcaacttatctaatgagcttaagcagctgtatgtttaacatgggatagtaacctacccaatgtttcaaaagtggacttggttaaaaataccccgaattcaacgtaac

SEQ ID NO: 5549 - DNA, 1400 bp, Cajanus cajan
gcttccatttgaggttagcgtctctctctttctcacctggctatctgcaattcgctacacaccatcgctacttcttttcaactttcctttccttgcaaaattagggcattcaaaactcaatactcactacttaccttactgcacgctattaggattagggttttgcccaattcgaatttcaaagtgagcaaccaccgtgtgcgtgtttggatcttcagatggcgttgcaggagaggctagagaagttcaagaagcagcaagagaagtgccagaccacgctgtcgagcattgcagcaagcaaggccgctgcccaaaaatctgcctccgcctcggccaacggaagaaatgcggttcctccggttaagttttccagcgacaccgagaggcttcagcatattaacagcatacgcaaatcccctgtgggtgctcagatgaagcgtgttattgacctccttctagagacacggcaagctttgacaccagagcagataaatgaggcgtgctatgttgacatgaaggctaacaaagatgtctttgagaatttgaggaaaaacccgaaagtaaactatgatgggcaacgattctcttacaagtcaaagtatggtcttaaggacaaaactgagcttctacatctgatacgaaagtatccagagggtcttgctgttattgacctaaaggatgcgtatccgactgtgatggaagacttgcaggctttgaaagctgcggggcagatttggctgctgtccaactttgattctcaggaagacattgcctaccctaatgatcccaaagtgcatattaaggtggatgatgatctgaaacagcttttccggagtattgaattgcctcgtgatatgattgatatagagaaggatcttcaaaagaatggaatgaagcctgccactaacactgccaagaggaggagtgcagcacaaattcaaggcatttcttccaagccaaagcctaagaagaagaagagtgaaatcagcaagagaacgaagctgaccaatgcccatcttccagagctttttcagaatttaaacagttcctgattaactctcaactagtgttgtattagttaaaatagaaacttatcagtcagtctaaactagattagcagtgtgagaaatattcaggaagttcttgctgctctgccctactcttatttgttttcaatttttatacatgaaggctgcagctaatggactgttgtgatctgtgtaataactcgtattaatttgtgaatccttgtatattaaaaccatgttataattaatgtccaaatcttgtaactttatatacaaaaaatactagatcgaaagttcaaatttcttttctttcaattcattaagtgaaacaaaagctgcactttgttcaacttgagattgtaacctacccca

SEQ ID NO: 5550 - DNA, 1260 bp, Glycine max
actagaaggagcacaagacacaataataagtggagactctattgtaagttctaacagcactgagtaacggcaaagtccttgctggttgcttccattcgcgatggcgttgcaggagaggctagacaagttcaagaaacagcaagagaagtgccaaacgacactttcgaccattgcagctaccaaggccgccgcggcaacccaaaagtccgccacacatgcctcggcaaatggaagaaacgctgcccctgcggttaagttttccaacgacaccgagaggcttcagcatattaatagcattcgcaaggcccctgtgggtgctcagatgaagcgtgttattgatcttcttctagagacacgacaagcttttacaccggagcagataaatgaggcatgctatgtcgacatgaaggctaacaaagatgtctttgagaatctgaggaaaaacccaaaagtgaactatgatgggcaacgattatcttacaagtcaaagtatggtattaaggacaaaacagagcttcttcaactggtacgaaagtatcccgagggccttgctgttattgatctcaaggatgcttaccccactgtgatggaagatttgcaggctatgaaagctgcagggcagatttggcttctgtccaacttcgattcacaggaagacattgcctaccctaacgaccccaaagtacacattaaggtggatgatgacctaaaacatcttttccgcagtattgaattgcctcgtgatatgattgatatagagaaggatcttcaaaagaatggaatgaagcccgctaccaacactgcacagaggaggagtgcagctcaaattcaaggcatttcttccaagccaaagcctaagaagaagaagagtgaaatcagcaagagaacgaagcttaccaatgctcatcttccagagctctttcagaatttaaacagttcctgattaactctcatcaagtggttgtgtagttcaaatagatactttatcagccagtctaaactagattagcattgtgaaatattcaggaggttcttgctgctgtgccctacttttatttgtttttttattttattttttttatttctgtacatcgaggctgcagctaatggactattgtactcgtcctaatttgtgaatccttgtatattatcatcatgttgcatttaaatttttagtcttgcaagtttatacaaattattagattggaacttggaagttcaattcttttttcttcaactctatgtttagcttgagatagt

SEQ ID NO: 5551 - DNA, 1252 bp, Glycine max
ggagcacaagacacaataataagtggagactctattgtaagttctaacagcactgagtaacggcaaagtccttgctggttgcttccattcgcgatggcgttgcaggagaggctagacaagttcaagaaacagcaagagaagtgccaaacgacactttcgaccattgcagctaccaaggccgccgcggcaacccaaaagtccgccacacatgcctcggcaaatggaagaaacgctgcccctgcggttaagttttccaacgacaccgagaggcttcagcatattaatagcattcgcaaggcccctgtgggtgctcagatgaagcgtgttattgatcttcttctagagacacgacaagcttttacaccggagcagataaatgaggcatgctatgtcgacatgaaggctaacaaagatgtctttgagaatctgaggaaaaacccaaaagtgaactatgatgggcaacgattatcttacaagtcaaagtatggtattaaggacaaaacagagcttcttcaactggtacgaaagtatcccgagggccttgctgttattgatctcaaggatgcttaccccactgtgatggaagatttgcaggctatgaaagctgcagggcagatttggcttctgtccaacttcgattcacaggaagacattgcctaccctaacgaccccaaagtacacattaaggtggatgatgacctaaaacatcttttccgcagtattgaattgcctcgtgatatgattgatatagagaaggatcttcaaaagaatggaatgaagcccgctaccaacactgcacagaggaggagtgcagctcaaattcaaggcatttcttccaagccaaagcctaagaagaagaagagtgaaatcagcaagagaacgaagcttaccaatgctcatcttccagagctctttcagaatttaaacagttcctgattaactctcatcaagtggttgtgtagttcaaatagatactttatcagccagtctaaactagattagcattgtgaaatattcaggaggttcttgctgctgtgccctacttttatttgtttttttattttattttttttatttctgtacatcgaggctgcagctaatggactattgtactcgtcctaatttgtgaatccttgtatattatcatcatgttgcatttaaatttttagtcttgcaagtttatacaaattattagattggaacttggaagttcaattttttttcttcaactctatgtttagcttgagatagt

SEQ ID NO: 5552 - DNA, 1264 bp, Trigonella foenum-graecum
aaggtgccgcaaactccgtcgttatccgtaaacggtgaagttattcgtgcgattttcaaacatttgttgaaagatggctttgcaagagcaactagataggttcaagaaacagcaggagaagtgtcaatcgacactttcgaacattgcgtcgagcaaggttggtggtagcagaaaagctactactccggtggctgcacatgcatctgcaaatggaagaaattcaacaagtagtgtcaaattctcgaaagatactgagaggcttcagcaaattaataatatacgaaaagcacccgttggtgctcagatgaagcgtgttattgatctattgcttgagacacggcaagcttttacaccagagcaaataaatgaagcatgctatgttgacatgagggctaacaaagatgtttttgacagtctgaggaaaaacccaaaagtaggctatgatggacaacggttctcttacaaggcaaagtatggccttaaggacaaaaccgagcttcttcgactgatacgtacgtatccagagggcattgctgtttttgacttaaaggatgcttaccccactgtgatggaagacatgcaggctttgaaagctgcagggcagatttggctgctgtccaactttgattcacaggatgacattgcatacccgaatgaccctaaagcgcacattaaggtggatgatgacctaaaacagctatttcggagtattgagttgcctcgtgatatgattgatatagagaaggatcttcaaaagaatggaatgaagcctgctaccaacactgcaaagaggaggagtgcagcacaaattgatggcatttcttccaagcccaagcctaagaagaaaaagagtgaaatcaccaagagaaccaagctgaccaatgcccatcttccggagctttttcagaacctaaagtaaacaatttctgattaactcactgcaagtgaagtatttgttcaagtagataatttgttagcctaagctagatcagcaggttgaaaatattcaggaggttcttattgctctgccctacttttgttgatatttgtttttagtttttatacattaagtgtgtaagctaatggtggactggtgtgatctaattacaattctagaaataaactgtgaaactgtgtatactaaagacttgtttgatattttattttcagcctgaaactatcaggagtgggtttggtagaaaataccctaaattcacactgagctataaaaaagtcctattaaaactttgattttgtggatgtt

SEQ ID NO: 5553 - DNA, 1460 bp, Medicago truncatula
aaaaaaagaaaatagaataacaaggaaaaaaactgcaaagactttctttttctgcattccttcatccatatcgaaaaatctgtgacgaactcaatcacgatggcgttgcaaggaaagctagatagattcaaaaagcagcaagagaaatgtcaatcaacactatcgagtatagcagcaaacaaggctgtatctgcatctgtgccaaatgctcttgctccggtcaaattttcgaccgatacggagagacttcaacatattaatagtattcgtaaagctcctgttggtgctcaaatgaagcgtgttattgatcttctttttgagactcggcaggctttaacattggagcaaataaatgaaacatgccatgtggacatgaaagctaacaaagatgtttttgacaatatgaggaaaaatccaaaagtaagatacgatggagaaagattctcttataagtcaaaacatgctcttcgggacaaaaaagagctgcttttcctgatacgcaaatttcccgagggcattgctgttattgacttaaaggattcgtacccaactgtaatggaggacttacaggctttgaaaggtggcagggagatttggctgctgtccaactttgattcacaggaagacattgcctaccctaatgatcctaaagtgcccattaaggtggatgatgacctaaaacagctttttcgtgggattgaattgcctcgtgatatgattgatatagagagggatctccaaaaaaatggaatgaagcctgctactaacactgcaaagaggaggagtgcagcacaaatggaaggcatttcatccaagcctaaacctaagaaaaagaagaacgaaatcaccaagaggaccaagctgactaacgcccatcttccagagctttttcagaacttgaacaactcctgatttaagtaactcagcgtgtgttgggcgaattctcgtagtttatttagtggtgtaaaaatgataatgtgtttacagagatttcccattgtccagaaggatgtatctttattattgtattagcttactgcctcaggttttgtgcatatttgttttgttgaagaaacaacttttcgtagtgggggacacattgcaaattcagggtattccttccaggattaaacaagattcttaagcaaaagggcaaaggtggccaaaacccctcttctagtggtttttctaaactcaaggtcgtatcatttaaatcaagggctgaaaatggcggaccaggttagccaactaagtcatttagcagagtgaaaacattgtccctctcattcttaggtcctacttctggaaatgaataatgaattatattgtttgttgcctattggtgagaataaagacttccatgtaattttattatggtcctgaatttcagaatgatgtaattttattgaacacatgtatgaaatgattatatacgcacataattttgaattttatacgca

SEQ ID NO: 5554 - DNA, 1439 bp, Medicago truncatula
ataacaaggaaaaaaactgcaaagactttctttttctgcattccttcatccatatcgaaaaatctgtgacgaactcaatcacgatggcgttgcaaggaaagctagatagattcaaaaagcagcaagagaaatgtcaatcaacactatcgagtatagcagcaaacaaggctgtatctgcatctgtgccaaatgctcttgctccggtcaaattttcgaccgatacggagagacttcaacatattaatagtattcgtaaagctcctgttggtgctcaaatgaagcgtgttattgatcttctttttgagactcggcaggctttaacattggagcaaataaatgaaacatgccatgtggacatgaaagctaacaaagatgtttttgacaatatgaggaaaaatccaaaagtaagatacgatggagaaagattctcttataagtcaaaacatgctcttcgggacaaaaaagagctgcttttcctgatacgcaaatttcccgagggcattgctgttattgacttaaaggattcgtacccaactgtaatggaggacttacaggctttgaaaggtggcagggagatttggctgctgtccaactttgattcacaggaagacattgcctaccctaatgatcctaaagtgcccattaaggtggatgatgacctaaaacagctttttcgtgggattgaattgcctcgtgatatgattgatatagagagggatctccaaaaaaatggaatgaagcctgctactaacactgcaaagaggaggagtgcagcacaaatggaaggcatttcatccaagcctaaacctaagaaaaagaagaacgaaatcaccaagaggaccaagctgactaacgcccatcttccagagctttttcagaacttgaacaactcctgatttaagtaactcagcgtgtgttgggcgaattctcgtagtttatttagtggtgtaaaaatgataatgtgtttacagagatttcccattgtccagaaggatgtatctttattattgtattagcttactgcctcaggttttgtgcatatttgttttgttgaagaaacaacttttcgtagtgggggacacattgcaaattcagggtattccttccaggattaaacaagattcttaagcaaaagggcaaaggtggccaaaacccctcttctagtggtttttctaaactcaaggtcgtatcatttaaatcaagggctgaaaatggcggaccaggttagccaactaagtcatttagcagagtgaaaacattgtccctctcattcttaggtcctacttctggaaatgaataatgaattatattgtttgttgcctattggtgagaataaagacttccatgtaattttattatggtcctgaatttcagaatgatgtaattttattgaacacatgtatgaaatgattatatacgcacataattttgaattttat

SEQ ID NO: 5555 - DNA, 1261 bp, Lupinus angustifolius
atgtttgataactattttttaagaagaaagaccttgtcataatgctatgttagctatagctaccaaacccaattgaacacagtcacggtggtgtgcaccgaagccccgttcctcctccgtccactcacgagatgtcattgcaagagagtttagagagattcaagaagcaacaagaaaagtgtcattcaacactttcaagcattgcaaatggaagaaattcagttcctcctcttccttctggtgttgctgttaaattctccaacgatacggagcggcttcagcatattaacagcattcgcaaagctccggttggtgctcagatgaagcgtgttatcgatctcttattcgagacccgacatgcttttacaccagagcaaataaatgaagcatgctatgttgacatgaaggctaacaaagatgtttttgacagtctgaggaaaaatccaaaagtgaagtatgatgggcaacgattctcttacaagtcaaagcataaccttaaggacaaaaatcagcttcttcagctgatacgcaagtttccagagggtattgctgttattgacctaaaagattcttacccaactgtgatggaggaccttcaggcttggaaagccgcagggcagatttggctgctgtccaactttgattcacaggaagacattgcataccctaatgaccccaaagtgcccattaaggtggatgatgacctaaaacagctttttcggagtatcgaattgcctcgcgatatgattgatatagagaaggaccttcaaaagaacggaatgaagcccgcgaccaacactgcaaagagaagaagtgcagcgcaaattcaaggcgcgtcttccaagccgaagactaagaagaagaagagtgaaatcagcaagaggaccaagctgaccaatgcccatcttcctgagctttttcagaacttaaacagttcttgacttgatgaagccggagtaagtgtttgattaagttcgcgtagattaatcggttgtgtaaaaatagatcctaaagcaggtagcagacaacattagcaaagtgaaaaagtatttaggtagcactgttagcaggcatcattagcagaatgccttgttcatccaaaaaaaactgtcttgagatttggttttaatctttgtaatttagtctttaaggctgtaggtaatgaatgaactatcaatgttgtggcctatgataaattagaattggtaacaaatggaaaccttgtttgacattttactgtggaattacaacacttttccca

SEQ ID NO: 5556 - DNA, 1884 bp, Cicer arietinum
cacttccgttcttcattgattacggaggagaaaaatctgtgacggactcacacgatggcgttgcaagggaagttagatagattcaaaaaacagcaagagaaatgtcaaacaacactatcgagcatagcagcgagcaaggcttcatctgtatctgcgtcaaaccctcctgttcctgtcaaattctcatctgatacggagagacttcaagtcattaacagtatacgcaaagcacctgttggagctcaaatgaagcgtgttattgctatcctttatgagactcggcaggctttaacgttggatcaaataaatgaagcatgctatgtggacatgaaagctaacaaagatgtttttgacagtatgaggaaaaatccaaaagtaagatttgatggagaaagattctcttacaagtcgaaacatgcccttagggacaaaaaagagctgcttttcctgatacgcaaatttccagagggcattgctgttattgacctaaaggattcgtacccaactgtgatggaggacttacaggctttgaaagctgcaagggagatttggctgctgtccaactttgattcacaggaagacattgcctaccctaatgatcctaaagtccccattaaggtggatgatgacctaaaacagctttttcgtgggattgaattgccacgggatatgattgatatagagagggatctccaaaaaaatggtatgaagcctgctactaacactgcaaagaggaggagtgcagcacaaatggaaggcatttcaaccaaacctaaacctaagaagaagaagagtgaaatcactaagaggaccaagctgactaatgcccatcttccggagctttttcagaacttaaacaattcctaacttaaggaactcatagtgcgtgttgggcgaattctcatagttcatctagtggcgtaaaattgataatgtctttagagagtctccacattgtctataaggatatatcttttttaattgtattagcttactgcctctggttttggaagtatccattttgttggagaaacaatttttcagagcggagggctcattgcaaattcagggtaatccttcgaggcttaatcaagattcttaagcaaaagggaaaaggtggccagagcccctcttctgatggtttttcttaactcaaggttgtattgttcaaacaaaaggcagaaaatggtcgttctcattcatatgttctacttctggaaatgaatagtgagtttgttggtgagaattaagagtatcacaattttcagagtgctgtcagtttgttgaacatttgtatggatcataatgttaaaacacctgcatgtaactttgaatattctacgcacaacacttgcatgtaaatttgcattatggctatgtttgaagtacttcaaaataaggaaataaaaatgtttacgaatgcaactttttagtccctctcatgagaaatagactattcacagatcccatcaagatttggttaagtttaatgcggacgaggcagaccaagtgacatctcacctcatcagcttgcacatcattaagtaatttgattttgcattttgatggctataggctgttgaactcatcatgcccagtcattctctttagatctattaattagaatctctaaatctgaaattttgagaaacattgatagagtataacgattacctaaaagatctaaaggaaaattgggggaagttcaacctgcaacaaggggttgggatcccttcctttttgtaagcttaaagcttgcatggtgcttagaaagggaaaaatactagatcgtctgactcatctttggggaggaggttgtgatgttctaggtgtggaatagaggtagcaaaatactattttgaatgaagtataaacaaaagtagt

SEQ ID NO: 5557 - DNA, 1217 bp, Medicago truncatula
agtgaagttcaaagtagagtcgagatttgctgccgtcattgattgcacacaaccatacagtgaaactgttcgtgcggttttcaaagttttggtgaaaaaatggctttgcaagagcaattagataggttcaagaaacaacaagagaagtgtcaatcgacactctcgagcattgcgtcgagcaaagttggtagcagaaaacctaatacgccggtggtggctacaaatgcatcagcaaatggaagaaattcaagaaccggtgttaaattctcaagtgatactgagaggcttcagcagattaataatatacgtaaagcccccgttggtgctcagatgaagcgtgttattgatctattgcttgagacacgacaagcttttacaccagagcaaataaatgaagcatgctatgttgatatgagggctaacaaagatgtttttgagagtctaaggaaaaatccaaaagtagaatacgacgggcaacggttctcttacaaggcaaagtatggccttaaggagaaaagcgagcttcttcaacttatacgtaggtatccagagggccttgctgtttttgacctaaaggatgcctaccccaatgtgatggaagacttgcaggctttgaaagctgcagggcagatttggctgctgtccaactttgattcacaggacgacattgcatacccgaatgaccccaaagcaaacattaaggtggatgatgacctaaagcagctgtttcggagtattgagttgcctcgtgatatgattgatatagagaaggatcttcaaaagaatggaatgaagcctgctaccaacactgcaaagaggaggagtgcagcacaaattgatggcgtttcttccaagcccaagtccaattctaggaagaagaatgaaatcaccaagagaaccaagctgaccaatgcccatcttccggagctttttcagaacctaaagtaaacaacaaccgctggttaactcactgcaagtgacgtatttgttcaagtagataatttgttagtttaagctagatcagcaggttgaaaaatattcaggaggttcttattgctctgccctatttttgatatttgtttttagtttttatacatcaagggtgtaagcatggtggactggtgtgatctaataacaattctacaaataaactgtgaaactgtgtaatactaaagccttgtttaatattttatttttcggcctgaaactatcaggag

SEQ ID NO: 5558 - DNA, 1052 bp, Lotus japonicus
atggcactacaacaacagctagacaaattcaagaaacagcaggagaagtgtcagtcaacactgtcgaacattgcagccaacaaggctgcaaaccgaaaatcttctgctccagtagtagctgcaccggcatcagccaatggaataaatccagcacctgctgtcaaattctcaaatgacaccgtgaggcttcagaatattcacaccatacgcaatagcactgtgggtcatcagatgaagcgtgtcattgagctcctgctagagacacggcaagcctttacaccagagcaaattaaggaagtatgctatgttgacatgaaggctaacaaagatgtttttgacagtctgaggaaaaacccgaaagtacactatgatgggcaacgattctcttacaagtcaaagtatggccttaaggacaaaacagagcttcttcaactgatacgaaagtttcctgagggcattgcgactattgacttaaaggatgcttaccccaatgtgaaggaagacttacaggctttgaaagctgcagggcagatttggctgctgtcaaattttgattcacacgacgaagacattgcctaccctaatgaccccaaagtgcatattaaggtggatgatgacctaaaacagctttttcggagcattgaattgcctcaagacatgattgatatagagaaggatcttcaaaagaatggaatgaagcccgcaaccaacaccgcaaagaggaggagtgcagcagaaattcaaggcattccttccaagtccaagcctaagaagaagaagagggaaattagcaagagaaccaagctgaccaacacccatcttccggagctctttcagaacttattcaattcctgatcaactcgaatcagagttttagattagttcacatagataatttgttagcctaacctagaacatactagtgaaaatgattaaggaggttcttatttccctactgttgatatttgtttttaattttcatacctaggctgcaagtaatggactgttgtgatttgaaacaactctagcaaccatttgtgaatccgtgtagt

SEQ ID NO: 5559 - DNA, 1476 bp, Trifolium pratense
ggcacgagggttattgcttcgagaggaggagaaaaagctttcacgatggcgttgcaaggaaagctagatagattcaaaaagcagcaagagaaatgtgcatcaacgctatcgagcatagcagcaagcaaagctgcatcatctgctgtgccaagtcctcttgttcctgtcaaattttcaaatgatacagaaaggcttcaacatattaatagtatacggaaagctcctgttggagctcagatgaagcgtgttattgatctcctttttgagactcggcaggctttaacattggagcaaataaatgaaacatgtcatgtggacatgaaagctaacaaagatgtttttgacaatatgagaaaaaatcctaaagtaagatatgatggagaaagattctcttacaagtcgaaacattcccttcgggacaaaaaagagcttcttttcctgatacgcaaatttccagagggcattgctgttattgacttaaaggattcatacccaactgtgatggaggacttacaggctttgaaagctggtagggagatttggctgctgtccaactttgattcacaggaagacattgcctaccctaatgatcctaaagtgcctattaaggttgatgatgacctaaaactgctttttcgtgggattgaattgcctcgtgatatgcttgatatagagagggatctccagaaaaatggaatgaaacctgctactaacactgcaaagaggagaagtgcagcacaaatggaaggcatttcatccaagcctaaacctaagaagaagaagaatgaaatcaccaagaggaccaagctgactaatgcccatcttccagagctttttcagaacttaaagaactcctgattgaagtaactcacagcgtgtgttgggcggattctcatagttcgcttagtggcgtcaaattgataatgtgtttagagagtcttcctgtcgtccttaagaatatatcttttttattgtattagcctactgccgctggttttggacgtattcaatttgttgaagaaacaatttttcagagcacattgcaaattcagggtattccttccaggcttaaacaggagtcttaagtaaaaggaaaaatgtgggcagagcccctcttctagtggttttatctaaattcaaggtcgcattgttttaaagtgcagaaaatggtgaaccagcaaccaagttatagcaaacttggtcatttagcagagtgaaaatattgagtatgttctcatttgtacgtccaacttctggaagtgaataatgatattttttgttgcctgttggtgagaattaagactatcacctctttcagagtgatgtaattttattgaaaatttgtattgatacttacatttaaacatttgcatgttattttgaatgttttactgttcaaaccacactttagaagtatacacaatcaatcatcatgtaaccaatccatcaaagaattcagttcttcttatttggctt

SEQ ID NO: 5560 - DNA, 1080 bp, Juglans hindsii x Juglans regia
  misc_feature (535)..(535): n is a, c, g, or t
tgcaagaagataaaaatatcagaaatctcaagcgcagctttgctctaaactctctcaaggtttatatggcattgcaagaacaattagataaattcaagaagcagcaagagaaatgccagtcaaccctcacaagcattgcagcatctaataaggccacaaacaaaaaatccacatttgtacctgcagcaccgtcagctaatgcaagaatccctgctcctgctgtcaaattttctaatgacacagagagacttcaacatatcaacagcattcggaaagcccctgtaggagctcagattaagcgtgttatagatctactgctagagaccaggcaagccttcacacctgagcaaataaatgaaacctgctatgttgacacgaatgccaacaaagctgtctttgacagtttgaggaataacccgaaagtgaactatgatgggaagcgtttctcttacaagtccaagcacgatctgaaggacaagactcaacttcttcacttaataaggaaatttctggagggcatagcagtcattgatcntaaagatgcatatccaacggtgatggaagacttgcaggctttgaaagctgcgggtcagatttggctgctatcaaacttcgattcacaggaagacattgcttacccaaatgatcccagggtgcccctgaaggtggatgatgacctcaaacagctgtttcggggaattgaactgcctcgtgatatgatagatatcgagagggatctacagaagaacgggatgaaacctgccaccaacactgctcaaaggagggcccggtcagaggttcatggcatttcctcaaagcagaagccgaagaagaagaagcacgagatcactaagaggacaaagctgaccaatgcccatctaccagagcttttccgaacctagagaatagtaattcctgaagttcggacgagcgttcggcgaaccttgaaaagaaaagatcaacagcaggcagatatatagcaaatgctcctatgtccactcgcatgggttatgttgtaggtatcaagtgttctggtactgataaatccaaattgattctctttccagatttgcatacaac

SEQ ID NO: 5561 - DNA, 1209 bp, Vigna unguiculata
gaaatttccgaaagtgtgttgtgtggggtgagaagacgatgaggaaatattggtagcagaaaattagagagagagagagagagagagagagttggattgattttcttcttcctttttctccaaagagaatctaatctcaatcctcaacctccttattgcacacatatcttcagatttcttcattcctctttcaatcttttctcttcccgttcacatcctcgttttctccgaaacataaaaaaataatcttggttttgttttcttgttttttgttatttgacttggttgtctgaatcggttgtcgcaggagggtcgggagacacagctatgcagaggcaacttgtgtgcaatggttgtaggagccttctgctttacccgagaggggcaaccaatgtttgttgtgcattgtgcaacacgattacctctgttcctccacctgggatggaaatgtctcaactttactgtggaggctgcaggacgttgctaatgtacactcgtggagctacaagtgtgagatgttcctgctgtcacactgtaaaccttgttccagcaactaatcaggtagctcatgtccactgtgggaactgccggacagccctcatgtatccttacggagctccctcagtcaaatgtgctatttgccactatattactaatacgaacaatggacggcttccaatccctgtccatagatccaatgggacagccaatgctgggacattaccttctacttcaacttcaatgcctcaatctcaaagtcagacagtagtagtagaaaatccaatgtctgtggattcaagtgggaaattggtgagcaatgttgtggtcggcgtcacaacagataagaaataacagcatcacacatacaaggtacactacatgtcacgaggcatcaccacagttactgtcacatgaagatattgtttgtgtatatgaatatatatatatatatatatatatatgatattgcagcctgcagtggttcaattgaaatcaatatttttccattccaagagtgggatggatatgtatgtatgaatgtatatgaggtggacaggttgtgaaaagggcataaaaacctattttgtgtgattgccagagcctgctttgtttttttcttggtactcaatatccaaaatcaattggttcattcagattatgttgactttcaaatcctagactagtaaatgctacttttttcttttatgg

SEQ ID NO: 5562 - DNA, 1354 bp, Cajanus cajan
gactaatagtcgctgaagaaatttccgatgagaagatgatgaggaaacattggtagaagaaattgaagagagagagagagagaaagagggttggattggttttcttcttcttttttccaaagagaatctaatctcaatcctcaacctcttcattagtcattacacacgtatcttctgatttcttcaattcctccctcaatcttttcttttcctcccttcacatcctccttttctccgaagcgaaaccaacaaagattttagttttttgttttctagttttgttatttggcttgcttctctgaatcggttgttgcagaagggtcgggagccgcagctatgcagagccaacttgtgtgcaatggttgtaggagccttctgctttacccgagaggggcaaccaatgtttgttgtgcattgtgcaacaccattacctctgttcctccacctgggatggaaatgtctcaactttattgtggaggttgtaggacattgctaatgtacacacgtggagctacaagtgtgagatgttcctgctgtcacactgtaaaccttgttccagcatctaatcaagtagctcatgtccattgtgggaactgccggacaacactcatgtatccctatggagctccctcagtcaaatgtgctctttgtcactatattaccaatgtcagtatgaacaatggaaggcttccaatccctgttcatagacctaatgggacaaccaatgctggaaccttgccttctacttcaacatcaatgccccaatctcaaagtcaaacagtagtggtagaaaatcctatgtctgtggattcaagtgggaaattggtgagcaatgttgttgttggagttacaacagataagaaataatggcagcacatatagagggtacagtaccacctttgctgtcacaagaagatattgtttgtgtatatgaatatatgatattgcagcctgaaacggtttatttgaaatgaatacttttccaatacaagggttggacggatatcatgtatgtacgtattgtatatgaggagaacaaatcgtgaaaagggcataaaacctgttagtgttttgtgtgattgccagagcctactttgttgtttccttggtatccatacccaaatcaattggttcattcagattatatgttatcctacaagtcctaaactagaaaatgctactttttctttcatggcttgtgaagcttgtgcttttcttgatgatctgttagatacatgtgttgtaatatttgatgatgttgtgcaaccattgcatgataaattatctcatttgactcttagctaaaaaaaataaaaaaagctgttgaaaagcattttcaggaaaattttgaaca

SEQ ID NO: 5563 - DNA, 1477 bp, Glycine max
aagaaacgtagattaatagtcgctgaagaaatttccgaaagtgtgtgtgggatgagaagatgatgaggaaacattggtagaagaaattggagagagagagagagagagagggttggattggttttcttcttcctcttcctaaagagaatctaatctcaatcctcattacacacatatctacagatttcttcattcctctctcaatcttttctgttttcttttcccctctttgacatcctcgttttcgccgaaacaaaaacaactaagattttgttttttgttgtatttttcttcctgttgttatttgactcggttgtctgaatcagttgttgcagcagggtcgggagccacagctatgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaataacatcatcacatataaaaggtacagttcacgtcatgacgcatcaccacagttgctgtcacaggaagatattgtttgtgtatatgaatatatatatgatattgcagcctgcaatggtttaattgaaatcaatatttttccaatataagagttggacgaatatcatgtatgtatgaatgtatatgaggcggacaagtcgtgaaaaggccataaaacctgttttgtgtgattgccagagcctactttgttttttgcttggtacccatacccaagtcaattggttcattcggataaaatatgttgacttccaagtcctagactagtaaatgctactatttctttcatggcttgtgaagcttgtgcttttcttggtgatctgttagttacatctgttgtaatatttgatcttgtgcaagcattgcttcataaaatgactgatatgataaatttttaccagtcatttgaaaattttggataagacacaggctgctttagaagtttgatatataccaattatctcatgttacttttaagtaaaaaaataaaataagctgttgaaaaacatttccaggaaaatgttggacatttgccattatt

SEQ ID NO: 5564 - DNA, 1339 bp, Glycine max
aaagtgtgtgtgggatgagaagatgatgaggaaacattggtagaagaaattggagagagagagagagagagagggttggattggttttcttcttcctcttcctaaagagaatctaatctcaatcctcattacacacatatctacagatttcttcattcctctctcaatcttttctgttttcttttcccctctttgacatcctcgttttcgccgaaacaaaaacaactaagattttgttttttgttgtatttttcttcctgttgttatttgactcggttgtctgaatcagttgttgcagcagggtcgggagccacagctatgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaataacatcatcacatataaaaggtacagttcacgtcatgacgcatcaccacagttgctgtcacaggaagatattgtttgtgtatatgaatatatatatgatattgcagcctgcaatggtttaattgaaatcaatatttttccaatataagagttggacgaatatcatgtatgtatgaatgtatatgaggcggacaagtcgtgaaaaggccataaaacctgttttgtgtgattgccagagcctactttgttttttgcttggtacccatacccaagtcaattggttcattcggataaaatatgttgacttccaagtcctagactagtaaatgctactatttctttcatggcttgtgaagcttgtgcttttcttggtgatctgttagttacatctgttgtaatatttgatcttgtgcaagcattgcttcataaaatgactgatatgataaatttttaccagtcatttgaaaattttggataagacacaggctgctttaga

SEQ ID NO: 5565 - DNA, 1316 bp, Glycine max
agtcgctgaagaaatttccgaaagtgtgtgtgggatgagaagatgatgaggaaacattggtagaagaaattgaagagagagagagagagagagagagagagagagagggttggattggttttcttcttccttttctctaaagagaatctaatctcaatcctcattacagatttcttcattcctctctcagtcttttctgttttccccctttgacatcctcgttttcgccgaaacaaaaacaactaagattttttgtttgttttgtttttcttctccttgttgttatttgactcggttgtctgaataggttgttgcagcagggtcgggagccacagctatgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatgtcagtacgaacaatggaaggcttccaatccctgtccatagacccaatgggacaaccaatgctggaacattacctactacttcaacatcaatgccccaatctcaaagtcaaacagtagtggtagaaaatccaatgtctgttgattcaagtgggaaattggtgagcaatgttgttgttggggttacaacagataagaaataacgccgtcacatataaaaggtacagttcacgtcatgacgcattaccacagttgctgtcacaggaagatattgtttgtgtatatgaatatatatgatattgcagcctgcaattgttgaattgaaattgatatttttccaatataagagctggacgaatatcatgtacgtatgtatgaatgtatatgaggtggacaagtcgtgaaaagggcttaaaacctgttttgtgtgattaccaaagcctactttgttgtttccttggtagccatacccaaatcaattagttcattcacattatatgtttgacttgtaagtcctaaactagtaaatggtatttctttcatgtcttgtgaagcttgtgcttttcttggtgatctgttagttacatatgttgtaatatttgatgatcttgtgcaagcattgcttgataaaatgactgatatcataga

SEQ ID NO: 5566 - DNA, 1492 bp, Glycine max
gaaacgtagactaatagtcgctgaagaaatttccgaaagtgtgtgtgggatgagaagatgatgaggaaacattggtagaagaaattgaagagagagagagagagagagagagagagagagagggttggattggttttcttcttccttttctctaaagagaatctaatctcaatcctcattacagatttcttcattcctctctcagtcttttctgttttccccctttgacatcctcgttttcgccgaaacaaaaacaactaagattttttgtttgttttgtttttcttctccttgttgttatttgactcggttgtctgaataggttgttgcagcagggtcgggagccacagctatgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatgtcagtacgaacaatggaaggcttccaatccctgtccatagacccaatgggacaaccaatgctggaacattacctactacttcaacatcaatgccccaatctcaaagtcaaacagtagtggtagaaaatccaatgtctgttgattcaagtgggaaattggtgagcaatgttgttgttggggttacaacagataagaaataacgccgtcacatataaaaggtacagttcacgtcatgacgcattaccacagttgctgtcacaggaagatattgtttgtgtatatgaatatatatgatattgcagcctgcaattgttgaattgaaattgatatttttccaatataagagctggacgaatatcatgtacgtatgtatgaatgtatatgaggtggacaagtcgtgaaaagggcttaaaacctgttttgtgtgattaccaaagcctactttgttgtttccttggtagccatacccaaatcaattagttcattcacattatatgtttgacttgtaagtcctaaactagtaaatggtatttctttcatgtcttgtgaagcttgtgcttttcttggtgatctgttagttacatatgttgtaatatttgatgatcttgtgcaagcattgcttgataaaatgactgatatcatagatttttaccagtcatttgataatttgtaccagacccaggctgctttagaaatttgatttataccaattctcttttgacttgggtaaacaaataatgttgaaaaacatttccatgaaaataatgaacatttgccattacttgtgctcaaatcctacctgttgg

SEQ ID NO: 5567 - DNA, 1057 bp, Trigonella foenum-graecum
cttgtttgacttcgtttcctaaatcgcttgtcgcagaacacggttcaggtgccgcagctatgcagagccaacttgtgtgtaatggttgtaggagcatgttgctttaccctagaggggcaaccaatgtttgttgtgcattgtgcaacacaattacctctgttcctccacctgggatggatatgtctcaaatttattgtggaggctgtaggacattgctaatgtacacacgtggagctacaagtgtcagatgctcttgctgtcacactgtaaaccttgctccagtatctaatcaagtcgcccatgtcccttgcgggaactgccggacaacactcatgtatccttatggagctccttcagtcaaatgtgctgtttgtcactatattactaatatcaatatgtccaatggtaggcttccaattcctggtcatagacctcatggaacaaccgactcgggaacgttaccttctacttcaacgtcaatgccccaatctcagagccaaacagtggtggtagaaaatccaatgtctgtagattcaagtgggaaattggtgagcaatgttgttgttggcgttacaacagataagaaataatgcagccatgtatagaaggtacagtatatgatgacgcattatcgcagttggtgtcacaagaagatattgtatgtgtatttgtttatgtatatgatattgcagcctccaatggtttcattgcaaatgaatccttccttttttgatatataagggttagatggataacagtatgtacatgtatatgaagaggacaaattgtggaaagggctgtgtgtttggttcattcttgttgtatcgtgacttagcaatttgtagacgagcagatgttatttctttcatttcttgttaagcttgtgatttgattgatgatctgttaggaccgtgtatggatattcgataaaaacattgtgtgatataataacagatctggttgaatacttgatactgaatgttgtacaggcattgcgctataaaatggcagattttaccagtcatttgaaaatggcaataagttctaagacaaaaaa

SEQ ID NO: 5568 - DNA, 1085 bp, Medicago truncatula
ggaagatgcgaggaaaataatattggtagcagaagaagaagaagtcacaaggaaggaagaaagggttgattggcttcaccttttctctttcccttttcttcttctttctctttccaacacaatcaaattattcccaattcaaccctccttcatatttcttttcctttatccccatatcaacgttttcttcttaaaataattattattatttatttttttttttaattattttctggtttgacttcgttgtctgaatcgcttgtcgcagaacacggtccaggtgccgcagctatgcagagccaacttgtgtgtaatggttgtaggaacacgttgctttaccctagaggtgcaaccaatgtttgttgtgcattgtgcaacacaattaccgctgttcctccacctgggatggatatgtctcaattatattgtggaggctgtaggacattgttaatgtacacacgcggagctacaagtgtcagatgttcttgttgtcatactgtaaaccttgctccagtatcaaatcaagtagcccatgtcccttgtgggaactgccggacaacacttatgtatccttatggagctccttcagtcaaatgtgctgtttgtcactatattactaatatcaatatgtccaatggaaggcttccaattcctggtcatagacctcatgggacaaccgactcgggaatgttaccttctacttcaacgtcaatgccccaatctcagagccaaacagtggtggtagaaaatccaatgtctgttgattcaagtgggaaattggtgagcaatgttgttgttggtgttacaacagataagaaataacgcagccatgatagaaggtacagtatatgacacattatcacagttgctgttaccagaagatattgcatgtgtatatgtatatcatattgcagcctccaatagtttcattcaaatgaatccttcctttttcgatgtaagggttagacagatatcagtatatgtatatgtatatggagaggacgagttgtggaaagggctgtgtgattggttcattcttgttgtatcgttatttagtaaatgttatttctttcattccttgataa

SEQ ID NO: 5569 - DNA, 1540 bp, Medicago truncatula
aaaaaaaaaagtggagtaatttaataatgaccaaagaaatttccaaagagtgtgttaaagatgatgaagtagaaaggaagatgcgaggaaaataatattggtagcagaagaagaagaagtcacaaggaaggaagaaagggttgattggcttcaccttttctctttcccttttcttcttctttctctttccaacacaatcaaattattcccaattcaaccctccttcatatttcttttcctttatccccatatcaacgttttcttcttaaaataattattattatttatttttttttttaattattttctggtttgacttcgttgtctgaatcgcttgtcgcagaacacggtccaggtgccgcagctatgcagagccaacttgtgtgtaatggttgtaggaacacgttgctttaccctagaggtgcaaccaatgtttgttgtgcattgtgcaacacaattaccgctgttcctccacctgggatggatatgtctcaattatattgtggaggctgtaggacattgttaatgtacacacgcggagctacaagtgtcagatgttcttgttgtcatactgtaaaccttgctccagtatcaaatcaagtagcccatgtcccttgtgggaactgccggacaacacttatgtatccttatggagctccttcagtcaaatgtgctgtttgtcactatattactaatatcaatatgtccaatggaaggcttccaattcctggtcatagacctcatgggacaaccgactcgggaatgttaccttctacttcaacgtcaatgccccaatctcagagccaaacagtggtggtagaaaatccaatgtctgttgattcaagtgggaaattggtgagcaatgttgttgttggtgttacaacagataagaaataacgcagccatgatagaaggtacagtatatgacacattatcacagttgctgttaccagaagatattgcatgtgtatatgtatatcatattgcagcctccaatagtttcattcaaatgaatccttcctttttcgatgtaagggttagacagatatcagtatatgtatatgtatatggagaggacgagttgtggaaagggctgtgtgattggttcattcttgttgtatcgttatttagtaaatgttatttctttcattccttgataagcttgtgattttatcgatgatctgttacgaccgtgtatggatattcgatacaagcattgtgtgatataataacagatctggttgaatatttgttcgttactgaatgttgtacaggcattgcgctataaatgacagattttatcagtcatttgtgaaaagggtgataatatccaagaccgggatgctttgaatgcttgaatatatatgcgtatgaaagtgcacttgtaattcaattcttataattatacacatttaaagtaagcttccatcacgcccataatactcctttccatcattgaagtttggctttggagattcaatattgtaggtacttaaatataaaaatcactaggatctccagcaaccctacaacaagggga

SEQ ID NO: 5570 - DNA, 1303 bp, Lotus japonicus
ggagcgaagaaatttcgtgcaatatgtattgttggatgaggaagaagacgacggtagcagaagaagtagcaaggaagagaaaaagggttctctgaaattctcttcctcttcttcttccttcttctctgaatccaattccaatcctcaaacctcaatcaaccatacaattttcatctcatctcgttacaaacagagacaattctacccttttcttacccttttccccatttatcaccatcctcgtatcctccgataaaaaaacaatcttttccttgtttcacttcggttggttccaggagacacagctatgcagagccaacttgtgtgtaatggttgtaggagcattctgctttaccctagaggggcaaccaatgtttgttgtgcattgtgcaacacaatcaccgctgtgcctccacccggaatggatatgtctcaactttattgtggaggctgtaggacattgctaatgtacacacgtggagctgctagtgtcagatgttcctgctgtcacactgtaaaccttgctccagctaatcaagttgcccacgtcccttgtgggaattgccggacaaccctcatgtatccatatggagctccctcagtcaaatgtgctctttgtcactatattactaatgtcaatatgtccaatggaaggcttcaagttcctatgcatagacctaatgggacgaccaactctggagcattaccttctacttcaacgtcaatgccccaatctcagacccaaacagtggtggtagaaaatccaatgtctgttgattcaagtgggaaattggttagcaatgttgttgttggcgtcacaacagataagaaatgatgcagccatatataaaaggaacaacagtatttgacgaattatcagttatcaaaagttcttgtcacaccaagatattgttttgtgtatatgtatatgatattgctgcctgtaaacggttatattgaagtgaatcattttccaatataagggttagacggataggaggacaagttatgaaaagggcatatggaacatgtttgtgtgattggttcattcttgttgtattttgacttacaagtcctggactgaggaaatgtaatttctttcatgacttgttaagcttgtgagtttaatggtggtctggtagaattatgtgtaaaaaaactcgataagaaaaatgctagcaagactcacttttactctcttcctaacactcattaattgatttaaattcatattaggtccatatgaacttcaaccaattaatgagagaggattggaaaatgagtgttgttagcactcattcaa

SEQ ID NO: 5571 - DNA, 1234 bp, Arachis hypogaea
cttcctcttctccgccttccttcaatccaatctaatcccaattccaatccctcaattaaccaaaataaaatcaagtttatcgccaaaccaccgccttcgtggccccttttcattcatcgagctaccgttttgattcttccccagattctttcttcaatttcgcatcttcttgttgcccccatcggttttccctttcttccatctttgtttctcagaagttttttttttccgttgacttggtttcgggattattgaagcagggtcattcgcagctatgcagagccaacttgtgtgtaatgggtgtaggagcattttgctttatcctagaggggcaaccaatgtgtgttgtgcattgtgcaacacaattacctctgttcctccacctggaatggagatgtctcaacttgtttgcgggggatgtaggacactgctaatgtacacacgtggagctacaagcgtgagatgttcctgctgtcaaactgtaaaccttgcaccaccagcacccagtcaagtcgcccacgtgcattgtgggaactgccggacaacactcatgtatccttacggagctccttctgtcaaatgtgcactttgccaatatgttaccaatgtcaatatgaacaatggaaggcttccaatcccagtccatagacctaatggaacaaccaactatgggacagtaccctctacttcaacatcgatgccccaatctcagacccagaccgttgtgatagagaatcccatgactgttgattcaaatggaaaattggttagcaatgttgttgttggggttacaacagataaaaaataatggaataagatttagaagcatagtgtacaacaaattatcacagtgctgtcataggaagatgttttttcttctttttcttgtgtataatgatgttgcagcctgcaatgatttcaattgaaatgaatcttttgtccaatgccagagttggagggtatcatatcatatatgcatgtatatgaattgaggaggacaagtcgtgtaaaggggcattaatatgtgtgtaattgccaaatctattggttcattcagattctatctcttgacttacaagtcctggactagcatatgctctttttggtcttttttcttatatttatttcatggattgtgaagcttgtgcttttcatgatgacatgttaagaacaatttgttgagatttatttgatatgatgtacccactgatgatgaggtggcttatgtgataga

SEQ ID NO: 5572 - DNA, 1242 bp, Arachis hypogaea
cttccccctttttcttcctcttctcgtccttccttcaatccaatctattcccaattccaatcctcaattaaccaaataaaatcaagtttatcgccaaccaccgccttcgtggccctttcattcatcgagccaccgtttcgattcttccccagattctttcttcaatttcgcatcttcttgttgccccatcggtttcccctttcttccatctttgtttctcagaagtttttttttccgttgacttggtttcgggattattgaagcagggtcattcgcagctatgcagagccaacttgtgtgtaatgggtgtaggagcattttgctttatcctagaggggcaaccaatgtgtgttgtgcattgtgcaacacaattacctctgttcctccacctggaatggagatgtctcaacttgtttgcgggggatgtaggacactgctaatgtacacacgtggagctacaagcgtgagatgttcctgctgtcaaactgtaaaccttgcaccaccagcacccagtcaagtcgcccacgtgcattgtgggaactgccggacaacactcatgtatccttacggagctccttctgtcaaatgtgcactttgccaatatgttaccaatgtcaatatgaacaatggaaggcttccaatcccagtccatagacctaatggaacaaccaactatgggacagtaccctctacttcaacatcgatgccccaatctcagacccagaccgttgtgatagagaatcccatgactgttgattcaaatggaaaattggttagcaatgttgttgttggggttacaacagataaaaaataatggaataagatttagaagcatagtgtacaacaaattatcacagtgctgtcataggaagatgttttttcttctttttcttgtgtataatgatgttgcagcctgcaatgatttcaattgaaatgaatcttttgtccaatgccagagttggagggtatcatatcatatatgcatgtatatgaattgaggaggacaagtcgtgtaaaggggcattaatatgtgtgtaattgccaaatctattggttcattcagattctatctcttgacttacaagtcctggactagcatatgctctttttggtcttttttcttatatttatttcatggattgtgaagcttgtgcttttcatgatgacatgttaagaacaatttgttgagatttatttgatatgaatatgatgtacacactgatgatgaggtggcttatgtga

SEQ ID NO: 5573 - DNA, 1179 bp, Lupinus angustifolius
atgggtgtagatgaacaaaggaaagaagtttccatagaaagaatagtgtgtggagttttctgctattgttgagttcagacatttcttcattctcaaccaacaaaaccgtcttacaattacaattttacccctcacatcttcttcctcttcttttccttcttccttcccctttattcattcctcgtttttttatttaaaaaaaacaaattttattttctgaatcgattgtattcaaaagacccataatagctatgcagagccaagttgtgtgtaatgggtgcaggaacattttgctttatcctagaggggcaaccaatgttcgctgtgcattatgcaacacaattacatctgttcctccacctggaatggaaatgtcacaactttactgtggaggctgcaggaccttgctaatgtacgcacgtggagctacaagtgtgagatgttcctgttgtcacactgtaaaccttgtaccagcgtctaatcaagtcagccatatccattgtgggaactgccggacaacactcatgtatccttatggggctccctcggtcaaatgtgcactttgtcactatatcactaatgtcactacgaccaatggaaggcttccgaatcctggccaaagaactaatggaccaaccaacccaggaaccgtatcttctactccaacatccatgccccactctcagagccaaactgttgtagtagaaaatcctatgtctgttgattcgagtgggaaactggtgagcaatgttgtcgtcggtgttacaacggaaaagaaatgatgcttatcacattatgaagttatatcttaaaatacataaagcattatcagttgctggcacatgaagatattgtctgtgtaaatgatgttgcagcctgcaatggttaaattgaagtcgataatctttttgccaattcaaggtttaaaccttaaaaagtgatttcatgtatgtatgtatgtatacaaggaggactagtggtgagtgctgatacaacttatgtgattgccagggtacacttttttttgctgccattgtatcttatccagatcagttgtttttttttcagattatgacatgaaagcatggggtaatattgctttttacatgttaatacttgatgttatactaggatctatcataaatcatgtccaagcatagcttaatatgttatagcttt

SEQ ID NO: 5574 - DNA, 1395 bp, Cicer arietinum
aaaaaaaagtggagtaattatgaccgaagaaatttgcaatagagtgtgaaggatgacgaagtagaggaagatgagaggaaaataacggtagcagaagtcgcagggaagaaagaaaggattgggttcacttacctttttccttttcctcttcttcttcttcttcttcatcttcttcatcatcatcttcctttcttctatcaatcacaatccattattcaattcacaattcaacctacatcttcagatttcttctcctttctctccatccaccgtttctcccccctaaaataataaacaaaaaaagattcttattaattttattattattattttttcttgtttgactccgttgtctgaatcgtttcttctagaatagggttcaggagccacagctatgcagagccaaattgtgtgtaatggttgtaggagcatgctgctttaccctagagggccaaccaatgtttgttgtgcattgtgcaacacaattacccctgttcctccacctgggatggatatgtcacaactttattgtggaggctgtaggacattgctaatgtacacacgtggagctacgagtgtcagatgttcctgctgtcaaactctaaaccttgctccagctcatgtcccttgcgggaactgccggacaacactcatgtatccttctggagctccctcagtcaaatgtgctgtgtgtcactatattactaatatcaatatgcccaatggaaggcttccaattcctgttcgtagaccttatgggacaaccaactcgggaacattaccttctacttcaacatcaatgccccaatctcagagtcaaacagtggtggtagaaaatccaatgtctgttgattcaagtgggaaattggtgagcaatgttgttgttggtgttacaacagaaaagaaataatgcagtcatgcatagaagatacagtatatgacgcatatttgcagttgctgtcacacgaagctactgtatgtgtatttgtatatgatattgcagcctccgatggtttcattcgaatgaatcctttctttttccaatatacaagggttggccggatatcactatgtatgtatatgaagagaacaagttgtgaaaagggatgtgtgattgtttcattcttgttgcatcgcgacttaacaagtcgcagactagcaaatgttatttctttcaaaacttgttaagcttgtgatttttttgttgatgatctgttaggaccatgtttggatatttgattcattgcattgcgtgatataataacagatcttgttgaatacttgagactgaatgttgttgaacaggcattgcactatcaaatgacagattttacctgtcatttgaaaatggtgataattttcatgaccaggatgctttgaaattttggataatac

SEQ ID NO: 5575 - DNA, 1338 bp, Lupinus angustifolius
agttaaaggaagaagagagatgaaaaatgaaaggagaagttgatggtaatcacaaggaagtgggttgagttgggttacctttacttttcttctcttccttctttcctttttcacaaaatctaatcctaatattcaattatcaaaaagcaaaacaaaaccatctacaaaacaatcctacatttcttcattcatctaccccttttgattctttgccaaccttttcttacttgatataaccctcaatctctttctgtattttttcttcttgacatcctcgttttcttgtaaagggttttttgttgttgacttgattgtctaaattggttgttgttgggtccaagagccagagctatgcaaggccaacttgtatgtagtgggtgtaggagcaatttgctttaccctagaggggcaccaaatgtttgttgtgcattgtgcaacacaattacctctgttcctccacctggaatggaaatgtctcaactttactgtggaggctgtaggacattgctaatgtacccatgtggagctacaagtgtgagatgttcctgctgtcacaccgtaaaccttgcaccggcatctaaccatgtcgcccatatccattgtgggaactgccgaacaacactcatgtatccttatggggctccctctgtcaaatgtgcaatctgtcactatattactaatgtcagtatgatcaatggaggttttccaattcctgttcatagtcctaatgggatgaccaactctgcaacagtaccttctacttcaacatcaatgcctcaatctcagagtcataccgtcgttgtagaaaatccgatgtctgtcgattcaaatgggaaactggtgagcaatgttgttgttggagttacaacagataaaagataatggcatcatgtttaaaggattcagaatatgatgcattatgacaattgctgtgccatgaagatattttgttgttgaaatggatctttttccaatacaaagggttagacagattatgtaagaatgtatatgaggaggacaagtgaaaagggcttaaaacttttgtgtgtttgccaaatcctactttgttgttggctcttgcatccatagccacaaatcaatttggttcattgagcttgtatcttgaattgcaagtcctggatgagcatatggtgttatttctttcaagcttgtgcttttcttgatgatatatgagaaggatgtgttgatatttgataatgaatgttgtagaaacattgcatgatatgaccttttgtgtgtaaacatgataaagtgactcaagataatatagaactttccaatcatttaacaaattgctaaataatcagcaatttcttt

SEQ ID NO: 5576 - DNA, 1175 bp, Glycine max
aatccgcgtacccagaaggaaggaagttattattatacagacaagagtttaatttgaaggccaaatcaaaatattgaaaagccgcgagggaggtttcgtttcgtttcgttcagttcacacattctattctctatcgattcctcttccctttttctcaatccactacaccacagttatgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatgaccaatggaaggctttcaattcctgtacagagaccaaatggaacagccaactctggaacagtatcttcaacttcatcgtcaatgccttattctcagagccaaactgtcgtagtagaaaatcctatgtctgttgattcgagtgggaaattggtgaggaatgtcgttgtgggcgttacaacagataagaaatgatacttgccacatgaaaatgttacacaagtgtaaagggaacatcatttgactcgtcaactgctggtgcttgaaaatattgttcgtgtatatgaaattgcagcttataagttaaagatatttttgttctaaatgagatttagactgatttaatttacatatatgtatacgaggaccagtggaaagggcacacaacttgtcatttattgaattgccaaggtcctctttttgctgcagttgtatcacagggtttttcgcatctcgaattacaagtcctagatgcacatttgattcctcttctttggtgacttgattttattatgcaagcatataacctgataaggtgcctagagtcaactggcgcagaaattcaaatgtgtacacgcactaaatcaaatatcaaaggattagttattgtaattttcgtccaattttgtgtaacatgttccaatgtgtacagggatcacacctcaaatcc

SEQ ID NO: 5577 - DNA, 1377 bp, Glycine max
acaaaaaaaaaggttagaacgcggtgaagtttcctaatccgcgtacccagaaggaaggaagttattattatacagacaagagtttaatttgaaggccaaatcaaaatattgaaaagccgcgagggaggtttcgtttcgtttcgttcagttcacacattctattctctatcgattcctcttccctttttctcaatccactacaccacagttatgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatgaccaatggaaggctttcaattcctgtacagagaccaaatggaacagccaactctggaacagtatcttcaacttcatcgtcaatgccttattctcagagccaaactgtcgtagtagaaaatcctatgtctgttgattcgagtgggaaattggtgaggaatgtcgttgtgggcgttacaacagataagaaatgatacttgccacatgaaaatgttacacaagtgtaaagggaacatcatttgactcgtcaactgctggtgcttgaaaatattgttcgtgtatatgaaattgcagcttataagttaaagatatttttgttctaaatgagatttagactgatttaatttacatatatgtatacgaggaccagtggaaagggcacacaacttgtcatttattgaattgccaaggtcctctttttgctgcagttgtatcacagggtttttcgcatctcgaattacaagtcctagatgcacatttgattcctcttctttggtgacttgattttattatgcaagcatataacctgataaggtgcctagagtcaactggcgcagaaattcaaatgtgtacacgcactaaatcaaatatcaaaggattagttattgtaattttcgtccaattttgtgtaacatgttccaatgtgtacagggatcacacctcaaatccttatttgtgacccaaaacttggacacaatgaagtacccacctatctaagtagcttattgataaacacatacacatttacaaattcccaactgatcaatggtaattataaggggtgccaatagtacaatctctccattgctatatagtatatataataaatgtttggg

SEQ ID NO: 5578 - DNA, 1290 bp, Glycine max
ggaacgcggtgaagtttcgtaatccgcgtattcaaggaaggaaggaagttattataagcagacttgaatttgaaggccaaatcaaaatattggtatagccgcgagcgaggtttcgtttcgttcagttcacacattctaatctctatcgattcctcttccattttctcaattcactacaccccagtttatgggaagccaacttgtgtgtaatgggtgtaggaacatcttggtttaccctagaggagcaaccaatgtttgctgtgcattgtgcaacaccgttacctctgttcctcctcctggaatggacatgtcacaactttattgtggaggctgtacgacattgctaatgtacacacgtggtgctacaagtgtgagatgttcctgctgtcacactattaaccttgtaccagtactagaatctaatcaagtcattcattgtacgaactgccggacaacactcatgtatccttatggagcttcctcagtaaaatgtgcaatttgtcgctatattactaatgtcagtatgacgaatggaaggcttccaattcctgtacagagaccaaatggaacagccaactctggaacagtatcttctacttcatcgtcaatgcctcattctcagagccaaactgtcgtagtagaaaatcccatgtctgttgattcgagtgggaaattggtgagcaatgttgttgtgggcgttacaacagagaagaaatgatacttgtcacattatcatgttatacaagtgtaaagagaacattatttgattcatcagctgctggtgctcaaagatattgttcgtatatgtgactttgcagcatagaagttaaaaatatttttgttctaaacgacatttagactgatttaatttacgtatatgaatacgaggacaagtggaaagggcacaaaacttgtcatttgtgcaattgcctaggtcctctttttgctgtagttggatcacagggtttttcacatctcgaattacaagtcgtagatgcacatttgtttcctcttctttggtgacttgattcgtatattcagatgtgttaataatagttttattatgcaagcatataacctgataaggtgcctagagtcaactggcgcagaaatacaatatcgacctgcttgaacattaagtatgagtaatgaagtacttataggagaagaaaattagaaagaaaaatgagattttttttttccttttgttaaaattaacttgtacacaagttaaaaatcaacttttggataaattaatggagtaaatagacattttggtccttgactttt

SEQ ID NO: 5579 - DNA, 1472 bp, Prunus mume
atgggacaaaataaaacaataaaaaaaatcgccggatggttttattttagccataggaggctctggtgtttgagttttcggatcctatttcacactctagaggattagcaagaaagaaacgagctgtcgagtttacaaattaaaaaaaaaaggttgtccgttgaaaattatttcgatatctcccatattcccaacccattacaacacaatctcaaaccaagaaaggaatttcaacaacaacgaccaaaaccttcgacgcttccttatcatcttcctcaaaaaccagacaaaccccgtttcttgctctgagacccaattcctcgttttcgatctaattccaaaaaaccccccaaaagttgtgatttttggtcctttgcacggccttcgcttctgttcttagggcgccttcagcaatccgattgcgtcgaatacagctccagttgcgcgaggggtggtgaagtttgaattttttgaacaaaatcaggtatgcagagccagcttgtgtgtagtgggtgtaggagcattcttctatatcctagaggagctacaaatgtttgctgtgcattatgcaatataattaccccagtccctcctcctggtacagaaatggctcaacttatttgtgggggttgtaggacgttgttaatgcatacacgtggggcaacaagtgtgaggtgctcctgctgtcatactgtaaatctcgctccagcatccagtcaggttgcgcacgtcaactgtggaaactgccggacaacacttatgtatccatatggagctccttcagtcaaatgtgcagtctgtcactatgtaactaatgttggtatgaccaatatgagggttccaattccagtgcacagacctaatgggacagccaattcaggaatggcgccctctacttccgcagcaatgccccattctcagagccagaccgttgtggttgagaaccctatgtctgttgatgaaagtggcaaattggtgagcaatgttgtcgttggtgtcacaaccgggaaaaaataatacagcaggattctgcaatcgattgcagctagttttatttcgcagggagcaaatcaaatccttattacacattacttggaagatagacatcaaaattggtgtatattttattggagttgttcataaacacctgtgcgagaaacgatttcaaatatgaggcgtcagataaatgtatcatgtactattaaagagacttgaattggaaaggacattcctatatcattcttgtaattgccatatcacccgcgtgttcaagttgagtcgagtgactgcacataaagtacatatattttcaaactacaaatccaattgtcaaacatttgttttgtatttaaacaatttattttgtttaattgttgttgtttacagtgctcggactatctcttctatttgattttaaacctagtcggttgatcggcagtaaattgagttcgcatggtggttggttgctcatg

SEQ ID NO: 5580 - DNA, 1238 bp, Sarracenia psittacina
caaacacagtgggaaatagccgacatatgcccattgacttgtaatttttttcaattatcgaaatattacattgggatgttttattcgcccgtcgtttctctggactcgctctcggtctctcccccttctccgttcctgcatctcgtgcttgggttggaaagtcagaacctagggtctctaatttgttgcgcggcttgcgccgcttcgtctccgtgactctgtccagagttttggcggtcgacgacgagtcgtcgacgactacgattcaccatcgtcgtctcctccatgatccatcgacgactacgactcaccatcgacgactctccttattcagtcattcctctctcggttccacgcttccaggctccagcacaaacctccgaacacgcctctcggctctcgcaatcgcaaatcgcaatcaaatctggacctctggctctggttctgcaattccgatattgacgagctcgatatgcagagccagctagtctgcagtgggtgtaggagctttcttttttatcctagaggagctacaaatgtctgctgtgtattatgtaatgcaataacctcagtcccgcctcctggaatggaaatggctcaacttatatgtggaggttgccgtacattgcttatgtatacacgtggggctacaagtgtgagatgctcctgctgccaaacggtgaaccctgtgccagcatctaaccagctcgctcacgtcaattgtggaaattgccgtacaacactgatgtacccttatggagctccatcagtcaaatgtgccatttgccagtacattacaaatgttaatatgggcaatgcaagggtccacattcctgtgcacagaccaaatggcacaactacgtctgcatcaatgccctcggcttcaacaccaatgccaagttctcagagccaaactgttgtggtcgagaatccaatgtccgttgatgaaagtggcaaactggtgagcaatgttgttgttggcgtcacaactgagaagaagtgatcttataattatatgatttatcctgaggaacattaataattagtggataatagttggaaattattgtttctttcggctgtgaagatggatgtggagatatgttgtgaatattagaatgaaattgactttatttaaccttgtgggtattaggttttcaagaaattgaactgtttggcttgtattgtaaggatatcaattgaagatgtagtgtgcttattatttgtgcaatgcgata

SEQ ID NO: 5581 - DNA, 999 bp, Euonymus alatus
tctttcttcatgtttgacacattctcatcctctctgcgtaatctaaagaaaccctctttccttgtttccatttcaaagcttctatcttgacccccaaaaatattttgaatccgcgtaaaaatcacgcgcgatctcttggaatctccatattatcttttttgccgtaagaactctcgaatttaccagagttctttttaaaatttggaatagcaacaccacctgctcttcgatacgcttataatcgatttgattctttctcgctttccagctatgcagagccagcttgtgtgtggtggatgtaggagcattcttctttatcccagaggagcatcaaatgtgtgctgtgctctatgtaatacagtcacttctgtccctcctcctgggatggaaatgactcagcttatatgtggaggttgtagaacattattaatgtatacacgtggggctacaggtgttagatgttcttgctgtcacactgtgaacattgcaccagcttccaaccagtttgctcatgtcaactgtgggaattgccggacgatgcttatgtatccatatggggccccatctgtgaaatgcgcaatctgtcaatacattactaatgttggtatggccaatgcaaggctcccactaccggcaaatagacctaatggaacagttgcctctggtgctgtaccccctgcttcaacggtaatccctcaatctcagagccaaactgtcgttgttgagaaccccatgtctgttgatgacagtggcaaattggtgagcaatgttgtcgttggtgtaacaacagagaagaaataacacagtgagatttgagaccatctgctgttttattcagggaattgcattcttaccatgcactacccagaaggtggatagaaactattgtttgtgtacattttgttggagatagctataaatgacattcattcaaaaagattgtttacaatataagagtttaaaggtattcataagtgatgtatattttcaagataagaa

SEQ ID NO: 5582 - DNA, 737 bp, Taraxacum officinale
gcgggggcccctttcatcagctcacttttcattctcatcgatgctcttctatggccagtaaattctcttcgcacaacgtcagagtagttaatcaaatcgttctcctctagatctcctcatctggccaggttgaatttgagagaaaaatatgcagagccaaatcgtatgcagcggttgtcggagcatattgctttatccaagaggagcttctaatgtgtgctgtgcattgtgtaatgccgtcacctcggttcctcctcccggcatggaaatggaccaacttatttgtggaggttgccgcacattgctaatgtacacacgtggtgctacaagtgtcagatgttcctgttgtcatacagtcaatcttgcaccagtttctaaccaagttgctcaagtaagttgtggaaattgtcgaacaatgttaatgtatccatttggtgccccatctgttaaatgtgccatttgtcactacattacaaatgtcaatactagcaatggaagggttcctgttcctatgcgacctaatggaactactacaacttcaggatcactgccccctgtttcaactgcaatgcctcactctcataaccaaactgtagtcgttgaaaatcccatgtctgttgacgagagtggaaaattggtaagcaatgttgttgttggggtaaccacagacaagaaaaaggcgattaaatgatggatgtatgaattgtattaaatgggtgcttttaaggatgtaatgt

SEQ ID NO: 5583 - DNA, 1040 bp, Fagus grandifolia
tttatttcggatctgaatcatctttgaagcgctttcgtgctgcttgcgcttaaggatcatcggggagtgtgggcccagggaagtgtgggctcgctactttcaacgcaaatcagagatgcagagccagctcgtgtgtagtggatgcaggagcattcttctttatccaggaggagcaacaaatgtttgctgtgcattatgtaacacaattacagcacgtccccccacctgggacggaaatggctcagcttatatgtggtggctgcaggacattgctaatgtatacacggtggggcaacaagcgttagatgctcttgctgcaacacagtgaaccttgcagcatctcctcaggttgcccatgtcaattgtgggaactgccggacaacactcatgtatccatatggagctccatctgtcaaatgtgcagtctgtcattatgttactaacgttggtatggccaatgcgagggttccaattcctgtacacagacctaatggaacaatgtcctctacttcaacttcagcaccctattctcagagccaaacagttgttgttgagaatcctatgtctgttgacgaaagtggaaaattggtgagcaatgttgttgttggagtcacaacagacaaaaagtaatacaatgacataccaagagctatcgctgttactttaattttgtaagaaacaatccgaatccatattacgcatcgcttggaagatggacgtggaaattgcttgtgtatattttgttggtgattggcatgattacaataattcaagaaactagttccattgtaaggctcaagagaaattttatgtgtgatgtatattaagcggataagaacagtggaggttgttgcacttgtagtcatatgtgaacgtcatattgaacccattctttgctacatgtttagtagtgaatatgctgatgaagtatattgttttcttaaaatgtaaaattaatggattattttttgtgtactttgttaatttgtcttttatattataaaagtactaaattatctgtaagtggggttattcggtcg

SEQ ID NO: 5584 - DNA, 1271 bp, Prunus persica
atgggacaaaataaaacaaataaaaaaatcgccggatggttttattttagccatagtaggctctggtgtatgagttttcggatcctatttcacactctagaggattaacaagagagaaacgagctgtcgagtttacaaattaaaaaaataaggttgtccgttgaaaattatttcgatatctcccatattcccaacccattacaacacaatctcaaaccaagaaaggaatttcaacaacgacgaccagaacctttttccttcgacgcttccttatcattttcctgaagaaccagacaacccagtttcttgctctgagacccaattcctcgttttcgatctgattccaaaaaaccccccaaaagttgtgatttttggtcctttgcacggccttcgcttctgttcttagggcgccttcagcaatccgattgcgtcgaatacagctccagttgcgcgaggggtcgtgaagtttgaattttttgaacaaaatcaggtatgcagagccagcttgtgtgtagtgggtgtaggagcattcttctatatcctagaggagctacaaatgtttgctgtgcattatgcaatataattaccccagtccctcctcctggtacagaaatggctcaacttatttgtgggggttgtaggacgttgttaatgcatacacgtggggcaacaagtgtgaggtgctcctgctgtcatactgtgaatcttgctccagcatccagtcaggttgcccacgtcaactgtggaaactgccggacaacacttatgtatccatatggagctccttcagtcaaatgtgcagtctgtcactatgtaactaatgttggtatgaccaatatgagggttccaattccagtgcacagacctaatgggacagccaattcaggaacggcgccctctacttccgcaagccagaccgttgtggttgagaaccctatgtctgttgatgaaagtggcaaattggtgagcaatgtcgtcgttggtgtcacaactgggaaaaaataatacagcgggattctgtccttattacacattacttggaagatagacatcaaaattggtgtatattttattggagttgttcataaacacctgtgcgagaaatgatttcacatatgaggcgtcagataaatgtatcatgtactattaaagagacttgaattggagaggacattcctatatcattcttgtaattgctgtatcacccgcgtgttcaagttgagtgactgcacataaaagtatatatgatttcaaactacttttcaaactac

SEQ ID NO: 5585 - DNA, 1173 bp, Tripterygium wilfordii
aaaaaaaggaagagagatttgcttgtaatttttcttgtttgacacattatctctgtgtaaattcaagcaaccttcttttccttgtttccatttcaaagcttctatcttgaccccataaacgttttgaatccgcgtataaatcacacgcgatctcttagaatctccatgttatcttttttccccgtaaaaactctcgaatttgccagagttttcttcttaatttggattttggaatagcaacaccacccgctcttcgatacgcttataatagttttgattctttttcgctttccaggagcttggctttgtgtctgattggtcctcgagtgtttaatctggtgttcttcaggagaattcagctatgcagagccagcttgtgtgcggtgggtgtaggagtgttcttctttatcccagaggagcatcaaatgtgtgctgtgctctatgtaatacagttacttctgtccctcctcctggaattgaaatgtctcaacttatatgtggaggttgtaggacattgctaatgtatacccgtgaggctacaagtgttagatgctcctgctgtcacactgtgaaccttgcaccagcttccaaccaggttgctcatgtcaactgtgggaattgccggacgatgcttatgtatccatatggggccccgaccgtgaaatgtgcaatctgccattacgttacttatgttgatgcggccaatgctaggcttccacttccggcaaatagacctaatgctacacttgcctctggtgctgtacccccagcttcaacagtaatcccacaatctcagagccaaactgtcgttgttgagaaccccatgtctgttgatgaaagtggcaaattggtgagcaatgttgtcgttggtgtgacaacagagaagaaataacacagtgagatttgagatcatctgctgttttattcagggaatagcagttcaaattcgtactatgcaccacccagaaggtggatagaaaccattggttgtgtacattatgttgaaggtagctataaatggcattcattcaaaaaattgtttacaatataaggtttttaaaggaattcattactgatgtatattttgaatgtgagaactggcaaacaggttctcgctgaaagtgtattttaagtttagcagagtgattgtgcttgtgttttttcctttgacct

SEQ ID NO: 5586 - DNA, 1333 bp, Carica papaya
atccccatccttaacgagattgtgaaagaattttctcaagaggatttctttgcttcttcgttatcctattttgcataccaaaaacatagacgcacatcttcgccttttgcgtaaacccgatttctccattccctctgaccccaacccacttgtaattaccattccaaaccactctcagactctaatctccatccattccctttgatttttcaattaatatttctctattttggtaaattccataaaaagcccaggtctaatttaattttcctttcattttagttttattttattgtattttttttacagctacattgtcagtcttcaaatcaattcctggccatctcaaagaagggcggactttgaatttgatttgaattgcgcatttgcgttcccacttcttcggggaaatcagctatgcaaagccagcttgtgtgtagtgggtgtaggagcattcttgtctatcctagaggggctgcaaacgtttgctgtgcaatatgtaatgcagttaccactgtccctcctcccggaatggaaatggctcaacttatatgtggaggttgccggacactactgatgtacacacgtggggcaactagcgtgagatgctcttgctgtcacacagtaaatcttgcaccagcatcaaatcctgttgctcatatcaactgcgctcactgtcggacaacacttatgtacccatatggagctccatcagttaaatgtgctctgtgtcactatgttactaatgtcgggatggccaatgtaagggttcctctaccagcaaacagacccaacgggaccactgctggacaaatgccctctacttcaacttcaatgccccattcacaaagccaaactgttgttgttgaaaacccgatgtcccttgatgaaagtggaaaattggtgagcaatgtcgtagttggcgtgacaacggacaaaaaatgaccagatgaatctgagaattatatccttgttttgtttggtatcagtagagatgaggctctgaatccttgttatgatacttgccggattgatggatatgaaaattggtttgtgtatattaatattggcgtagttatgtatatctcatcattttacagaagtaattgcaacatgagaatggtccaaagggatttgaaaagtgtgttttttacattttgaggtgagggagtaggaaaagggaactattttgtcatttgtgtgtgatgatatactgggaaataatgtttggttggtagacttatatgagttagcttcttttctcatataatataattcatgggtgtattataattcctatatttatattgtgtgagatattgatggagacttt

SEQ ID NO: 5587 - DNA, 826 bp, Humulus lupulus
gaattcctacttatatttcccccccttactttagctatccgatttcattgaatagagtttgaactccatcaaagattgtgaaagaacaaattttgaccagaatcagttatgcagagccaacttgtgtgtagtgggtgtaggaacgtacttttatatcctagaggatctgcaaatgtttgctgtgcaatatgcagcacaattacctcagtcccccctcctgggatggaaatggcacagctaatttgtggaggctgcaggactttgttaatgtatacacgtggagcaacaagtgttagatgctcttgctgtcatacagtgaatcttgcaccaggatccaatcagatggctcatgttaattgtggaaactgccggacaacactcatgtatccgtttggagctccatcggtaaaatgtgcagtttgtcaatatgttacaaatgttggtatgggcaatatgagggttccaattcctgtgcacagacccaatgggatcaattccggaacaatgccctccacttcatctccaatgcctcattcacaaagccaaactgtcgtggtcgagaaccccatgtctgttgacgaaagtggcaaactggtgagcaatgtcgttgttggggttacaacagaaaagaaataataaaattaagattccaggacgtgctgtaagcattatttggctggggcaaatccagatgttttttatacatctctatatatagacatggaaattggttgtgtatatcttgtgagagattgaccatgattttcattttttcgagaaccttatatcaaaatgtgaggtttctgtgattaaactgtgattgtac

SEQ ID NO: 5588 - DNA, 1393 bp, Vigna unguiculata
agtaacagcaccattcttcattaatcagatatggcttccgcagacagtagaaaaaaatctgtggttttggctctctgcaagtacctttcattggatcctagtgttgttccagctgaaagtttagacagtgatattaagagtctttacttgaaaatcaaagaggcatctggacatggggttgataacactgacgaggtgttgaagtgggtatcatttgcagaagccttccctgttgccaatgatgcatgctttgagaatctcaagagattaaatgatgaattatctggaaagtctgtggttctgggcaatggattgaaaccctctgaagctgatgttatagtctattcagtgattcattcttccctggtcaacctttcagatacaaacaaagaaaaactgtcacatgtgttgagatggatggattatatccagaataagcaagaatttgtaggcttgtttgagaagatattgttgcagaagcctggatttgagcctccggtgacaaaagctgttggagtcctggaagctgatttaaaatcaaagactgaccaaagcataaagaatgtcagcaagtcagaaacagaaccatccaaggataaaaacaaagctgagggaaaggcaacagcagcagacaaagaacctaacaaagcgaaggcaaaacctgctgaaaaagaggtggctgggaaggagaatgaagttagcgtcagtttgcttaatattcaagtaggattaattcgcaaagcatggaagcatccatctgcagatagcttgctagttgaggagatagatgttggggaggccaaagtgcggcaggttgtaagcggtttggcaaagtacttcagtcctgatgagttgacgaatcgtcgtgttgtacttataacaaatgtgaaacctggaaaactacgggatgtggtatctgaaggtctggtcttatgtgcttcgaatgaagggccaactgttgtggagcccttgatccctccagaaggagcaaaaatcggggaacgcatttcttttactgggattgatggaaagccagaggatgtgctaaacccaaaaaagaaacaactggagaagataacaccgcatcttttcactgatgacaagggggtggccacatttaagggaataccatttatgacgtctggtggaccatgcacctcatccattcccagagcaactattaaataatggagagatatgggccatgtccattgttcatttgttcttcaccactcacagatttttggcaccacaaaatattcaaagttttcattacgtgaataagacgttactatcttattttgttggcaagtttatgttgcagttgcactgccgtggtcttaaatgcttcaaatataatcttgaatccaatgattcttgagtttatagtata

SEQ ID NO: 5589 - DNA, 1589 bp, Cajanus cajan
tttccacagagaacaaaatcctgaaacaacagggatgtcatagaaatcggaaaaaaaaaacctaaacctaaaccctgcaaagtgttgagtttacagtgtagtgagtagaaattgaagttgaaaggataatagtaacagcaccattcatcactcagcagagatggctaccgttgaaagtagaaagaaatcattggttttggctctctgcaagcacctttcattggatcctagtgttgtttcagctgatagtttagacagtgatattaagagtctttacttgaacattgcagcggcaccgggacacgaggttaatcactctgatgaggagttgaagtgggtagcttttgcagaagctttcccagtggcccctgatgcatgctttgagaatctcaagaaattaaatgaggaactgtctggaaaggctgtgctcctgggcaatggattgaaaccctctgaagctgatgttatagtgtattcagtggttcattcttctctgatcaatctttcagatacaaacaaggacaaactgccacacgtgttgagatgggtggattacatccagcacaagcaagaatttgtaggtttatttgagaaaatattggtgcaaaagcctggacttaagcctccggtaacaaaacctgttggagctgtggaagctgatttgaaatcaaacaagactgagcaaagcataaagaatgtaaacaagccagaaacagacataagcaaggctaaaaccaaagctgagggaaagtcaataggagacaaagaacctaccaaagccaaagcaaaacctgctgacaaagaagtggctgagaaagagaatgaagttagcgtcagtttgcttaatattcaagttggattaattcgtaaagcatggaagcatccatctgcagatagtttgttagttgaggagatagatgttggggaagccaaattgcggcaggttgttagtggtttggcaaagtacttcagtcccgatgagttgacgaatcgtcgtgttgtacttataacaaatgtcaaacctggaaaattacgtgatgtggtgtccgaaggattggtcttatgtgcttcaaatgaaggtccaaccgtggtggagcccttgctccctccagaaggagcaaaaattggggaacgcatttcattttctggaatcgatggaaaaccagaagatgtactaaacccaaaaaagaaacagctggaaaagattacaccgcatcttttcacagatgacaagggggtggccacattcaagggaataccatttatgacgtctggtggaccatgtacatcatccattcccagagcaactattaaataatggagctatggcccattcaatgttcttcactacttaaaagatttttggtaccacaatgttgggaagttttgattacgtgaataagacgttactatattgttgacaagtttatgttgcagttgcagttatatggtcttaaatgctacaaatataatcttgaagccaatgattcttgaatagttgagttaatactgtagtaacttcacacattgtaaaagtaacgaaagactctttaaaattatacaacctaccaaccaagggttaatatgca

SEQ ID NO: 5590 - DNA, 1596 bp, Glycine max
aggaagacagagaaatcggacaaaaacctaaacctaaaccttaccctgcaaagtgttgaatttacagtgtagtagtaaagtgagtagagaaatcgaagttgaaaagataatagatagtaacagcatcattcatcactcatcagagatggctaccgttgaaagtagaagcaaatcagtggtattggctctctccaagtacctatcattggatcctagtgttgttccagccgatacttcagacagtgatattaagagtctttacctgaacatcatagcggtatcaggacatggggttaatcactctgatgaggtgttgaagtgggtagcatttgcagaagccttccctgtggcccttgatgcatgctttgagaatctcaatagattaaatgatgaactgtctgaaaagtctgtgcttctgggcaatggattgaaaccctctgaagctgatgttatagtgtattcagtgattcattcttccctgatcaacctttcagatacaaacaaggaaaaactgccacatgtattgagatggatggattacatccagcacaagcaagaatttgtaggtttatttgagaaaatattgttgcagaagcctggatttgagcccccggtaacacaacctgttggagctgtggaagctgatttaaaatcaaacaagactgagcaaagtgtaaagaatgtcaacaagtccgaagtagactcaagcaaggataaaaacaaagctgagggaaaggcaacaggaggaaaatcaactggagacaaagaacccaccaaagccaaggcaaaacctgctgacaaagaagtggctgagaaagagaacgaagttagcgtcagtttgcttaatattcaagttggattaattcgcaaagcatggaagcatccatctgcagatagtttgctagttgaggagatagatgttggggaggacaaagtgcggcaggttgttagtggtttggcaaagtactgcaatcctgatgagttgacgaatcgtcgtgttgtacttataacaaatgtcaaacctggaaaactacgggatgtgatgtctcaaggattggtcttatgtgcttcggatgaaggtccaaccattgtggagcccttgctccctccagaaggatcacagattggggaacgtatttctttttctgggattgatggaaagccagaagatgtactaaacccaaaaaagaaacagctggataagattacaccgcatcttttcactgatgacaagggggtagccacatacaagggaataccatttatgacgtctggtggaccatgcacatcatccattcccagagcaactattaaataatggagatatggcccattcattgttcttcgccactcatagatttttggtaccacaaaatatttgaagttttgattacgttaatgagacgttactatcttgttgacaagcttatgctgcacttgcacttgcatgctctttaatgctaccaatataatcttgaatccaatgattcttgaggtaataccatagtaactttctccacattgtaaaaagaacgaaagactttaaaattatacaacctaccaaccaagggttattatgcaggccttcaatgctac

SEQ ID NO: 5591 - DNA, 2064 bp, Glycine max
aacaaaatcccagaacaacaaggaagacagagaaatcggacaaaaacctaaacctaaaccttaccctgcaaagtgttgaatttacagtgtagtagtaaagtgagtagagaaatcgaagttgaaaagataatagatagtaacagcatcattcatcactcatcagagatggctaccgttgaaagtagaagcaaatcagtggtattggctctctccaagtacctatcattggatcctagtgttgttccagccgatacttcagacagtgatattaagagtctttacctgaacatcatagcggtatcaggacatggggttaatcactctgatgaggtgttgaagtgggtagcatttgcagaagccttccctgtggcccttgatgcatgctttgagaatctcaatagattaaatgatgaactgtctgaaaagtctgtgcttctgggcaatggattgaaaccctctgaagctgatgttatagtgtattcagtgattcattcttccctgatcaacctttcagatacaaacaaggaaaaactgccacatgtattgagatggatggattacatccagcacaagcaagaatttgtaggtttatttgagaaaatattgttgcagaagcctggatttgagcccccggtaacacaacctgttggagctgtggaagctgatttaaaatcaaacaagactgagcaaagtgtaaagaatgtcaacaagtccgaagtagactcaagcaaggataaaaacaaagctgagggaaaggcaacaggaggaaaatcaactggagacaaagaacccaccaaagccaaggcaaaacctgctgacaaagaagtggctgagaaagagaacgaagttagcgtcagtttgcttaatattcaagttggattaattcgcaaagcatggaagcatccatctgcagatagtttgctagttgaggagatagatgttggggaggacaaagtgcggcaggttgttagtggtttggcaaagtactgcaatcctgatgagttgacgaatcgtcgtgttgtacttataacaaatgtcaaacctggaaaactacgggatgtgatgtctcaaggattggtcttatgtgcttcggatgaaggtccaaccattgtggagcccttgctccctccagaaggatcacagattggggaacgtatttctttttctgggattgatggaaagccagaagatgtactaaacccaaaaaagaaacagctggataagattacaccgcatcttttcactgatgacaagggggtagccacatacaagggaataccatttatgacgtctggtggaccatgcacatcatccattcccagagcaactattaaataatggagatatggcccattcattgttcttcgccactcatagatttttggtaccacaaaatatttgaagttttgattacgttaatgagacgttactatcttgttgacaagcttatgctgcacttgcacttgcatgctctttaatgctaccaatataatcttgaatccaatgattcttgaggtaataccatagtaactttctccacattgtaaaaagaacgaaagactttaaaattatacaacctaccaaccaagggttattatgcaggccttcaatgctacaattattatatcgaatccattgagtcgagttaatgctacagcaaactatatacattggtaaaagaacatgagattgaagttatacaactaggcagtccgggattagtacaattcgtcataattatacaggatttgaggctgcgaatatttctcttggattaaataaaaaaaaaaatgcaagaatgaggatgacttcgaggcattttggtcaaacactatttcaagatgaatttaccgaaataagggggaaaaaaagaattagatgcaagattgaggtaattttgtcaatatggtatgttgataacttgatttggttaaatataaaggtcgacaaaaattatagcaaatgtgtaaggactaaggacaaggatgttggagccggtggaacaacatatcctgttgaaaaaaggtcgtgtgtagaaatagcaaagcggttcaatttgtcctc

SEQ ID NO: 5592 - DNA, 1619 bp, Glycine max
cgacaccgtttttgacagcgaacaaaatcccagaacaattaggaagacagagaaatcggacaaaaacctaaacctaaaccctgcaaagtgttgaatttacagtttagtagtgagtgaattgagaaatcgaagttaaaaagataatagatagtaacagcaccattcaatcactcatcagagatggctaccattgaaagtagaaggaaatcagtggctttggctctctccaagtacttttcattggatcctagtgttgttccagccgatagttcagacagtgatattaagagtctttacttgaacatcatagcggtttctggacatagggttaatcactctgatgaggtgttgaagtgggtagcatttgcagaagccttccccgtggcccttgatgcatgctttgagaatctcaagagattaaatgatgaactgtctggaaaggctgtgcttctgggcaatggattgaacccctctgaagctgatgttatagtgtattcagtggttcattcttccctgatcaacctttcagatacaagcaaggagaaactgccacatgtcttgagatggatggattacatccagcacaagcaagaatttgtaggtttatttgagaaaatattgttgaagaagcctgaatttgagcctctggtaacaaaacctgttggtgctgtggaagctgatttaaaatcaaacaagactgagcaaagtataaagaatgtcaacaagtccgaagcagattcaagcaaggataaaaacaaagctgagggaaaggcaacaggaggaaaatcaactggagacaaagaacctaccaaaggcaaggcaaaacctgctgacaaagtggctgagaaagagaatgaagttagcgtcagtttgcttaatattcaagttggattaattcacaaagcgtggaagcatccatctgcagatagtttgctagttgaggagatagatgttggggaggccaaagtgcggcaggttgttagtggtttggcaaagtactacagtcctgatgagttgatgaatcgtcgtgttgtacttataacaaatgtcaaacctggaaaactacgggatgtgatgtctgaaggactggtcttatgtgcttcgaatgaaggtccaaccattgtggagcccttgctccctccagaaggagcaaaaattggtgaacatatttctttttctgggattgatggaaagccagaagatgtactaaacccaaaaaagaaacagctggagaagattacaccgcatcttttcactgatgacaagggggtggccacatacaagggaataccatttatgacgtctggtggaccatgcacatcatccattcccagagcaactattagataacggagatatggcccattcattgttcttcaccactacagatttatggtaccacaaaatatttaaaagttttaattacgtgaatgagacgttactatcctgttggcaagtttatgttgcagttgcacttgcatggtcttaaatgctacaaatataatcttgaatccaattattcttgagttaataccgtagtaacttcatacacattttgaaaagaacgaaagactattttaaaattatacaacctacttccaaccaagggttattatgca

SEQ ID NO: 5593 - DNA, 1525 bp, Glycine max
cagaacaattaggaagacagagaaatcggacaaaaacctaaacctaaaccctgcaaagtgttgaatttacagtttagtagtgagtgaattgagaaatcgaagttaaaaagataatagatagtaacagcaccattcaatcactcatcagagatggctaccattgaaagtagaaggaaatcagtggctttggctctctccaagtacttttcattggatcctagtgttgttccagccgatagttcagacagtgatattaagagtctttacttgaacatcatagcggtttctggacatagggttaatcactctgatgaggtgttgaagtgggtagcatttgcagaagccttccccgtggcccttgatgcatgctttgagaatctcaagagattaaatgatgaactgtctggaaaggctgtgcttctgggcaatggattgaacccctctgaagctgatgttatagtgtattcagtggttcattcttccctgatcaacctttcagatacaagcaaggagaaactgccacatgtcttgagatggatggattacatccagcacaagcaagaatttgtaggtttatttgagaaaatattgttgaagaagcctgaatttgagcctctggtaacaaaacctgttggtgctgtggaagctgatttaaaatcaaacaagactgagcaaagtataaagaatgtcaacaagtccgaagcagattcaagcaaggataaaaacaaagctgagggaaaggcaacaggaggaaaatcaactggagacaaagaacctaccaaaggcaaggcaaaacctgctgacaaagtggctgagaaagagaatgaagttagcgtcagtttgcttaatattcaagttggattaattcacaaagcgtggaagcatccatctgcagatagtttgctagttgaggagatagatgttggggaggccaaagtgcggcaggttgttagtggtttggcaaagtactacagtcctgatgagttgatgaatcgtcgtgttgtacttataacaaatgtcaaacctggaaaactacgggatgtgatgtctgaaggactggtcttatgtgcttcgaatgaaggtccaaccattgtggagcccttgctccctccagaaggagcaaaaattggtgaacatatttctttttctgggattgatggaaagccagaagatgtactaaacccaaaaaagaaacagctggagaagattacaccgcatcttttcactgatgacaagggggtggccacatacaagggaataccatttatgacgtctggtggaccatgcacatcatccattcccagagcaactattagataacggagatatggcccattcattgttcttcaccactacagatttatggtaccacaaaatatttaaaagttttaattacgtgaatgagacgttactatcctgttggcaagtttatgttgcagttgcacttgcatggtcttaaatgctacaaatataatcttgaatccaattattcttgagttaataccatagtaacttcatacacatt

SEQ ID NO: 5594 - DNA, 1695 bp, Cicer arietinum
ccatttcagcccaatacctctaactatacaagaaaggcccgctattaaaatccagtggaagctacgtaagataccatttctgaattgaaacagtaattgagaacaaaacagaccccaaagaaagagaaatcagtctgaaccctaaacctaaaacccttcaaagcgtgaagcacatttttggaacattgctgtgtgtagaaagaagactgagataatttgaagttcaaagaatcattcaccactatcagaaatggcttctgttgacaatagaaagaaatcagtggttttggctctgtccaagcatctttcattggatcctagtgttattccagctgatagtttagacggcgatattaagactctttacttaaacattactgctgcatctggacaagaggtcaatcattctgatgaggtgttgaagtgggttgagtttgcagaatccttgcctgtggccctcgatgcatgctttgagagtctcaaaagattaaatgatgaactttctggaaagtctgtgctccttgggaatggattgaaaccctctgaagctgatgttatagtgttttcagtgattcattcttccctgatcagcctcccagacacaaacaaggaaaatttgccacatgtattcagatggatcgactacatccagcacaaacaggcatttgtaggcttatttgaggaaataatgttgcagaagccagaatttgagcctccagtaacaaaatctgttgatgtcgtggaatctgatttaaaatcaaacaagaccgagcaaagcataaagaatgcaaacaagtcagaagcagacataagcaaggataaaaagaaagctgagggaaagtcgacaggagatactggacctaccaaagccaaggcaaaacctgctggcaaagatgttgctgagaaagagaatgaagttagtgtcagtttgcttaatattcaagttggagtaattcgcaaagcgtggaagcatccctctgcagatagtttgttagttgaggagatagatgttggtgagaccaaattgcggcaggttgtcagtggtttggcaaagtacttcagtcctgatgagttgacgaaccgtcgagttgcacttattacaaatgtcaaacctggaaaactgcgggatgtgatgtctcaaggactggttttatgtgcttcgaacgaagatcacaccactgtggagcccttgcttcctccagaaggagctaaaattggggaacatgtttcgtttgctggaattgatggaaagccagaagaagtacttaacccaaaaaagaaacagctggagaagattacaccgcatcttttcactgatgacaatggtgtggccacgttcaaggggataccatttatgacttctggtggaccatgcacatcatccatttccagagcaactattaagtgatgaagatatagcccatttattgttgttgacccctcagattgtttagtaccgcaaaaacaatttatgtttttagtgacgtgaataaaacgtaccaacatttatgttgcagttgtaacatggtcttaaatgctctacaaacatgatctcgaatccaatgacttcgaaacttaatacactaaaacgaactatagtataaactttgaaagttatttatttctcaacaaacgatccaacaattagaatctgaaatctaacgatttagtagttagctgaacttctttagtggg

SEQ ID NO: 5595 - DNA, 1385 bp, Medicago truncatula
ggtagaacactaaaagagaatttgaagttcaaaggagaatcatcatcatcacaaatggcttccgttgacaacagaaagaaatcactggttttggctctctccaagcacctttcattggatcctagtgttttcccagctgatagtgcaggaggcgatattaagactctttacttaaacataatcgcggcatctggacacgaggttaatcattctgatgaggtgttgaaatgggtagaatttgcagaaaccttgcctgtttctcttgacggatgctttgagattctcaagagattaaacgatgaactatctggaaagtctgtgctccttggcaatggattgaaaccttctgaagctgatgttattgtgttttcagtgattcattcttccctgatcagccttccagacactaacaaggaaaagttggcacatgtgttgagatgggtggactacatccagcacaaactggaatttgtaggcttatttgaggaaatattgttgcagaagcctgaatttgagcctccggtaacaaaatctgctgctgctgtggaatctgatttaaaatcaaacaagactgagcaaagcgtaaagaatgtaaacaaggcagaaccagagactagcaaggataaaaacaaagcagaggtaaagtcaacaggagacaccgaaccggctaaggccaaagcaaaacccgcaaaacctgctgccaaagaggtgtcagagaaagagaatgaagttagtgtcagtttgcttaatattcaagttggactaattcgtaaagcgtggaaacatccctctgcagatagtttgctagttgaggagatagatgttggcgaagccaaattgcggcaggttgtcagtggtttggcaaagtactgcagtcctgatgagttgacgaatcgccgagttgcacttattacaaatgtcaaacctggaaaactacgggatgtggtgtctgaaggattggtcttgtgtgcttcaaatgaaggttccaccatcgtagagcccttgctccctccagaaggggctaaaattggggaacgtgtttcttttgccgggattgatggaaagccagaagatgtacttaacccaaaaaagaaacagctggagaagattacaccgcatcttttcactgatgacaatgggatggccacatttaaggggataccatttatgacttctggtggaccatgcacatcatccatttccagagcaactataaagtgatcaagagatatgtctcgttcattggtggtgaccactcagattgttagtaccacaactttttttaatgttttgaacaacgtgattaacatgttctaacatttatgttgcagttggtgtatcatggtcttaaatgctactaatatgatctcgaatccaatgacttc

SEQ ID NO: 5596 - DNA, 1616 bp, Medicago truncatula
aaaatatttgttattgggcgatctaaccataccgaaaaggcccgatacatttctcagtagaaacagtaactgaagaagacaacctgaagaaaaatcagaccgaaaccaaaacctaaaacccttcaaagtgcagaaccacaatttcgtagaacactaaaagagaatttgaagttcaaaggagaatcatcatcatcacaaatggcttccgttgacaacagaaagaaatcactggttttggctctctccaagcacctttcattggatcctagtgttttcccagctgatagtgcaggaggcgatattaagactctttacttaaacataatcgcggcatctggacacgaggttaatcattctgatgaggtgttgaaatgggtagaatttgcagaaaccttgcctgtttctcttgacggatgctttgagattctcaagagattaaacgatgaactatctggaaagtctgtgctccttggcaatggattgaaaccttctgaagctgatgttattgtgttttcagtgattcattcttccctgatcagccttccagacactaacaaggaaaagttggcacatgtgttgagatgggtggactacatccagcacaaactggaatttgtaggcttatttgaggaaatattgttgcagaagcctgaatttgagcctccggtaacaaaatctgctgctgctgtggaatctgatttaaaatcaaacaagactgagcaaagcgtaaagaatgtaaacaaggcagaaccagagactagcaaggataaaaacaaagcagaggtaaagtcaacaggagacaccgaaccggctaaggccaaagcaaaacccgcaaaacctgctgccaaagaggtgtcagagaaagagaatgaagttagtgtcagtttgcttaatattcaagttggactaattcgtaaagcgtggaaacatccctctgcagatagtttgctagttgaggagatagatgttggcgaagccaaattgcggcaggttgtcagtggtttggcaaagtactgcagtcctgatgagttgacgaatcgccgagttgcacttattacaaatgtcaaacctggaaaactacgggatgtggtgtctgaaggattggtcttgtgtgcttcaaatgaaggttccaccatcgtagagcccttgctccctccagaaggggctaaaattggggaacgtgtttcttttgccgggattgatggaaagccagaagatgtacttaacccaaaaaagaaacagctggagaagattacaccgcatcttttcactgatgacaatgggatggccacatttaaggggataccatttatgacttctggtggaccatgcacatcatccatttccagagcaactataaagtgatcaagagatatgtctcgttcattgttgttgaccactcagattgttagtaccacaactttttttaatgttttgaacaacgtgattaaaatgttctaacatttatgttgcagttgttgtatcatggtcttaaatgctactaatatgatctcgaatccaatgacttcaaaaaatatcctactccctccgtccctatacgtaaacacccatttgactttatttttgtccctaaatgtaaacccctcttcaaatta

SEQ ID NO: 5597 - DNA, 1790 bp, Trigonella foenum-graecum
agattataaaacgcaaagaagtaaaattgcaaaacggagggatgcgagaagaacatgagggtgggaaaagaatttctggaacaaatacaacgacagaaaggcccaaaatatttatcgaaatccaatgagaactacgataccatttctcagttgaaactgaagaacctgaagaaaaaccagatagaagaaacctaaacctaaaacccttcaaattgcaggaccacaatttcgtagaacactagagagagaatttgaagttgaaaggagaatactaatcatcataagaaatggcttccgttgaaaacagaaagaaatcactggttttggctctctccaagcacctttcattggatcctagtgttattccagctgatagtttagacggcgatatcaagactctttactcaaacctcattgcagcatctggaaaagaagttaatcattctgatgaggtgttgaagtgggtagcatttgcagaatcattgcctgtggctcttgatgaatgttttgagaatctcaagaaattaaatgatgaactttctggaaagtctgtgcttcttggcaatggatctaaaccctctgaagctgatgttattgtgttttcagcgattcattcttccctgatcagccttccagatacagacaaggaaaagttagccacatgtgttgagatggatggactacatccagcacaaacaggaatttataggcttatttgaggaaatagtgttgcagaagcctgaatttcagcctccggtatcaaaatctgttggtgctgtggaatctgatttaaaatcaaaaaagactgagcaaagcataaagaatgtaaacaagtcagaaccagacactggcaaggataaaaacaaagctgaggtaaagtcaaaaggagacaccgaacctgctaaagccaaggcaaaagccgcaaaacctgctggcaaagaggtgcctgagaaagagattgaagttagtgtcagtttgcttaatattcaagttggactaatttgcaaagcatggaaacatccctctgcagatagtttgctagttgaggagatagatgttggcgaagcaaaattgcggcaggttgtcagtggtttggcaaagtactgcagtcctgatgagttgacgaatcgtcgagttgcacttattacaaatgtcaaacctggaaaactacgggatgtggtgtctgaaggattggtcttatgtgcttcaaatgaaggttccaccatcgtagagcccttgctccctccagaaggggctaaaattggggaacgtgtttcttttgccgggattgatggaaagccagaagatgtacttaacccaaaaaagaaacagctggagaagattacaccgcatcttttcactgatgacaatggtgtggccacatttaaggggataccatttatgacttctggtggaccatgcacatcttccatttcaagagcatctataaagtgatcaagatatgtccccgttcattgttgttgaccactcagattgttagtaccgcaactttttttaatgttttggaacaatgtgatttaaacgtactactaacatttatgttgcagttattgttgtaacatggtcttaaatgctacaaatatgatctcgaatccaatgacttcgaaaaatatcctatattgtaaaatgagagaaagtgttgtgtggtcacaagacttgggagtttaggcacacacaaaaaagaaagagctaagtgtgtatttttaaagtaattaaatggtatatttttgtgtgtgccaaaaatatcgttaaatgtactaaacactctg

SEQ ID NO: 5598 - DNA, 944 bp, Cajanus cajan
gcggtatcaacgatcgaggaaggagaagacgaggaagcgcatcactgttctgagagctgaggaacatgtctgctgaatcgcccacttctgttcgtaaagtggttgttcatcttagagccaccggtgatgcccctattctcaagcaatccaagttcaagatagcaggaactgataagtttgctaaagtgatagactttcttcgccggcagcttcatagggagacattgtttgtatatgtcaatagtgccttttcaccaaaccctgatgaattggtcattgatttatttaataattttggttttgatggcaaactggtggtcaactacgcttgctctatggcatggggctaaccctgaatgatgattgctgattacaaaagctccatattgtgaatacatattgttctctttaagaaactcgggacttgcatatattcacagtacacgatttccttttcaacttgaagattctaacaaagatggaagtgtacaaaaccaacataggactctccacaatttattggttttatttgtttttcttttggaggggggtatttagacattaaaaacaaattggagtcacccatttaaaactattcatgtgatagttatggatgcttatggtttagagtcttgtactgcttattaaaaggccaatttgtatcatattgatgtatattacttcaatagttatactttcgcagcttgccatctgttcattacatggtcagagccagaggcgttccataatagtcctgcatttttctaattttattttggcaaaaggaacagtgggtagatatggtacatggctttgtgaaaaatatattttgttaacatagggtctgtttatttaaactaaaaaaaaatcttaaaaaaattgaagcaggtaagaatcgcttcttaaaagagtaggagattgcttatttaaaaaaaaaaaaaaaa

SEQ ID NO: 5599 - DNA, 745 bp, Glycine max
cgacgattcttatcgaataaaaaaatagaagaaaaattgcgacgatcgagcaaggtggagaaacagggatcagtgtagaggaagagcatcagtgttgtgagaactgaggacaatgtcttctgaattgccaagttctgttcgcaaagtggttgttcatctcagagccaccggcgatgctcctatcctcaagcaatccaaattcaagatagcaggaactgataaatttgctaaagtgatagactttcttcgccgacagctccacagggagacattgtttgtatatgtcaatagtgccttttcaccaaaccctgatgaattggtcattgatttgtttaataattttggctttgatggcaaactggtggtcaactacgcttgttccatggcatggggctaactctgaatgatggttgctggttacaaaagctccatattgtgaatacattgtttactttcagaaattcgggacttgcatataatcacagtacccgatttcttttgaacttgaagattctcacaagatgtaagtgcacaaaaggttttactttaggggggtagacatttaaagcaaactggagtcacccatttgggcgtgttcatgtgatagttatgggtgattatggtttgtactttgtactgcttgttaaaatgctaatccttcagttgttcatcatgactttttgaaaaatatattttgctgccaatacatataaaaacatagtcaatggaggcacataaaaagttt

SEQ ID NO: 5600 - DNA, 1064 bp, Vigna unguiculata
gggatatttaaggtttgtaataggaattattggtttcagtgttaatcttgatcttaatctactggaatctatctaatgggtcttcgcaatggataaaagggtttttcaattttgaagaaaagaagagattgttttgtttgtgttgtttgagagcaaggttcttcacgcagatcgattctccatctgcgccttcctctgcgcgcccatggccgcatcatagcagcgtccatcacatcaaaatcaatggcggagagcgcatcaccgtcgtccaaaccctcaccaatggatcctcaaaaccctgcaatcccttccccttcccacaagaacacagcttcaccctcgctccctctgccccccgaagagcagcaacagcaacagcagttgaacgtcctctcctcgaggagaaacagggataatactgaaggaagcgcatcacataacagtgaactgaagacaatgtctgctgaatcgccaagttctgttcgtaaagtggttgttcatctcagagccaccggtgatgctcctattctcaaacaatccaagttcaagatagcaggaactgataaattcgttaaagtgatagactttcttcgccggcaactccacagggagacaatgtttgtgtatgtcaatagtgctttttcaccaaaccctgatgaattggtcattgatctgtttaataattttggttttgatggaaaactggtggtcaactacgcttgctccatggcgtggggctaaaccctgaatcgtggttgttcgttactaaagcttcaaattgtgaatacacatcaaaaactcgggacttgcatataattttgacaagaccaagcgcagaaaacctacacaggactctaatctggatatttcttattcaattttcaattgttatcatgctcgtgtatttctgtatatatatttatgcatgtctactaaatcttgttttgatatacttcaaaagtattgataaacttcttcattaatatttcataaatgttgacattgttgtccttcattgcttataagcttcatgcaagttagtgattcataaaaaaaaaaaaaaa

SEQ ID NO: 5601 - DNA, 873 bp, Glycine max
ctaacacataaaaaacatatttaaatttactatttactcataagaaaaaaaatcgacgattcttatcgaataaaaaaatagaagaaaaattgcgacgatcgagcaaggtggagaaacagggatcagtgtagaggaagagcatcagtgttgtgagaactgaggacaatgtcttctgaattgccaagttctgttcgcaaagtggttgttcatctcagagccaccggcgatgctcctatcctcaagcaatccaaattcaagatagcaggaactgataaatttgctaaagtgatagactttcttcgccgacagctccacagggagacattgtttgtatatgtcaatagtgccttttcaccaaaccctgatgaattggtcattgatttgtttaataattttggctttgatggcaaactggtggtcaactacgcttgttccatggcatggggctaactctgaatgatggttgctggttacaaaagctccatattgtgaatacattgtttactttcagaaattcgggacttgcatataatcacagtacccgatttcttttgaacttgaagattctcacaagatgtaagtgcacaaaaggttttactttaggggggtagacatttaaagcaaactggagtcacccatttgggcgtgttcatgtgatagttatgggtgattatggtttgtactttgtactgcttgttaaaatgctaatccttcagttgttcatcatgactttttgaaaaatatattttgctgccaatacatataaaaacatagtcaatggaggcacataaaaagtttaaagaataaatatgtttttcaaactttcttggatttattttttttatccgtaggaatggaagacggatattagga

SEQ ID NO: 5602 - DNA, 1111 bp, Glycine max
aaaaatttgcgacgatcgagcaaggtggagaaacagggattattattattgtagagctgagaactgaggacaatgtctgctgaatcgccaagttctgctcgtaaagtggttgttcatctcagagccaccggcgatgctcctattctcaagcaatccaaattcaagatagcaggaactgataaattcgctaaagtgatagactttcttcgccgacagctccacagggaaacattgtttgtatacatcaatagtgctttttcaccaaaccctgatgaattggtcattgatttgtttaataattttggttttgatggcaaactggtggtcaactacgcttgttctatggcatggggctaaccctgaatgatggctgcaggttacaaaagctccatattgtgaatacattgtttcctttcagaaattcgggacttgcatataatcacagtacacgatttcttttgaacttgaagattctcaccggatggaagtgcggtaagacatttaaagcaaactggagtcacccgtttgggtgtgttcgtgtgatagttatggatgattatggtttgtgctgcttgttaaaatgctaatccttcagtaattcatcatgacatttttaaaaatatattttgctgccaatacacaaactcatagtcaacggattggaggcacaaaaaaagtttaaaggatgaacatattttcaaacttgcaccttggattctttttttttttgtctgtaggaatcgaagacatgtactgagaggtttataatcgctcacgcatcatattcaatcaatttagctatactgtcttggttggatcccttaaatgcattaaacaatgggaaaaacttaaaatgtgttgagacacagtacctatggtactgttggtgcaattcttaaaacaagatagggattttatctcatattatacctgaataaggttatgcatccttcacataaaaaataaaggttatgcatccttgtgttataggtttgcatgtaagcttgtaatccaatccattacagtacaataatcagagtgacgggcttcaccttgtaaatgtgtgttgatcaaggcccagggcccattttataataaatatataatgagg

SEQ ID NO: 5603 - DNA, 886 bp, Lupinus angustifolius
taaataaaataaaataaaaggtagcgagcttcagcaacgagaagagaagaagaaagaggattgaagagtgaaaagaacaatggctactgagtcaccgagttctgttcgtaaagttgttgttcatctcagagccaccggtgatgctccaattctcaagcaatctaaattcaagatagcaggatcggataaatttgccaaagtgatagactttcttcgccggcagctccacagggaaacattgtttgtatatgtcaatagtgcattttcaccaaaccctgatgaattggtcattgatttgtataataatttcggttttgatggcaaactggtggtcaactatgcttgttccatggcatggggctaactttgaacaaaggttggtgattataaaaatgctccttattgtgaatacacaatttcatttaaacttacattctgacaaaaatggaaatggaacaagaacaacatttgggtctcataaaagtcatgatctatgttgttgggtcattattggttagagactgtactgcttattgaattgctaatctgataactttgttcattctgtatattcattatcatgtagatgtaaattgtcaaccaattacttttcttatgagtgctaagacttttgtagcttgaaatctgtgattctgttcattactacttcagaggtgttccatttgcaagcacaaatcatcctgcctctagtttgatatctattaaagaaacttgtcatagatatggggcatgactttctcaaaaaaaatgtttttaatcctaaacccctagaaaaggcggcttagtagctctcacctagtagtgtctgttagctacgtggatgtacgtcttcttacccttgcaaataaagagattgtttgtggca

SEQ ID NO: 5604 - DNA, 719 bp, Theobroma cacao
gcaattttccttcatccttgctccgaaattcatctgactcgtgttttagctcaggcaacaatggcagccgagtcacctacttctgttcggaaagttgttgttcatttgagagcaactggggatgccccaatactaaagcaagccaaattcaagataccaggaactgacaaatttgctaaagtaattgattttttacgccggcaactgcaccgggatacactgtttgtgtatgtcaacagtgccttctcaccaaacccagatgaattagtgattgacctgtataataattttggttttgatggtaaactggtggttaattatgcctgttccatggcatggggctaactctctgtgatggatttgctgagataaaactgttcattctatactaacttcttacttccacacaagcaagggaatatcattggtggtattctgagcattctgatcaaggagacattgattgaagcagcagttaatgtgcatctgtcactttgttttttcttcttttctttattgttgatttcattaacatagctatacggtttggagttatgcatcctgtatattccaacttgttcataattcaagtcgagaaaacttctcttggttcacgtgcttcaagtacatcctgtgaattttttctctgttgattggcgtcaattgttgaatgtgttttgatgccaagacaaattgtccttggtttgcttgctgcgtac

SEQ ID NO: 5605 - DNA, 830 bp, Arachis hypogaea
agcagtggtatcaacgcagagtacgggggggttagaaattaatcagattttggttaaccagtcgaatactcccactgtcccacaccttgcctctcttcgtccttcgtttctttagcggcggcggctacctcaccggaggagccgtcgatgagcctctctccaccgtcccagtgttgcggacctctccccaatttctgctcatattctctcaaagcaaataccccttcctcaccctatttcggctattcggccgtcgttcttgatctctattggagttaaaagaaaaatataaagaatattcaggtattcaagtgtcagcaatggctgctgagtcaccaagttccgttcgtaaagtggttgttcatctgagagccactggtgatgctcctattctcaagcaatctaaattcaagatagcaggagctgataaatttgcaaaggtgatagattttcttagacggcaactccacagggaaacattgtttgtatatgtaaacagtgctttttcacccaatcctgatgaatcgatcattgatttgtatactaattttggttttgatggcaaattggtggtcaactacgcatgttctatggcatggggctaattctgaatgatacttgctaagcatataatttcttcttattaattgtgaatacgtttagttttgacaaaaagatagaatggaacagaaacatgaaacccaaaaatttgttgtttttttgaattattttttttcttcctttgcgtgtataaattcaaagcagagttacccacttgaatgtcgcgacaaaaagaaaagttcattaatatcataatttacggattgtta

SEQ ID NO: 5606 - DNA, 1410 bp, Theobroma cacao
ggcttacattgagctcaattctgctacctaacctcggcccaagtttcaccatggcccatagaatattggaaacttgaaatctaccgtggaagtagcaattttccttcatccttgctccgaaattcatctgactcgtgttttagctcaggcaacaatggcagccgagtcacctacttctgttcggaaagttgttgttcatttgagagcaactggggatgccccaatactaaagcaagccaaattcaagataccaggaactgacaaatttgctaaagtaattgattttttacgccggcaactgcaccgggatacactgtttgtgtatgtcaacagtgccttctcaccaaacccagatgaattagtgattgacctgtataataattttggttttgatggtaaactggtggttaattatgcctgttccatggcatggggctaactctctgtgatggatttgctgagataaaactgttcattctgtaatatcacctgttcatttgtttccttcaatagcttttcaaaaaaaaaaaaattgtttccttcaattctccattatgcagtcctcgtagaaccctctttaattttgcttttttcctctttatctttatctctgaaataatggtgtttctgtagcagatactaacttcttacttccacacaagcaagggaatatcattggtggtattctgagcattctgatcaaggagacattgattgaagcagcagttaatgtgcatctgtcactttgttttttcttcttttctttattgttgatttcattaacatagctatacggtttggagttatgcatcctgtatattccaacttgttcataattcaagtcgagaaaacttctcttggttcacgtgcttcaagtacatcctgtgaattttttctctgttgattggcgtcaattgttgaatgtgttttgatgccaagacaaattgtccttggtttgcttgctgcgtacccttgctcccttcagaaattattactctttagtgcttcccatctaatactttatcaaatgcatgccatgcatcagaaactttatcgaatgtggttccaacgtgtaagattgttgtaccctttatggctaaagacttcatagccagatataccattttaaagctgtagatgattgttgagtaggaagtcagaatttcatttacacttgaccctctggagcaaccctagcaatttattcgacatttatagcccagcaccggctcaagcgatcaggttttgcattaggtgggaaccactaaaatgtgggaatcttttgttgttacgttttcatggtacagaagtaaacggcaacgtgatacacttggagcagtcatgattctgcaatcatgctacttcaagctgaatagaccacaaaagtggacataaaagatgaaaatttca

SEQ ID NO: 5607 - DNA, 795 bp, Cicer arietinum
atttaactcttattttgtattctcacatagaagtagcgagaagaaaacaggattgaaagtgcttagagtgttctgagaaattgcgatcatggctactgaatctccaacttctgctcgtaaagttgttgttcatctcagagccaccggtgatgctcctattctcaaacaatccaaattcaagatagcaggaactgataaatttgccaaagtgatagactttcttcgcagacaactgcacagggacacattgtttgtatatgtcaacagtgctttttcaccaaatcctgatgaactggtcattgatttgtataataattttggttttgatggaaaactagttgtaaactacgcttgttctatggcatggggctaacactaaatcatggttgctgattcatatacaagctgcacatttcaaaatgtgaatagatattgttttgctttacttgttgctgcacctttcagccgaaactcagggcttccattgtatacaatcaaattacattcttgaagattctgacaaggtagaaatggaacaaaaactaacacatgaccaatcataacttgttgatttgaaatgccgttattttaggtgtgtctttacatattggagtcacagttttagtttttattcatgtcaatatagttatggatgatggtcgttttagagactagtactggtatgcttgttgtagtgataaaagttcagatatccattctttaatcaataattttattgcaaaagtagccaataattttattttattttacaaaagtagcactataatgataatt

SEQ ID NO: 5608 - DNA, 957 bp, Lotus japonicus
ggaattgcaaggctgcaactcttgatcaagcagagaaggcaaaagggagtgactgaagaagaccagagaaagtggttctgtgttcggcgaacggagatccatgtcggttgaatcgccaagctctgttcgtaaagtggttgttcatctgagagctaccggtgatgctccgattctcaagcaatccaaattcaagatagctggaactgataagtttgccaaagtgatagactttcttcgccgacagctccatagggacacattgtttgtatacgtcaatagtgcttttccaccaaatcctgatgaattgatcattgatttgtataataattttggttttgatggcaaactgatagtcaactacgcttgttccatggcatggggctaactctgaatgatggttgctgattattggagtgaacttcactcactcacttgcatatactataaaagtacacacgatttctttataacttggaagattctgacaaatacggaaatggaacaaaaccaacacggtagggactcttcatgattttggtttgaaatgtttttttgggagtgtctacttttatagcaaattggaatcacccttctgggaatattcatgtcatgatagttgtggactgacaattatttagagactcgtagtgcttgttgaatcctttagttattcattctgtaataattattattttgatgtatatagcttcggccaattttttctttttctttttgaattgtacatcttagtagtaaaacttttgaaacttgctatctgttcgttggttagaacatctcccgtggagatcttaagttgagatcttaaaataagagatggatctaacaagaacttgtcattggagttatcctacatggcatgagatttttagcaaaagcttcctcttggagctgtaaaattttgattcagttgtagattgtgacttaaagaacaaatta

SEQ ID NO: 5609 - DNA, 732 bp, Medicago truncatula
ttcttcttcttcttcagtgttccttcttctccatggctgctgctgaatctccaacttctgttcgtaaagtggttgttcatctcagagccaccggtgatgctcctattctcaaacaatccaaattcaagatagctggaactgataaatttgccaaagtgatagactttcttcgcagacagctccacagggaatcattgtttgtatatgtcaacagtgctttttcaccgaaccctgatgaactggtcattgatttgtataataattttggctttgatggaaaactggttgtcaactacgcttgttctatggcatggggctaacactaaaataacagttgctggtcgatataacctgcaaattccaaaatgtgaatatatatagtttttctttagttgttaccacacgtttcagcacaaactcggacttcaattgcatacaatcaaagtacaatattgctattgaacttgaagattctgacaaggtagaaatggaacaaaaactaacatgtgttcttcataacttgttggtttgaaatgcctttattttaggagtgtctttacataatggagccacccttttagttttattcatgccattttttttttgttgagaaatctatcatgtcaatttagtcatggatgatggtggtttagaaactcgtatgcttgttgaagtgataaccattcaactattattctttaatcaatatatcatgatgatgtatatagcttc

SEQ ID NO: 5610 - DNA, 730 bp, Medicago truncatula
gtaggaaatagggattgaaattggttcttcttcttcttcttcagtgttccttcttctccatggctgctgctgaatctccaacttctgttcgtaaagtggttgttcatctcagagccaccggtgatgctcctattctcaaacaatccaaattcaagatagctggaactgataaatttgccaaagtgatagactttcttcgcagacagctccacagggaatcattgtttgtatatgtcaacagtgctttttcaccgaaccctgatgaactggtcattgatttgtataataattttggctttgatggaaaactggttgtcaactacgcttgttctatggcatggggctaacactaaaataacagttgctggtcgatataacctgcaaattccaaaatgtgaatatatatagtttttctttagttgttaccacacgtttcagcacaaactcggacttcaattgcatacaatcaaagtacaatattgctattgaacttgaagattctgacaaggtagaaatggaacaaaaactaacatgtgttcttcataacttgttggtttgaaatgcctttattttaggagtgtctttacataatggagccacccttttagttttattcatgccattttttttttgttgagaaatctatcatgtcaatttagtcatggatgatggtggtttagaaactcgtatgcttgttgaagtgataaccattcaactattattctttaat

SEQ ID NO: 5611 - DNA, 1177 bp, Arachis hypogaea
gggttagaaattaatcagattttggttaaccagtcgaatactcccactgtcccacaccttgcctctcttcgtccttcgtttctttagcggcggcggctacctcaccggaggagccgtcgatgagcctctctccaccgtcccagtgttgcggacctctccccaatttctgctcatattctctcaaagcaaataccccttcctcaccctatttcggctattcggccgtcgttcttgatctctattggagttaaaagaaaaatataaagaatattcaggtattcaagtgtcagcaatggctgctgagtcaccaagttccgttcgtaaagtggttgttcatctgagagccactggtgatgctcctattctcaagcaatctaaattcaagatagcaggagctgataaatttgcaaaggtgatagactttcttagacggcaactccacagggaaacattgtttgtatatgtcaacagtgctttttcacccaatcctgatgaatcgatcattgatttgtatactaattttggttttgatggcaaattggtggtcaactacgcatgttctatggcatggggctaattctgaatgatgcttgctaaacatataatttcttcttattaattgtgaatacgtttagttttgacaaaaggatagaatggaacagaaacatgaaacccaaacatttgttgtttttttaattatttttttcttcctttgcgtgtataaattcaaagcagagttacccacttgaatgtcgcgacaaaaagaaaagttcattaatatcataatttacggattgttatggctttgagggacccatgtttaaaatggttgaagtgcttatccttagggtgtttactttaataattatcgtattgttatgtagtttaagcaagttacttctttgtagaggtaaaaagggaatgaaatgcttcacaaatgaactatgtgtaattaatttacaatgtaattttcattcgtgaaaattctctgttccatttttatccccctaaccaaacgtattattaggagtcttgttgatcagggttgttctatgtgaagcatgaggataatccagcacttcttcagcaagcagttgttagatgtaatgttttaaaaatctgatttaagaactatttggcaagtaatttatttttatgattaataaatagttaaatc

SEQ ID NO: 5612 - DNA, 600 bp, Primula obconica
gcatctccttcgccagagagagagagagatgtcctcagactccccaagttcagctcgtaaagttgtggttcatctaagggcaactggcgatgccccaattctcaagcaagctaagttcaagattgctggatcagacaagtttgctaaagtgattgactttcttcgtcggcagcttcacagagaaactttgtttgtgtatgtcaacagtgccttttcgcccaacccagatgagttggtgattgatctttacaataattttggttttgatggaaaacttgtggttaattacgcctgttcgatggcatggggctaactatggctgttaccgttacactcttttttgatgtaaaggcctgccacctgaatacgtattttacctattcctgctctcttacggccctttggcaggttagtacttggcatcaagctgtttcattgaacatatataattgtacatggcacattaagtaacaggaatttgatgtccgttctgtaattggtgcaactctttctgtaaataattcaatgaatccagtcccttttgttttggtacctgttacattgtgaaaattattttgaattgtttccagaataccttgc

SEQ ID NO: 5613 - DNA, 735 bp, Trigonella foenum-graecum
atagagaagcgagaagaaaaaagggattgaaagtgcttcgctacgcttcagtgttcttcttcttcttcttcttcatggctgttgttgaatctccaacttctgttcgtaaagtggttgttcatctcagagccaccggtgatgctcctattctcaaacaatccaaattcaagatagctggaactgataaatttgccaaagtgatagactttcttcgcagacagctccatagagagtcattgtttgtatatgtcaacagtgctttttcaccgaaccctgatgaactggtcattgatttgtataataactttggttttgatggaaaactggttgtcaactatgcttgttctatggcctggggctaacacaaaagtgacggttgctgattgatataatcttctgcaaattttaaaatgtgaatacatattgtttttctttagttgttgccactcgtttcagcacaaactcgggtcttcaattgcatacaatcaaagtacaatatttctactgaacttgaagattctaacaaggtagaaatggaacaaaaactaacacggtactcttcatagtttgttggcttgaaatgcctttattttaggagtgtctttacatattggagtaagccttttagttttatgcatgtcaatttagttatggatgatggtggtttagaaactcatatgcttgttgaagtgatataatcattcagctatccattctttaatcaataatatatca

SEQ ID NO: 5614 - DNA, 859 bp, Quercus alba
atgggcacccataaaatcccagcctaacccgaaaattgagagaggaagaggaagaggaagaagtagaccaagattgagagggagaaggaaattgaggtttgaaaaataacaaacggaaagcccaattgggcccaaacactaagcccataaaccttggaaccaataaaacttgccgtggaaatagcaatttacccacatctgagtctgacccgaaactcgttctttgtttgttttcagaggaaaataacaatggcagctgagtctcagtctccgagttctgttaaaaaagtggttgttcatctgagagccactggtgatgctcctattctcaaacaagcgaaattcaagatacctggaactgacaagtttgctaaagtaattgactttctacgccgacaacttcatcgggaaacattgtttgtctatgtcaacagtgcattctctccaaacccagatgaattggtgattgatctgtataataattttggttttgatggtaaactggtggttaattatgcttgttccatggcatggggctaacggattttggtgaagggtctgcttgtgtaaattcattttaaactcggattattacttccatacaagcaaggaaacacgatttgatggtaaatttgaagattgtgattaggggattgaagattggaactgaaagtttagattcataatcatttgagttgaagccacacttttattgagttgctttgcttacaagctgtaattacctggttgattgatattcaatacataatgatgtatatagctaaaaggttaatgctaaatgtgcttcatgcccatcaaaaaaaaaaaaaatgtgcttcatgtgagaaaaatgtctaat

SEQ ID NO: 5615 - DNA, 864 bp, Panax ginseng
ggagcacaaccggcttaaaccacgtactcgtcgtaacttaaaaacatattattttggttagaagttggagcaatccaatggcttcagagtctcctagtaatgctgctcgaaaagttgtagtccacctaagagctactggtgacgccccaatcctgaagcaagctaagttcaagattgctgggaccgacaagttcgcgaaagttattgattttcttcgccgtcaacttcacagggagacattgtttgtttatgtcaatagtgccttctctccaaacccagatgaattggtgattgatctatataataattttggttttgatggtaaactggtagttaattatgcttgttccatggcttggggctaactctcatcaccactattgagttgtatatctgtcgaattgtgtatatggtgagtacaattgtgagttttcttattctcttgtctctctttaggtctttccacatgacccaaactagtctgggactatatatatgtaatgttcacatatagtattctttcctcattgccaatccggatgtgtagctgatggctttggtagcttttaacttgacagaaaggtagtaaacatatcacaatacatgcgagttgccaaactatttcttcccaagtgctcatcccctattactagcgctcattacaatgatggaagcagacactacttgcatgaatataatttttgaaggaaaaggaaatagacatgagttaaatggaatatttctccttcttttctttttctttttggtttttccccttttggtactatgtataaaatggtttctattttgacaaagtccggctacatgagtattgaatatttatggcatccgagtccgaatttt

SEQ ID NO: 5616 - DNA, 741 bp, Gossypium raimondii
taacccttattttttaaagggattcgtgctttagctcaggtaatcatggcagctgagtctcccagttcagcacgaaaagttgttgtccatttgagagcaactggggatgcccccatactaaaacaagccaaattcaagatacttggaactgacaaatttgctaaagtaattgattttttgcgtcggcaattgcaccgtgatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctccattatgcatattcctcatagaaccatcttctataattttttccccctttttctctgagaaacgggtgatcctgtagcagatactaacgtcttgctactactcaagcaaggaaatattggtgttctgaagattctgataatggcgacatcaatttgaactgcagttgatgtacatctatcacactgttttttattttcctttttgtacattccacttgtacgttccaacttgtttgtaattcaaatctggaaaacttctcttggttcacatgcatcgagcacgtaaatttctttgttggatttggagcatttgctgaatgttatttgtttttctttggttc

SEQ ID NO: 5617 - DNA, 736 bp, Gossypium hirsutum
cttaattagttgtgtagaggctaaatttatgtttttaacccttattttttaagggattcgtgctttagctcaggtaatcatggcagctgagtctcccagttcagcacgaaaagttgttgtccatttgagagcaactggggatgcccccatactaaaacaagccaaattcaagatacttggaactgacaaatttgctaaagtaattgattttttgcgtcggcaattgcaccgtgatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctccattatgcatattcctcatagaaccatcttctataattttcccccctttttctctgagaaacgggtgatcctgtagcagatactaacgtcttgcttctactcaagcaaggaaatattggtgttctgaagattctgataatggcgacatcaatttgaactgcagttgatgtacatctatcacactgttttttattttcctttttgtacattccacttgtacgttccaacttgtttgtaattcaaatctggaaaacttctcttggttcacatgcatcgagcacgtaaatttctctgttggattt

SEQ ID NO: 5618 - DNA, 876 bp, Gossypium raimondii
cttaattagttgtgtagaggctaaatttatgtttttaacccttattttttaaagggattcgtgctttagctcaggtaatcatggcagctgagtctcccagttcagcacgaaaagttgttgtccatttgagagcaactggggatgcccccatactaaaacaagccaaattcaagatacttggaactgacaaatttgctaaagtaattgattttttgcgtcggcaattgcaccgtgatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctccattatgcatattcctcatagaaccatcttctataattttccccccctttttctctgagaaacgggtgatcctgtagcagatactaacgtcttgcttctactcaagcaaggaaatattggtgttctgaagattctgataatggcgacatcaatttgaactgcagttgatgtacatctatcacactgttttttattttcctttttgtacattccacttgtacgttccaacttgtttgtaattcaaatctggaaaacttctcttggttcacatgcatcgagcacgtaaatttctttgttggatttggagcatttgctgaatgttatttgttttctttggttcaaagctgaatatgttttgatgtcagagaaattgtctttgggattcttgccgcttacctttgctcccttgagaaattaatactcttcagtgcttttgatcta

SEQ ID NO: 5619 - DNA, 515 bp, Actinidia deliciosa
ttcgttgaggaagaagatcatggcttcagagcccccaagttctgctcgcaaagttgttgttcatctaagagccactggcgacgccccaattctcaagcaagccaagttcaagattgcaggaactgataagttcgctaaagtgattgactttcttcgacgacagcttcacagggagacattgttcgtgtatgtcaatagtgccttctcacccaatccagatgaattggtgatcgatctatatactaattttggctttgatggtaaactggtggttaactatgcttgttccatggcatggggctaactattaccaaggatctgacttcagacctatatacctttatcattgctatggcacaccctatgtggttcgtacgtttgtaaatattttcaagctactatactatttcccctgtaacacgctatcggtttcctcgtgtacatttgacttttgtaccacacaatttggcatcttatatgctctactgctttcttgtcccattaaaaaaaaaaaa

SEQ ID NO: 5620 - DNA, 627 bp, Castanea mollissima
  misc_feature (84)..(84): n is a, c, g, or t
ctaaggaaagacccaacttagggcccgaaaccaacctaaagacccataaaacccttaggtaaccaataaaactttagccgtggngacagcaatttcccctaccatctgagtctgacccgaaactcgttctttgtttgttttcagaggaaaataacaatggcagctgagtctcagtctccgggttctgttaaaaaagtggttgttcatctgagagccactggtgatgctcctattctcaaacaagcgaaattcaagatacctggaactgacaagtttgctaaagtaattgactttctacgccgacaacttcatcgggaaacattgtttgtctatgtcaacagtgcattctctcccaacccagacgaattggtgattgatctgtataataattttggtttttgatggtaaactggtggttaattatgcttgttccatggcatggggctaactcttggattttggtgaagggtctgcttgtgtaaaattcattctttaagctcggattattacttccatacgagcaaggaaacacgatttggtggtaaatttgaagattatgattaggagattgaagattggaactgaaagtttagattcataatcatttgagttgcagccacactttta

SEQ ID NO: 5621 - DNA, 1743 bp, Aristolochia fimbriata
aagtgaggaagtctatcaggaccctctgaaaattggagggagacgaatttgagcaaagcagcgaagggagccgatcccctaagaagaaggaaggacctcgtcgtgtcggtgctcccctgccggacggaggtagccggcgagagcgagctgacggaaccatcacgttttcttctcttatcaatcgatttttcctcccatccaaattcagttgctgacctaatcattgattgtattgacttggcttgaactagtcttgagctcggcttgaaaactcagtatttgctcaaattcgtatgtaaagttgaggtcaagctcgaggttgagttcgaagaaaatctattgagctaaggccaaagataccagggttcgagctaagcccaaaaataccagggttcgagctcagctcagctcgtttccaccccttgcctcatgttggactccagtttttcaggatgagatacgctcaaacttaagcagttgatttagctcaggatcgaagtattttgatagataaaagctcaaagctttttccaaagtcatggctgctgagtctgtggcatctacccgaaaaggtgttgttgtccacctgcgagctacaggtgatgctcctatacttaaacaagcaaaattcaagatagctggaacagacaaatttgcaaaggtcattgacttcctccgccgacaacttcatagggacacactgtttgtgtatgtcaacagtgccttctcaccaaatccagatgaactggtgattgatctttacaataattttgggtttgacgggaaactggtggtcaattatgcctgttccatggcgtggggttaggatgtattgacttgtatactggcattcatcagatcatgaagtttcacacccaaaatttcatcttctttgttgttttcctggaggcagtcaaaattctctcactacctgaaaaggttttaatagcacaactgtgaaaggcgtggacgaattcatgatattcattcattcaaacatgtaaatcattttatggcagtttccgggtgcttgaattgtaaagagacttactgaacttgattattttatagaatctggttatgtaagtttttgttgacaatggatttatggagtgtgaatatgcaagtattttgatattactatcaaataatgattgggatctgggaccttttaaggaaatttatgttccttggaatgcagaacgagcttcatttttgaaagaacattattccaaacatcttcccttttgtggatttacgccattgatggcaatgaccatccccttcctgataatgaaatgataatcaaacacgcctaatcattgtatcacggcatcaatgacagaatagccaaaaaagaaggcagagagcccgattcaaagaagattgattacccaggaacaactcagtttctaccaaaagaaacttccatttcaatggtatccgtaagaagtttatcaacaattacaacttggattttttctttccattgcttctgttgggggtacgtctcggtgacccgaatccgttgccagtgccgctgctatcattctccaagaggtccatttccttttccattcgttcttcattcggatcttccgttggcgcagctcctaaaataaactccggtacaacaaaatttgcaatccagtagacgaatagaagcacaccacttgcaataaaaaaaaacaaaaaaaccaaacacctgttcagaggaggatgttcatagcagaaactaaaatt

SEQ ID NO: 5622 - DNA, 956 bp, Prunus mume
caggatcgaattgaaattccaattccatcattagccttgttatttgaaacccctgattcttccgtccaagttcaattgtttgtaagttgaggcgttcgaatcagagatcgatagcaatgtcgaccgtggagtctccgagcgctgttagaaaagtggttgttcatctgagagctactggtgatgcccctatactgaagcaagccaaatttaagattcttggaactgacaagtttgcgaaagtgattgagtttctaagaaggcaacttcaccgggataccttgtttgtgtatgtcaacagtgcattctctccaaacccagatgaattggtgattgatctctataataattttggttttgatggtaaactggtggtcaattatgcttgctccatggcatggggctgacactcatgtttcggctgacagtacctattgatagtgtgaacacgaaattattccttccgcacaagcaaagggagcatgagttgctgtccatttaaaaaaaaattcggaccagggatggatgaagatatttcaatactttttttcttctcattgtatatatgctatgattactcttggttgggatgtaactatctgcttttgttactttttctataaatctagatgtaaaggcaaaaaattgatatatgctggttcaaacaatttacctatcttccgtatttgaatgacagtgattttgtcgccctaatgctttcccatctgtccaaaagtccaaaagaagaaggaaaaaaattccgatgatagaagggattgacagatccagcctgatctcgagacatatcaggtttgggacatagcacgggcttcatcttcatggcggtggcagataactcagtggagagtggaagttctaagaaattgacttgaagttttgtagttttcctttggtttgggatgtaggcgaattattcagagcctaaatgggacacgagc

SEQ ID NO: 5623 - DNA, 547 bp, Vitis vinifera
gcttatccccgtcccggccggcggctgcgaggtctccccatctctcctaaacttctcccggtcttcggccggagctatatgaggcagaaactcgtcccacgtatctggatatagcaattacccaaacggtctcaaaggtccgagcttcacatcagaaaagccatggcttctgaatctccaagctctgcacgtaaagttgttgttcatctgagagccactggtgatgcgcctatactcaagcaggccaagttcaagattcctggaactgacaaatttgctaaagtgattgaatttcttcgcagacaactacacagggacacattgtttgtatatgtcaacagtgcattctcaccaaacccagatgaattggtgattgatttgtataacaatttcggttttgatggtaaactggtggtaaattatgcttgttcgatggcatggggttgactgttggcaactagtctcggctgtatttgtagaattttccacagaattggtctcttgactagtcattaggctgtctacgagaggtgacaagcaaactgat

SEQ ID NO: 5624 - DNA, 651 bp, Gossypium hirsutum
catggcagctgagtctcccaattcagcacgaaaagttgttgtccatttgagagcaactggggatgcccccatactaaaacaagccaaattcaagatacttggaactgacaaatttgctaaagtaattgattttttgcgtcggcaattgcaccgagatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctttattatgcatattcctcattgaaccattttctataattcccccccccttttctctgagaaacgggtgatcccgtagcagatactaacttcttgcttcttctcaagcaagggaatattggtgttctgaagattcggataatggcgacatcaatttgaactgcagttgatgtacatctatcacacttttttattttcttttatgtacattccacttgtacgttccaacttgtttgtaattcaaatctggaaaacttctcttggttcacatgcatagagcacataaatttctctgttg

SEQ ID NO: 5625 - DNA, 1519 bp, Vitis vinifera
aataggtggaatttagaaaaccggcacaagcttatccccgtcccggccggcggctgcgaggtctccccatctctcctaaacttctcccggtcttcggccggagctatatgaggcagaaactcatcccacgtatctggatatagcaattacccaaacggtctcaaaggtccgagcttcacatcagaaaagccatggcttctgaatctccaagctctgcacgtaaagttgttgttcatctgagagccactggtgatgcgcctatactcaagcaggccaagttcaagattcctggaactgacaaatttgctaaagtgattgaatttcttcgcagacaactacacagggacacattgtttgtatatgtcaacagtgcattctcaccaaacccagatgaattggtgattgatttgtataataatttcggttttgatggtaaactggtggtaaattatgcttgttcgatggcatggggttgactgttggcaactagtctcggctgtatttgtagaattttccacagaattggtacatatgtcattgctattttagtcttcttctgaagggtggcaaggaactccataaaatgtttgaatggttttttagtttttatttgtttatttatttatttcaattttcctctcaagaattagcttagccagctattctgtactgtcattagcggctgtatcttgatttacaaaaattgtgaacaacaagtttgcagtttaatgaacttactgatacctaccctttttgccgtctcctagatatgaaaataaatagcagataagcactattgaaatacaccatatattgagtgaatatgttccttctgttgttttggttatagtctatccaagaggtaacactattttcattgttggagctgctgcagagttggtacatatatgctaaacagtattgaaatcttggagtttgtgattgaattagaagtgaaagttggtacattgttacctatacttcatgaccttaaagtatgtagtaggttttcgattatgtttaatgaaattcattcttgtgatggatcatgatttcaaccttggtactggcataggtctcttgactagtcattaggctgtctacgagaggtgacaagcaaactgatagatgggccagcatgctgtcagtgactcaaattcacttccttacaaaggggcacatgtagcttgtagatcaaagattctgatggaaacagtgagaggatttgaaagcaagaggttcatgtacaatcactacatgatttttcccccttttccccctcaaactgcaatgttcaagttatgcaataataaaacaaacctgtgtgacaagattcgataaggcttgtacaaattcacatgtttcggatgcatgcccgtgatttgatgttgattagcttccaactgttgaaatacatcatgtgaaatccagaaccctttttcatagtcattttatagttcctcatgctgtaacatttattccctttcgagctagtaagacttttaggccttgtcatccg

SEQ ID NO: 5626 - DNA, 465 bp, Carpinus betulus
tggccgctgattctccgagttctatacgaaaagtggttgttcatctcagagcaactggcgatgcgcctatactcaaacaagccaaattcaagattcctggaactgacaagtttgctaaagtgattgactttctatgccggcagcttcatcgggaaacattgtttgtctatgtcaacagtgcattctcaccaaacccagatgaattggtaattgatctgtataataattttggttttgatggtaagctggtggtcaattatgcttgttccatggcatggggctaacaaatggtgatgggtctgctgctgtacatttgttcatgtagtaagtgcagagtaactcattgtctcttttttcgtatttctcctcggtctgataattgataaggaacaggtatttgctggtatattgaagtattatgattaggatctgaagagtaggaactgagtagtttataccataatc

SEQ ID NO: 5627 - DNA, 626 bp, Papaver somniferum
cttcattgaacaagttctctcttgtctcctctccactgttcccaaaacctctcagaaaacaattgatggctacagaatcaccaaattcgtctcgtaaagttgtggttcatcttagggcaactggtgatgctccaatacttaaacaagcaaagttcaagatagcaggaactgataaatttgctaaagtaattgattttcttcgtagacaacttcaccgagatacactatttgtgtatgtaaatagcgctttttcgcctaaccctgacgaattagtgaatgatctttacaataattttgggtttgatggaaaactggtggtgaactatgcttgctcaatggcctggggctaagaggtgaagatcttgggattggcgttacaaacacagtaccatgtaaatcctctcttttgtttcagctttcttttctatcttgttcgtatgtggaaaagagaataactttcaacattgattaccatgtacaaaatacagaggcttgttatttttagttcatccttgacttcatttcttgagttcattgctcttttcttttatcctaatattttcctgattcttgtgcactttacgggggtaaaataatgatttagtgtctgaaaaaaaaaaaaaaaa

SEQ ID NO: 5628 - DNA, 754 bp, Amborella trichopoda
gagtctctccctctctctctctcatccgatctcccctgtgaatgcacctctctctctcatctgatctccccctgtgaatccacctctctctctctatctctctctctctcttctgttcttctgcaaactgcaaagaaccaacgattcaacgattctgtttctcggaatataagaaatctcagttgagagatggctgctgaatcgcctgctactccgcgcaaagtggttgtgcatctcagggcgactggtgatgcccccattcttaagcaagccaagttcaagataggagggactgagaagtttgcgaaagtcattgattttcttcggagacaacttcatcgggagacacttttcgtttatgtcaacagtgctttctcacccaatccggatgaattggtgatcgatctgtatgataatttcggatttgatgggaaattggtggttaattacgcttgctccatggcatggggttagtaggcaattgcaattgaggttatggaatcactatctcgttataacttttcttgtatatatgtcatattcttctagtgtagctaatttgggtttctcttgagtgtcatctgttgataggagccatattcaatagaaaatattaccgatgcttgtgattcttttccttctggtaagcctgaagttctgatggtcttgtttttttctcgctgtcttcactaaacccttcgtaatctcgtaaattctccattgattttttcatgtttaagttcttttcttgaaa

SEQ ID NO: 5629 - DNA, 469 bp, Cleome spinosa
attcaataatggcgaccgagtctccgagttctgtgcgaaaagttgttgttcacctaagagctactggtggcgctccaatactcaaacaatctaaattcaagatcccaggaactgacaaattcgctaaagtgattgactttcttcggcggcagcttcattcagacacattgtttgtctatgtgaacagcgctttctcgccaaaccctgatgaatcggtgattgatctatacaataattttggctttgacggtaaactggtggttaactatgcattttccatggcatggggctaaaaactgatgaattcgccattctcaagctttgaagccaaggcaaggttctttgtggtatatgagcacaacatcagtacctatccctgagcttcattgtagaaccgaaagtctctgtacattcatagcaataccactgatctttttttatacatgtacaaagtggtgtttattcggct

SEQ ID NO: 5630 - DNA, 690 bp, Gossypium hirsutum
catggcagctaagtctcccaattcagcacgaaaagttgttgtccatttgagagcaactggggatgcccccatactaaaacaagccaaattcaagatacttggaactgacaaatttgctaaagtaattgattttttgcgtcggcaattgcaccgagatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctttattatgcatatgcatattcctcattgaaccatgttctataatttccccccccctttttctctgagaagcgggtgatcctgtagcagatactaacttcttgcttcttctcaagcaagggaatattggtgttctgaagattctgataatggcgacatcaatttgaactgcagttgatgtacatctatcacacttgttttttatttctttatgtacattccacttgtacgttccaacttgtttgtaattcaaatctgggaaacttctcttggttcacatgcatcgagcacataaatttctctgttggattttggagcagttgctgaatgttatttg

SEQ ID NO: 5631 - DNA, 726 bp, Euonymus alatus
ccggggttcctcgctgctacggccgggagggcgacctcttgatggaaaagacttgatttcgtatctctttcagcggacgccagaaggaatcttcctctctaatctttcgacttcagatcgaggtgtgtattgatgatcttgggaaagaatgtctatggagtcaccgaattcattccaaaaggtagttgttcatttgagagccaccggggatgctcctatactcaagcaagctaagtttaagatagctggaacagaaaagttcgctaaggtgattgactttttacttcggcaacttcaccgggagacactgtttgtatatctcaacagtgcattctcaccaaaccctgatgagctggtgattgatctatataataattttggctttgatggaaaattggtggtgaattatgcttgctcgatggcgtggggctaagtctcggagacagcttgcctgatacaatttggaacacttttttcttgatggtccaaaaaactttgatcatggtggagactacaagtactactagtggattccaacttgtgtattattttgaactgaccagatttctgctgctttacatggcttaagtaaattctgcaaatctttctcgtgctgggaacataaaaatatattagttgcattattgatgtaaagtagaaatagctattcacccttttcgtagtgattggtaaggtgtctgtctgtgcatgccagcttattcagaa

SEQ ID NO: 5632 - DNA, 853 bp, Euonymus alatus
gaccaagcctcaactctgttctctcttgcgggatttgcgaccaagactggtttcgattctctctgttctctcttgctgggattcgattctctctgttctgtgcaactacgttgttttcgacgcaacactgactgtcctcttggtaatttcttcgattcttcagatctgtgatatgctgaagaatatgtaaagaaaagaaagaaaatcggagtggatttactacgctgcactgacgtgttggacagcgctcgtgaactacttgttggacagataagactggcgcctgagtcctctgtctctttctctcatggagattacagtgatgctggagaaatttatgcaaacaatcttgctcactttgttgaaaagagtctgaaacacaagagggctgcttctggaaacaatgtctatggagtcactgaattcagtccaaaaggtagttgttcatttgagagccactggggatgctcctatactcaagcaagctaagtttaagatagctggaacagagaagttcgctaaggtgattgactttttacttcggcaacttcaccgggagacactgtttgtatatctcaacagtgcattctctccgaaccctgatgagctagtgattgatctatataataactttggctttgatggaaaattggtggttaattatgcttgctcgatggcgtggggctaagtctcggaaacggcttgcctcatacagaacaatagagaactggacgaagcatttcttgatattgtcgctaataattgtacatttataagtacagcgcatatttgggcactaaaaatttgcactattgattgactatgcatgtaacaaacacatcgtgctcggttc

SEQ ID NO: 5633 - DNA, 824 bp, Tropaeolum majus
gggaaacccaactaactaaaagccttactactccttctcctccaatgcagagacgattcacatacccttgaattgattgatccccgcgatcttcgtcgacaaagctgctcaactcatcatccaaaaccataatttcaacacttaatttcttcgtcgacagctcatgactcgttaaagagaagccaataacaaaggacgaaaggtactaagggaggaaatctctacacctacatatcccgcgaccaacgttcaactcagaatggctaaagaatcaccgagttccattcaaaaagttgtggtccatttacgcgcaacgggtgatgctccaatactcaagcaaactaagttcaagataccaagtacagataagtttgctaaagtgattgattttctacgccggcagcttcatcgtgacacactgtttgtatacgttaatagtgcattctcaccaaaccctgatgaattggtgatcgatttgtacaacaactttggttttgatggcaaattggttgtcaattatgcttgttctatggcgtggggttaactccacgatcactaactaggtttctaagtagtcgttgtatagttttagcatcgtacagctaccctttccgcgcttttaagattgaagtcatcctcctcttacactttgtttaaatgttgcttgtagatgaaggtacataaataccttgattcttgaattatcttttggtacgaatggcttttgtctttattctcattctcatttccaattcttccagttttattttaaaataaacttatgttatcaataatatttttaattttatagacaaaaaaaaaaa

SEQ ID NO: 5634 - DNA, 647 bp, Panax ginseng
ggagcaatccaatggcttcagagtctcttagtaatgctgctcgaaaagttgtagtccacctaagagctactggtgacgacccgatcctgaagcaagctaagttcaagattgctgggaccgacaagttcgcgaaagttattgattttcttcgccgtcaacttcacagggagacattgtttgtttatgtcaatagtgccttctctccaaacccagatgaatttgtgattgatctatataataattttggttttgatggtaaactggtagttaattatgcttgttccatggcttggggctaactctcatcaccactattgagttgtatatctgtcgaattgtgtatatgcttctccggatgtgtagctgatggctttggtagcttttaacttgacagaaaggtagtaaacatatcacaatacatgcgagttgccaaactatttcttcccaagtgctcatcccctattaggctagcgctcaatacaatgatggaagcagacactacttgcatgaatagaatttctccttcttttctttttctttttggtttttccccttttggatatgtataaaatggtttctattttgacaaagtccggcttcacgagtattgaatatttatggcatccgagtccaaattttgtgtcaaa

SEQ ID NO: 5635 - DNA, 920 bp, Panax ginseng
aagcagtggtatcaacgcagagtacatggggaggcttggagcacaaccggcttaaaccacgtactcgtcgtaacttgaaaacatattattttggttagaagttggagcaatccaatggcttcagagtctcttagtaatgctgctcgaaaagttgtagtccacctaagagctactggtgacgacccgatcctgaagcaagctaagttcaagattgctgggaccgacaagttcgcgaaagttattgattttcttcgccgtcaacttcacagggagacattgtttgtttatgtcaatagtgccttctctccaaacccagatgaatttgtgattgatctatataataattttggttttgatggtaaactggtagttaattatgcttgttccatggcttggggctaactctcatcaccactattgagttgtatatctgtcgaattgtgtatatggtgagtacaattgtgagttttcttattctcttgtctctctttaggtctttccacatgacccaaactagtctgggactatatatatgtaatgttcacatatagtattctttcctcattgccaatggattagcttctccggatgtgtagctgatggctttggtagcttttaacttgacagaaaggtagtaaacatatcacaatacatgcgagttgccaaactatttcttcccaagtgctcatcccctattaggctagcgctcaatacaatgatggaagcagacactacttgcatgaatagaatttctccttcttttctttttctttttggtttttccccttttggatatgtataaaatggtttctattttgacaaagtccggcttcacgagtattgaatatttatggcatccgagtccgaattttgtgtcaaatcagccaagtttaagtttactaatgaattatcttttggta

SEQ ID NO: 5636 - DNA, 560 bp, Rosa hybrid cultivar
gttcagatttcggaaacaaggattcgtagcaatgtctaccacggaatctccgactgctgctaagaaagtggtcattcatctcagagctactggcgatgcccctatactgaagcaagccaaattcaagatacctggaacggacaagtttgctaaagtgattgactttttaaggaggcaacttcaccgggatacgttgtttgtgtatgtcaatagtgcattctcgccaaacccagatgaattggtgatggatctgtataataattttggttttgatggtaaactggtggtcaattatgcttgttccatggcgtggggctaactatcagtgtggggtttggaggcatataactattgataatgagtacatcaaattttctttccacaaacgtggaacataagttgctgatgaagacatgaagatatgttggactctctttttgtacatattctgtttctttcaattggtggccatgtaacttttcaacaagtctagatgtaaagccaaacactgatatatgatgctactgttcaaaagatttcctttattcaaaaaaaaaaaa

SEQ ID NO: 5637 - DNA, 732 bp, Carica papaya
accgatgaacggattctgacagagtggcggacgagttaatggtggtcaactcgtaaatcggcgtttcttttccgcgcaatctcggtattgatcatggcaagcgactcaccaagttctgttcggaaagttgttgttcatttaagagccaccggtgatgctcccatactcaagcaagctaagttcaagatactgggaaatgacaagttcgtgaaagtgattgactttctgagacgacaacttcaccgggatacattgttcgtctatgtcaacagtgcattctcaccaaaccctgatgaatcagttattgatctttacaataattttggttttgatgggaaattggttgtcaattatgcttgttccatggcatggggctaactcagtaataggggctgtgtagaagctgttcatattgatctgaacctgtaaatgatctgagccaacaagcctactactgcctcacagagttgaactccgctataatggaatttaggctgtgcataatttgtttagattgaaatgtgaagtaaataactaaagataaaatattcttacaattttgcatcctgcttttttcttctattcgagaatcacgagctgtcaatgatttctattttcggtcttaagtgatgttccattatcttaccatgaccagtaaaattgagtgatttaaattgcttcccatgtattattgccaccaaaatttagttgtacttttagttgaattggttg

SEQ ID NO: 5638 - DNA, 707 bp, Solanum lycopersicum
aaaggagttgatatttttctataaatttggacgcactgagcaaaagaatcagcaaattctccatagctatggctgccgattctcgaaaagtgattgttcatttaagagccactggcgatgctccgattcttaaacaagcgaaattcaagattgcaggtactgacaaattcatcaaagtaatagattttttgcgccgtcaactccatagggagacattgtttgtgtatgtcaacagcgccttctcaccaaatccagatgagttggtaattgatctatacaataactttggttttgatggtaagttggtggtcaattatgcatgctccatggcgtggggctgagaactcctggttgtttgcgctacaacgcttcaaagcttcaaagcctcctccatacatgagtaaatagatagtatgtaagatagaaacccaacatcaatgattagtcagattgttattctgtagattgttcagtatataactactcgtatgatttctatatcgatgctttgtgcttcagtagtctccttatgtactattcaccagctcttcaaagttcagacttggatatctgttatattcgtatgagaagttgtgagtccctttcaactctcaccattgccaccctttaattctgtaaagttaacaatcctctttcattggtgtgtaatttcaaatttgtttgtaactttcatctctatattggga

SEQ ID NO: 5639 - DNA, 794 bp, Solanum lycopersicum
ataatttaaagctaaataggacaaaagcattagtccagactaaatgaacttggttaaaggagttgatatttttctataaatttggacgcactgagcaaaagaatcagcaaattctccatagctatggctgccgattctcgaaaagtgattgttcatttaagagccactggcgatgctccgattcttaaacaagcgaaattcaagattgcaggtactgacaaattcatcaaagtaatagattttttgcgccgtcaactccatagggagacattgtttgtgtatgtcaacagcgccttctcaccaaatccagatgagttggtaattgatctatacaataactttggttttgatggtaagttggtggtcaattatgcatgctccatggcgtggggctgagaactcctggttgtttgcgctacaacgcttcaaagcttcaaagcctcctccatacatgagtaaatagatagtatgtaagatagaaacccaacatcaatgattagtcagattgttattctgtagattgttcagtatataactactcgtatgatttctatatcgatgctttgtgcttcagtagtctccttatgtactattcaccagctcttcaaagttcagacttggatatctgttatattcgtatgagaagttgtgagtccctttcaactctcaccattgccaccctttaattctgtaaagttaacaatcctctttcattggtgtgtaatttcaaatttgtttgtaactttcatctctatattgggatttgattgtgctcagttaaaagagctcctaaa

SEQ ID NO: 5640 - DNA, 436 bp, Tripterygium wilfordii
caaaagtaactctgttgttcctctcaacccgggcggtctctcttgatttcgtttctttctcaccggacgccggaaggaagacaagaaattggaagagaagccaactaattccctactccgagtctccgattgtttgcctctttacaatcaagggcagcaatgtctacggagtcaccgaattcagtccaaaaagtggttgttcatgtgagagccactggggatgctcctatactcaagcaagctaagtttaagatagctggaacagagaagtttgctaaggtgattgactttttacttcggcaacttcaccgggagacactgtttgtatatgtcaacagtgcattctcaccaaaccctgatgagttggtgattgatctatataataattttggttttgatggaaaattggtggtcaattatgcttgctcgatggcgt

SEQ ID NO: 5641 - DNA, 631 bp, Arabidopsis thaliana
aacgtcttcttcattcagttacgaaaaccatcaatggcgacggagtcgtcgtccccgagctctgttcggaaagttgttgttcatctaagagctactggaggtgctcctatactcaaacaatctaagttcaagattccagggactgataaatttgccaaagtgattgactttcttagaagacagcttcattctgattcgttgtttgtctatgtgaatagtgctttctcgccaaaccctgatgaatcagtcattgatctttataataactttggatttgatggtaaactggtggttaactatgcttgttccatggcatggggctaaaactgaagactacagaattctcaaagctgtgctcgcgctagatgcttgctttgttggaaagatgacctttcagatgaaagttgctgtacataaccaagcaatggaattgaaaattttaccctatatacatgtacataaagaccatatcaaacgtcaaaaacattagattttagtctcgtctttgtatttttccgtcggctaaacaaaagtctcttgttccagtactcagagattccaaagaagcgttaaacatatttcatctgtgccttgctctttgttatctatgccaatgcaatgcttatgctta

SEQ ID NO: 5642 - DNA, 601 bp, Arabidopsis thaliana
tcttcattcagttacgaaaaccatcaatggcgacggagtcgtcgtccccgagctctgttcggaaagttgttgttcatctaagagctactggaggtgctcctatactcaaacaatctaagttcaagattccagggactgataaatttgccaaagtgattgactttcttagaagacagcttcattctgattcgttgtttgtctatgtgaatagtgctttctcgccaaaccctgatgaatcagtcattgatctttataataactttggatttgatggtaaactggtggttaactatgcttgttccatggcatggggctaaaactgaagactacagaattctcaaagctgtgctcgcgctagatgcttgctttgttggaaagatgacctttcagatgaaagttgctgtacataaccaagcaatggaattgaaaattttaccctatatacatgtacataaagaccatatcaaacgtcaaaaacattagattttagtctcgtctttgtatttttccgtcggctaaacaaaagtctcttgttccagtactcagagattccaaagaagcgttaaacatatttcatctgtgccttgctctttgttatcta

SEQ ID NO: 5643 - DNA, 470 bp, Chelidonium majus
gactctgaaacaagcatggctgctgctgccgaatcaccaaattcatcccgtaaagttgtagtccatcttagggcaataggtgacgctcccatacttaagcaagccaagttcaagatagcaggatctgacaaatttgccaaagtaatcgactttcttcgtcgacaacttcacagagacacactgtttgtgtacgtcaacagtgccttctcaccgaaccctgatgaattggtgattgatctttataataattttgggtttgatggaaaattggtggtaaactatgcttgctcaatggcatggggctgatgtctgtaatgttgcttcggacttttaaatggtcatgagtactctaattcctgtgctgatattaacaagatctggaagtcctacattaagatggttcgcttctatgtggaaaactgcgatcagagatatcttgggcttcagtagaatataggaaacgaacagtc

SEQ ID NO: 5644 - DNA, 932 bp, Fragaria vesca
atacgaaatcgaattctattcaaaaccctaaaaatctttgacaaaattccaattcaattcgaaactgggtattcatcagaagttgagattgataccaatgtcttcaacggaatctccgactgctgctaagaaagtggttattcatctcagagctactggtgatgcccctattctgaagcaagccaaattcaagatacctggaactgacaagtttgctaaagtgatagactttttgaggaggcaacttcaccgggatacgttgtttgtgtatgtcaatagtgcattctcgccaaacccagatgaattggtgatggatctatataataattttggttttgatggtaaactggtggtcaactatgcttgttccatggcgtggggctaactatcagtgtggggttggcagacatataactattgataatgtggacatcaaattttcctttccacccaagaacatgttacatgagttgctgatggagacatgatattttggactctgttctttcaattggtgggcatgtaacttttaaacaagtctagatgtaaaggcaaacactgatatatgatggtactgttcaaaagatttacctttattcacaatttttgaatcatagcgagtgagtttgtctatctaatgcttttccatctgttaaaaatgtaaagcgacaatgatagagccatagaggtgatcaatatcgccagcctgttatcgtacagatctatatcaaatcaaatgattgtggtattgaaattttacagcgcctccatggtagtggatcacctctggctgttctgaattgtgctagaatttgataagcttgttcttgtttaagtggctgtggtgtggtttctgtgttgcagatcatgaaatgttgtttctgtgtagttgaaagactttaaaatccaacagaagccactgaagtctgtca

SEQ ID NO: 5645 - DNA, 643 bp, Acacia harpophylla
ggtagaacgccggtcgggagcaaccgattgggtgaagttttgattcctaagcgggtccttgatttcataagaccatggctactgattcaccaggttccgttcgcaaagtggttgtccttctgagagccaccggtgatgctcctatactcaagcaagcgaaatttaagattgctgggactgataaatttgctaaagtgattgactttcttcgccggcaactccacagggacacattgtttgtatatgtgaatagtgctttctcaccaaacccagatgaatcagttattgacttgtataaaaattttgggattgatggcaaattggtggtcaactacgcttgttccatggcatggggctaattctcaagaatggctgctgatttgtaaatgaaacgcttgcttctgttttgggatttgggagtcataacacttaaaatgctggaatgcaaagctttaagttgtttattctttagtcatcatgaatagtttcaatcacttattctgttagcaaatactttttcaatcgagactgtcccatgtaggaagcagaaatcaaccaccaataattcatttcctgtacagaaagagggatatgaacatactatttccttccttgttaatatgatatacaatattcttttttt

SEQ ID NO: 5646 - DNA, 671 bp, Beta vulgaris
gttttcttgatcgaagcttcttcctacgggctatggcttccgaatcaccaagtgctgttcgaaaggttgtgatacacttgagggctactggtgatgctcccattcttaagcaacaaaaattcaaggtctctggcactgacagatttgctagtgttattgattttttacgacgtcaactacatagagaaactctgtttgtgtatatcaacagtgccttttctcctaatccagatgaatcggtgatagatctctataataactttggaattgatggtaagctggttgtaaattatgcttgttccatggcgtggggatgactttagtgcgatgtctttgttgggataaatcattgaaatgtacattcagtttgctatatcaagttcttcactgctacaaggccatgtacaggacactgcagattgtataaatttcaaggagctggttagctgatagattgttgagtattctggctttctctcctagatatgtcttacagcagcaaaattaatacatatgatttctcaggattttatttgtaaagttgatctgattcatgttgatgtctgtagcaagcaaagaatttgcttaaaaactctggtcccgcattgtgcttgttcttctatttcacagtcgacaaaggtaacacggaaataaaatcgataattgaattg

SEQ ID NO: 5647 - DNA, 671 bp, Elaeis guineensis
agccccatccccgactctctcttccctccgacgagctctatctaccggccttgagcaccagccagtgttcgaggcggggcggtcggacgaggccctcggccgcttagccaccgccgtccacgccccgctccgccacccccgctgccgccgtcgagactgctttcaggtccatctccggcgccgttctatcatggccgcagaatcgccgacttccgaccggaaagttgtagttcacctgagagcgaccggcgatgctccaatactcaagcaagccaaatttaagatttctgggaatgacaaattctctaaggtcattgaatttcttcgtcgtcaacttcatagagatacattatttgtttatgtcaatagtgcattttcaccaaatcccgatgaattggtgattgatctatacaataattttggctttgatgggaagctggtggtcaactatgcatcctccatggcatggggctaagagaaaacgcacggtggtcttcaagctggatttctggctacttgcacagggaaagataagcttgttttttttttttggattcatgattgtaaaatatttcttggcaacagatgaatgatgacagagttgccactttgtgacaaatataagttgtactgattacaagtattgtttctttataggaatccaggtttaa

SEQ ID NO: 5648 - DNA, 541 bp, Raphanus sativus
ggagagtaacgtcttccttcttcagcaatctctctctctctcttcatcaatggcgacagagtccccgagctctgttcgtaaagttgttatacatctaagagctactggaggcgctcctatactcaaacaatctaaattcaagattccagtaactgataaatttgctaaagtgattgactttcttagaagacagcttcattctgactcattgtttgtctatgtgaacagcgctttctcgccaaaccctgatgaatcagtaaacgatctgtacaataactttggctttgatggtaaactggtggttaactatgccttctcaatggcatggggctaaagccaagaactactacattgttctcatgtcacggttgtgctagatgttctggctttgttgaaaaatggcttccagatggaagttgctgtacataatctagcattgtaattgatatttttgtcaccctaaatacttcatgtacataaaagaccatatgaaacttccaaaaatactattttttttctttttgaatgaatgctaaattta

SEQ ID NO: 5649 - DNA, 501 bp, Eutrema halophilum
tcttacgaaccatcaatggcgacagagtccccgagctctgttcgtaaagttgttgttcatctaagagctactggaggtgctcctatactcaaacaatctaaattcaagattccggggactgataaatttgctaaagtgatcgactttttaagaagacaacttcattctgactcattgtttgtctatgtgaacagtgctttctcgccaaaccctgatgaatcagtagacgatctatacaataactttggctttgatggtaaactggtggttaactatgctttttcaatggcttggggctaaaggcgcgtactacggtattctcaagccgcggtgaagatagatcctcgctttgttggaaagatgactttcaaatggaagtttctgtacataatctagcgttggaattgataatttcttactctaaatactacatgtacacaatgacaaaatcaaacttcaaagaaattaggttttaatctcgtatgtgtatttttgttgagc

SEQ ID NO: 5650 - DNA, 591 bp, Eutrema halophilum
ggaaaaaggaagagagcgacgtcttcttcaggtatctttccatcttacgaaccatcaatggcgacagagtccccgagctctgttcgtaaagttgttgttcatctaagagctactggaggtgctcctatactcaaacaatctaaattcaagattccggggactgataaatttgctaaagtgatcgactttttaagaagacaacttcattctgactcattgtttgtctatgtgaacagtgctttctcgccaaaccctgatgaatcagtagacgatctatacaataactttggctttgatggtaaactggtggttaactatgctttttcaatggcttggggctaaaggcgcgtactacggtattctcaagccgcggtgaagatagatcctcgctttgttggaaagatgactttcaaatggaagtttctgtacataatctagcgttggaattgataatttcttactctaaatactacatgtacacaatgacaaaatcaaacttcaaagaaattaggttttaatctcgtatgtgtatttttgttgagctcgtgttgagattcaaaattaggaaacagagattgttatttttcttct

SEQ ID NO: 5651 - DNA, 896 bp, Chenopodium quinoa
accgtacattgttcgaaatttcgtctattcatttgctcggcacttttataaaggggtatcttatacagtagatttattgatcgaagcttctttcccatggcttccgaatcccccagtgccgttcgaaaggttgttattcacttgagggctactggtgatgctcccattctcaagcaacaaaaattcaaggtttctggcaccgataaatttgctagtgttattgattttttacgtcgtcaacttcacaaagataccttgtttgtttacatcaacagtgccttttctccaaatccagatgaatcggtgatagatctctacaataacttcggaattgatggtaagctggttgtcaattatgcttgttccatggcttggggctgactctggtggtgatgtctgattgttgttccggctatatcatattaccaaaatgtacattcagcttgcttactgaagttctttgctgctatatgaggacactgcagatggtgaaaatctcaaggtgatggtttagctgatagattttgatttgtgtttttctgaagcatgctggttctctctatccacctttagtgtgtcatattgcagcaatacacattattttttcttgatttcacttgtaaaattgacatgatttttgttaatgtttgtaaaaagccaaagaattagttttgtaaaaacttcagccctgcatcttgttcgttttccttcttctttctttctttgaaagtaaatgtctgcaaaaagccgactagtttgctttgtaaaaacttcagttctgcttagtgctcatttccttctttcctgatttaaaactctccagtaaaggtgcgttctcttcaattacttggattcaactaataagctggctctggcagaatctaatttaactgcac

SEQ ID NO: 5652 - DNA, 356 bp, Arabidopsis lyrata
aacgtcgtcttcttgagttacgtaaacaaaccatcaatggcgatggagtcgtcgtccccgggctctgttcggaaagttgttgttcatctaagagctactggaggtgctcctatactcaaacaatctaagttcaagattccggggactgataaatttgctaaagtgattgactttctaagaagacagcttcgttctgactcattgtttgtctatgtcaatagtgctttctcgccaaaccctgatgaatcagtcattgatctttataataactttggatttgatggtaaactggtggttaactatgcttgttccatggcatggggctaaaactgaagactacagaattcttaaactgt

SEQ ID NO: 5653 - DNA, 621 bp, Arabidopsis lyrata
aacgtcgtcttcttgagttacgtaaacaaaccatcaatggcgatggagtcgtcgtccccgggctctgttcggaaagttgttgttcatctaagagctactggaggtgctcctatactcaaacaatctaagttcaagattccggggactgataaatttgctaaagtgattgactttctaagaagacagcttcgttctgactcattgtttgtctatgtcaatagtgctttctcgccaaaccctgatgaatcagtcattgatctttataataactttggatttgatggtaaactggtggttaactatgcttgttccatggcatggggctaaaactgaagactacagaattcttaaactgtggtcgcgctagatgctcgctttgttggaaagatgacactttcagatgaaagttgatgtgcataatcaagcaatggaatacatgtacaagaaaaaaagaccatatcagacttcagaaaacattagatttcatttaaatctcgtctttgtattttcattggctaggaaaaagtctcttgtacagttctctgagattgcaaaggagcgttaaaacattttttcatctctgcattttgctctttctttctttgttttctatgccaatgc

SEQ ID NO: 5654 - DNA, 403 bp, Arabidopsis lyrata
ccaaagtcccaacaatggcgacggaatctccgaattctgttcggaaaattgttgttcatctaagagctactggtggtgcttcaatcttgaaacaatctaaattcaagattgcagggactgaaaaatttgctaaagtgattgattttctaagacggcagcttcactctgactcattgtttgtttatgtaaacagcgctttctcgcctaaccccgatgagtcagtaattgatctatacaataactttgggtttgatggtaaactggtggttaactatgcttgttccatggcatggggttaaaagccaacaatccgagtatcatgttgcatcttatgctaagatgagacaagctgctactacttgactttgctaggagaattcaattgtagaagaaacttgttgta

SEQ ID NO: 5655 - DNA, 498 bp, Arabidopsis lyrata
aagtcccaacaatggcgacggaatctccgaattctgttcggaaaattgttgttcatctaagagctactggtggtgcttcaatcttgaaacaatctaaattcaagattgcagggactgaaaaatttgctaaagtgattgattttctaagacggcagcttcactctgactcattgtttgtttatgtaaacagcgctttctcgcctaaccccgatgagtcagtaattgatctatacaataactttgggtttgatggtaaactggtggttaactatgcttgttccatggcatggggttaaaagccaacaatccgagtatcatgttgcatcttatgctaagatgagacaagctgctactacttgactttgctaggagaattcaattgtagaagaaacttgttgtatgtatgtacatccttaggaatgggtctccattcttttcttttttttgcaaaatgggctatgaacgtaaattaaatgggcttaggcccattaagtgagt

SEQ ID NO: 5656 - DNA, 894 bp, Mimulus guttatus
aaaaagttttgcagctacttccgtatggcttcggaaactcgaaaagttgtagttcatctgagagccaccggcgatgctccgattctcaagcaagccaaattcaagattgctgggactgacaagtttgtaaaagtaatcgattttcttcgtcgtcagcttcatcgggagacattgtttgtgtatgtaaacagtgcattctcgccaaatcctgatgagttggtctcagacctctataataactttggtttcgacggcaaattggtggtgaattatgcatgctccatggcgtgggggtaattactacccagaatttattctgtacattcgtaaagtaaatataggtcctagtggtggtagactgacaattcgaagatgatactgctagtgaaaatggtcgtccctcaagaagtggcgtgcattttacaaaatagtttacggttattttcattccacagacatattctttgcagattaaaactcgttctgcgaaagaaaattattttcgaataatgcaatattgtggccctcctatattacttttattgtatatatttgttcaccgggaaaataaaattctggctcggccaccgactcaatggctaccaaattcgagaaacttagtgttgaaggactctcatttgagaaatcaaagaagtcatcatcattgactttagaatttgcatttgagtcctcaaaaccactgctgctcctgctacttttactactagaatttgcattcgagtcctcaactttagtttctttgtctgaaaaccctgcaactaatactcccgtgtctgataccttcttgctcaaatgatagttccagtagttctttacctcattgtctgttcgacccggcaatcttgctgcaatcaacgaccatctgcagtacga

SEQ ID NO: 5657 - DNA, 663 bp, Nicotiana benthamiana
caagagaatcgtgtaaatttcatttaatcaaaggagctatggcttccgattctcgtaaagtgattgttcatttaagagcaaccggtgatgccccaattcttaaacaagccaaatttaagattgcaggtactgacaaattcatcaaagtaatagattttctgcgccgccaacttcatagggagacattgtttgtgtatgttaacagtgccttttcaccaaatccagatgagttggtaattgacctatacaataactttggttttgatgggaagttggtggttaattatgcatgctccatggcgtggggctgagaactcttggttgttcgcactacattatttcaaatcaccatacctagtaaatacatttagtagagcaatagaaccgtggcatcaaatataagtaagattgttctccagtagattgttcagtattgagctacggtatgtagaatgatgcttgccaattttgcttcagtagttctttgatagactattctgtctatactcgggcaggagacatttcgggcttttgctgtcccttttcttgtacaatcccctgaagcttagagttgaatgtctgccgtattggtgtgaaaagtttacgtgtcctttcttctctcaccatagtgactcttaagttctgtaaagttagcaatactcc

SEQ ID NO: 5658 - DNA, 491 bp, Allium cepa
cttcaatgatttatggctgctgaaattgctggtgctgatcggaaggttgtgattcatcttaaagcaactggagatgctccaattctcaaacaagcgaaattcaagattgctggaacagataaattttcaaaggttattgaattcctacgccgtcaacttcaccgtgatacagtatttgtttatgtcaatagtgcattttcacccaatccagatgaattagtcattgatctattcaataattttggatttgatgggaagctggtggtgaattatgcaagctccatggcatggggctagttagacttgcagacaaagttgattttggagttcatgcatcaggatacgccatatcaaaagttgcaaaaatttatggtttctgttatttggattcttgtaaaaatgtgtgacaaaaccattattctccctgtgagggatattatgctcaaatgtttgttttattttcgtagtgtacatctttttattcatataca

SEQ ID NO: 5659 - DNA, 473 bp, Allium cepa
aaaagccggaacacttcaatgatttatggctgctgaaattgctggtgctgatcggaaggttgtgattcatcttaaagcaactggagatgctccaattctcaaacaagcgaaattcaagattgctggaacagataaattttcaaaggttattgaattcctacgccgtcaacttcaccgtgatacagtatttgtttatgtcaatagtgcattttcacccaatccagatgaattagtcattgatctattcaataattttggatttgatgggaagctggtggtgaattatgcaagctccatggcatggggctagttagacttgcagacaaagttgattttggagttcatgcatcaggatacgccatatcaaaagttgacaaaaatttattggtttctgttatttggtattcttagtaaaatgtgtgacaaaccattattctcctgtgagggatattatgctactaatgttttgtttt

SEQ ID NO: 5660 - DNA, 959 bp, Capsicum annuum
gcacgaggcgaagagaagcttgaaatactcaatttcgtcaacgtactatgacttccgattctcgtaaaggtactgaaattaattgcttcgatttcttcaaattttgtttcttctttcccaattaattgattttctcccttgttcattgttgattttgattattatatagtcataattacttctaaaatgttgggatttatgaaatttacacataatttaatccgcaaactaaataataaccccttaataattcaaatccataatctttaaaattagatgctgatataaaattgggcgcacgacttaagaagggtaaataaattgcaatttgggcagtgaagcgaagagaagcttgaaatactcaatttcgtcaacgtactatgacttccgattctcgtaaagtgattgttcatctaagagcgactggcgatgcccccattcttaaacaagccaagtttaagattgcaggtactgacaaattcatcaaagtaatagattttctgcggcgccaactccatagggagaccttgtttgtgtatgtcaacagcgccttctcaccaaatccagatgagttggtaattgatctatacaataactttggttttgatggtaagttggtggtcaattatgcatgctccatggcgtgggggtgaaaactcctggttgtttgcagtacattgctagaagcttctccatatctgagtaaatacttactctgtacgatagaaacccggcatcaatgattagtcagattgttcttctgtagattgttcagtatataactacgatttatatgttgttgcttatcgattgtgttccaatagtttcttcatggacgattgatctacgttacccataacgaaaggcctttctctgcgtccttttttccctccagctcgtaaagttcagatgaaaagtttggagtcctttcaattttcaccattgtcacccttcaattc

SEQ ID NO: 5661 - DNA, 639 bp, Sesamum indicum
gttcaaataaagccgtgtgttttgaggaaaacgtagttgtgtgtatttgcaattttaagtcaaacgggagaagatcccacatcattgagcagactgaattaaatacaggagcagcttgctccgtaaattggctatggcgtcggagactcgtaaagtggttgttcatctcagagctaccggcgacgctccgattctcaagcaagccaaattcaagattgctgggaccgacaagtttgtgaaggttatagattttcttcgtcgtcaacttcacagggatacactatttgtgtatgtaaacagtgccttctcgccaaatcctgatgagttggtcatagacctgtataataattttggttttgatggtaaattggtggtcaattatgcatgctccatggcttggggatgactattaccaagatttcgtcttttgcattcataaagctgtacataaggtcctaggttagattctgaatggtgataggtgcacaatttggagatgctgctgctttcaattggtttttaccccagggcacatatttgcagaatttggccattatttcattccacaaattgggaaatacagggtaatttttggtctgtattgtttttcttcgtgtcagcctgtcagggactcaaggg

SEQ ID NO: 5662 - DNA, 2145 bp, Cannabis sativa
ctactactatggattctcccactgctgttcgaaaggtggttgttcatctgagagccactggtgatgctcccattctgaagcaagcaaagttcaagatacctggaactgacaaattcgccaaagttatcgactttttaagacgacaacttcatcgagacaccatgtttgtgtatgtgaacagtgcattctcaccaaaccctgatgaatctgtcattgatctttacaacaatttcggtttcgatggtaaactagttgtcaactatgcttgttctatggcctggggttaacttaacacataccagtgatgaaggagttcatttcatttcacaggatatggtgctggctggcatgatgggcaaagaagactttgattagatttagagtagggatttaggaatgaatatacaagattgaaacaaagcaagcactaattcttttatgtaaattttagccaaatcattcaacttacaaaggttggttatggattgtgttgataatttttctccatttgaatacaacaatggatggtataatgataccattaccatagataaatagaacaagattattttgttttattgcaggcacaaacaaactgtgaacaatgtactaacacttgttttttattgttgttatagaaattctaggcttttaaaaaagaaaaagaaagaaagaaacacaaagtattgatagttgtcttttacagttgatcttttaacaaccaactaaagaaaaaacaaacagtatctacaaagccttagattgattgatcacacaaggaaagaagactaaagaaaaaaagaaagagtgatggaaaatgcagcagcagcatagggatgatactgatattctattctatgatgatgatgatgatctctttatctattactgattcacgtactcttcactactattaagtactatattatatatttgagattgattgccattggtgaccaaactcaactcagcagcagcagcaccaccacttcaaatcttgatttctctaccaaatatccagctgaaaggaaccattgatgcttgcttggtccttccctgagctctctcctccaactttcttatcctctggggcaatttacacacataatcttgtgctctgtggccctcactcgaaagaccactcaatttctcaatcttccatcttccaaccagaaactccatgatatcagcataatccttggcagtgtaaacttcaagcttctgtgtaactgctgcaaagtgatcgaaaagattgtcatccttcccgtcgtacatcaagtgggcaggcatcgatatcttcttcttcatcatgtcagcaaaagccataacagtgccattcgggtcaatctcaaagagcttctccacaatctttgtgtaggcagtttcatgacgtttctcatcggcagcaattgtgccgcatatctgcgccagtttcaggtcaccgtgctctttggcttgcctggcagtatttccatgggagatgaatgtagccctctcttgaaaggaggtgtagatgaaacccaaatacgggttgttttcctgtataaggatctcaccattcctgagccaatgagatattggatggtcttctcaacttgcttcatatcaacccttccagagagatacagatacttgttgagaaggtctccatgcctattctcctcagcagtccacgccctggtccatattccccaagaagtagggcttgcaccggtctcatctctaaccccgtctaaagtattaagcattgtctggtatgtcggtagagcttcttcagtgatcatatcaccgaccaatgcaacaaaatagtcatcgggaatttctttcgccctttcccttaactccctgacttgatcataaaacccttcagattccggctcgggtagaaaatcttgtggctgccaacatttctccacaggtttcaagtgcaccaaaatgttatcttcagcccagccttctaatgacttgaagatctcaaccttttgaggtggtagtgaatgagtcacttgaagatgtacctccttcggaggcgaataaggcttttttccattttcagtctctctacaacaaacataagaaaaaagtcagaagctttttacatgaacatacattattttgtaactaactaactaactaacattactt

SEQ ID NO: 5663 - DNA, 522 bp, Brassica oleracea
gaaagagtgacgtcttccttcttcagctctctctctctctctctctccttggaatcattcaatggcggagacagagtcaccgagctctgttcgtaaagttgttgttcatctgagagctactggaggcgctcctattctcaaacaatctaaattcaagatcccaggaactgataaatttgctaaagtgattgactttttaagaagacagcttcattctgactcattgtttgtctatgtgaacagtgctttctcgccaaatcctgatgaatcagtaaacgatctatacaataactttggctttgatggtaaactggtggttaactatgcgttttcaatggcgtggggataaatccgtatatgctactacagtctacagtgttctcaggccgtggtcttgatggatgctctggtgactttcagatggaagttgctgtacataatgtagcaatggacttgatatttttcactctacatacatgaaataaagaccacatcaaagttctaaaaactagatcttcaatt

SEQ ID NO: 5664 - DNA, 700 bp, Brassica rapa
ccaaaatataatcgtcaatcgcagacgtgaacgaaagagtaacgtcttccttcttcagctctctctctccttggaatcattcatcaatggcggagacagagtcaccgagctctgttcgtaaagttgttgttcatctgagagctactggaggcgctcctattctcaaacaatctaaattcaagatcccaggaactgataaatttgctaaagtgattgactttttaagaagacagcttcattctgactcattgtttgtctatgtgaacagtgctttctcgccaaaccctgatgaatctgtaaacgatttgtacaataactttggctttgatggtaaactggtggttaactatgcgttttcaatggcgtggggctaaggccgtatacagtatactacttactacagtctaaagtgttatcatgccgtggtcttgctggatgctctgatgacttttagatggaagtttctgtacataatctagcaatggacttgatatttttcactctacatacatgtaaataaagaccacatcaaagttctaaaaactaatcttcagttctcgtctttgtatttttgttgggcacttgggtttgtgtttgagattcagaatcaggaaacagagggagtataatgcaatgaacttgacattgatatagttaagagtataattaggaaacgatgatgaaaatggttgtttcttag

SEQ ID NO: 5665 - DNA, 533 bp, Brassica napus
gggtgaacgaaagagtaacgtcttccttcttcagctctctctctctctctctccttggaatcattcatcaatggcggagacagagtcaccgagctctgttcgtaaagttgttgttcatctgagagctactggaggcgctcctattctcaaacaatctaaattcaagatcccaggaactgataaatttgctaaagtgattgactttttaagaagacagcttcattctgactcattgtttgtctatgtgaacagtgctttctcgccaaatcctgatgaatcagtaaacgatctatacaataactttggctttgatggtaaactggtggttaactatgcgttttcaatggcgtggggataaatccgtatatactactacagtctacagtgctctcaggccgtggtcttgatggatgctctggtgactttcagatggaagttgctgtacataatgtagcaatggacttgatatttttcactctacatacgtgtaaataaagaccacatcaaagttctaaaaactagatcttcaattc

SEQ ID NO: 5666 - DNA, 449 bp, Fraxinus spp
ggtgcaaaagagcaattattactggttgttttccgacgaaaccatggcttcggagactcgtaaagttgtggttcatctcagagccacaggcgacgcccctattctcaagcaagccaaattcaagatttctgggactgacaagttcgtgaaagtgattgattttctccgccggcaacttcacagggagacactgtttgtgtatgttaacagtgccttctcaccaaatccggatgagttggtgatagacctgtacaataatttggcattgatggtaaactggtggttaattacgcttgctccatggcatgggggtaaccattagcaaggcgtaggcagcgtacattctttgaactgtacatttggtagattgacatggtaatagtaatatctttggtaaatccttcacatcgactatttgtgaactcaatgtgatttatctttgttctcat

SEQ ID NO: 5667 - DNA, 789 bp, Nicotiana tabacum
  misc_feature (496)..(496): n is a, c, g, or t
  misc_feature (506)..(506): n is a, c, g, or t
  misc_feature (510)..(510): n is a, c, g, or t
  misc_feature (514)..(514): n is a, c, g, or t
  misc_feature (516)..(516): n is a, c, g, or t
  misc_feature (525)..(525): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (557)..(557): n is a, c, g, or t
cttcaagagaatcgtgaaattctcagctatggcctccgattctcgtaaaggtctgatcacatgcttcaatttggtcaagcatcctactttttcccaattattttgctctttaaatagattaatgcttgttgttaattattttttctgttgattttgatgtttatgtagtgattgttcatttaagagcgactggcgatgccccaattcttaaacaagccaaatttaagattgcaggtactgacaaattcatcaaagtaatagattttctgcgccgccaacttcatagggagacattgtttgtgtatgttaacagtgccttctcaccaaatccagatgagttggtaattgacctgtacaataacttcggttttgatgggaagttggtggttaattatgcatgctccatggcgtggggctgagaactcttggttgttcgcactacattgtttcaaatcaccatacctagtaactacatttagtagtagcaatagaaccntggcatcaantatnagtnanattgttctncagtagattgttcagtattgagntacgntntntagaatgatgcttgacaattctgcttcagtagttctttgatagactattctgtctatactcaggcaggaaacatttcgggcttttgctgtcccttttcttctaccatcccctgaagcttagagttgaatgtctgccatattggtgtgaaaagtttacgcgtcctttctcctctcaccatagtgactctttaagttctgtaaagttagcaatcctcctatagcggccgcatga

SEQ ID NO: 5668 - DNA, 350 bp, Eutrema parvulum
ttattcagttatcatctttctcttctacaaatcatcaatggcgacagagtccccgagctctgttctgaaggttgttgttcatcttagagctactggaggtgctcctatactcaaacaatctaaattcaagattccagggactgataaatttgctaaagtgattgactttctaagaagacagcttcattctgattcattgtttgtctatgtgaacagtgctttctcgccaaaccctgatgaatcagtaaacgatctatacaataactttggaattgacggtaaactggtggttaactatgctttttcaatggcatggggctaaagctgaacactacagtattttcaagtcg

SEQ ID NO: 5669 - DNA, 566 bp, Triphysaria pusilla
cgaacgacagaagggctaaaaaactcctgcagcttgcttcatggcttccgaaactcgaaaagtggtagttcatctgagagccaccggtgacgctccaattctcaagcaagccaaattcaagattgccgggagtgacaagtttgtgaaagtgatagattttcttcgccgtcagcttcacagagagacactgtttgtgtatgtaaacagcgccttctcgccaaatcctgatgagttggtcattgacctgtttaaaaactttggcattgatggcaaattggttgtcaattatgcgtgctccatggcgtggggctaataacttcaaggattgttctgtacattcataaaaaaagttaacatagggttagttcggcaggagtggtagatgaaaccgtttgaaaaatggtgtcggtgaagctggctcgatcccttgagggtggcattgtgaattttacagaatttttatgttttcctgaacgtgattggtatttttggttatgctgtatttgtcattatgactcatgtcctaatatctggttccaaacgatgaatcatgtatggtacggctg

SEQ ID NO: 5670 - DNA, 892 bp, Musa acuminata
gaaaaatcggagacgaagtggtgtggagaaccaacaggaccggttcatctattagccggttcgagactcgcggctccggttttctgaacgtccgcaacaggaaggcagcatcgcgtcctttttgaagacgacgggaccgctgccggcacgggtgtttactttctctcggcgcctgccaagcaaagcaaagggccgacgcagcacaaacgcacggcgaaatctcgatttcttcgaacacgaagacgctcgtttctttttgtctcttggcgttgttcacttttttcgtttgtatagtgttgagagatggcggctgaatcacccaccgctgaacgaaaagtggtcgttcacctgagggctaccggcgatgctcctattctcaagcaagcaaagttcaagatttctggaagtgacaaattctcaaaggttattgaatttcttcgtcggcaacttcatcgggatactttgtttgtttatatcaacagcgccttctctccaaaccctgatgaattggtgattgatctctacaataactttggatttgatggtaagctggtcgttaactatgcttcttccatggcatggggctgagaaagagatgctgctatttcataagatctttagcatcgaatgtatgaaaagtcaatattttattgtcaaatctaggttgttttttggtctcaacttttgttatttgtggacagaaaaaaaggatcttcgggtctcaagcttctgaatgtctttgtaaattagttatattaacaattacaagcttgggatggtcttcattattgttaaaaagccatcactggcaacaatttgctgtatcgtgtagtcttaaaggttattgatattaattagctgcactgtgaaacattcaggtatttgaagggct

SEQ ID NO: 5671 - DNA, 632 bp, Cirsium arvense
caacttgtctacttttcgtctccggaacaacaagccatttccatggcttccgattctccgattgcttctcgtaaagttgttgtgcatttgagagccactggtgatgctcctattctcaaacaagctaaattcaagattgcaggcacagataaattttcaaaggtgattgattttcttcgtcgccaacttcacagggaaactctgtttgtttacgtgaacagtgccttctctccaagtccagatgaaatagtaaatgacctgtacgataattttggattcgatgggaaattggtggttaactatgcatgttctatggcttggggctaactttgactatttagcaaagcttgtacagcggcaaaactcaaaaaacgggagctgcatttggtaaatatggttaatattttctccctgtttgtttggatactctgtaattgatagtttgatactcatatcatctttcagaagaaccttctgagacttccccacctcttatcttttacattttgtcaatataattcaacatcttggtattgatgatcttcagtaaagtcgaagacaactcacctatctattattttttataagtagtttatgagttacaacttaaaaagaaaaaagtaccgactgcg

SEQ ID NO: 5672 - DNA, 617 bp, Ipomoea nil
gaggttcaaccaacagaccggatccgatttaaacactcccggagccttgcacgaagaaggaagctcaaacctcggaaaatagagtatgcaacaaggctcgtaaagctctggattttttttctgcgagtgggataaatccatgactacggaatctcgtaaagtgattgttcatttgagagctactggtgatgctcctatcctcaaacagtctaaattcaagattggtgggaatgacaagttcgctaaagtaattgattttctgtgccggcaactgcacagggagacgctgtttgtgtatgtcaacagtgccttctcaccaaatccagatgagttgataaatgacctatataataactttggttttgatgggaagctggtggtgaactatgcatgctccatggcatggggctaagtatgagcagtggtttggcgctctgggtctgatatacaagtagattaacgcctgcctttgtacagtccctcaatcccattttatttgtgaatgtgtatgacaagtatatcggttctcattcaaactgtctgcttagttaagtcaattcctctcatcttacattgcataactgcacatactaatggaatgatgaaagctgttgatc

SEQ ID NO: 5673 - DNA, 517 bp, Lippia dulcis
cgaacgatggcttccgaagctcggaaagtggtagttcatctgagagccgccggtgacgcgccgattctcaagcaagccaaattcaagatcgctgggactgacaagtttgtgaaagtgatagattttcttcgtcgccaacttcacagagagacattgtttgtgtatgtaaacagtgctttctcgcctaatcctgatgagttggtgatagacctttacaataattttggcattgatggaaaattggtggtgaattatgcgtgctccatggcatggggataataactaccaaagtgatggtttggcatattcatataagtgtatataagcgaccaggttcatacattgacaggtgaaagatgaacagtttggagtgattgcttgtcggagctggccaggttgcattttgaagaaaaagtgtcgatagttgtttttggtgcacaaaaatgaaggatagtagtagtaatagaaagcattcctggacttaattctgagaatgagatttaactctttgacaagt

SEQ ID NO: 5674 - DNA, 751 bp, Valeriana officinalis
gaagagagaggagcagcgaggtgatataggcgagacaaggcgatacgtgctagggttcaatccatccaacgacggcgtaggcgatcgggttccgagtggtgtcggttgtcttacgaagtcgattggcccagttggaccgggcggccctgcccaagtagaagaaataagagggaccggattactttgatttcagtctttcttcagttgatcttttgaaattgaatgaacttgcgagttgtgatctcttgacgaaggaattgcgccatggcttcagatcgcaaagttgttgttcatctgagggctacaggcgatgccccaatccttaagcaagctaaattcaagattgctgggagtgacaaatttgtcaaagtgatagattttcttcgacgccaactcaacagggagactttgtttgtgtacgttaacagtgctttctcgccaaaccctgatgaattggtaatcgatctttacaataatttcggctttgatggtaaacttgtggtcaactatgcttgctccatggcatggggctaacggtggaaagtttgattttgctgtatatagatagaagtatacatttatttgtacgttcgttttactaagcctccacaatcttcctttacgattgtttagatgaaacaatagatactacctttgtcctgttcgctatttaccataataaacaactaaaattcttttcagtctttagcttatacacgtcgactaacgtttaccatactaaagagttaac

SEQ ID NO: 5675 - DNA, 667 bp, Valeriana officinalis
gaagagagaggagcagcgaggtgatataggcgagacaaggcgatacgtgctagggttcaatccatccaacgacggcgtaggcgatcgggttccgagtggtgtcggttgtcttacgaagtcgattggcccagttggaccgggcggcccgacccaagtagaagaaataagagagacccgattactttgatttcagtctttcttcagttgatcttttgaaattgaatgaacttgcgagttgtgatctcttgacgaaggaattgcgccatggcttcagatcgcaaagttgttgttcatctgagggctacaggcgatgccccaatccttaagcaagctaaattcaagattgctgggagtgacaaatttgtcaaagtgatagattttcttcgacgccaactcaacagggagactttgtttgtgtacgtcaacagtgctttctcgccaaaccctgatgaattggtaatcgatctttacaataatttcggctttgatggtaaacttgtggtcaactatgcttgctccatggcatggggctaacggtggaaagtttgattttgctgtatataaatagaagattacatttatttgtacgttcgttttactaagcctccacaatcttcttttacgattgtttagatgaaacaatagatactacctttgtcttgttcgc

SEQ ID NO: 5676 - DNA, 538 bp, Nicotiana benthamiana
caagagaatcgtgtaaattctcatctaatcaaaggagctatggcttcctattctcgtaaaggtctgatcacatgcttcaatttggtcaaacatccttttttcccaattattttgttcttaaatagattaatgccacttgttacttattttttgtgttgattttgatgtttatgtagtgattgttcatttaagagcgaccggtgatgccccaattcttaaacaagccaaatttaagattgcaggtactgacaaattcatcaaagtaatagattttctgcgccgccaacttcatagggagacattgtttgtgtatgttaacagtgccttttcaccaaatccagatgagttggtaattgacctgtacaataactttggttttgatgggaagttggtggttaattatgcatgctccatggcgtggggctgagaactcttggttgttcgcactacattatttcaaatcaccatacctagtaaatacatttagtagagcaatagaaccgtggcatcaaatataagtcagattgttttccactag

SEQ ID NO: 5677 - DNA, 358 bp, Ambrosia trifida
agttagggatcataaatcggttgaatggcttcagactctccgattgcttctcgtaaagttgttgtgcatttgagagctactggtgatgctccaattctcaaacaagcaaaattcaagattgctggaaccgataaattctctaaggtgattgattttcttcgtcgccaacttcacaaggagactttgtttgtttatgtgaacagtgccttctccccgagtccggatcaactagtgaatgacctgtacgataatttcggatttgatgggaaattggtggttaactatgcatgctctatggcttggggctaacttggacaaatgtagcaaaatttgtacagctgcaaaaacctgttatagg

SEQ ID NO: 5678 - DNA, 873 bp, Eucalyptus grandis
aggaaagtataaaacaggcttgaattcgaacaaaaaaaagaagggtttctttcacgcaaaattccgactggaaatcaaaccaaattccgcaacttgcttcagcaatctctgaagcccctcctccggtcgatgttctcttgaagggattcctggtttttcgatagcgaatggcgtccgattctccgaattcagatcgcaagatcgttgtccacttgagggccaccggcgatgctcctattctgaagcaagccaaattcaagatttctggggcagaaaaatttgccaaagtgatcgactttctttgccgacaacttcaccgggagactttgttcgtatatgtaaacagcgccttctcgcccaacccagatgaactggtgaatgatctgtatgagaattttggctttgatggtaagcttgttgttaattatgcttgttctatggcatggggctaaatatcagtaacatctgccaatgtatttgtacataaattcgagcgtacacttcattacactaagaaagatgccatctgccattagactcggaattcccatcgaaaaactttagtcaaagtacagaacctgcatgtttcttacatatttttatttgtttctcattatttggctggtgaacaaagctaggtgggattatttcatccaaggatgcagacaagaatgtgacttgagttgacaagagtttgtaccgggtcacattattttggtattgatgttatttcatgtcagctggcctctccttttgatttcatgttggttgtcattcctactatttagttctatcacctaatggaactttaaggctgtggctgagctgacattgggagatatctttttagcttttaccctgccagttccaatt

SEQ ID NO: 5679 - DNA, 503 bp, Fraxinus spp
aaagagcaattattaccggttgtttttcctaacgaaaccatggcttcagaaactcgtaaagttgtagttcatctcagagccacaggcgacgcccctattctcaagcaagccaaattcaagatttctgggactgacaagttcgtgaaagtaattgattttctccgccggcaacttcacagggagacactgtttgtgtatgtcaacagtgccttctcgccaaatccggatgagttggtgatagacctgtacaataattttggcattgatggtaaactggtggttaattacacttgctccatggcatgggggtaaccattagcaaggcgtaggcagtgtacatttggtagattaacatggtaatatctttggtaaatccttccacatcgactatttgtgaactcaatgtgatttatctttgttctcatggttctttaaagttttcaactgtgtaacgattgttaatagacttccaacattttataaattgttaatatccaatttgc

SEQ ID NO: 5680 - DNA, 960 bp, Lactuca sativa
attttcgcctaaatcgaaaggagcccagtacatatatacttcgacgtgatgaggcccaataggtgtttccgggcaaaaattcaagtttttacacgtttcgactcctgagcaagaaactgtttctatggcttccgattctccgattgcttctcgtaaagtcgttgtacatctgagagctaccggtgatgctccgattctcaaacaagctaaattcaagattgctggaactgatagattttctaaggtgattgattttctttgtcgtcagcttcacagggaaactctgtttgtgtatgtgaacagtgccttttctccaagtccagatgaactagtgaatgatctgtatgataattttggatttgatggtaaattggtggtgaactatgcgtgttctatggcttggggataaagttgatcatttacagctggaagaattctttgattgggaattacatttggtaaatttaggtaatcttcttgcttgtattcatagttgttttaagaagatgaaatttgtaaaatgtttgatcaactctttagcttggagtttattcatttgattggtgactttgtaattgatactcgtagcatatttcacaagaatttcctgagcactaagctaagagccaatcaaaatagaatgcaaaataagtgaacatgtgaaatgaagtatcctctttccccttttattcttactcctcacatcattgctcatgaagccactttttccatttgacccttttgttcttcttgagtacaccttccagattctgggctttgttgtatttgggcttgagtggatcctcatcatactttgtgtctttttcacacaccttgataaatataaattacataaatattgtaagaacatatcacaaccgtctaaatttttagatctagggttaatatgaatgtgtcatttatgtaaattgtgaaacaaattgtaccgatttgtaattt

SEQ ID NO: 5681 - DNA, 523 bp, Olea europaea
acgaaaccatggcttcagagactcgtaaagttgtagttcatctcagagccacaggtgacgcccctattctcaagcaggccaaattcaagatttctgggactgacaagttcgtgaaagtgattgattttctccgccggcaacttcacagggagacattgtttgtgtatgttaacagtgccttctcgccaaatccagatgagttggtgaaagatctgtacaataattttggcattgatggtaaactggtggttaattacgcatgctccatggcatgggggtaaccattagcgcaaggcgttggcagtgaacattcttagaactgtgcatttgttaggttgacatggtaatatctttggtaaaaaccctccaaattggacaattatttgttgaactcaatgtgatgtatctttgttcaggtggttctttaaactatctttgtctgtctattaaatttggtcagtaaatcagacatggaggttgtgctatgaggtgattattaaggagaaatgtaatgtatctttca

SEQ ID NO: 5682 - DNA, 594 bp, Raphanus sativus
  misc_feature (330)..(330): n is a, c, g, or t
  misc_feature (381)..(381): n is a, c, g, or t
  misc_feature (384)..(384): n is a, c, g, or t
  misc_feature (547)..(547): n is a, c, g, or t
gggtcgtcgtcgttagtaacgttttctctcaatctcgacaatggcgacggagtcgccgagttccgttcggaaaatcgttgttcatctaagagctactggcggtgctccaatactgaaacgagataagttcaagatttcagggacggataagtttgctaaagtgattgactttctaggaaggcagcttcactctgactcattgtttgtgtatgtaaacagtgctttctcgccaaaccctgatgaatcagtaattgatctatacaataactttgggatagatgggaaactggtggtgaactatgcttgttccatggcatggggataaaaaancccaccaaatgatcaagctctgagtatgaagttggcatctaatgtagtagnctntgtcccaattgatggatgatactgctaaagctgctgctgctactttgtttgctagtaggataatcgaaaatgtggatggaaacttgtttgtacattcataggaaatggcttttcatattttatttttctcactcagaatatacattacaaaatgcaacgattnaagctgtgattctctcttatcatataaatctaaccggttgatacttg

SEQ ID NO: 5683 - DNA, 463 bp, Vinca minor
atccatggcttccgagcctcgaaaagttgtagtacatcttagagctactggagacgccccaattctcaagcaatccaaattcaagattgctgggtctgacaaatttatgcgagtcattgattttttgcgccgacaacttcacagggagacattgtttgtttatgtcaacagtgccttctcacctaatccggatcagctggttatcgacctctacaataattttggtattgatggtaaattggtggtcaattatgcttgctcgatggcatggggctaactggtagctgctgattatcaaggtaggaagcttgctatttcgacgaagtagtttttgccttgttaattccacgctctgtaacatcgtaagtggattagttcgctgcatatttgatgttcaaaaattggttagagcggcttcattttcgcaagggaatgcgagtcctactgatggatgtcaaatcag

SEQ ID NO: 5684 - DNA, 704 bp, Echinacea purpurea
cggccggggggtaattagtaacaagggagtgcattttcgtctctaaaaacaagaaaccgtttctatggcttcttcagactctccgattacttctcggaaagtggttgtgcatctgagagctaccggtgatgctccaattctcaaacaagcaaaattcaagattgctggaactgataaattctctaaggtgattgattttctttgtcgccaacttcacagggatactctgtttgtttatgtgaacagcgccttctccccaagtccagatgaactagtggatgacctgtatgataattttggattcgatgggaaactggtggttaactatgcatgttctatggcttggggctaactttgagcatttagaaaagcttgtacaggtacaaaaactcattcaaaggaaacttcatttggtaaatttggcttatcttcattgcctgtataaacagttgtcatatatagatgaaacctgtaaactatttgatcaactcttcagctgttgatgatattgacttggttatctcttggtattggagttaattcatcttgatgcttttcatcccttatcttttctgttttgttgttcctgtactcgtctcatatgacttcttagagtttatttggatctattcctgtttcttgctgttgcacaacctcacatttttgaattgtaactgaacgagggtctatacgtattggatgag

SEQ ID NO: 5685 - DNA, 708 bp, Unknown
  Sequence found in Organisms: Citrus clementina, Citrus sinensis
attgcgtgcgagtcgacaactcaacggtgtttgatccgactaacagagatggcggcaactgactcgccgagttctactcgaaaagttgttgttcattttagagccactggtggtgctcctatactcaagcaagcaaagttcaagatatctggatctgataagtttgcaaaagtgattgaattcctatgccggcatcttgggcgggagacattgtttgtgtatgtcaatagtgcattttcaccaaaccctgatgaattagtgattgatctgtacaataattttggctttgatggtaaattgattgtcaattatgcttgttccatggcgtggggctaatttaatgttactggtctgctgatgttatatagctgctcatacttagagaattcaagcttttttcgcttccagacaagaaatggaacaccattatttcttacgctgaagtctcattgggatgacagattgatagcagaaaattcagatgcttaccattattattatttttttcttttcaaaattcaatttaccgtcatgagattacaagttttgagtatattcgatgttaagatgaaatgttaatgtggtgcacataataatacttcttacttccatttgcaattattgccacctctgcttgctatgtatcggcaagttggtcagattgtgtaaatattattcttaatagatagaattgccaaattaaatccc

SEQ ID NO: 5686 - DNA, 529 bp, Arabidopsis thaliana
aacttcctccaaaatcgttcttctcaagttttttctacttccaaagtcgcaacaatggcgaccgaatctccgaattctgttcagaaaattgttgttcatctgcgagctactggtggtgctccgatactgaaacaatctaaattcaaggtttcagggagtgacaagtttgctaacgtgattgattttctaagacggcagcttcactctgactcattgtttgtttatgtgaacagcgctttctcgccaaacccggatgaatcagtaattgatctatacaataactttgggtttgatggtaaactggtggtgaactatgcttgttccatggcatggggttaaaacttcgtcatcaatctctgagtataaagtccaattatggatatgctagatgatacaagctgctactttactttgctaggagaatccaattgtagaagaaacttgttgtacatccttcatttttttgtaacctgaatagtggaatacataacaaaatggttgaatcatatataaacatttttttgcaaaa

SEQ ID NO: 5687 - DNA, 582 bp, Arabidopsis thaliana
atgggcttaaaataatttgggcttctataatccaaaattccaaagaaatctttaacttcctccaaaatcgttcttctcaagttttttctacttccaaagtcgcaacaatggcgaccgaatctccgaattctgttcagaaaattgttgttcatctgcgagctactggtggtgctccgatactgaaacaatctaaattcaaggtttcagggagtgacaagtttgctaacgtgattgattttctaagacggcagcttcactctgactcattgtttgtttatgtgaacagcgctttctcgccaaacccggatgaatcagtaattgatctatacaataactttgggtttgatggtaaactggtggtgaactatgcttgttccatggcatggggttaaaacttcgtcatcaatctctgagtataaagtccaattatggatatgctagatgatacaagctgctactttactttgctaggagaatccaattgtagaagaaacttgttgtacatccttcatttttttgtaacctgaatagtggaatacataacaaaatggttgaatcatatataaacatttttttgcaaaa

SEQ ID NO: 5688 - DNA, 500 bp, Taraxacum officinale
caaactgtttccatggcttccgaaactccgattgcttctcgtaaagttgttgtacatttgagagctactggcgatgctccgattctcaaacaagccaaattcaagattgctggaacggatagattttctaaggtgattgattttctttgtcgccagcttcacagggagactctgtttgtgtatgtcaacagtgctttttccccaagtcctgatcaactagtgaatgatctctatgataattttggatttgatggtaaattggtggtgaattatgcatgttctatggcttggggctaacattgatcattagcaaaagttcattgatttgggaactctgcatttggtaaatttaggtaaaaatttcttgcttgtattcatagttattgtaagaagttgaaatctgtatagtgtttgagatcaaactcattagctggagtttattcattttacttggtgacttggtaattgatactcaaagcatagttcaaattggttaaaat

SEQ ID NO: 5689 - DNA, 498 bp, Flaveria ramosissima
taattctagatataatgtttttaaaatagttgaagccattctaaaacgtgagcttgttttagtagtaagggggtgtttgatgatccaaacaaaaccaagggatccatttgaagggcaaacatccaatttgtctacgggttctgggaacaagaaaccgtttctatttctatggcttcagactctccgattgcttctcggaaagttgttgtgcatctcagagctaccggtgatgctcccattctcaaacaagcaaaattcaagattgctggaactgaaaaattctctaaggtgattgattttctttgtcgtcaacttcacagggagactctgttcgtttatgtgaatagtgccttctccccgagtccagatgaactagtgaatgacctctatgataactttggaattgatgggaaattggtggttaactatgcgtgttctatggcttggggctaactataaccatttagaaaagcttgtacagccaacaaaaaaactcat

SEQ ID NO: 5690 - DNA, 550 bp, Orobanche aegyptiaca
atatcgtctatggcttcggaaactcggaaagtcgtagttcatctgagagccaccggcgacgctccgattttgaagcaggccaaattcaagattgatgggagtgacaagtttgtaaaagtaatagattttcttcgtcgtcagcttcacagagagacgctttttgtgtatgttaacagtgccttctcgccaaatcccgacgagctagtcctcgacctgtataacaactttggtatcgatgggaaattggtcgtgaattacgcgtgctccatggcgtgggggtaattacgtccaagatatggttgcgtacattcgtaaaaagttgacgttaggggtaatttcgagtcgagttcgaatattgctcgaaataatttcgagtttaggtgaaagtcgtcgaatcggttttttcgtgcaggtttcgaattactctgtccgtttgtaggtggaccgttcgaaaatgcttccttaattcacataattattgatggttttatgttttagtattttgataatatttatgtgaatattttaaatctcgtaatattgttgattt

SEQ ID NO: 5691 - DNA, 508 bp, Phalaenopsis aphrodite
tcgatttggtggctctgtccttccaaattcccgttgattcaccgcagaaaagggttacacatccttcagcgttgtcgatcatggcggcagagtctccaacctccgaccgcaaagtggttgttcacctgagagcgaccggcgatgctcccatcctcaagcaggcgaagtttaagactgctggaagtaataaattctctaccgtgattgaatttctacgacgtcaacttcatagagatactctgttcgtctacatcaacagtgcattttctccaaatccagatgaattgatgattgatctctacaataattttgggtttgatggaaagcttttggttaattacgcgtgttcgatggcttggggctaagaactggagtcaaggacatcaaaactacacttctcgttttcagccaaaaaattggcaaaataaaaatctgaggttcatgttctacttatatttttgaattatttttttatcgagttagtacctaccaatttagtgtatattaa

SEQ ID NO: 5692 - DNA, 690 bp, Pinus taeda
cggccggggacaacaaagggatccggtggaaaaagctatagaatccaacgtgggggtcactttaaatcttctcgacttgttcgactcaaaccgccgcagcctttacatatactgtcgaccggaggatttagagattcatctctgcgtcagctgaccattatctggtttctattgtgggtcattcctcagatttcagccgtggtaagcagtttgctgctgtaaaaaataaatgtgaataaatagatgagcagatggatccagaggcttcatctcgcaaagttgtagtgctgctcagagcaacaggagatgccccaattctcaagcaatccaaattcaagataggagcaacagaaaaatttgccaaggtaattgattttctgcgaagacaactgcacagggagactctgtttgtatatatcaacagtgcattctctcccaatcctgatgaggctgtgattgatttatacgataatttcggcattgatggaaagctggtggtgaactatgcttgctcaatggcttggggttgattgtcttattaataatagcaaatcttcacgaacatctatgtaacatatggttatttgacaatgctaatttcaacattgttgatcgtcattgatttatatgataaatgtattttgtagttatgtgaaatgaaatgtcagtatgatctctatatattaatcc

SEQ ID NO: 5693 - DNA, 1523 bp, Mimulus guttatus
aaaataatcccaaccagctcaattcatcaatggcgggttcagctccgaccatctccttcttcaactcctcttccctgtactgcaatcgcgctttcgataatttcaaacattctcgcactttcgataagcgtttatcgttcacatgtttctcgtccaagaagaaacagctagggttcatggatcaaatcctcgattacatcgaagggggtccaaagttaaggaaatggtatggagcacccgatattctctcgaaagacggaatcgaatcggccgaaaacgaggctccagaagaagatgaagttaaagatgcagtattagtaaccgacggagataatgagatcggtcagatgatcatactttcgctcattgtcaaaagaattcgagtgaaggcactcgtgaaggataagcgcgttgctatggaagcattcggcacttacgttgagtcaatggccggggatacaaaagacaaggcgtttttgaagaaggcattaagaggcgttcgtgcagttatatgcccaaatgaagggtttttatacaatctcgaaagctggaaaggtatacaacacgtgatcctgttatctcagttgtctgtctataggggctcaactggtattcaagcagtaatgaatagcaacgcacgaaaactagcagagcaagacgagaatttggtgaaggcatcgggtgtgccgtatagcattattcggaccggtgtcttaaaagatacacctggcggccaacaaggtttttgcttcaaagagggtagtgcagcaaagggtagtcttagcaaggaagacgcctcgtttatttgtgtagaagcgctggataatgtcccggttaaaggattggtatttgaggtgattaacggtgaggaaaaggtttcggattggaaaaagtgctttgctacattgatggatatgtcgagcggagaagcttgaaaaacacgaaggcgaatctagttgtagttcatctgagagccaccggcgatgctccgattctcaagcaagccaaattcaagattgctgggactgacaagtttgtaaaagtaatcgattttcttcgtcgtcagcttcatcgggagacattgtttgtgtatgtaaacagtgcattctcgccaaatcctgatgagttggtctcagacctctataataactttggtttcgacggcaaattggtggtgaattatgcatgctccatggcgtgggggtaattactacccagaatttattctgtacattcgtaaagtaaatataggtcctagtggtggtagactgacaattcgaagatgatactgctagtgaaaatggtcgtccctcaagaagtggcgtgcattttacaaaatagtttacggttattttcattccacagacatattctttgcagattaaaactcgttctgcgaaagaaaattattttcgaataatgcaatattgtggccctcctatattacttttattgtatatatttgttcaccgggaaaataaaattctggctcggccaccgactcaatggctaccaaattcgag

SEQ ID NO: 5694 - DNA, 931 bp, Picea glauca
aagccaagttttctacaagagaagaaaaaatgaaacttgcgagcatatgtatagttgcaccccaaagccactttgacatggactccaaacacaacgtttggcttggcaattttttctcatagaaaatttcgattcaaaatacatattaattttgaaacaatgtaggtagaagaggccatacagaagttacgactcaggcaacctgagaatcaacgggttcggacatgcagagctgtgaataaataaatgaataggatggatccagaggcttcgtctcgcaaagttgtagtgctgctgagagcaacaggagatgccccaattcttaagcaatcaaaattcaagataggagcaacggaaaaatttgccaaggtaattgattttctgcgaagacaactgcacagagagactctgtttgtgtatatcaacagcgccttctctcccaatcctgatgaggctgttattgatttatatgataactttggcattgatggaaaactcgtggtgaactatgcttgctcaatggcttggggttgattgtcttccttaataatagtgaatcttcaccaacatctatgtaacatatggttctttgacaatgttatttttaacattgttgatcttcattgatttatatcataaaatgtattttgtagccctgtgcaatgaaatgccagcatgatctctatatattaatcaaggtttttcagtcatgaaagctgcgagttccatcccttgttcagtttctaaggacagttatattgcttagtgacattggtgtggacctagtttttaataatgcatataaatgtacatccaaacaatctataacaatttctacttcaagcaattggatgtggtattcttttaggaaatgctgttttcagtgtaagttttccttcccatcaatgtttacatttcttcttttattagc

SEQ ID NO: 5695 - DNA, 365 bp, Fagus grandifolia
agtggttgttcatctgagagccactggtgatgctcctattctcaaacaattaaaattcaagttacttggaactgacaagtttgctaaagtaattgactttctacgccgacaacttcatcgggaaacagtgtttgtctatgtcaatagcgcattttccccaaacccagatgaattggtaattgatctgtataataatttttggttttgatggtaaactggtggttaattatgcttgttccatggcatggggctaaactcttggtgatgggtctgcttgtgtaaattcattttaaacttggattatcctccatacaggcaaggagcacaatttgctggtaaattgaagttagattcataatcatttg

SEQ ID NO: 5696 - DNA, 695 bp, Pinus pinaster
acaacaaagggatcgggtggaaaaagctatagaagccaacgtgggggtcactttaaatcttctcgacatattcgactcaaaccgcctcaaaccgctgcagcttttacagatactctcgaccggaggatttagagattcatctctgcgtcagctgaccatcatctggtttctattttgggtcgttcctcaaagatttcagccgtggtagcagtttgctgctgtaaaaaataaatgtgaataaatagatgagcagatggacacagaggcttcatctcgaaaagttgtagtgctgctcagagcaacaggagatgccccaattctgaagcaatccaaattcaagataggagcaacagaaaaatttgccaaggtaattgattttctgcgaaggcaactgcacagggagactctgtttgtatatatcaacagtgcattctctcccaatcctgatgaggctgtgatggatttatatgataatttcggcattgatggaaagctggtggtgaactatgcttgctcaatggcttggggttgattgtcttgttaataatagcaaatcttcacgaacatctatgtaacatatggttatttgacaatgctaatttcaacattgttgatcgtcattgatttatatgataaaatgtattttgtagttatgtgaaatgaaatgtcagcatgatctctatatattaatccat

SEQ ID NO: 5697 - DNA, 609 bp, Pseudotsuga menziesii
cgggttcggacacgtacattgtgaataaataaattagaaggatggatccagaggcttcatctcgcaaagttgtagtgctgctcagagcaacgggagatgccccaattctcaagcaatcaaaattcaagataggagcatcggaaaatttgccaaggtaattgattttctgcgaagacaactgcacagggagactttgtttgtgtatatcaacagtgcgttttctcccaatcctgatgaggccgtgattgatttatatgataacttcggcattgatggaaaactggtggtgaactatgcttgctcaatggcttggggttgattgtctttattaataatagtcaatcttcggcaacatctatgtaacatatggttctttgataatgctaatttaagattgttgatcttcactaatttatacgataaatgtattttgtagtcctttgcaatgaaatgccagcatgatctctatatattaatcaagattttttcagaatcatgaaagctgcaaatttcatccgtcgttcagtttcttatgataagtcatattgcttagtgacattggtgtggacctagtttttcataatgcacataaatgtacatctaaacaat

SEQ ID NO: 5698 - DNA, 337 bp, Artemisia annua
ctccgatcgcttcacgtaaagttgttgtgcatttacgagccaccggtgatgctcccatcctcaaacaagctaaattcaagattgctggaacggataagttttctaaggtgattgattttcttcgccggcagcttcatagggagactttgtttgtttatgtgaatagtgccttctctccgagtccagatcagctagtgaatgacctatacgataatttcggatttgatgggaaattggtggttaactacgcgtcttctatggcttggggctaatttggaccatttagcaaaggttgtacagctgcgtaaactcattaaacgggaactgcatttggtaa

SEQ ID NO: 5699 - DNA, 409 bp, Euphorbia peplus
ttccccgcgagaatggctggtgaatcgccgagttccggtcgaaaagtgatcgttcaattgaaagcaactgctgatgctcctatactcaagcagaacaagtttaagatagatgcaactgataaatttgctaaggtgattgactttttgcggagacaacttcatcgagagacagtgtttgtgtatatcaacagtgcattttcaccaaaccctgatgaattagttagtgatctattcaataattttggtgttgatggcaaactgctggttaattatgcttgtaccatggcatggggctaactacgaaatctggctttgccgttactgcactgttaatactgtttcttcttacatggatacatgattgtggatatgactgtatttaactaacgccgaatactggagcagaaaa

SEQ ID NO: 5700 - DNA, 653 bp, Fagopyrum esculentum
atcccatcccatggcttccgggtcttcaaccgctgtttcgaaagtcatagttcatttgagggctaccggggatgctccgatactcaagcaagccaaatttaagatttctggagcagataagtttgctaatgtgattgacttcctccgaaggcaacttcacagagaaactatgtttgtctatgtaaacagcgctttttcaccaaatccagacgaattgattatagatctctataataactttggtattgatggtaagctggttgtgaactatgcttgttctatggcatggggctgagactgctgagtatatgcttggtttattcgcaacattctgccatttacacagggatgcgggggatgctgaagttgcatggttattaacagattaagattcaaaagggtatctgttgaaagtttttttaatgacagacatcgaacatctatggaaacaggttgtttgattcagattttgtcttggaccttgacattgttcagatatgtacttgcttaaatgtgaggtaaaaaaacatcttagtttcatgtatatataaaaacaacatgattagttgatgactagtgggcaactatcacatctcccgtgtgtatattgtatcagggattcattcacaacatttacaaataccatttctatc

SEQ ID NO: 5701 - DNA, 563 bp, Prunus persica
ggggttttcaatttggtccagtggttgttcatctgagagctactggtgatgcccctatactgaagcaagccaaatttaagattcttggaactgacaagtttgcgaaagtgattgagtttctaagaaggcaacttcaccgggatacgttgtttgtgtatgtcaacagtgcattctcgccaaacccagatgaattggtgattgatctctataataattttggttttgatggtaaactggtggtcaattatgcttgctccatggcatggggctgacactcatgtttcggctgacagtacctattgatagtgtgaacacgaaattattccttccgcacacaagacaagcaaagggaagatgagttgctgtccgttgaaaaaaaaatcggaccaggagatgaagatatttcagtactttttttcttcccattgtatatatgctatgattactcttggttgggatgtaactgtctacttttgttactttttccgtaaatctagatgtaaaggcaaaaaattgatatatactggttcaaacaatttacctatgttccgtatttgaatgac

SEQ ID NO: 5702 - DNA, 617 bp, Helianthus annuus
cggaccataagttgtgaatcagggatcgaaaaccgtttcaatggcttcagacaatccgattgcttctcgtaaagttgttgtgcatttgagagctactggtgatgctccgattctcaaacaagcaaaattcaagattgctggaaccgataaattttctaaggtgattgattttcttcgtcgccaacttcacaaggagactctgtttgtttatgtgaacagtgccttctccccaagtccagaccaactagtgaatgacctgtacgataactttggaattgatgggaaattggtggttaactatgcatgctctatggcttggggctaatttggagaatgtaacaaaacttgtacagctgcaaaaacttgttatacgggaatttcatttggtaaatatgattaatctttttagattgtatccaaaatttgtttgaccattgcattttactagctctttagctgtgggtcgctttgacttagatggttatttcttcctaatggggtaaatttatcattcagaagggttttctgatactttttcaggccttgttattacgttttatagttttcctaagctcgtgctgatacctcttattatatttcaatagctcatacttttt

SEQ ID NO: 5703 - DNA, 589 bp, Amorphophallus konjac
ttcgtgacttcgtcggagttctccgtgctcatggctgcttcaacggctgtggactctcctctttccacccggaaagtggtgattcacctgagggcgaccggcgacgctcccatcctaaagcagagcaagttcaaggtagctggatcagacaagtttgtgaagatcattgaatttctgaggggacaacttcatagggacacattgttcgtgtatgtaaacagtgccttttcacctaatccagatgaactagtgattgatttgtacaataactttgggttcgatggcaaactggtggttaactatgcttgttccatggcgtggggctaagaaaaattatcggaaggtctcgagggaggtgtctttcaacgctaagaacagtggtacacattcaaatgtattcaatatgttttgatgagtagccacatgtaaatatgacaaatttgtcatggatcaatacatattgaatattcccattcagctggaggatttcagtcccaaaattgtgggtaactttgttccatcccttctctttttactcctgtaactgaacatctgtaattgcaaagtttgtggctgtttgcactgttct

SEQ ID NO: 5704 - DNA, 504 bp, Zostera marina
ggcgggggagtttggtgagttgcggaggaaggaagagatctccgatggcggcgattgtaccagaatctcccaactcctccgatcagaaagtggtggttcatcttaggtccacaggcgatgttccaattctaaaacaatccaagttcaagatagctggatctgacaaattctccaaagtaatcgactttcttcgcaggcagcttcacagagatacattgttcgtatacgtaaacagtgcattttcgccgaatccagatgaatttgttattgatctctacaacaatttcggttttgatgggaaactggttgtcaattatgcatcgtctatggcttggggataataactaataataaacaaaagaaaacatgaaggtgttaattacggaaccatctattgttattatattttttgttccatatctttttcataattactttctttccttttaattgttgttaatcttcatgtatgcacatgtattttattacctttttgtttttagt

SEQ ID NO: 5705 - DNA, 546 bp, Centaurea maculosa
agttgttgtgcatctgagagctactggtgatgctccgattctcaaacaatccaaattcaagattgcagggaccgataaattttccaaagtgattgattttcttcgtcgccaacttcacagggagactctgtttgtttatgtgaacagtgccttctctccgagtccagatgaaatagtaaatgatctgtacgataattttggatttgatgggaaactggtggttaactatgcgtgctctatggcttggggctaactttgaccatttagcaaagcttgtacagcggcaaaaactcattaaacgggagctgcattcggtaaatatggttaatatcttctccccgtattttgtttagaaactctgtaattgatactcatatcatctttcagaagaaccttctgatactttccagcccttattttttacatcttatcaatataacatcttggtattgatggtcttagttaactcgaagacaactcacatatctattatttttatttttataaatagtttatgagttaccactcaaaaaagaaaaaaatacc

SEQ ID NO: 5706 - DNA, 446 bp, Echinacea purpurea
cggccgggggatgtttctgaattttatcagttgcagatcgtaacttgtgaattcgggatcgaaaaccgtttctatggcttcagacaatccgattgcttctcgtaaagttgttgtgcatttgagagccactggtgatgctccgattctcaaacaagcaaaattcaagattgctggaaccgataaattttccaaggtgattgattttctttgtcgccaacttcacaaggagactctgtttgtgtatgtgaacagcgccttctccccgagtccagatcaacttgtgaatgacctgtacgataattttggaattgatgggaaattggtggttaattatgcatgttctatggcttggggctaacctggacaatttagcaaaacttgtacagcttcgaaaactcgttatagggaacttcatttggtaagtgtggttaatatatcagtcaaaa

SEQ ID NO: 5707 - DNA, 558 bp, Brassica juncea
tccgttcggaaaattgttgttcatctaagagctacaggaggtgctccaatactgaaacaaaataagttcaagatttcagggacggataagtttgctaaagtgattgactttctagggaggcagcttcactctgaatcattgtttgtgtatgtaaacagtgctttctcgccaaaccctgatgaatcagtaattgatctatacaataactttgggatagatgggaaactggtggtgaactatgcttgttccatggcatggggataaaaaacgaggatgtacatcatcagagctatgaagttgggcatcatggccaatgatgggatctgcaaaagatgatactgctgctacttttgtttgctaggataatcgaaagtgtagttggaaacttgtttgtacattcataggaaattggctttttcatcttttagttttcacttcagaatatatacattacaaaattcaacgattttaaggggcggtttctctgtcatataaaaccagggtctttccaatatctattctatttttaagtaaaacttctctttctcttattacact

SEQ ID NO: 5708 - DNA, 1187 bp, Populus trichocarpa
gcagaattgggtcgtgtagataggtcgggttgatatttgcaacctgaatcaaagtagctaatttatctttcctttcttcttggattttgttctgtaacttgcggacaccgggcgcatcctaatttcttcccctctttcttcttcctccctcttcatcgaaatcacaattgtaaaatataactggaattgccagctcgagaacatcacttacactgctaagtttcaacttctaaggctcatctagctctcaaattctaagctgaaagcaacaatggcaactgagtcactgagttctgctcgaaaagtgattgttcagttaaaagccactgctgatgcgcctattctcaagcaaaacaagttcaagatacttggaactgataagtttgctaaggtgattgattttttgtcccggcaacttcacagggagagcatgtttgtatacatcaacagtgcattctcaccaaatccagatgaattggtgattgatctgtttaataattttggcgttgatggtaaactgctggtcaactatgcttgttcagtggcgtggggctaactttcggcaatgcccgtgctgatttacgctgttcatacttgagatcttttgttacatattatgaatatttgtggtgttttcttggacccaacgagtaataaggaaacttcattgatgcaaaccctgcaatatcgtttgctccgtgtacttacttctacaataccgttctgtagatctcatgcaagcaagcgccgtacataactagttgatatactagaagtgtgattgaagagatggagatttcaatcatagaattcacgtgcatttgtaagatttcttttttcttcttgtttatggttaatttcccacttcatccatttatacccctgcttcagtgatgagtctaattatacaagacctgtactggtttaagatgcttctatcgaaggctggagatttgttttttatgatttggtcttcaacttttcgatgcgagagtgatgtgataatgacatgtacctgtagcacacactatgcctttgatacctttcggaatctttacagcacgaaagatgtccatcagaattttgttctcattgtaccagtctgtaaaatgacgaaaccattcagaaattgttacaaactgcattcgagattccatatattttcacacgagatcaagaaattgtga

SEQ ID NO: 5709 - DNA, 694 bp, Populus trichocarpa
agcaaaacctttcgtggacgtatcaaaatccctgacttgtatgtttcaactcttgtagctttcaaattctaagctcatagcaacatggagattgaatcacaggattctgctcgaaaagtgattattcagttaaaagccactgctgatgcgcctattctcaagcaaaagaagttcaagatgcttggaactgataagtttgctaaagtgattgactttttgcgtcggcaaattcacagggagaccgtgtttgtatacatcaacagcgcattctcaccaaatccagatgaattggtgattgatctgtttaataatttcggcgttgatggtaaactgctggtcaactatgcctgttcagtggcgtggggctaactttcacgaacagctatgccgatacactgttcatactatttcatgcaagagcagtacatgatttgtcgacagactgagaatatgattgaagaaatggagattacgtaaaattcacatgcatctgtcagaattgctttatttttttatttccggttgatgtcccacttcgatactgtttggacttgcgattcatcttgtgattggatgcatatagtttacttttaaaaaatattaaattgatatttatttagtgtttttcaatagttttgatgtatggatgaaaaaaaaattaattttttttttaatatattttcaaataaaaaaa

SEQ ID NO: 5710 - DNA, 647 bp, Papaver somniferum
ttgtagttcatcttagggcaactggtgatgctccaatacttaaacaagcgaagttcaagatagcaggaactgataagtttgcgaaagtaattgcttttcttcgtagacaacttcaccgtgatacgctatttgtgtatgtaaatagtgctttctcgcctaaccctgatgaattagtgaatgacctttacaataattttgggtttgatggaaaactggtggtgaactatgcttgctcaatggcctggggctaagaggtgaaaatctggtggccggcgttacaggacaccgtatgaaccatgtaaatcccctcttttgtttcagctttctttcctgtcatgttcatatgtggaaaagaagaataactttcaacattgtacaaaatacagaggcttgttattgaagtcatcttgacttcatttcttgagttcgagcctgctttgaactcgaatgaaatttaggggctatcacaatattgttcttttcttttatccaaatattttcccgagtgcactttacagggtaaataatgatacagtttctgaaacatattgaatcacagccactgcatattcactttgttgttcatattatggtttccttcttgacaaataggatctacgtaacattttctaagaaaaaaaaaaaaa

SEQ ID NO: 5711 - DNA, 368 bp, Senecio madagascariensis
aagcagtggtatcaacgcagagtacacgggggcgcaacaagaaaccgtttcaatggcttccgaatctccgattactgctcgtaaagttgttgtgcatctgagagctaccggcgatgctccgattctcaaacaaactaaattcaagattgctggaacggataaattttctaaggtgattgagtttcttcttcgtcagcttcgtagggatactgtgtttgtttatgtgaatagtgcattttctccgagtccagatgaagtagtgaatgacttgtatgataattttggattcgatgggaaattggtggttaactatgcttgttcaatggcttggggctaacattgaaccgtgttaacaaaacctagtacag

SEQ ID NO: 5712 - DNA, 958 bp, Silene vulgaris
catggcttccgaatctcccactgttgttcccaaagttgtgatttatctccgtgctactggtgatgccccaattcttaagcaacaaaaattccaggtctctggcaacgacaaatttgcaagggttattgagtttctgcgaaggcaactccacagagacactttgtttgtgtatgtcaacagcgctttctctcctaacccagatgaattggtctcggatctttacaacaacttcggcattgacagtaagctggtcgtgaactatgcgtgctccatggcatggggttgacttagtgctgccaattgagtattaatacacctagatattttcaccgacattctaagacgctgaatcgctgagaactgtgaaggatgatggcgccctctctgactcaaatagaacccttttccatttctgatcgagacattcaaatgaacgagcaattggtgtttgtttgtctgctaccaactttttcttacaatctggtatatatgtttgcaattaactcgttttagtacagattcgtaagtcttttcttgcaaagaaatataatgggatttgtttttttttgtcagagataatgggattgttttgtgcaataaatagtcgacactaatactacaagcgtagtactttaagggaatgctgaaatagactgtgtactgcctgcttatttttcatctgaattccaaaagtaattaggtaacacaaattacgctcttatccgcacataaagaaaagaagcatgattccgcttagggatgtcaatggatcgggtgcggatcgggtgaagcctcatccgtcatccatccgtccctttaaaatctcatccaacccgtccgtcatccgtgagacatatcatccgtcatccatccatccatcatccatggatgaaacgggtggatcgggtggtaaacgggtgttgtgtatttatatgttttaagttacaaaaagtgatga

SEQ ID NO: 5713 - DNA, 276 bp, Eutrema parvulum
atcttttccgtcacagttgttgttcatctaagagctaccggaggtgctccaatactgaaacaatctaaattcaagatttcagggactgacaagtttgctaaagtgattgactttctaggaaggcagcttcactctgattcattgtttgtctatgtaaacagtgctttctcgccaaaccctgatgaatcagtaattgatctatacaataactttgggtttgacgggaaactggtggtcaactatgcttgttccatggcatggggataaaaccattat

SEQ ID NO: 5714 - DNA, 710 bp, Populus trichocarpa
gcagaattgggtcgtgtagataggtcgggttgatatttgcaacctgaatcaaagtagctaatttatctttcctttcttcttggattttgttctgtaacttgcggacaccgggcgcatcctaatttcttcccctctttcttcttcctccctcttcatcgaaatcacaattgtaaaatataactggaattgccagctcgagaacatcacttacactgctaagtttcaacttctaaggctcatctagctctcaaattctaagctgaaagcaacaatggcaactgagtcactgagttctgctcgaaaagtgattgttcagttaaaagccactgctgatgcgcctattctcaagcaaaacaagttcaagatacttggaactgataagtttgctaaggtgattgattttttgtcccggcaacttcacagggagagcatggtagcttatcaatgatattgatttctctccaatttagcaaaagaattaataagtgggtttctggaatagtaatgttgtctgtttctcccttgttctttagtttgtatacatcaacagtgcattctcaccaaatccagatgaattggtgattgatctgtttaatgtaagtttttgtagcagttaatttttgttttattaatttaatgtcatctctttggttgtggctgttatagataattctgatttgaaaaatacaatttggttttttatcggttca

SEQ ID NO: 5715 - DNA, 660 bp, Solanum tuberosum
gggggggctttgaagagagaatgcagaaatcgtgagggaagcaaaagaatcagctaatactcaatagctatggcttccgattctcgtaaagtgattgttcatttaagagcaattggcgatgctccgattcttaaacaagacaaattcaagattgcaggtacagacaaattcatcaaagtaataaattttttgcgccgtcaagttcgtagggagacattgtttgtatatgtcaagagtgccttctcgccaaatccagatgagttggtaattgacctatgcaataactttggttttgatggtaagttggtggttaattatgcatgctccgtggcgtggggctgaaaactcctggttgtttgcactacaacgcttcaaagctcctccatacctgagtaaatagatagtattataagatagaaacctggcatcaatgattagtcaagagtgttcttcggtagattgttcagtatataactactcgtatgattttaacattgatgcttattgattgtgcttcagtagtttccttatggactattcaccagctctttaaagtttaaacttggatagctgtcatattcgtataaaaagttgtgagtccctttcaactctcaccattgtcaccctttaattctgtaaagttaacaatcctctttcatt

SEQ ID NO: 5716 - DNA, 508 bp, Cynara scolymus
gggggacagaaccgtttcctggcttccgattctcccattgcttctcgtaaagttgttgtgcatttgagagccactggtgatgctcccattctcaaacaagccaaattcaagattgcaggcaccgataagttttccaaggtgattgattttcttcgtcggcaacttcacagggagactctttttgtttacgtgaacagtgccttctcgccgagtccagatgaactagtaaatgacctgtatgataattttggattcgatgggaaattggtggttaactatgcatgttctatggcttggggctaacttttaccgtttagcaaagtctgtacagcggcaaaaactcattaaacgggagctgcatttggtaaatatggttaatatcttctccctgtattttgtttggatactctgtaattgatattcatatcatctttcagaagaaccttctgatacttccccagcccttatcttttacattctatcaatataattcaacatcttggtattg

SEQ ID NO: 5717 - DNA, 1716 bp, Vigna unguiculata
gttctagtcgcgagcggcccctttttttttaaaatcttctagttttgaacaaatttattctgttgttgagagagtaagatcgagaaagcagaaccatggggttggaatcggtcggagatttagccattaacgcaatactaagaaagttagaagccgaagacattgccagagttgcctgtgccagcaaaaggtttaggtcttttgcatccgatgacactctttggatcaatctctgcttcaatgaactcgctttgacccaacccatcgatcatcttgggaaccctttcccttccttcaaggaatgttatcaagcatggagaaaagcttttggaatgtatccttggtttcttgttaagcgtgtcaaaaggtgctgggataggataaaaacctggttgaccaataattttcctgaagctgaggccacgctttgtaaaggggcaactgaagctgacattcagatgttggagaatttgttaaaggtggaattgccacttcctacgaggatcctttatcgcttcaataatgggcaagaaatcgtaaaagcaaatctagaagctagtacatttggaagttgtttgggtctaatcgggggctactccttctataatcatttggtgaatgtttacctattgcctgtgcatcagataatccgagaaactcagcaaatttggcgtcacttgaactttttaaggacatccaagtttgttcttgtggcttcttcgtccacactccgtagaaaattgtttttcctcaattgttccaatggccaactatatgttggaaccaataaacttcgttctgaaaaagacataatcccttgtgtacctcaagatctgataagtttacatcaggaatcaaatggtgaagagcaacaagatgccatgctactgtggttagaagaacatggtcgccgtttagaacatggcttcatcaaactttgtgaaaatgaatatggccgaagcattaatcttttcccagaggaatcccctttttgttcaacggctgttactaatggtgtgaaggttcgctcgtctgcattggttatccctgagtttattgatcctcaagatgacagcgaaaagtacttatttgcttattcaatccgcttgtcccttgaacctcaaggatgtttgattaatggaatgtccttcgactcttgtcaactccattggaggcgctggatcatccgtgctaatgatgatgttgtatcggatgtcaatggagaagctgttataggacagtatccacttttgcatcctggtggacaagaatttgtttatcagagttgcacacctctaccaacgccatcaggttccattgaaggttcttttacatttatacctggcagcttggcatacccaaaaggagacccttttctagctacagtggcacaattccctctccagctgccagactatattttctgattttgattctgaatgggaatgaagcatctctgatggcaaatgcagctcctaaataccatttgagcacaatattttacttagtgagagtagcttggttgttgagtttttattcttctgagttggacctgcacaatttccctatatatataatctttctgtatttaaatgttagtgtagttatattggatttcttgcattattgactttatctgttaactttttaccctccattcactgtgtatatgtaggtatgcaattcaatgatatacatatttagtaatgtaattac

SEQ ID NO: 5718 - DNA, 2045 bp, Glycine max
gaatttttcagctattaaaaagtagctaaaatctcttggatataattgtctatgcatcgtagatgctaaaacacactgaagtcatattaggatttttgttattattttgtggcagcagtgacagagtgattggtgtgagtgcggcaattactggaacagcggttgagtgtgcgatcgagaaagcagagaaatggggttggaatcggtgggagatttagcgattcacgtgattctcagtaagttaggagcccaagacactgccagagtcgcgtgtgtgagcaaaaggttctgttcttccgcttccgacgacactctctggatcaatcactgcttccacgaactcgctctgacacaacccctcgatcatctcggaaaccctctctcttccttcaaggaatgctatcaagcatggcgaggagcttttgttatgtatccttggtctcttgttaagcgtgtaaaaaggtgctgggataaaataaaaacctggttgaccaataattttcctgaagctgaggccactctttgtaaaggtgctactgaagctgacattcaggagttggagaatgtattaaaggtgaaattgccacttccttcaaggatcctttatcgttttcacaatgggcaagaaattgcaaaagcagatccagaaactactacatatggcagttctttgggtctaattggtggctactccttctatagtcatttggtgaatgtttatctattacctatacgtcagataatcctagaaacaaagcaaactaggcgtcacttgagctttttaagaagatcaaagtatgttctcgtggctgcttcatccacatacagtagaaagttatttttcctcaactgtaccaatggtcaactatatgttgggaccagggatctacttactgaaggagacataatcccttgtgtacctcatgatctgattaatttacatcaggaattgaatatttcagagcaacaagatgccatgctactgtggttagaagaacatggtcgccgtttagaacatggctttatcaaacttcatgacaaaggaaatggcaaaagcattaatcttttcccagaagaaccccctctttgttcaatggctgttactaatggtgtgaaggttcgtgcttctgcattggttatccctgagttgattgatcttcaagatgaccttgaaaagtacttatttgcttattcaatccgcttgtcccttgaacctcaagggtgcactattaatggaatgtccttcagctcctgccagctccattggaggcactggatcatccgagctaatgatattgttatatctgatgtcaatggagaagctgttataggacagtatccacttttgcgtccaggtgctcaagaatttgtctatcagagtcgcatgcatctaccaacaccatcaggttccattgaaggttcttttacatttatacccggcagattggcagacccaaaaggagatccttttctagctacagtggctcgtttcccgctccagcttccagactatattttctgattttgatgctagatgggattgaagcatctctaatggcaaatgcagctctcagtatattgtttgggtgcattatgtcattttcgtgagagttgctaggtcgttgagttttttaagttggacctgcacaatttccctatctattatatatcaatatctatctatctgtatctagtgtggtgtagtaataattcgattacttgcgttcttgacttgtgtattaacttcctatccttcattcattgtacaaatctatatgcatgcagcaattcaatgatacatatttagtattgtcgtctataacatgggaacgtgtttgtgttaagtggtggtttgcaatgcgtactctaatatttacgatacaatgttagttgttaaagtaaagcaatgttagagaatccggtccatatgcttttgttcttgaaagtgaatgtattattattctagttccagtattagtataaaaaaagaaaacaaagtgaatgcattgtatttattctccataaagcaaacaaaagtgcattgc

SEQ ID NO: 5719 - DNA, 1990 bp, Glycine max
atcgtagatgctaaaacacactgaagtcatattaggatttttgttattattttgtggcagcagtgacagagtgattggtgtgagtgcggcaattactggaacagcggttgagtgtgcgatcgagaaagcagagaaatggggttggaatcggtgggagatttagcgattcacgtgattctcagtaagttaggagcccaagacactgccagagtcgcgtgtgtgagcaaaaggttctgttcttccgcttccgacgacactctctggatcaatcactgcttccacgaactcgctctgacacaacccctcgatcatctcggaaaccctctctcttccttcaaggaatgctatcaagcatggcgaggagcttttgttatgtatccttggtctcttgttaagcgtgtaaaaaggtgctgggataaaataaaaacctggttgaccaataattttcctgaagctgaggccactctttgtaaaggtgctactgaagctgacattcaggagttggagaatgtattaaaggtgaaattgccacttccttcaaggatcctttatcgttttcacaatgggcaagaaattgcaaaagcagatccagaaactactacatatggcagttctttgggtctaattggtggctactccttctatagtcatttggtgaatgtttatctattacctatacgtcagataatcctagaaacaaagcaaactaggcgtcacttgagctttttaagaagatcaaagtatgttctcgtggctgcttcatccacatacagtagaaagttatttttcctcaactgtaccaatggtcaactatatgttgggaccagggatctacttactgaaggagacataatcccttgtgtacctcatgatctgattaatttacatcaggaattgaatatttcagagcaacaagatgccatgctactgtggttagaagaacatggtcgccgtttagaacatggctttatcaaacttcatgacaaaggaaatggcaaaagcattaatcttttcccagaagaaccccctctttgttcaatggctgttactaatggtgtgaaggttcgtgcttctgcattggttatccctgagttgattgatcttcaagatgaccttgaaaagtacttatttgcttattcaatccgcttgtcccttgaacctcaagggtgcactattaatggaatgtccttcagctcctgccagctccattggaggcactggatcatccgagctaatgatattgttatatctgatgtcaatggagaagctgttataggacagtatccacttttgcgtccaggtgctcaagaatttgtctatcagagtcgcatgcatctaccaacaccatcaggttccattgaaggttcttttacatttatacccggcagattggcagacccaaaaggagatccttttctagctacagtggctcgtttcccgctccagcttccagactatattttctgattttgatgctagatgggattgaagcatctctaatggcaaatgcagctctcagtatattgtttgggtgcattatgtcattttcgtgagagttgctaggtcgttgagttttttaagttggacctgcacaatttccctatctattatatatcaatatctatctatctgtatctagtgtggtgtagtaataattcgattacttgcgttcttgacttgtgtattaacttcctatccttcattcattgtacaaatctatatgcatgcagcaattcaatgatacatatttagtattgtcgtctataacatgggaacgtgtttgtgttaagtggtggtttgcaatgcgtactctaatatttacgatacaatgttagttgttaaagtaaagcaatgttagagaatccggtccatatgcttttgttcttgaaagtgaatgtattattattctagttccagtattagtataaaaaaagaaaacaaagtgaatgcattgtatttattctccataaagcaaacaaaagtgcattgc

SEQ ID NO: 5720 - DNA, 1885 bp, Glycine max
tatattatatgtgaagcggtttttgttgtttggtgttattttatttttttaatccgtaaaaataaaaagaaatacaacatttcacccacccttgttgttatgtgagtgcggcaatagtggaatagcggtagagtgtgcgatcgagaaagcagaaagcagaaagatggggttggaatcggtgggagatttagcgattaacgtgattctgaaaaaattaggagcccaagacattgcgagagtggcgtgtgtgagcaaaaggttcagttcttccgcttccgatgacactctttggatcaatctctgcttcaatgaactcgctttgacacaacccctcgatcatctcggaaaccctctctcttccttcaaggaatgctatctagcatggagaggagcttttgttatgtacccttggtctcttgttaagcgtgtaaaaaggtgctgggatagaataaaaacctggttgaccaataattttcctgaagcggaggccactctttgtaaaggtgcaactgaagctgacattcaggagttggagaatgtattaaaggtgaaattgcctcttcctacaaggatcctttatcgctttcacaatgggcaagaatttgcaaaggcagatccagaaactagtacatttggcagatctttgggtctaattggtggctactccttctatggtcatttggtgaatgtttatctattacctatatgtcagataatcctagaaactcagcaaactaggcgtcgcttgagctttttaagaagatcaaagtatgttcttgtggctgcttcatccacatacagtagaaagttgtttttcctcaactgtaccaatggtcaactatatgtcgggaccaggtctcctcttaccgaaagagacataatcccttgtgtacctcatgacctgattagtttacatcaggaattgaatagttcagagcaacaagatgccatgctactgtggttagaagaacatggtcgccgtttagaacacggctttatcaaacttcatgatgaaggaaatggcaaaagcattaatcttttcccagaagaaccccatatttgttcaacggctgttactaatggtgtgaaggttcgcgcttctgcactggttatccctgagttgatggatcttcaagatgaccttggagagtacttatttgcttattcaatccgcttgtcccttgaacctcaaggatgcattattaatggaatgtccttcagctcttgccagctccattggaggcactggatcatccgtgctaatgatattgttatatctgatgtcagtggaaaagctgttataggacagtttccacttttgcgtccgggtgctcaagaatttgtttatcagagttgcacgcctctaccaacaccatcaggttctattgaaggttcttttacatttatacccggcagattggcagacccaaaaggagacccttttctagctacagtggctcgtttcccgctccagctgccagactatatattctgattttgattctggatgggattgaagtatctctaatggcaattgcagctctcagatattgtttgggtgtattatgtccctttcgggagaggtttttaagttggacctgcacaatttccctatctataagagaagcaaagtatgtacaatatttgatctctatcataagagaagcaaagtagatacaatatttgttaggggtgttcatggtttgattaggttggattttttgttaaaaaatcatccaaatcaaacttaaaaaacttgtgatttggttcgattcagttttcatttaaaataaaattcaaatcagaccaagttaatatatattgcactttagttcaattcgattttggcaatggcaatttctacttgaatgttattttattaaaa

SEQ ID NO: 5721 - DNA, 1767 bp, Glycine max
catttcacccacccttgttgttatgtgagtgcggcaatagtggaatagcggtagagtgtgcgatcgagaaagcagaaagcagaaagatggggttggaatcggtgggagatttagcgattaacgtgattctgaaaaaattaggagcccaagacattgcgagagtggcgtgtgtgagcaaaaggttcagttcttccgcttccgatgacactctttggatcaatctctgcttcaatgaactcgctttgacacaacccctcgatcatctcggaaaccctctctcttccttcaaggaatgctatctagcatggagaggagcttttgttatgtacccttggtctcttgttaagcgtgtaaaaaggtgctgggatagaataaaaacctggttgaccaataattttcctgaagcggaggccactctttgtaaaggtgcaactgaagctgacattcaggagttggagaatgtattaaaggtgaaattgcctcttcctacaaggatcctttatcgctttcacaatgggcaagaatttgcaaaggcagatccagaaactagtacatttggcagatctttgggtctaattggtggctactccttctatggtcatttggtgaatgtttatctattacctatatgtcagataatcctagaaactcagcaaactaggcgtcgcttgagctttttaagaagatcaaagtatgttcttgtggctgcttcatccacatacagtagaaagttgtttttcctcaactgtaccaatggtcaactatatgtcgggaccaggtctcctcttaccgaaagagacataatcccttgtgtacctcatgacctgattagtttacatcaggaattgaatagttcagagcaacaagatgccatgctactgtggttagaagaacatggtcgccgtttagaacacggctttatcaaacttcatgatgaaggaaatggcaaaagcattaatcttttcccagaagaaccccatatttgttcaacggctgttactaatggtgtgaaggttcgcgcttctgcactggttatccctgagttgatggatcttcaagatgaccttggagagtacttatttgcttattcaatccgcttgtcccttgaacctcaaggatgcattattaatggaatgtccttcagctcttgccagctccattggaggcactggatcatccgtgctaatgatattgttatatctgatgtcagtggaaaagctgttataggacagtttccacttttgcgtccgggtgctcaagaatttgtttatcagagttgcacgcctctaccaacaccatcaggttctattgaaggttcttttacatttatacccggcagattggcagacccaaaaggagacccttttctagctacagtggctcgtttcccgctccagctgccagactatatattctgattttgattctggatgggattgaagtatctctaatggcaattgcagctctcagatattgtttgggtgtattatgtccctttcgggagaggtttttaagttggacctgcacaatttccctatctataagagaagcaaagtatgtacaatatttgatctctatcataagagaagcaaagtagatacaatatttgttaggggtgttcatggtttgattaggttggattttttgttaaaaaatcatccaaatcaaacttaaaaaacttgtgatttggttcgattcagttttcatttaaaataaaattcaaatcagaccaagttaatatatattgcactttagttcaattcgatt

SEQ ID NO: 5722 - DNA, 1829 bp, Cajanus cajan
ggttataatttgtggtggttgcattttatcagtggcagaagctaacagtgattgagcggtcgagaaagatgggtttggaatctgtgggagatttggcgattaacgttattctgaagaaattaggagcagaagacattgcgagggtggcgtgtgccagcaaaaggtttaggtcttccgcttccgaagacactctttggatgaatctctgtttccatgaactcgctctgacccaaccccaagatcatctaggaaaccttctcccttccttcaaggaatgttatcaaacatggagaggagctttttctatgtatccttggtctcttgttaggcgtgtaaaaaggtgctgggataggatacagacctggttggccaataattttcctgaagctgaggccactctttgtaaaggtgcaacagaagctgacattgaggagttggagaatgtattaaaggtgaaattgccacttcctacaaggatcctttatcgctttcataatggacaagaaatagcgaaaacagatctggagactagcacatttggtagttctttgggtctaattggtggctactccttctacagtcatttggtgaatgtttatttattaccaatacgtcatataattctagaaactcagcaacataggcgttgcaggggctttttaagaagatccaagtttgttctcatggctgcttcatccacacacagtgaaaagttgtttttcctcaactgtaccaatggtcaactatatgttggaactaggaatattcttactgatagagacataatcccttgtgtacctcatgatctgattcatttacatcaggaagtgaatagtggagagcaacaagatgccatgctactgtggttagaagaacatggtcaccgtctagaacatggcgttatcaaacttcgggatgaagtaaatggcagaagcattaatcttttcccagaagaaccccctttttgttcaacggctattactaatggtgtgaaggtttgtgcttctgcgttggttatccctgagttgattgatcttcaacatgactttgaaaagtacttgtttgcttattcaatccgcatgtcccttgaacctcaaggatgcatcattaatggaatgaccttcaactcttgccagctccattggaggcactggatcatccgtgccaatgatattgttgtatctgatgtcaatggagaagctgttataggacagtttccacttttgcgtcctggtgctaaagaatttgtttatcagagttgcacacctctaccaatatcatcaggttccattgaaggttcttttacatttatacctggcagattggcagagccaaaaggagacccttttctagctacagtggcacatttcccgctgcagctgccagagtatattttctgattttgattctggtatctttaatggaaactgcagctccaagattttgtttggccgcattatgtcacttccgtgagtgttgcttggttgttgtgacccttgtgagagtatgtagtgtagtaactagtaataattgggtttctcgcgttcttgacttgtctcttaactttctacccttcactcgcacaaatctatatgcatgcaattcatatttagtattgtgtgtgtgcggactcttcttttttgtgtgtgtggggtcatagtggtggtttgaaatgtattatctacgcaaaggaatgtcatagaatcccatccatcggcttttcttcttaaaagtgaatgcattattccagtatatatttttttttttaaaaaaaagtggatatataatgtatatttatttaccagaagttcactcacacgtctcatatt

SEQ ID NO: 5723 - DNA, 933 bp, Vigna unguiculata
gggaaaaaacgacgctgggaaggaatatttgtaggttgtaggttgagaatcctttgacaaggaaggtgagatcaaagaatcaacaacgaagtttctggttgtcttgaagtcattatattatcgtaatcataccaacatttctttctcttctggagactcttcctttcgcattcgtctttctcactcaacaaatgagtcgccatcctgaagttttgtgggctcaacgttctgataagatttaccttactgttgctctgcctgatgccaaggatgtttctgtgaagtgtgagcctcagggtttgtttagtttctctgcttcgggcactcaagatgaatcctacagctttagcttagaactttatggatctattgaacctgagggttgtaaaactaaatctagcttaagaaacatactatgctcaattcagaaaggagaaaaaggttggtggaagaggctattgaagtctgaagagaaacctgctccgtacttgaaggttgattggaatagatggtgtgatgaagatgaagagtcaacttctgatttggtgtctgatgatgattctcggtttgttggtcaagatgagggaagcagtgatgatgatggaatgttgtatcttccagacttggaaaaggctaggggatagtaactgttatagtactgtgaaagatataagaagcatgggaacatggaatcacgttgaactattttcataggggcagaatcagactactttatgagatgcactgtgatatgattgtgtggctgccttgtatatagaatctaagtagtgctttggaactcgatcctttgttactactttgaaccaattctgatgagggtttctttgaagggagttctggttgcatcatataatcaatctaacattgttctgaacaacattgttttaagattagacaaccctaactttgatt

SEQ ID NO: 5724 - DNA, 769 bp, Vigna unguiculata
gtaggttgtaggttgagaatcctttgacaaggaaggtgagatcaaagaatcaagaacgaagttcaggttgtcttgaagtcattaccatatcgtaatcatacccacatttctttctcttctggagactttctttcgcattcgtccttctcactcaacaaatgagtcgccatcctgaagttttgtgggctcaacgttctgataaggtttaccttactgttgctctgcctgatgccaaggatgtttctgtgaagtgtgagcctcagggtttgtttagtttctctgcctcggggattcaagatgaatcctacagctttagcttggaactttatggatccattgaacctgagggttgtaaaactaaatctggcttaagaaacatactatgcttaattcagaaaggagaaaaaggttggtggaagaggctattgaagtctgaagagaaacctgctccgtacctgaaggttgattggaacagatggtgtgatgaagatgaagagtcaatttctgatttggtatctgatgatgattctcggtttgttggtcaagatgagggaagcagtgatgatgatggaatgttgtatcttccagacttggaaaaggctaggggatagtaactgttatagtgctaaacaaagatatataagaagcgtagggaacatggaatcatgttgaactatttttataggggcagaattagactactttatgagatgtactgtgatatgattgtgtggctgccttgtgtatagaatataagcagtgctttgga

SEQ ID NO: 5725 - DNA, 982 bp, Glycine max
tattcttaggttgggaaaccgaaacaagtaacgagagaccaaagtggccaagaacgaagcttgacgttgtcttgaagtcattacaatttcatacccacattccgctttctttggaacactctcgctttcgccttcttccttcacactcagcaaatgagtcgctatccagaagttctgtgggcacaacgttctgataaggtttaccttactgttgctctacctgatgccaagaatgtttctgtgaagtgtgagcctcagggtttgtttactttctctgcttctggggttcaagaagaagcctacagctttagcttggagctgtacggatgcattgaacctgagggttgtaaaactaaatctggcttaagaaacatactatgctcaattcagaaaggagaaaaaggttggtggaagaggctattgaagtctgaagagaaacctgctccatacttgaaggttgattggaacagatggtgtgatgaggatgatgaagagtcaacctctgatttggtatctgatgatgatgctcggtttgttggtgaagatgatggaagcagtgatgacgaaggaatgctgtatcttcctgatttggaaaaggctaggggatagaagctctcactgtactgacagatttagggagcatggttgacatggaatcatattcatatggaactatttacaataggggcagagatagactatttgataagatgcaccgtgatgtgattgttgctgccttgtatatagaatctaagctaattagtgctttgaaaacagtcttgatattttgtgtgactacttgggaccaattcttatgagaggtttctttgaagggaatgctggttgcatcatataatctaataacattgtccggaacctcatttgtcatttcaaggttgcaacatttataagaaattctatttttctccttttattttatttcatttttatgggatttaacgttttttaaaatgtgataaga

SEQ ID NO: 5726 - DNA, 946 bp, Glycine max
gaatattcttggtttggaaaccgaaacaagtaacgagagaccaaagtggccaagaacgaagcttgacgttgtcttgaagtcattacaatttcatacccacattccgctttctttggaacactctcgctttcgccttcttccttcacactcagcaaatgagtcgctatccagaagttctgtgggcacaacgttctgataaggtttaccttactgttgctctacctgatgccaagaatgtttctgtgaagtgtgagcctcagggtttgtttactttctctgcttctggggttcaagaagaagcctacagctttagcttggagctgtacggatgcattgaacctgagggttgtaaaactaaatctggcttaagaaacatactatgctcaattcagaaaggagaaaaaggttggtggaagaggctattgaagtctgaagagaaacctgctccatacttgaaggttgattggaacagatggtgtgatgaggatgatgaagagtcaacctctgatttggtatctgatgatgatgctcggtttgttggtgaagatgatggaagcagtgatgacgaaggaatgctgtatcttcctgatttggaaaaggctaggggatagaagctctcactgtactgacagatttagggagcatggttgacatggaatcatattcatatggaactatttacaataggggcagagatagactatttgataagatgcaccgtgatgtgattgttgctgccttgtatatagaatctaagctaattagtgctttgaaaacagtcttgatattttgtgtgactacttgggaccaattcttatgagaggtttctttgaagggaatgctggttgcatcatataatctaataacattgtccggaacctcatttgtcatttcaaggttgcaacatttataagaaattctatttttctccttttattttatttca

SEQ ID NO: 5727 - DNA, 781 bp, Lotus japonicus
gataggttcagaagcaagtcacgacatccaagaatcttcggcctagaacgaaggttgatgttgttttaaacgcgttgctttcttctcagactactctgcactcgccttcttcaatcccactgagcaaatgagtcgccaccctgaagttctgtgggcacagcgttctgataaggtttaccttactgttgctctacctgatgccaaggatgtttctgtgaagtgtgaacctcatggattgttcagtttctctgcttctggtgttcaacatgaaccctacagctttagcttagaactttatggatcaattgaaccagagggttgtaaaattaaagctggcttaagaaacatactatgctcagttcaaaaaggccaaaaaggttggtggaagaggctactgaagtctgaagacaagcctgcaccctacctgaaagttgattggaacagatggtgtgatgaggacgatgaagagtcagcttctgatttggcatctgatgatgatgcgccgtttggtcaagatgatggaagcagtgatgatgacggaatgttgtatctccctgacttggaaaaggctaggggctagtaacttttagcaatactaacaaatatttatgaagcttgatggagatggaatcatatggaactatttagataggttcatggatagactacttgataaaaagcattgtgatgtaattgtagctgttctgtatataaaatgttctgaaaacttactcttgattttctttgatttcttagcatcaattcaggtgagatttctatc

SEQ ID NO: 5728 - DNA, 522 bp, Glycyrrhiza uralensis
gacagccacattttaatgttgtcttgaagtcacatccatttcacacccacgttgcattcttcgccttcttcattcccactgtgcaaatgagtcgccaccctgaagttctgtgggcacagcgttctgataaggtgtaccttactgttgctctacctgatgcaaaggatgtttctgtcaggtgtgagcctcaggggttgttcagtttctctgcttctggggttcaaggtgaatcctacagctttagcttggaactttatggatcaattgaacctgagggttgtaaaactaaatctggcttaaggaacatactatgctcaattcagaaaggacaaaaaggttggtggaaaaggctactgaagtctgaagagaaacctgcaccatacctgaaggttgattggaacaaatggtgtgatgaggatgatgaagagtcagcttctgatatggatgatgatgcacggtttgctggtcaagatgatgaaagcagtgatgatgaaggaatgttgtatctccctgacttggaaa

SEQ ID NO: 5729 - DNA, 750 bp, Arachis hypogaea
atcacattcttctctcaacaacaccaaatgagtcgccatcctgaagtactgtgggcacagcgttctgacaaggtttatctgactgtggcactgcctgatgcaaaggatgtctctgtcaagtgtgagcctcatggtttgtttactttctctgcttctggtgctcaaggtgaatcttacagcttcactttagagctttatggccccattgcacctgagcgttgcagaactaaagctggtttaagaaacatactatgctatgttcagaaagcagagaaaggttggtggaagaggctactgaagtcagaagagaaacctgctccatacctgaaggttgattggcacagatggtgtgatgaagatgatgaagagtcaacttctgatttggcatctgacgatgatactcgatttgttggtcaggatgagggaagcagtgatgaggatgaaggaatgttgtatctcccggacttggaaaaggctaggggatagcaactctgactgttctctaacatggatttacggaaacatcttggagatggagtctacctagataagtaaatttgggagtagtagtctaatatggttgtcttttttgtatatattatcctaagtaaagctctaaaaacttagagaacctttgatcttttatgacattttggcaccatttctggtatctaactaggcttctctcatgcccttgctgatttcacaacatgctccacataatctaacttttcttcttctttaacaaaa

SEQ ID NO: 5730 - DNA, 1354 bp, Arachis hypogaea
attttctctgtttcgctcactctctctctctcgctatcacattcttctctcaacatcaccaaatgagtcgccatcctgaagtactgtgggcacagcgttctgacaaggtttatctgactgtggcactgcctgatgcaaaggatgtctctgtcaagtgtgagcctcatggtttgtttactttctctgcttctggtgctcaaggtgaatcttacagcttcactttagagctttatggccccattgcacctgagcgttgcagaactaaagctggtttaagaaacatactatgctatgttcagaaagcagagaaaggttggtggaagaggctactgaagtcagaagagaaacctgctccatacctgaaggttgattggcacagatggtgtgatgaagatgatgaagagtcaacttctgatttggcatctgacgatgatactcgatttgttgctcaggacgagggaagcagtgatgaggatgaaggaatgttgtatctcccagacttggaaaaggctaggggatagcaactctgactgttctctaacatggatttacggaaacatcttggagatggagtctacctagataggtaaatttgggagaagtagtctaatatggttgtcttttttgtatatattatcctaagtaaagctctaaaagcttaaagaacctttgaacttttatgacattttggcaccatttctggtatctaactaggcttctctcatgcccttgctgatttcacaacatgctccacataatctaacttttcttcttctttaacaaaattcggtgaattataccaaaatcatatcaactttagaaatcttaaggctggaatcctttactacacaccccattcaactttgaaacttattaagatttcatggttctgttcggcatggcatggtgtatttggccctttcctctgaactgactccttctctgccttgaacctgtcaactgggaaagagcgttgacgataagggtggtggtaactacatatgggatagctaactaatgtcaactttattgccatgatcactcagtctcccaaggtaactagatatgggatagctgaagccatagaccttcagctccaaggtatggcctctttggtagcgttgtatctaccggtaacatgtccgccggaggatgagttgtaagttgtaatatggtgatgttagagaggattgcagggtgttgattcggggtgcacctacaattaatgggtgtataagtgtcttagtgacatttcaagcattgatattagaataatagttaagagtaaagtgatgtgtggtgcattttatttcatttgctaaaccacattcttggactaacttcaatcattatc

SEQ ID NO: 5731 - DNA, 1068 bp, Arachis hypogaea
agtcgccatcctgaagtactgtgggcacagcgttctgacaaggtttatctgactgtggcactgcctgatgcaaaggatgtctctgtcaagtgtgagcctcatggtttgtttactttctctgcttctggtgctcaaggtgaatcttacagcttcactttagagctttatggccccattgcacctgagcgttgcagaactaaagctggtttaagaaacatactatgctatgttcagaaagcagagaaaggttggtggaagaggctactgaagtcagaagaaaaacctgctccatacctgaaggttgattggcacagatggtgtgatgaagatgatgaagagtcaacttctgatttggcatctgatgatgatactcgatttgttggtcaggacgagggaagcagtgatgaggatgaaggaatgttgtatctcccggacttggaaaaggctaggggatagcaactctgactgttctctaacatggatttacggaaacatcttggagatggagtctacctagataggtaaatctgggagtagtagtctaatatggttgtcttttttgtatatattatcctaagtaaagctctaaaaacttagagaacctttgatcttttatgacattttggcaccatttctggtatctaactaggcttctctcacgcccttgctgatttcacaaaatgcgccacataatctaacttttcttcttctttaacaaaattcggtgaattataccaaaatcatatcaactctaggaatcttaaggctggaatcctttactacaccccattcaactttgaaacttgttaagatttcatggttccattcggcatggcatggtgtatttggccctttcctctgaactgactccttctccgccttgaacctgtcaactgggaaagagcgttggcgataagggtggtggtaagtggtaactacatatgggatagctaactaatgtcaactttattgccatgatccactcagtctcccaaggtaactagatatgagatagctgatgccatagaacttcagctccaaggtatggcctctttggtagtgttgtat

SEQ ID NO: 5732 - DNA, 821 bp, Cicer arietinum
cattaaggaacaaaaataaaaaggaacaagtgacgacatatcaaagaatctaaaatcctgaaagaaagaaacgaagtttgacactcactgatcaaatgagtcgccatccggaagttctgtgggcgcagcggtctgacaaggtttacctgactgttgctctacctgatgccaaggatgttactgtgaagtgtgagcctcatggtttgtttagtttctctgcttctagggttcaacatgaatcttacagctttagtttggaactttatggatcaattgaacctgggggttgtaaaactaaaactagctcaagaaacatactatgctcaatccagaaaggacaaagaggttggtggaaaaggctactgaagtctgaagagaaacctgcaccatacctgaaggttgattggaataaatggtgtgatgaagatgaagagtcagattatgagttgatatctgacgacgatggacgatttgctggtgaagatgatgaaagcagtgatgatgaaggaatgttatatctccctgacttggaaaaggctagaggaaagtaactcttacagtactaacaaaagttgaagaagcttcaaggagatggaatcatatggaactgttagataggtgcatggatagactactttataagaaacattgatattatttgtagctgtcctgtatatagaatctgagtagtgttttggaatctgaaaacaatcttgatcttctttgatgtgaatgatggtggttgcatcacatagggctcgattgatatagattttaaaaaagttttaaaaaaagtgattttggcactttacacatttaca

SEQ ID NO: 5733 - DNA, 816 bp, Lupinus angustifolius
attcttatttctcagtcacattcagaacctcacccactcccacttttcttcttcttcttcttaccaaaatgagtcgccaccctgaagttctgtgggcacaacgttctgataaggtttatctcactgttgcactgcctgatgctaaggatgtttctgttaagtgtgagcctcatggtttgtttaccttttctgcttctcatgttcaaggtgattcctacagctttaccttagaactttacggctcgatttcgcccgagggttgtaaaactaaaaccggtttaagaaacatactatgctcagttcagaaagcgcagagaggttggtggaagaggctgctgaagtctgaagagaaacctgctccatatctcaaggttgattggcacagatggtgtgatgaggatgatgaagaatcagcttctgatgcagacgatgatgatgcccggtttgtcagtcaagatgatgaaagcagtgacgatgaaggaatgttatatctccctgacttggaaaaggctagagtgtagcaattcttacagttctaacaaagatctgaacaattatccttgagatggagtcatattaaactacttagataggtacactagggtaaagtacttttgataaaatgaagtttagcatcattgtgactgtcctgtatatagaatctaagtattgctctgaaaaacataggcagcctttgatcttttgactgtttggctacctattttctcgtcttctgactatgcttcttgatgctcttcctggcttcatacatataattgaacatttttcttacaacaaaaaagaaaaaagtaccga

SEQ ID NO: 5734 - DNA, 744 bp, Medicago truncatula
gtcactctttcacttcactctcactcagctgaagaatgagtcgccatccagaagttctttgggcacagcgttctggtaaggtttacctgactattgctctacctgatgccaaggatgtttctgtgaagtgtgagcctcagggtttgtttatcttctctgcttctagggttcaacatgaatcctacagctttagcttggaactttacggatcaattcaacctgagggttgtaaaactaaaactggctcaagaaacatactatgctcaattcagaaaggacaaagaggttggtggaaaagattactgaagtctgaagagaaacctgcaccatacctgaaggttgattggaataaatggtgcgatgaagatgaagagtcagaatctgaaccgatatctgatgatgatggacggtttgctggtgaagatgatgaaagcagtgacgacgaaggaatgttatatctccctgacttggaaaaggctagggcaaagtaactctgacagtagcaacaaaggttgatgaagcttcaaggagatggagttatatggaagtgttagataggtgcatggatagactactttataagaaacaatgatattattgtagctatcctgtatatataaaatctgagtagtgctttggaatctgaaaacaatcttgtttttctttgattatttggcactaaatttagctagctatctttgttgtgaatgttggttgcatcacataatctaacatcttttattt

SEQ ID NO: 5735 - DNA, 791 bp, Medicago truncatula
cagtattcctcgtataaatagattaaggaacaaaaaaagaacaaccaacgacacatcaaagaatcaaaagttgtcactctttcacttcactctcactcagctgaagaatgagtcgccatccagaagttctttgggcacagcgttctggtaaggtttacctgactattgctctacctgatgccaaggatgtttctgtgaagtgtgagcctcagggtttgtttatcttctctgcttctagggttcaacatgaatcctacagctttagcttggaactttacggatcaattcaacctgagggttgtaaaactaaaactggctcaagaaacatactatgctcaattcagaaaggacaaagaggttggtggaaaagattactgaagtctgaagagaaacctgcaccatacctgaaggttgattggaataaatggtgcgatgaagatgaagagtcagaatctgaaccgatatctgatgatgatggacggtttgctggtgaagatgatgaaagcagtgacgacgaaggaatgttatatctccctgacttggaaaaggctagggcaaagtaactctgacagtagcaacaaaggttgatgaagcttcaaggagatggagttatatggaagtgttagataggtgcatggatagactactttataagaaacaatgatattattgtagctatcctgtatatataaaatctgagtagtgctttggaatctgaaaacaatcttgtttttctttgattatttggcactaaatttagctagctatctttgttgtgaatgttggttgca

SEQ ID NO: 5736 - DNA, 935 bp, Lupinus angustifolius
ttgtgctccaaggaggagagagacaaaaatacgaacagaaaaatacaaacaaaagttgacattactgttgtactcactcactcacatttcattcttatttctcagtcacactcagaactcagcgactcccattttcgtcttcttcataccaaatgagtcgccatcctgaagttctgtgggcacaacgttctgataaggtttatctcactgttgcattgcctgatgctaaggatgtttctattaagtgtgagcctcatggtttgtttaccttttctgcttctcatgttcaaggtgattcctacagctttaccttagaactttatggcccgatttcgcccgagggttgtaaaactaaaaccggtttaagaaacatactatgctcagttcagaaagcgcagaaaggttggtggaagaggctgctgaagtctgaggagaaacctgctccatatctcaaggttgattggcacagatggtgtgatgaggatgatgaagaatcagcttctgatgctgacgatgatgatgcccggtttgtcggtcaagatgatgaaagcagtgacgatgaaggaatgttatatctccctgacttggaaaaggctagagtgtagcaactattacagttctaacaaagatctaagcaagtatccatgagatggagtcatattaaactatttagataggtacactagggtagagtacttttgataagatgaagtttagcatcattgtgactgttctgtatatagaatctaagtattgctctgaaaaacataggtagcctttgatcttttgattgtttggcaccattttctggttgcatcatacatatgatttaacatttttcttaaaatattttggtgatattttggtcgtgttaaacgttttaacaaaaatgggatttttgttcggattgcgaagctcttacactctgaatttgg

SEQ ID NO: 5737 - DNA, 886 bp, Vaccinium corymbosum
ttattgttttttcctctttcccaaattccatttccactatctttatgatccaaactctggtgtccagtagggtttttgatacttcgttccgactctgtgtgcgacgatttcttcggcttaactcctacctaatcgccatttcttttcctaaatgagtcatccggaagttctttgggctcagcgctctgacaaagtttatctgaccattgctcttcctgatgcgaaagatgtttctgtgaaatgtgagcctcaggggttatttagtttctccgctaagggtgtccaagggaaatcatttgacttcagtctggaactttatggaaatatagcaccagagggctgcaaatctaaagctgggttaaggaacatactttgctcaatccagaaggagcagaagggttggtggaaaagacttttgaagacagaagaaaagcctgcaccctatatcaaggttgattggaacaaatggtgtgatgaggatgatgaagagtcaaccagttctgatcttgcctctgatgatgatgttccgttcactggtgaagatgatggtagtagtgatgatgaaggaatgctctatcttcctgacttggagaaggccagaggaaactagcataggatcgatacctaaccagtaaccggtaatgtagttcctttgaaagcagtttacttagctaggtatgtgtactctcagatactgttaatcctaattagcactgtaaatatgctgtatgaaatgagatccaattcctactcgaccgtatgaaatgagacccaattcttactcaaaaatattagtggtttactttgaatgtccagaggcttgggcttccttcttggcttcttaatctctgattgaatgtatctgaatgtagccttgagtattgac

SEQ ID NO: 5738 - DNA, 757 bp, Trigonella foenum-graecum
ggaacaactaacgacacatcaaaggttgtcactttcacttcttcactctcactcagctgaaaaatgagtcgccatccagaagttctgtgggcgcagcgttctgacaaggtttacctgactgtttctatacctgatgccaaggatgtttctgtgaattgtgagcctcatggtttgtttactttctctgcttctagggttcaacatgaatcctacagctttagcttggaactgtttggatcaattcaacctgagggttgtaaaactaaaactagctcaagaaacatactatgctcaattcagaaaggacaaagaggttggtggaaaagactactgaagtctgaagcgaaacctgcaccatacctgaaggttgattggaataaatggtgtgatgaagatgaagagtcagaatctgaaccaatatctgacgatgatggacggtttgctggtgaagatgatgaaagcagtgatgatgacggaatgttatatctacctgacttggaaaaagctagaggaaagtaactcttacagtggtaacaaaggttgatgaagaagcttgaaggagatggaattatatggaagtgctagataggtgcagggatagactactttataagaaacagaacaatgatattattgtagctatcctgtatataaaatctgaaaagagtcttgttcttctttggttacttggcagtaattctagtaaggtttctttgttgtgaatgttggttgcatcacataatctaacatcttttat

SEQ ID NO: 5739 - DNA, 891 bp, Quercus alba
gttgagaaaaagataccttgccttggttgtgagtgtacggagtagagtgagtgtttggttgttttgttttgatatatcgttccgttccacactcactccctgtaacacacgcacgcacgcgacctttcactgaaacatcgttcattctccgttcacaaaatcaaaatccaaatgagtcgcaatccagaggttctttgggcgcagcgctctgacaaggtttatctgacagtagctctacctgatgcaaaggatatttctgtcaagtgtgagccccagggaaaatttagtttctctgctcgaggggtgcaaggtgaatcctttgacttaagtttggaactttatggagcaatagtacctgagggttgtaaaactaaagttgggttgaggaacattctgtgttcaatcccaaaagggttggtggaaaagattgttaaagtcagaagaaaaacctgcaccgtacattaaggttgattggaacaaatggtgtgatgaggacgaggaagagtcttcttctgatctggcctctgaaaatgatgatgctgcgtatgttggacaagatgatgaaagcagtgatgacgaaggaatgctctatctccctgacttggaaaaggcaagaggaaactagcaactatcagtagtgacaagtagcattctgcatctcataaattcaacttttccctagtgtacctatttttaagaagagtagagtggttccatttaaactccagttccatgagatgcagaattatgaccatgttggcactgtatacacctaatccaactcatgcttaaggaaagtctgacatttgatttccagagttacatttgatttcttgtcttgtttgcttggatgtctggctggttttacccaatagctaaattgtagggttc

SEQ ID NO: 5740 - DNA, 1130 bp, Lupinus angustifolius
gagagacaaaaataccaaacaacaatccaaagaaaagttgacgttactgttgtactcacacatttcattcttatttctcactcacacttgcactcacaaatcacccactcccattttcgtcttcttcttcataccaaatgagtcgccatcctgaagttctgtgggcacaacgttctgataaggtttatctcactattgcactgcctgatgctaaggatgtttctattaagtgtgagcctcatggtttgtttactttctctgcttctcatgttcaaggtgattcctacagctttaccttagaactttatggcccgatttcgcccgagggttgtaaaaataaaaccggtttaaggaacatactatgctcagttcagaaagcgcagaaaggttggtggaagaggctgctgaagtctgaagagaaacctgctccatatctcaaggttgattggcacagatggtgtgacgaggatgatgaagaatcagcttctgatgctgacgatgatgatgccaggtttgccggtgaagatggtgaaagcagtgatgacgaaggaatgttatatctccctgacttggaaaaggctagagtgtagttataacaaagatctaagcaagtattcttatgatggagtcatattaaactatttagataggtacactagggtagagtacttttgataaaatgaagtttagcatcattgtgactgtcctgtatatagaatctaagtattgctctaaaaaacataggcagcctttgatcttttgactgtttggtaccattttctggcttctgactatgcttcttgatgctctttctggttgcatcatacatataattgaatttggagtatccaactttcaagcaactcacaaggaaaaagacttggataaaatgagtttatatggaatgtgtgcaaataaggatgttttaagtttcagatcattgaatgagttgagattttgatgcttttaacttatggagagtgaatatatttttacttattaattttatagacttattttagaggagtataattcggtcttgaaggtagtggtggatatccacccaaccattagagcctataggccttgtctatagtgtccttttatgactcactcctcatcttaatgaa

SEQ ID NO: 5741 - DNA, 958 bp, Theobroma cacao
ccgcctcaaccaaaaacccagctgaattttgaagcattcgaattcgttgagcctcctccctcaaaaccttctgtctttgcctttctctttattttctgcagccttttactcctccttcaagcaccatccaacatgagtcgccatccagaggttctttgggctcagaggtctgataaggtatacctgacgatctctttacctgatgcaaaagatatttctgttatatgtgaccctcaggggttatttagtttctctgccatgggggtgcaaggagaatccttcgatttcagtttggagctttttgggaaaatagtacctgagggttgcaaaactaatgttgggttaaggaatataatatgctctatccagaaagaagagaaagggtggtggaaaagattactaaagtcagaagagaaacctgcaccttacatcaaggttgattggaacaaatggtgtgatgaagatgaggaagagtcaaattctgatttggcctctgatgatgatgatgccatgtatgttggtcaagatgatgaaagcagcgatgatgaaggattgctgtatcttcctgatttggaaaaggcaagaggaaactaagcaaagaatcagaactaaccagtgacaaatggaagatggagctacgaggaacaattttcatcctgctgtggaattattagaactggagttcatatatattcatatctaaccccttcttcaaggcagaggccaatcagattaagagcactagaattctgaattcatttcaatctatttttgcttaacttgtttacagtatttgctcatatcagccacaatgatgcatccatctgctttattttctacattgtttggtctttctttgactaggctgctctgcttacctggtttaactgttgaagctttgcaattttcacaaagcttgaggcagggaaattcaagttttaatattgatataatgata

SEQ ID NO: 5742 - DNA, 6535 bp, Medicago truncatula
ttgtcttaaaagaagatgcgttgatctatgaaggcaagtagcttttagcttttgtcattttccatcacacttctattcaccaccttccctcactctccatccaccaaacgcaaacactttgacatgagttcaacaacgtgaacattacgattcttctttcactttcttccatcgcttccatttcatagggtttctgcaaccatgggaaccgcttcacgccagttaaaggttatgctcagaaaaaactaccttctcaaaattcgtcaccctttcgttactgctgctgagattttgctccctgcgattgttttgatgctattagcagctgtaagaacacaagtggatacacaaattcatccagctcaatcgcacattcagaaagatatgtttgtagaagtggggaaaggtgtatcccctaactttcaacaagttttggaatccttgttggataagagagagtatttagcttttgtaccagacaccaatgaaacaaggatgatgatagacgtggtgtccatcaaatttccgattttgaagcatgttagtattgtatacaacgatgagttagagttggaaacatacatccggtcagatgcttatggtacctgcaatgatgtaaggaattgttcgaatcccaaaattaaaggagcagttgtatttcacgaacaaggtcctcagtcatttgattatagcatacgtctcaatcatacatgggctttctccggttttccggatgttacaacaataatggatacaaatggcccttttcttaatgacttagaacttggtgttagtgctgtaccaacaatgcaatacagcttgagtgggtttttgacactccagcaaatggttgattcattcataataataattgctcaacaacatgaattaaacttgagtgccgaaactgtaaatcttcctcttctaggatttcatgacactgatttctcgcgaaaagttccatggacccagtttaaccctactaacatacgaatagctccatttcccactcgagagtacaccgatgaccagttccaggcaatagtaaaagaagtcatgggaatattgtatttattggggtttctctatccagtttctcgcctgataagttattctgtgtttgagaaggaacaaaagatcaaagaaggactctatatgatgggcttaaatgacagcatatttcatctctcttggtttgtcacatatgctttccagtttgcaatttcttctgcggtcattacagcttgcacgatggataatatattcaagtatagtgataagacactggtgtttgcgtacttcttcatttttgggcttagtgcaatcatgctgtcattttttatatcaacgtttttcaaaagggccaaaacagctgtagctgttggaactctgtcatttcttggtacctttttgccgtattactctgtcaacgatgagggagtctctatgatcttgaaggttctcgcttctctgctttcacctacggcatttgctctgggttctatcaactttgctgattacgagcgcgctcatgttgggctccgctggagcaacatatggcgggagtcttctggagtgaacttttctgcatgtcttctgatgatgatacttgatacactgctctattgtgcaattggactgtatttcgataaggttcttccaagggagtatggactgcgatatccatggaactttatttttaaaaaggatttgtggagaaagagatcctccagttctaaaattaaatttactggcaagagttctgagtcagaagggaatcttttggggcgaggtattttcaatcctgctctagaagcaataagcttagacatgaaacaacaggagcttgatggcaggtgcattcaaatcaggaatttgcataaagtgtatgctactaaaaaaggagattgctgtgctgttaactcattacagctgacattatatgaaaatcagattcttgctcttttaggacataatggagctgggaaaagcacgacgatatcaatgcttgttggtcttcttcctcctacttctggggatgctttgatttttggaaagaacattgtctctgatattgatgagatacggaaggttttgggtgtctgcccacaacatgatatactatttcccgaattgactgtgagagagcatttagaactatttgccatattaaagggtgttgacgaagacacattggagagcgttgttataaatatggccgatgaggtgggcctggctgataaaatcaacactgttgtgagatctctttctgggggcatgaagaggaaattgtcccttggaatcgcattgattggaaatagtaaggttataattcttgatgagcctacaagtggaatggatccatactcaatgcgtttgacttggcagttaataaaaaaaattaagaagggcaggataattttgctaacaacacactctatggatgaagcagatgaactaggtgaccggatagctatcatggccaatggttctctgaaatgctgcggaagctctcttttcttgaagcatcattatggagtcggttacactctaactcttgtaaagtctgctcctactgcttctattgctggtgatattgtataccgatatgttccgacagcaacctgtataagtgaggttggaactgaaatttccttcagactccctatggcatcctcctcaacctttgagaggatgttcagggaaattgaaagttgtatgaaaaagcctgtttcgagcatggaaataagcggcaattgtgaaaaagacagtcacggtattgaaagctatggtatatctgtaacaaccttggaggaggtattcttgagagttgctggatgtgactatgatgaagatgaatgctttgaagaaaataaccgttcgcttatatcagaagctgtggtttctcttccttctaatgatcgtccatccacaaaaatatgttattataaagtttgtggaaattacaagaagattcttggtttcatgtctaccatggtggggagagcttgtggtttaatttttgctacagttattagctttgtcaacttcataagcctacagtgttgtagctgttgtctcattactacgtccactttttggcaacactcgaaagccttaattattaagagggcgatatctgcacggagagatcacaaaacaattatttttcagttaatgattcctgctatcttcttgtttattggtcttctatttctggagctcaagccgcatcctgatcagatttcactgactctttcaacttcttattttaatcctctattgagcggtgggggtgggggtggtccaattccgtttaacctatcttttccaattgctgaagaggtagcacaaaatgttaaaggaggttggattcaaaggtgtaactcaagctcatacaaattccccaattcagaaaaggcattagttgatgcagtggaagcagcagggccagctttgggacctgctctacttaacatgagtgaatatttgatgtctagctttaatgaatcctaccaatctaggtatggggcaattgtgatggatgatcagaacaccgatggaagtttaggctacactgtattacataacttttcttgtcaacatgctgctcccacctttatcaatttgatgaattcggcgattcttaggcttgctactcataatgtgaatgcgacaattcagacacgcaaccaccctctaccaatgacacaaagccagcacttacaacgccatgacctggatgccttctctgctgctatcattgtcaatatagccttctctttcattcctgcttcatttgctgtttcaattgttaaggaacgtgaagtgaaagctaagcaccaacaactaatcagtggggtttctgtcctttcatactggatctctacatttatttgggacttcgtgagcttcttgtttcctgcctcttttgccattgttctcttttacatctttggtctagatcagtttgttggaggagtttctttgataccaacaattatcatgcttttggaatacggacttgcaattgcatcatcgacttattgccttacatttttcttttttgaccataccgtggcacagaacgtggttctcctggtccactttttttctggattgatactaatggttatctcattcattatggggctcctcccatccacaataagtgccaattcttttcttaagaactttttcagaatatctcctggattttgttttgccgacggtcttgcttcattagctcttctgcggcaaggaatgaaagataaaacaagtgatggagtgtatgactggaatgttacgggtgcctccatctgttatcttgctgtcgagagcttcatttattttttattgacactcgggcttgaaatatatccttcgctcaaattaactccattcaagatcaagaagtggtgggggaaaattaatatcttcccacataatactagttatctggaacctttattagaatcttccccagaaacttttgttacggacctcaatgaagacgtggatgtgaaaacagaaaggaatagagtactttcaggttccattgacaatgccattatctacttgcgcaatcttcgcaaggtgtattctgaagagaagaatcatgggaaaaaggttgcagtagattcattaaccttctcagttcaggaaggagaatgttttggttttttaggaacaaatggagctggaaagaccacaacgctttccatgttatgcggggaagaatctccttctgatgggactgcttttatttttggcaaagacatatgttcccatcccaaggctgctcgtaaatatattggatattgtccacaatttgatgctctgttggaattcttaactgtcaaagagcatcttgagctctatgctagaataaaaagtgttccagactacacaatagacaatgttgttatggaaaagctggtggagtttgacttattgaagcatgctaataaaccatcattttcacttagtggagggaataaaagaaaactatctgttgcaattgcaatgattggagatcctcctattgtcattcttgatgagccgtccacaggaatggatcccattgcaaaaaggttcatgtgggatgtaatatctagaatctcaactagacgaggcaagactgcagttattcttactacccatagcatgaatgaagctcaagccttgtgcaccagaatagggattatggttggtggacaactaagatgcattggaagtccgcagcatctaaaaacaagatttggcaatcatctagaactagaggtaaaacctactgaagtgagctctgtggacttgcaaacactctgccaaactattcaggaaatactttttgatgtcccttctcaacctagaagcttacttaatgaccttgaaatttgcattgggggtgctgattccgtcacctcaggaaatacctccattgcagaaattagcttgacatcagagatgataggcttaattggacgctggcttggcaacgaagaaagagtaaaaactctaacgtgctgtacacctgtctatgatggggcctctcaggaacagttgtccgaacaattacttcgagatggtggtattccattgcccgtgttttctgagtggtggttgtccaaacaaaaattctcagaaattgactcatttattctctgttcatttcgtggagcaaaatgccagggatacaatggtttaagcatcagataccagttaccttgtgatgaggacttttccctggcagatgtttttggacttctggaagcaagcagagataagttagggattgcagagtacagcctcagccaatcaactcttgagacaatatttaaccattttgcagctaattcatgagatgcccgtatttcatccttttctttcataaaatgatgcatgctggttgcaatgtgtttgaatgtatcaaagttataatattttcttaacttttactagtagtgaaatccaacagagggccctgggtgagattctaaggccttgtatattgtagagtccgtcattatagtgccatttaattgtaaatagattcccagttattaaatcttgaatctgactgtttcaccaacttttggagtagtttaggataatccatattaggattatctttaacttttcttgtggttctgctccaatgcttgttggaggaaagcgaaggggagtttggtagcagtcgttttaatgtttcttctttgcttgatggtttttattaattgatcaaatgaccctgtgacaatcatgaagtatatgcacttcttatggaatcaaacaacattttcttttcctgcctcatttatttggctaaatataaaatcgctgaagtgtcattcctcaatttaaagaatgacaatttgacaaataaaaaggatagatgaaaagaacagtaggttacggcagcaattatgttgtttaagattttgaattatgaattaatgatatagtagatttatatattaaaaaatttgtgaccttcgaattgaattttataagtttcaagtatatgtaaattgag

SEQ ID NO: 5743 - DNA, 6126 bp, Cicer arietinum
tttccatttcctagggttttcgcaaccatgggaacttcttggaggcagttgaaggttatgctcagaaaaaactgcctcctcaaaattcgtcaccctttcgttactgctgctgagattttgcttcctgcgattgtgttgttgctattagcagctgtaaggacacgtgtggatacacaaattcatccagctcaatcgttagttttctattcatcaatttctattgggaaaggtatatcccctaacttccaacaagtgatagaatccttgttggataagaaagagcatttagcttttgcaccagataccaaagaaacaaggatgatgatagacgtggtgtcaatcaaatttccacttttgaagcttgttagtattgtatacaaagacgaggtagagttggaaacctacatccggtcagatgcttatggtatctgtcatgacataaggaattgttcaaatcccaaaattaaaggagcagttgtattttacgaacaaggtcctcagtcatttgactatagcatacgcctcaatcatacatgggctttctctggttttccagatgttacaacaataatggatacaaatggtccttttcttaatgacttggaacttggtgttagtgctgtaccaacaatgcaatacagcttcagtgggtttttgacactccagcaaatggttgactcattcataatattaatagctcaacagcctgaattaaattcagttgctgacacagtaaagcttcctcttctaggatttcatgacaccgatttctcgttaaaagttccatggactcagtttaatcctactaatatacgaatagctccatttcccactcgagagtacactgatgaccagttccaggcaattgtaaaggaagtcatgggaatactgtatttattggggtttctctatccagtttctcacctaataagttattctgtgcatgagaaggaacaaaagatcaaagaaggactgtatatgatgggcttgaaagatggcatatttcatctctcttggtttatcacatatgctttgcagtttgcaatttcttctgcggtcattacagcttgcactttggataatatattcaagtacagtgataagacactggtgtttgcatacttcttcatttttgggcttagtgcaatcatgctatcatttttcatatcaacatttttcaaaagggccaaaacagctgtagctgttggaactctgtcatttcttggtgcctttttcccttactacactgtcaatgatgcgggagtctctatggtcttgaaggtgcttgcttctctgctttcacctacggcatttgcgctgggttctgtcaactttgctgattatgagcgtgctcatgtcggacttcgttggagcaacatatggcgggagtcctctggagtaaacttttccatatgtcttctgatgatgatacttgatacactgctctactgtgcaattggactgtattttgataaggttcttccaagggagtatggattgcgatatccgtggaactttattttccgaaaggacttctggagagagaaaaaaattgtaaatacttgttcctccagttttaaagttagaatttctggtaagaattctgagtcagaagggaaccctttagggcaagatactttcaaacctgccatagaagcaataagcttagacatgaaacaacaggagcttgatggcaggtgcattcaaatcaggaatttgcataaagtgtatggtactaaaaaaggagattgctgtgctgtaaactcattacagctgacactgtatgaaaatcagattcttgctcttctagggcataatggagctgggaaaagcacgacaatatcaatgcttgttggtcttcttcctcctacttctggggatgctttgatttttggaaagaacattgtttccgatattgatgagatacggaaggttttaggtgtctgcccacaacatgatatactatttcctgaattgactgtgagagagcatttagaactatttgccatattaaagggtgtgcagcaagacacactggaggacgttattattaatatggctgatgaggtgggcctggctgataaaatcaacacagttgtgaaatctctttctggtggcatgaaaaggaaattgtctcttggaattgcattggtcggaaacagtaaggttataattcttgatgagcctacaagtggaatggatccatactcaatgcgcttgacttggcagttaataaaaaaaattaagaagggcaggataattttgctaacaacacattctatggatgaagcagatgaactaggtgaccggatagctatcatggccaatggttctctgaaatgctgtggaagctcccttttcctgaagcatcactatggagttggttacactctaactcttgtaaagtccgctcctactgcttctatagctggtgatatagtataccggtatgttccaacggcaacctgtataagcgaggttggaactgagatttccttcagacttccaatggcatcctcttcaacctttgagaggatgttcagggaaattgaaggttgcatgaaaaagccggtttcaaacatggaaataagtggcagttgtgaaaaagacagtcacggtattgaaagctatggtatatctgtaacaaccctagaggaggtattcttgagagttgccggttgtgactatgatgaagttgagtgctttgaagaaaataacaattcccttatatcagattatgtggtttctcttccttctaatgattgtccatccactaaaacgtgttgtttgaatgtttttggaaattataagaatattcttggcttcatgtctaccatggtggggagagcttgtgatttaattcttgctacagttattagttttgttaactttgtaggcatgcaatgttgtagctgttgtctcattactaggtccactttttggcaacattctaaagctttagttattaagagggcgatatctgctcggagggatcacaaaacaattattttccagctaatgattcccgccctcttcttgtttattggtcttctatttctggagctcaagccacatcctgatcagatttcactgactctttcaacttcttatttcaatcctctattgagcggcggaggtgggggtggtccaattccgtttaatctatcctttccaattgctgaaaaggtagtgcaaaatgtcaaaggtggttggatacaaacgtgcaacccaagctcatacaaattccccaattcagaaaaggcattagctgatgcagtggaagcagcagggccaactctgggaccttctctactttcaatgagtgaatatttgatgtctagctttaatgagtcttaccaatctaggtatggggcaattgtgatggatgatcagaataccgatggaagcttaggctacactgttttacacaacttttcttgtcaacatgctgctcccacctttatcaatttgatgaattctgcaattcttaggcttactactcgtaacatcaatgcgacaattcagacacgcaactaccctctaccaatgacacgaagccagcacttacaacgtcatgacctggatgctttctctgctgctataattgtcaatatagccttctctttcatacctgcctcgtttgctgtttcaattgttaaggaacgtgaagtgaaagctaagcaccaacaactaatcagtggggtttccatcctttcatattgggcctctacatttatttgggactttgtgagcttcttgtttccagcctcgtttgccataattctcttctacatctttggtcttgatcagtttgttggaggagtttctttgttaccaacgatcatcatgcttttggagtatggacttgcaatcgcatcgtcaacttattgccttacatttttcttttttgaccatactgtggctcagaacgtggttctcctggtgcactttttttctggattgatactaatggttatctcatttgttatgggacttattccatccacaaaaagtgctaattattttcttaagaacattttcagaatatctcctggattttgttttgctgacggccttgcttcgttagctcttttacggcaaggaatgaaagataaaacaagtgatggagtgtatgactggaatgttacgggtgcctccatttgttatcttggtgttgagagcttgatttattttttattgacgctcgggcttgaattttttccttctctcaaattgacttcattcatgatcaagaagtggtgggggaaaattaatatcttcccaaataatatttcttatctggaacctctattagaaccttccccagaaactttcgttacggacgaagacgtagatgtgaaaacagaaagaaatagagtactttcaggttctgttgacaatgccattatctacttgcgcaatcttcgtaaggtgtattctgaagacaagaatcatgggaaaaaggttgcagtagattcattaaccttctctgttcaggaaggagaatgttttggcttcttaggaacaaatggagctggaaagaccacaacaatttctatgctatgcggggaggaatctccttctgatgggactgcttttatttttggcaaagatatatgttcccatcccaaggctgctcgtaaatatattggatattgtccacaatttgatgctctgttggaattcttaactgtcaaagagcatctggagctctatgctagaataaaaagtgttccagattacacgataaacaatgttgttatggaaaagttggtggagtttgacttattgaagcatgctaataaaccatcattttcacttagtggagggaataaaaggaaactctctgttgcaattgcaatgattggagatcctcctatagtcattcttgatgagccatccacaggaatggatcccattgccaaaaggttcatgtgggacgtaatatctagaatctcaactagacgaggaaagactgcagttattcttactacccatagcatgaatgaagctcaagccttatgtaccagaatagggattatggttggtgggcaactaagatgcattggaagtccacagcatctaaaaacaagatttggcaatcatctagaactagaggtaaaacctactgaagtgagctctgtggacttgaaaacactgtgccaagcaattcaggaaatactttttgatgtcccttctcaacctagaagcttacttaatgaccttgaaatttgcattgggggtgctgactctatcacctcgggaaatacctccgttgcagagattagcctgacacccgaaatgataggcttaattggacgctggcttggcaacgaagaaagagtgaagacactaatatgcagtacacctgactacgatggagcctctcaggaacagttatcagaacaattatttcgagatggtggtattccattgccagtattttctgagtggtggttgtccaaacaaaaattctccgaaattgactcatttattctctcttcatttcgtggagcaagatgccaggggcacaatggtttaagcatcagataccagttaccatatgatgaagagttttccctggcggatgtttttggacttctagaaggaaacagagaaaggttagggattgccgagtacagcatcagccaatcaactctggagacaatatttaaccattttgcagctaattattcatgaggtgcccttatttcatcatttttcattcataaaatgatgcatggaggttgcaatgtgttatagaatgtatcaaaatgataacattctcttgacttctactagtagtagagtccacgtagagccccgagagagattctaaggcattgtatattgtagagtaaattattattgtgccattgaattgtaaatagattcccagttataaatttttgcactaaaagggactaatttattaaatcttaactgcttcaccaactttttgagttgtttaggataatccattttaagattatcttcaatttttcttgctgttctgctccaatgcctgatggaggaaaggcagcagcaattttaacttttcttctttgtttggatggttttcgtttattgatcaaacggcccactgcattcatctacaataactgc

SEQ ID NO: 5744 - DNA, 1015 bp, Vigna unguiculata
aggcaaaaccctatccctaaaaaccctaatcctgaagcactgtaagtgtgtaatggcaagagccatttcctcatcctgcgcacgcttcaccatgcgtcttctctccaccagcaccttcaccgctgcattacccaaaccctcaacactttcactcccttcgcgtcgtttccttttccctctctcccatgccatcgttcctccctccactcgcgttgccgggatccgatgccgtgtcaaccgagctggcgactccgcctactcgcctctcaactccggatcttcgtccttcagcgatcgccctcccaccgagatggcgcctcttttccccggctgcgactacaaccactggctcattgtgatggacaagccaggtggcgagaatgccaacaagcagcagatgattgattgctacatccaaacccttgccaaggttttaggcagcgaagaggaagctaagaagaagatttacaatgtttcctgcgagaggtactttggtttcggctgtgagattgacgaggaaacctctaataagttagaagggttgcctggagttttgtttgtgctaccggattcgtatgtcgatccggaaaacaaggactatggcgctgaattatttgtaaatggagagatcgtccagagatcacctgaaaggcagagaagggtggagccacagccacagaggcatcaagacagaccaagatacaatgataggacaaggtatgtccgccgcagagagaacacgcagtgaaggaccaattggcgatcggagagggatgtaatgtgtatataaaaccattgaagtactataacatgcactgttttagtgatgcctttggagacattatattatattttctggtgttcctgaagacgttagtgcgcgaacttctcttggtgtattagatgaactcctcttgtgttacaaatttttactatgaacagaatttggaactcttttcaccttgttctgcccgacataaatgtgtcatatttggtttcaaaaaaaaaaaaaaaa

SEQ ID NO: 5745 - DNA, 1042 bp, Cajanus cajan
ggtgaataaaaagggtgggaagcagattagatatgcagagacaaaaaccctagcctttgaaaaccctaaatctgcgatagtgctactgtgatatggctagagccatttcctcctcttgcgcacgcctcacaatgcgtcttctcaccaccaccaccaccaccgccacgttactcagaccctcaacactctcatcgcgtcgcttccttttccccctgtcccatgccatcgtcgctccctccacccgtgtcgccggtatccggtgccgcgtgaaccgtgccggcgactcggcgtactcgccgctgaactcggggtcgtcgtcgttcagcgaccgtcctcccacggagatggcgcctctcttccccggctgcgactacaaccactggctcattgttatggataagcccggtggtgagggcgccaccaagcagcagatgattgattgttacgttgagacgctcgccaaagttcttggcagtgaagaggaagctaagaagaagatttataatgtttcctgtgagaggtacttcggattcggctgtgagattgatgaggagacttctaataagctcgaagggttgcctggggttctgtttgtgctacccgattcgtatgttgatcctgaaaacaaggactatggcgctgaattatttgtgaatggagaaatcgtccagagaccacctgaaagacagagaagggtggaaccacaaccacaaaggcatcaagacagaccaagatacaatgatagaacaaggtatgtccggcgccgagaaaacaatcagtgaaggaggaccaattggtgatagggagagtgatgtgatgtacatatattatggaacgttacgtgcaccatttcagtctttggagacattttatatttctggtgggagtggtaactatgattgtaagttgaacatgtatgtctgtatcagatggacccactttcttttgtttactataaaaaaacctagacccttcgcactttagatttatctcttatttggttttgatgtttgtatttcatatctctgcttttatttcaacg

SEQ ID NO: 5746 - DNA, 1089 bp, Glycine max
gtggataaaaagggtgggaatcggattaggttctgcgtgcacaggcgaaaaccctaatcctgaggcactgaaagtgtgatatggcaagagtcatttcctcttcctgcgcacgcctcgcaatgcgcctcttctccaccaccaccacagccaccgcgttcgccgtcactttacccaaaccctcatcactctccctctcatcgcgtcgattcctcttccctctatcccatgccatcgtccctccctccacccgcgtcgccggaatccggtgccgcgttaaccgcgccggagactcggcgtactcaccgctgaactcggggtcgtcgtcttcgtcgttcagcgaccgcccccccacggagatggcgccgctcttccccggctgcgactacaaccactggctcatcgtcatggagaatcccggtggtgagggcgccaacaagcagcagatgatcgattgctacatccaaaccctagccaaggttctcggcagtgaggaggaagctaagaagaagatttacaatgtttcctgtgagaggtactttggattcggctgcgagattgatgaagaaacttctaataagctcgaagggttgcctggtgttctgtttgtgctgccggattcgtatgttgatcctgagaacaaggactatggtgctgaattatttgtgaatggagagatcgtccagagatcacctgaaagacagagaagggtggaaccacagccacaaaggcatcaggacagaccacgatacaatgatagaacaaggtatgtccggcgcagagaaaacatgcagtgaaggaccaatttgagatagggagagggatgtgatgtacatacactatggaagtactttgttacatgcactattttagtcttgcctttggagacattccatatatttccggtggggtaactcaaatgtttgttgtcaaacttctatggctgtatcagatggacacctcttcgttatcatttttactataaacataatgttggactcttttcacgtcattttttccccaacaaagttgccataggtgatttggttctgatgtgtttcatatccgatttctctcaactggacatggaga

SEQ ID NO: 5747 - DNA, 1281 bp, Glycine max
gatgataacacatttgttattggatcaccgataacaaaagatggtgtatttattctaattttaaatttctgatattcgtggataaaaagggtgggaatcggattaggttctgcgtgcacaggcgaaaaccctaatcctgaggcactgaaagtgtgatatggcaagagtcatttcctcttcctgcgcacgcctcgcaatgcgcctcttctccaccaccaccacagccaccgcgttcgccgtcactttacccaaaccctcatcactctccctctcatcgcgtcgattcctcttccctctatcccatgccatcgtccctccctccacccgcgtcgccggaatccggtgccgcgttaaccgcgccggagactcggcgtactcaccgctgaactcggggtcgtcgtcttcgtcgttcagcgaccgcccccccacggagatggcgccgctcttccccggctgcgactacaaccactggctcatcgtcatggagaatcccggtggtgagggcgccaacaagcagcagatgatcgattgctacatccaaaccctagccaaggttctcggcagtgaggaggaagctaagaagaagatttacaatgtttcctgtgagaggtactttggattcggctgcgagattgatgaagaaacttctaataagctcgaagggttgcctggtgttctgtttgtgctgccggattcgtatgttgatcctgagaacaaggactatggtgctgaattatttgtgaatggagagatcgtccagagatcacctgaaagacagagaagggtggaaccacagccacaaaggcatcaggacagaccacgatacaatgatagaacaaggtatgtccggcgcagagaaaacatgcagtgaaggaccaatttgagatagggagagggatgtgatgtacatacactatggaagtactttgttacatgcactattttagtcttgcctttggagacattccatatatttccggtggggtaactcaaatgtttgttgtcaaacttctatggctgtatcagatggacacctcttcgttatcatttttactataaacataatgttggactcttttcacgtcattttttccccaacaaagttgccataggtgatttggttctgatgtgtttcatatccgatttctctcaactggacatggagaagagaattccaaaattgtatttataggttaggtttctcaacgccaacaaaatatcttacttataagttatacttaagcttagtcatgctttaatctacacccagaagcaagtcag

SEQ ID NO: 5748 - DNA, 1285 bp, Glycine max
gggtgggaatcggattaggttctgcacaggcaaaaaccctagccttcgaaaaccctaatcctgaggcactgtgatatggcaagagccgtttcctcttcctgcgcacgcctctcaatgcgcctcttctccaccaccaccaccgctgcgttcgccgtttcattacccaaaccctcgtcactctcagtctcaacgcgtcgattcctcttccctctctcccatgccatcgtccctccctccacccgcgtcgccggaatccggtgccgtgtcaaccgcgccggcgactcagcgtactcgccgctgaactcagcttcgtcatcgtcgtcgtcgttcagcgaccggcctcccacggagatggcgccgctctttcccggctgcgactacaaccactggctcatcgtcatggaccatcccggcggcgagggagccaccaagcaacagatgatcgattgctacatccaaaccctcgccaaggttctcggaagcgaggaggaagctaagaagaagatttacaatgtttcatgtgagaggtactttggtttcgggtgcgaaattgatgaagagacttctaataagctcgaagggttgcctggagttctgtttgtgctaccggattcgtatgttgatccagagaacaaggactatggcgctgaattatttgtgaatggagagatcgttcagagatcacctgaaagacagagaagggtggaaccacagccacaaaggcatcaagacagaccaagatacaatgatagaacaaggtatgtccggcgtcgagaaaacacgcagtgaagaaccaatttgtgacagggagagggatgtgttgtacatactctatgaaagtactttgttacatgcactattttagtcttgccttttgagacatttgatatatttctggtggggggtaactcaaataattgtagttgaacttctatggctgtatcagatggacatctcgttgttatcatgttcagtataaacataatcttttactcttttcacgtcattttctccccaacttatagttgccatgggtgatttggttctgatgtgtttcatatatgatttctctcaagtggacaaggagaggagaaatctaaaattgtatttagtgaacatgatgttggattgtctgacattgaaaataggttgcctgggcattgtttctggtattgcgaacgatgttggattcagattgtctgcggcaaaaggcttactgcaacactcaaaacctaacattgttttctgcttcaggaaagacgacaaaaaagaatgttatgaagcc

SEQ ID NO: 5749 - DNA, 1156 bp, Glycine max
ttgattttaaatttatgatattggtggataaaaagggtgggaatcggattaggttctgcacaggcaaaaaccctagccttcgaaaaccctaatcctgaggcactgtgatatggcaagagccgtttcctcttcctgcgcgcgcctcacaatgcgcctcttctccaccaccaccaccaccaccaccaccaccgctgcgttcgccgttacattacccaaaccctcgtcactctcagtctcaacgcgtcgattcctcttccctctctcccatgccatcgtccctccctccacccgcgtcgccggaatccggtgccgtgtcaaccgcgccggcgactcagcgtactcgccgctgaactcagcttcgtcatcgtcgtcgtcgttcagcgaccggcctcccacggagatggcgccgctctttcccggctgcgactacaaccactggctcatcgtcatggaccatcccggcggcgagggagccaccaagcaacagatgatcgattgctacatccaaaccctcgccaaggttctcggaagcgaggaggaagctaagaagaagatttacaatgtttcatgtgagaggtactttggtttcgggtgcgaaattgatgaagagacttctaataagctcgaagggttgcctggagttctgtttgtgctaccggattcgtatgttgatccagagaacaaggactatggcgctgaattatttgtgaatggagagatcgttcagagatcacctgaaagacagagaagggtggaaccacagccacaaaggcatcaagacagaccaagatacaatgatagaacaaggtatgtccggcgtcgagaaaacacgcagtgaagaaccaatttgtgacagggagagggatgtgttgtacatactctatgaaagtactttgttacatgcactattttagtcttgccttttgagacatttgatatatttctggtggggggtaactcaaataattgtagttgaacttctatggctgtatcagatggacatctcgttgttatcatgttcagtataaacataatcttttactcttttcacgtcattttctccccaacttatagttgccatgggtgatttggttctgatgtgtttcatatatgatttctctcaagtggacaaggagaggagaaatctaaaattgta

SEQ ID NO: 5750 - DNA, 1217 bp, Lupinus angustifolius
ttgagaaatggaatatgttttcatcgatacccaaacaccatagaaaataaaccctactcttcaaaaaccctgagcctccatatccacccacactcaaacttcactcacctcttcttcttcaatccataaccaaaatggcgtcaagatctctctggtcttcatcctctgcacgcctctccacactccttaccacgcgcgtcttttcttccaccaccaccaccgccgccaccgcctcaatcaccaaaccaccttcactcacatctctaatcctcccccgccgtcgacccctcctccctctctcaaacgccaccatcttcccacaaacaacccggttcggtggaattaggtgccgagtgaaccgagccggtgactcggcctactcaccgatcaactccggttcgtcattcagtgaccgaccacccactgagatggcaccactcttcccaggatgcgattatcaacactggctcatcgtaatggacaagcccggtggtgaaggtgccaataagcaacaaatgattgattgctatgtccaaaccctagctaaagttcttggcagtgaagaggaagccacaaagaagatttacaatgtatcgtgtgagaggtactttggatttgggtgtgagattgatgaagagacatctaataagctcgaagggttgcctggagttctgtttgtcctcccagattcatatgttgatcctgaatacaaggactatggtgccgaattatttgtaaatggagagatcgtgcagaggccacctgagagacagaggagggtggagccacagccacaaaggcatcaagatagaccaagatacaatgatagaacaaggtatgttcgacgcagagaaaacatgcgttgaaggactaatgtgcgatgagagggttgatatatgtacatactatggatttgaacctgcatcagatggatggactcctctttgttatcatttttctcatgactaaaaacttgataattaatgttatggtcttacgctgctacttggactttgtacttcgttttctttggggtgaaaaagtatcagtttctactgggtgatattgtgttagatacttctatttcatgcatgattttgttgaaagataaggataaaaatatttcgaagttgtttgattggttagtctgatctattgtgtgtttaacatataactgaaaattggattatgattataatcaatagtaatctggttat

SEQ ID NO: 5751 - DNA, 1221 bp, Lupinus angustifolius
aaacaccatataaagtaaaccctactcttcaaaaaccgtcaaccccacactaacccttcactcctcacccaatccacaaaccataatggcaacaacaacaaaaatactctggccttgttcctctacacgtctctccacactccttaccatgcgcctcttctccaccacaaccaccgccacctctatcatcaaaccaccgccactcccatttctcagcctccccatccgtcgatccctcctccctctctccaatgccaccacccggttcggtggaataaggtgcagagtgaaccgagccggtgactcggcctattcaccactcaactccggttcatcgttcagtgatagaccaccaactgaaatggccccactatttccaggttgtgattatcagcattggctcattgttatggataagcctggtggtgaaggtgccactaagcagcaaatgattgattgctatattcaaaccctagctaaagttcttggcagtgaagaggaagccataaagaagatttacaatgtatcatgtgagaggtactttggatttgggtgtgagattgacgaggagacatctaataagctggaagggttgcctggagttctctttgtcctcccggattcatatgtcgatcctgaatacaaggactatggtgctgaattatttgtaaacggagagatcgtgcagaggtcacctgagagacagaggagggttgagccacagccacaaaggcatcaagacagaccaagatacaacgaccgaacaaggtatgtccgtcgcagagaaaacacgcgttgaagaacctccaatttgtaataagcagagatgctatgtacatactatccaagtgttacattatgtgctattttactctttcctgtggagacattcatttgaagttctggttggtgtggtaactgaagatatttgtcctttgaacctgaatcagatggtctcttctttgttatcattttcccattaacagaatcttggtgatgaatgttttgttcttttgctgccactcaaaaaatatatgatgctatcagcatcgggtgttattgagtttaatgcttctatttcatatctgattttgcctaaagattaggacaaaaatattccaaaattgtgtttaatagtaaattatgattataattgattattagctgtttgaatctgtttattaactaatatgtttgttgaaaagtaatctcattagtatt

SEQ ID NO: 5752 - DNA, 1812 bp, Glycine max
caaaggtgtagactgttccaccgaactgctctctctcgttctccgctgttgtctcgtaaaccctgaacccaaagggtcgtttgtagcttcttcctccgtaagcctaccgagttcgccacccggaacccacaactgagtcgtgactcggttctttcacactgagccatgcaagttttctctaacgctcggcaagcctctcggcttctcctctcgcctcatctccgaagctcggaagctcctcactccaccgcgctctctctcttctcagggctcacgcaacgtgattcccggccagtgaacactgatccaatacaatgcttcttgtcgaaggctttttactcttccggagtgggtaccgttgaagcaactccatcagaggatgtgaaggaattatacgacaaaatgcttgactctgtaaaagttaaacgatcaatgcctccaaatgcttggttgtggtcaatgattgcaaattgcaaacaccagcccgatattagacttctcttcgacattttgcagaacctccgcagatttagattgtcgaatcttcgaattcatgacaattttaattgcaatctctgtcgagaagttgctaaggcatgtgttcatgcaggagctcttgattttggaatgaaggctttgtggaagcataatgtctatggactgactccaaatattgcatctgctcaccatttactgacgaatgctaagaaccacaatgatactaaactgttggtggaagtaatgaagcttctgaagaagaatgatttaccattgcaaccaggcacagcagatatagttttcagcatttgttataatacagatgattgggagttgattaataagtatgcaaaaagatttgtcatggctggcgtaaaactacgacaaacctcattggaaacatggatggaatttgctgccaaaagaggagacattcactcattgtggaaaatagaaaagttgagatccaattcaatgaagcagcacactttgataactgggttttcttgtgtcaagggtcttctgttggaacgtaaacccagtgatgcagttgctgtcattcaagttctaaatcagaccttgtctgatacaaagaagtcaggcatcaagggtgaacttcagaagcttgtatctgagtggcctttggaagttattaagcaccaaaaagaagaggacagaaaggcattagcagcctctttgaaatctgatatccttgtcatggttagtgagctactgagcatgggtcttgaggcaaatgtaagtttggaagacctggacagaaaggaagatattccacaatagcatggaactcagaatttgatgacattgtgtttcagaatgtgcttgtttgtggagtatctacttaccaggatgcttcctagccctggttagatactgagtctgcgaacatagcaaacgttgattactaaattaaaattattattttgcttcactttttaccatttcttattttccgtacaacaagtggttacggttttggttgcatagtagtggtatatcagtagattatgttggaacaaaaataatctggcatatgtcctctactctgaactgcaagaaattgctttcacaagtgagagatacaatcatggctttttaatctctagttctagttcaagttcaagtggaccctaccacaaaggaatgctaaggcctaagagttgcaatttgtgtcatctggtgtaacattgaattgttctacttgaagtcttgaaagaaagtgttttatattcacggattgtcggcaatatgggttaacttgtttatttaaatgcaaaatgaatgtgtgcgtag

SEQ ID NO: 5753 - DNA, 1009 bp, Vigna unguiculata
ggactccatctcttcatcctttgcttattcatattcttttcccaccgttattgttttcgtccctcgctcataacattcgaccatgtcgcagttgaacggagcctactacggccccgctattccgccgcagaagtcctacaaccgcccagggcgcggcggcgggcttggctgctgctgcggctgcctcttcagctgcatcttcagcctcatcttcaaggtgattttcacgctgatcatcatcgtggccatcgccgtgttcatcttctggctcatagtccgtcccaacatggtgaaattccacgtcactgacgccaccctcacggagttcaactactccaacaacaccctccactacgatcttgccctgaacatcacagtgcgcaaccctaacaagaggctgggtatctactacgacttcatcgaggcgcgtgcattgttccacgacgccaggttcaactcccagtaccccaatcccttctaccaggggcacaagaccacgaacgtgctgaaccccgtcttcaaggggaaccaagtgatggctttggacgctgaccagagcgccgaattgagcaaggagaactccaccgggttgtatgagatcgatgtgaagatgtacctgagggtgaggttcaagttgggcgctttcaagaccaagacactcaagcccaaagttagctgcgacttgcgcgtgcctttcaagggaaccgccaccgcctttcaaaccaccaagtgcgactgggatcgctgatcgattcgggttcttacacccacccgacccgacccgacctgtttttacgtcatttgtggctttttcatatatttttttatttgttagttttggacacagtcgtacctcttgtacttgagttcagagatactattattattatactgcatgtatacttcattgtatgtatctgtatcctctacctccgttcggccgaggggatttttggtttattctttattcacacttatgttatatgttaataaataaatttctattttc

SEQ ID NO: 5754 - DNA, 1249 bp, Glycine max
caatgtttggtggccggttaagtttgatgtttgtagattatcacgcgctttttctaactcccctaccccagagttggctataaaaccaaacccacagacacaaggagcttcaagtcttgttccattgattccatctctcacatcatttcccactctcgcgtttcctttatcatatttatattctttggttattcaattcatattacgccatgtcccagttgaacggagcctactacggcccctccatcccgccgccgaaaacttcctaccaccgtcctgggcgcggcggaggcctcggctgctgctgcgggtgcctcttcagcctcatcttcaagctcatcctaaccgtgatcatcatcattggcatcgccgtgttccttttctggctcatagtccgtcccaacgtggtgaaattccacgtcaccgaggccaccctgacgcagttcaactacacccccaacaacacgctccactacgacctcgccctcaacatcacggtccgaaaccccaacaagaggctcggaatctactacgaccgcatcgaggcgcgtgcaatgttccacgacgcgaggtttgattcccagttcccggaaccattctaccagggccacaagagcaccaacgtgctgaacccggtgtttaagggtcagcaattggtgccactcaacgctgaccaatccgcggaactgaagaaggagaacgccactggggtgtacgagatcgatgtgaagatgtaccttagggtcaggttcaagttgggtgtcttcaagaccaagacgcttaagcccaaagtatcatgcgacttacgtgttcctttgaaaggaagcgccggtgctggtgtctttcagaccaccaagtgcgactgggatcgctgatggattcggattcacccgacccgacccgacccggttctgctttcacgtcatttctcccttttcttatttctttattggttagttttggacatagtcgtcgtactccttgtccttcagggttactgttcagagatatgattattttattataccgcatgtatgtatgcatgcatcatctaccttgactactgtattcccttctgtggacgggatttttgctgtattatttatatcacacattcacacttgttatttgttgataaataaatttcattttcattccgcttcttcaatacccttgtaacttgttccgtttctcaagttgccagcttgcgacgtaatataaatttacctcctgattacgcgtgctcaaa

SEQ ID NO: 5755 - DNA, 1246 bp, Glycine max
caatgtttggtggccggttaagtttgatgtttgtagattatcacgcgctttttctaactcccctaccccagagttggctataaaaccaaacccacagacacaaggagcttcaagtcttgttccattgattccatctctcacatcatttcccactctcgcgtttcctttatcatatttatattctttggttattcaattcatattacgccatgtcccagttgaacggagcctactacggcccctccatcccgccgccgaaaacttcctaccaccgtcctgggcgcggcggaggcctcggctgctgctgcgggtgcctcttcagcctcatcttcaagctcatcctaaccgtgatcatcatcattggcatcgccgtgttccttttctggctcatagtccgtcccaacgtggtgaaattccacgtcaccgaggccaccctgacgcagttcaactacacccccaacaacacgctccactacgacctcgccctcaacatcacggtccgaaaccccaacaagaggctcggaatctactacgaccgcatcgaggcgcgtgcaatgttccacgacgcgaggtttgattcccagttcccggaaccattctaccagggccacaagagcaccaacgtgctgaacccggtgtttaagggtcagcaattggtgccactcaacgctgaccaatccgcggaactgaagaaggagaacgccactggggtgtacgagatcgatgtgaagatgtaccttagggtcaggttcaagttgggtgtcttcaagaccaagacgcttaagcccaaagtatcatgcgacttacgtgttcctttgaaaggaagcgccggtgctggtgtctttcagaccaccaagtgcgactgggatcgctgatggattcggattcacccgacccgacccgacccggttctgctttcacgtcatttctcccttttcttatttctttattggttagttttggacatagtcgtcgtactccttgtccttcagggttactgttcagagatatgattattttattataccgcatgtatgtatgcatgcatcatctaccttgactactgtattcccttctgtggacgggatttttgctgtattatttatatcacacattcacacttgttatttgttgataaataaatttcattttcattccgcttcttcaatacccttgtaacttgttccgtttctcaagttgccagcttgcgacgtaatataaatttacctcctgattacgcgtgctc

SEQ ID NO: 5756 - DNA, 1155 bp, Glycine max
atgtttggtggccggttaagtttgttgtttgtagattatatgacgcgctttttccaactcccctaccccacagttggttatataaccaaaccacagacacaaggaacttcaagtcttccattgattccatctctcacatcatttcccactcccgcgtttcctttatcatattcttattccgccatgtcccagttgaacggagcctactatggcccctccatcccgccgccgaaaacctcctaccaccgcccagggcgcggcggaggctgctgctgcggctgcctcttcagcctcatcttcaagctcatcttaaccgtgataatcatcgttggcatcgccgggttcgtgttctggctcatagtccgtccgaacgtggtgaaattccacgtgaccgacgccaccctgacgcagttcaactacaccgccaacaacactctccactacgacctcgccctaaacatcacggtccgaaaccccaacaagaggctcggaatctactacgaccgcatcgaggcgcgtgcaatgttccacgacgcaaggttcgattcacagttcccggagccgttctaccagggccacaagagcacgaaggtgctgaacccagtcttcaagggtcagcaagtggtgccactcaacgctgagcaaagcgcggaactgaagaaggagaacgccactggggtgtacgagatcgacgtgaagatgtaccttagggtgaggttcaagctgggggtgttgaagaccaagacgctcaagcccaaagtatcatgcgacttgcgtgttcctttcaaaggaagcgccgcctttgagaccaccaagtgccactgggatcgctgatggattcgcatctgttttcactcatttcttccttttcatatttctttattgattggttacttttggacataggtccttcagggttatcccttcgctcgaggggatttttgctccattctttatcctttatatcacactcttgtcgttatttgttaataaatcaattttattttcattccccttcttcaattcccttgtttcgccgtttctcaagttgccaacttgcgccgtaatataaatttacctctggattacgcgtgcccaaacacaaaacgtaatgcagtacatgacttataagataaatactatccaatccttaag

SEQ ID NO: 5757 - DNA, 1162 bp, Glycine max
tgcaccaatgtttggtggccggttaagtttgttgtttgtagattatatgacgcgctttttccaactcccctaccccacagttggttatataaccaaaccacagacacaaggaacttcaagtcttccattgattccatctctcacatcatttcccactcccgcgtttcctttatcatattcttattccgccatgtcccagttgaacggagcctactatggcccctccatcccgccgccgaaaacctcctaccaccgcccagggcgcggcggaggctgctgctgcggctgcctcttcagcctcatcttcaagctcatcttaaccgtgataatcatcgttggcatcgccgggttcgtgttctggctcatagtccgtccgaacgtggtgaaattccacgtgaccgacgccaccctgacgcagttcaactacaccgccaacaacactctccactacgacctcgccctaaacatcacggtccgaaaccccaacaagaggctcggaatctactacgaccgcatcgaggcgcgtgcaatgttccacgacgcaaggttcgattcacagttcccggagccgttctaccagggccacaagagcacgaaggtgctgaacccagtcttcaagggtcagcaagtggtgccactcaacgctgagcaaagcgcggaactgaagaaggagaacgccactggggtgtacgagatcgacgtgaagatgtaccttagggtgaggttcaagctgggggtgttgaagaccaagacgctcaagcccaaagtatcatgcgacttgcgtgttcctttcaaaggaagcgccgcctttgagaccaccaagtgccactgggatcgctgatggattcgcatctgttttcactcatttcttccttttcatatttctttattgattggttacttttggacataggtccttcagggttatcccttcgctcgaggggatttttgctccattctttatactttatatcacactcttgtcgttatttgttaataaatcaattttattttcattccccttcttcaattcccttgtttcgccgtttctcaagttgccaacttgcgccgtaatataaatttacctctggattacgcgtgcccaaacacaaaacgtaatgcagtacatgacttataagataaatactatccaatccttaag

SEQ ID NO: 5758 - DNA, 1324 bp, Vigna unguiculata
gaaagagaggagtgaggaaaaagggtgaaagaaacaaagggggcagcaaaaagtagcacctcccctaagcttatcccagcgccagacaccaccctcttccggtagtttcagcccactgactgtgacagtaacaccaatgggggaggagggaaagaaaccggaggaacccaaggtggaggagaagaagccagaagaagccgagaagaaacaagaggagaagaaggaagaaacagcggaaaaaccagcaggggagaaaaaaccagaagcgactcctccaccgccaccgccaccgcccgagattgtgctcaaagtgttcatgcattgcgagggttgcgctcggaaggttcatcgctccctcaaaggattcccaggtgtcgaagaagtgctcaccgactgcaaatctcacaaggtggttatcaagggagagaaagcggatcctctgaaggttttggagagaatacagaggaagagtcacagaaaggtggagcttctctctccgatcccgaaacctccagaggagaaggtcccggaagaagaaaaaccaaagcccaagctcgaagagaaagtacaagagccaccgattgtgacggttctgaaagttcacatgcattgcgaggcttgttcactggaaatcaagagacgcatccagagaatgaagggggtggaatcagctgaacccgatctgaagaagtcagtggtgagtgtgaagggcgtgtacgatccagagaagttggttgagtacgtgtacaagagaactgggaagcacgcagtgatcgtgaagccggaggcagaaaagaaagaggagaaggtggaggaagcaaaagaggagaaaaaggaggaggttgagaaagagaagaagaagagtggtgaaggagaagaaaacaaggaaaagaaagaggaagaagcaaagggtgagacgaaggcagaggaaacagcagtagtagcagcagctgcaacatctagtgaagagagcaacaaggttgttccagaggtgaagattaatgaatacttctataacccaccaaggtatggcatggaggtgtatgcatatcctgcacaccctgtacaaccagcataccctgcatatttccatgcctaccctccccagatattcagcgatgagaacccaaatgcctgcactgtcatgtaaaaacggaaggggtcaagggtgaaatgggaaaattctcaactatgggtgcctcataatatagattataccctttcctgggttacttatgcgctgttgtactattcctgctgaaagtacactgtatgcataaactatagaattttcaatttcctaagactttatgtttaagtacaa

SEQ ID NO: 5759 - DNA, 1496 bp, Cajanus cajan
tagttaaacttttttctttgacaagatttcaattgaactttgaaaataggaatagatgaattcactggaaaataaattttacaaaattaatttggttaaaaatgaattttacggagacagccatgacgctaaggcttcaatgaggtttggcaaacggttggagtgaagggtgaagcatcttctaggattaggaataggatggccatcgatagcgtttatgcttcgtctccaccgtttcagaccggaccatccggccacccgcgccatttctacctcgccgtcgatcgccttcagttcaaaatgcaaacggtggttgaactcgtggatctggtggctcgacgtccatgcttgccgatcgtcgtctgttgcagcacgcgcgacgacctcgactctctctgctcctccctctccgctctccccttcctttcctcctccgctttgtacagtgacctcgccgaagatgaacgcgctttcgtattggagaagtttcgacaggtaaccgcgaggtggaatcagatgaatcacggtggagcaccaaacgaggacgaggcaggcaaagatgagagatctcatatgatcattgtaaccgacgcttgcctccctctccttgcttccggagaacttcctctgaacgctcatcttctcatcaactatgaattaccggcaaagaaggagacatacggaaggcgattggcaacttgtttaacagctgatggatttgtcattaatatggttgttggtggggaagtggtaactctaaaaagtattgaagaaagcagcaatattgtcatgcaagagatgcctatgcaaattcttgacattttatgaagatgtttagtctttgctgtctcttgaagaaagcaaagaatttgatcgcttgcatccatagatggttgtagacttgaagccctctcatcattcctttgaatattctgtgagtactgctataaagaaaatatactgccaagttttttttttttttaaattgttatttttgcacttgtagatttttatgttggattacatcttctattggttgtttaaaattaaaatacagaaatttggttggaatgacaaacttcttggtatttattttttgggaaggtaagggtcatatattattgtaaaagggtatttgattgtaggaagcaattgagggccaaatttctctttccgagtctatgaaaagattaacgggaacaactttagtaattgtgtttttgggagaaatttaaaaatgagatgtaatgccaaactcaaagtaaaatttaaaaggaaacttctcatgtatctactaagcattttttgtggttgatgattgtactacatggtataatacgcgttggatgcataattagttagtgtttttattttttccataagttgatgttgttaagtaatttgttagaaggattgaagttgaataatggtttttaatctttgacagggaaatattaagatttagtatgaatgagatataagtattttttgaagca

SEQ ID NO: 5760 - DNA, 1992 bp, Glycine max
tatgccgcagagggaattaggcacgagtttgacccccttgaggccagtgaagcatctcctcgcctctcctcctccaggatggccatcgacagcgtttatacttcgtctccaccgtttcagagcggaccatccggccactcgcgccatttctaccttgcagtcgacaggctccacttcaaaatgcaaacggtgattgaactcgtggatctggtggctcgacgtccatgcttgcccatcgtggtctgctgcagcacgcgcgacgacctcgactctctctgctcctctctctccactctccccttcctttcctcttctgctctgtacagtgaccttggcgaagatgaacgctcttttattttagagaaattccgacaggtgacggcacggtggaaccagacgaatcacggtggagcaccgaatgaggatgagattgggaaagatgagagatctcacatgatcattgtaacagacgcttgtcttcctctccttgcttctggagaatttcctttgaacgctcatcttctcattaactatgagttaccagcaaagaaggagacatatggaaggcgtttggcaacttgtttaacagctgatggaattgttattaatatggttgttggtggggaagtcgtaactctaaaaagtatagaagaaagcagcaatattgtcatgcaagaaatgcctatgcaaattcttgacattttatgaagacaatatcactgcttgcatttgtgaatggctgaacacttgaagctctctcactcctttgaatattctgtgagtagtcactgctacaaagaaaataaactgctaagctttttattactattttggacgtgtagatttttttgctggattacatcttttattggttgtttcaaactagaatacagaaatttgctagaaaagacaaacttattggtcttctctttcttttgaaagtgagtcatatattgttcaacattgaaagagggtattccgaatttctctctctctatctctaagaaaagattaatgggaacaacttttgtaattatgtttttaaggagaaatttaaaagtgaattggaatgccaagcatatggtgaaatttaaaaggaaacttctcatgtatcaactaacattgacatgtaaactttgtcaaggcaaaatttactggttaaaatgtcctgaaaggctgaaatctgacagtgacatttcttagttggcatgttttgccaaaaaatagcattaaggggcctgaaatctggggccttatgtttttgcctgaccattgcctgggagaaacactgaagcaatggaagtgctgaagctgatttaacaagtgcagtgaacactgaataaagttttcgttgagatcaccctttctatgagctactaccctagctcttgcatgggaggggttgtttggcagtcgaaaaaaaatgttgtgtatttacgttaggtttactatgagtcaatagtgaatcgtgtgcgggaagatacaacttctggatggcaacttctgtgtgattttcaatgaggcttccatgaatttagacaatctcgtgctgactgcatgaaaattcttgctgtgggctacttgcttgtggctagcatgtgcgttttttagtctgggctcttgggtcctttggaccccatgtaagccaaaatagggctactgcatcctgcactctcactattgcatcttgcttctcccattttattccggaatgcaaattaccattatggaattttggaatgggctttccggaatacaatgggaggtacaagatgctatagtagaaatgcaggaatcaaatggcccaaaatagaaaggaaagtgaacggcaaaacatttttttttgctgaattgaatgtcaaaacagagaaacagatgaggacttttttaatttcaatattttattttattttataaatgatattctcaccgtcagaaatggaaccggatgtaattgcatttttttttgctgaattgaatgtcaaaacagag

SEQ ID NO: 5761 - DNA, 1935 bp, Glycine max
tatgccgcagagggaattaggcacgagtttgacccccttgaggccagtgaagcatctcctcgcctctcctcctccaggatggccatcgacagcgtttatacttcgtctccaccgtttcagagcggaccatccggccactcgcgccatttctaccttgcagtcgacaggctccacttcaaaatgcaaacggtgattgaactcgtggatctggtggctcgacgtccatgcttgcccatcgtggtctgctgcagcacgcgcgacgacctcgactctctctgctcctctctctccactctccccttcctttcctcttctgctctgtacagtgaccttggcgaagatgaacgctcttttattttagagaaattccgacaggtgacggcacggtggaaccagacgaatcacggtggagcaccgaatgaggatgagattgggaaagatgagagatctcacatgatcattgtaacagacgcttgtcttcctctccttgcttctggagaatttcctttgaacgctcatcttctcattaactatgagttaccagcaaagaaggagacatatggaaggcgtttggcaacttgtttaacagctgatggaattgttattaatatggttgttggtggggaagtcgtaactctaaaaagtatagaagaaagcagcaatattgtcatgcaagaaatgcctatgcaaattcttgacattttatgaagacaatatcactgcttgcatttgtgaatggctgaacacttgaagctctctcactcctttgaatattctgtgagtagtcactgctacaaagaaaataaactgctaagctttttattactattttggacgtgtagatttttttgctggattacatcttttattggttgtttcaaactagaatacagaaatttgctagaaaagacaaacttattggtcttctctttcttttgaaagtgagtcatatattgttcaacattgaaagagggtattccgaatttctctctctctatctctaagaaaagattaatgggaacaacttttgtaattatgtttttaaggagaaatttaaaagtgaattggaatgccaagcatatggtgaaatttaaaaggaaacttctcatgtatcaactaacattgacatgtaaactttgtcaaggcaaaatttactggttaaaatgttctgaaaggctgaaatctgacagtgacatttcttagttggcatgttttgccaaaaaatagcattaaggggcctgaaatctggggccttatgtttttgcctgaccattgcctgggagaaacactgaagcaatggaagtgctgaagcagatttaacaagtgcagtgaacactgaatacagttttcgttgagatcaccctttctatgagctactaccctagctcttgcatgggaggggttgtttggcagtcgaaaaaaaatgttgtgtatttacgttaggtttactatgagtcaatagtgaatcgtgtgcgggaagatacaacttctggatggcaacttctgtgtgattttcaatgaggcttccatgaatttagacaatctcgtgctgactgcatgaaaattcttgctgtgggctacttgcttgtggctagcatgtgcgttttttagtctgggctcttgggtcctttggaccccatgtaagccaaaatagggctactgcatcctgcactctcactattgcatcttgcttctcccattttattccggaatgcaaattaccattatggaattttggaatgggctttccggaatacaatgggaggtacaagatgctatagtagaaatgcaggaatcaaatggcccaaaatagaaaggaaagtgaacggcaaaacatttttttttgctgaattgaatgtcaaaacagagaaacagatgaggacttttttaatttcaatattttattttattttataaatgatattctcaccgtca

SEQ ID NO: 5762 - DNA, 946 bp, Vigna unguiculata
ggtggaagagaaagagagtccacggtgaagcagcatctcctctcctctaccctggcgatggacagcgtttacggttcgtctccgccgtttaagggcggaccgttcggccacccgcgtcatttttacctcgccgttgacaggctcaacttcaaaatgcaaacggtaatcgaactcgtggatctgatcgctcgacgtccatccttgccaatcgtggtctgttgcagcacgcgcgacgatctcgactctctctgctcctctctctccactctcccctttgtttcctcctctgctctgtacagtgatctcgctgaagatgaacgcgcttttcttttagagaaatttcaacaggtaacagcacggtggaaccagtcgaatcagggtggagcgccaagcgaggatgagattgggaaagacgagaagtctcatatgatcattgtaacagactcctgcctccctctcctttcttctggcgaacttcccctgaatgctcatcttctcattaactacgagttaccggcaaagaaggagacatacgctaggcgattggcagcttgtttaacatccgatgggattgttattaatatggtggttgggggggaagtggtgactctgaaaagtatcgaagagagcagcaatattgtcatgcaagagatgcctatgcgaattcttgacgttttatgaagatcttcagtctttgctctttctcgaagaaagcaaaatttgatcgcttgcattcatgaatgtttgaagacatgaggcttgctcatttcttcgaatattatgggagtggtcactagccagtgcagcaaaaaaatactgattttttattactattttggatttgtagattttcattctagattacatcttttattggatgtttaaaattataacacagaaatttggtagaaatgacaaacttcttattcttctcaaaaaaaaaaaa

SEQ ID NO: 5763 - DNA, 1691 bp, Glycine max
atgtcatgtgtgaacacactcaattctttattaatgagactaatgacagattttttgagcataatcacaaatactcttacctgcacattacctatcaaaagatccaaataatcaatactcttgatgacccttgattcctccaccagcttttctctttgagtaacttttcaacaaccaaatttctacactaggtcaagctaactcttattctgctttatcaagtaaattttctaccacagggaaggtcacttttttgttctgtttagcacccccatccattccctaaacaccagaaaaaaaaaatggtaaaaactaggcaccatatcttccttcaccatgtgtttggtatggtctaggccaaaaagaaaaatggggcatcataaattgaaccagtgtccttatatgatcagaattaaggtagtctcctcaattcatttttatcatatcagatcctttctagggacgggaaaactgttacttcttcctagacacaataaaggagcgctcaaaaccacattttttttcttctttgcatttaccaatccttaaatgctgaaccagaggtcagagcagacccatttaatggccttgtacgcataggtggaagtgccttttttatctacctatacactttctctagtctgtcctagaaaccttaagttttcactacttggcacgctgtgcagcattgcagctaattaagcaccaccatcactatcttataagggggggaaataacaacttgtgttgtgtctatatataataagtagtgagggggttaaggttggtgttctcatccatagttctcactggttttctctctaggtggatttgaggaactcttttatattgaactgtgtttcttgtttctgagtgctgattttggaggagaaatgagtagttatttgggtgtaggtgttagtcctgggaatgtcccagtttaccacagcacaaatgtgaaagtgttagataggaagatcaagataacagaattggtgttgaggtgtgtgatccttggtttaggggttcttgcagctgttcttgtggggactgattccgaagtcaaggagtttttctcatttcagaaggaagctaaatttacagacatgaagtctttggtgttcctggtggttgcaaatgggttagctgctggctactccttaatccaagggttgcgctgtatccttagtatgatcaggggaagagtactcttcagcaagcccctagcttgggccattttttctggtgatcaggtaatggcctatgtaacagtggtggcattggcggcggcagggcaatcgggtatgattgcaagggttggccagccagaactgcaatggatgaagatatgcaacatgtatgggaaattctgcaaccaagtgggagaagggatagctagtgcttttgtggctagccttagcatggtggtcatgtcttgtatttctgctttcagcctcttccgtttgtatggtggtaacaaaaccaaaaatgtgcattggtaggttagaaactactaccagtggttcaaggttcttcttgtatatgtagtagtgaatgattatggtaatatctattgcaatgatcacttaataattgatggcagtaatataaagtttaggttctttgataaatttagccacttttgcatatccttacatcccgtatggctaaggctaagtttgtgaatctgt

SEQ ID NO: 5764 - DNA, 1269 bp, Vigna unguiculata
ggggctttgactgtatctttgtgaccacattgagaacaaatctgacgatgaagtgtgtagccttgctgtcagtggtagcgtgcgccttcgcggcggcgatttgggctgcgaacggcgatgacagcctggtcccgccgcgcagggaagtatacggcaatggccgaatattcgacatcagtcatcggtaccaccccgagatgccggaatttgactcgaaggatggtatagggcagttcctgtggcttccgaagagcatgaagaacggctccatcgctaacaactccgaaatgaagctcccaacccacaccggcacgcgcgtagactctcccggccacgtcttcgaccactacttcgacgctggctttgacgtcgatacgctcgacttggacatcctcaacggacctgctctgttagtcgatgttccaagagatagtaatataactgctgaagttatgaagtcgttacatattccaagaggtgtaatacgtgttctcttccgaacgttaaattcagacaggcggcttatgtttcagaaggaatttgacgcaagctatgtaggattcacagtggatggagccaaatggcttgtggagaacactgatatcaaacttgtaggaattgattacctatctgttgcttcttatgattacttgattccatctcaccttgtttttttaaaagaccgggaagtcattcttgttgagggcttgaagcttgatgatgttcctgcgggattttattcagtgcattgcttacctcttaggttgtctggtgccgagggatctccaattcggtgcattctgattaagaattaaggaaacagcgttgtctcaagtgcagggggaggtgcaaatcatcaggggtttatcatgtgaaatgtgaggggatgcaacaatcttagcgttatgttgaatttggtgttcttttgtctgttacgctggaactgataaattcacagtggtgcggttatggagcaagatagtaatgaacgtgttgtgcatcgagttttgtggcttaggttcacagttactagatacacgcataagacgttatatttagataatggcattatgcttaattttgttttctcttgtcccgtatgttggaacagaataaattggcacagtggtgtgtatctttatatatcaagatggtagcaataatatttttgatctctagggactaatgtgtaaacttgtaaccacggacaagcactgcaatttgacagatctttttgaaaaagaaaagaaaagatcatttacgcagagc

SEQ ID NO: 5765 - DNA, 1717 bp, Glycine max
cttacgtgtccaaattattgggtggacgaaaatatctcgttcatggtaacgataacgaggaatggactgtacggactgatgctgttctgttggtgacgattgtatccacattgagacgaaatctgacgatgaaacgtggagcattattgtcagtgcttgcgttcgccttcgcggcggcgatctgggcggcgaacggcaacgacaacctcgtcccgcctaggcgggaagtgtacggcaatggccgaatattcgacatcagtcaccggtaccaacccgagatgccggaatgggaatcgaataacggcattgggcagttcctgtggcttcccaagagcatgaagaacggttccctcgccaacaactccgaaatgaaactcccaacacacaccggcacgcatgtcgacgcccccggccacgtgttcgaccactacttcgatgccggcttcgatgtcgacaccctcgacttggacatcctcaacggacctgctctattagttgatgttccaagagatagtaatataactgctcaagttatgaagtcgttgaatattccaaggggtgttgtacgtgttctcttccgaacgttaaataccgacaggcggcttatgtttcagaaggaatgggacacaagctatgtaggattcacagttgatggagctaagtggctagtggataacacggatatcaaacttgttggaattgattacctatctgttgcttcttatgattacttgattccatctcaccttgtttttctaaaagacagggagatcattctcgtggaaggcttgaagcttgatgatgttccagcaggattatattcagtccattgcttacctcttaggttggctggtgctgagggatcaccaatacggtgcattctgattaaaaattagggaaacagtgctgtttcaaagtagtttttgcatttgcagagcaagagggatgcatcaatctttgcaatacttgaatttggttctcttttgtctgctaggctggaactgataaattggcatagtggtgtggtgtccttatggagcaagatagtttcaatgttgtgcatcaacttttgtggcttacgtttacacttgttaaaaacatgcataagcacttcaagaaatcattttgaaatggaaaataatgtatatatagataatttgcacgtagcattagcacttcgagaaagatgcaatggaataagttggcacaatggtgtgtctttgtggagcaagattagtaatgtttgttaactttagtggctcatgtgtacacttattcttgtttcctagtacagaattgcaactttcgttttgggcttgtttcaatagttagtccatcatagagcaccatgtacttgaaagttgatggattgaagatcaaggtgggattgttattactcgcagctatgaccatgtgataactggatactctctatctgttttgaattctatcagaagagtttaatttttctattcagtagatcaatagccgacacagtatgttgaaattgctgcaggaaacgatgctgtggatcatcagtagtttatgcgttgcatagcaagagagatgcaacaatcttaccattacattgaatttggttctcttttgtctgctaagctggaactgataaattgacatagtggtgtcattatggagcgagatagtttaaatgttgtgcaacaatttttgtggcttatgtttacacttattagtaaca

SEQ ID NO: 5766 - DNA, 1718 bp, Glycine max
cttacgtgtccaaattattgggtggacgaaaatatctcgttcatggtaacgataacgaggaatggactgtacggactgatgctgttctgttggtgacgattgtatccacattgagacgaaatctgacgatgaaacgtggagcattattgtcagtgcttgcgttcgccttcgcggcggcgatctgggcggcgaacggcaacgacaacctcgtcccgcctaggcgggaagtgtacggcaatggccgaatattcgacatcagtcaccggtaccaacccgagatgccggaatgggaatcgaataacggcattgggcagttcctgtggcttcccaagagcatgaagaacggttccctcgccaacaactccgaaatgaaactcccaacacacaccggcacgcatgtcgacgcccccggccacgtgttcgaccactacttcgatgccggcttcgatgtcgacaccctcgacttggacatcctcaacggacctgctctattagttgatgttccaagagatagtaatataactgctcaagttatgaagtcgttgaatattccaaggggtgttgtacgtgttctcttccgaacgttaaataccgacaggcggcttatgtttcagaaggaatgggacacaagctatgtaggattcacagttgatggagctaagtggctagtggataacacggatatcaaacttgttggaattgattacctatctgttgcttcttatgattacttgattccatctcaccttgtttttctaaaagacagggagatcattctcgtggaaggctttgaagcttgatgatgttccagcaggattatattcagtccattgcttacctcttaggttggctggtgctgagggatcaccaatacggtgctatctgattaaaaattagggaaacagtgctgtttcaaagtagtttttgcatttgcagagcaagagggatgcatcaatctttgcaatacttgaatttggttctcttttgtctgctaggctggaactgataaattggcatagtggtgtggtgtccttatggagcaagatagtttcaatgttgtgcatcaacttttgtggcttacgtttacacttgttaaaaacatgcataagcacttcaagaaatcattttgaaatggaaaataatgtatatatagataatttgcacgtagcattagcacttcgagaaagatgcaatggaataagttggcacaatggtgtgtctttgtggagcaagattagtaatgtttgttaactttagtggctcatgtgtacacttattcttgtttcctagtacagaattgcaactttcgttttgggcttgtttcaatagttagtccatcatagagcaccatgtacttgaaagttgatggattgaagatcaaggtgggattgttattactcgcagctatgaccatgtgataactggatactctctatctgttttgaattctatcagaagagtttaatttttctattcagtagatcaatagccgacacagtatgttgaaattgctgcaggaaacgatgctgtggatcatcagtagtttatgcgttgcatagcaagagagatgcaacaatcttaccattacattgaatttggttctcttttgtctgctaagctggaactgataaattgacatagtggtgtcattatggagcgagatagtttaaatgttgtgcaacaatttttgtggcttatgtttacacttattagtaaca

SEQ ID NO: 5767 - DNA, 1753 bp, Glycine max
tataatgatttctaattatcaatgatacaacacaaccacttacgtgtccaaatgtgtcgatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaactttagtggcttacgtgcacgcttataaccatatgcacaagcacatcaatttaataggtcgttttgaaaaagggaagatcatgtatatagataatttgcaaatagcagttagatcatattttaattacttagaaaaaagcattaacagttctacccaacaaccgcatgttttggtctcagtttgttattgacaatggccgcttagggctcaattctagttgacagcaaaggctactgtacattgacgacgaacacacaatctgtgtacagtaggatatctactcgattgagcaaatgttgctgtaattggtgcatggccacattatgtttactatgatacctattgttgcaagattccgctacttcggctaccaatgtgtaatataagaatgtctaacaataaaggttgatccctcgagtatggataaatttgaaatgaagagttagataacatttttaccaaa

SEQ ID NO: 5768 - DNA, 1707 bp, Glycine max
tccaaatgtgtcgatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaactttagtggcttacgtgcacgcttataaccatatgcacaagcacatcaatttaataggtcgttttgaaaaagggaagatcatgtatatagataatttgcaaatagcagttagatcatattttaattacttagaaaaaagcattaacagttctacccaacaaccgcatgttttggtctcagtttgttattgacaatggccgcttagggctcaattctagttgacagcaaaggctactgtacattggcgacgaacacacaatctgtgtacagtaggatatctactcgattgagcaaatgttgctgtaattggtgcatggccacattatgtttactatgatacctattgttgcaagattccgctacttcggctaccaatgtgtaatataagaatgtctaacaataaaggttgatccctcgagtatggataaatttgaaatgaagagttagataacatttttaccaaa

SEQ ID NO: 5769 - DNA, 1252 bp, Cajanus cajan
tattaacgactaacgaacgaggaagggattacgctagggactggtgagtgagtggtggtgtcggcgtgagagtgagtgcatccaatccaacaacaatgaagcgcggagcggtctcactgattgcgtgcgccttcgcggtggcgctctgggcggcgaacggcgaagacggggccctggtcccgcctcggcgggaagtgtacgacaatgggcgaatattcgacatcagtcaccggtaccagccggagatgccggattgggaatcgaaggagggcataggacagttcctgtggcttccgaagagcatgaagaacggttcgctcgccaacaactccgaaatgaagctcccaacgcacaccggcacgcacgtcgacgcccccggccacgtcttcgaccactacttcgacgccggcttcgatgtcgactcgctcgacttacacgtcctcaacggacctgctctgttagtcgacgttccaagagatactaatataactgctcaagttatgaaaacgtttaatattcccaggggtgtaaaacgtgtgctcttcagaacgttaaataccgacaggaagcttatgtttcagaaggaatttgacactagctatgtgggatttacggtggatggagcaaaatggctggtggagaacacagatatcaaacttgttggaattgattatctatctgttgcttcttttgattacttgattccatctcaccttgtttttctaaaggacagggaaatcattctcgtggaaggcttgaagcttgatgatgttccagcaggattatattcagtccactgcttacctcttaggttggctggtgctgagggatcaccaatacggtgcattttgattaaaaattagggagactgctatctaaaatgccatggaggtacggatcatcggtggctcgtgcatgtgcagagcagagcaagagggatgcagcattacattgaatttggttttctttttcctgctaggctggaactgataaattggcacagcggtgcccttatggagcaagatagtatcaatgttgtgctcaacatttgtggcttatgtttacacatgttagaaacatgcatgagcatatcaaaaagtcattttgaaaaggagaatattgtgtatatagataatttgcacgtagcattaacacttcaagatgttagcattcctctgaattgacttactttggccgctaggtttgaacataataaattggcacagcggtgtgtcgtcattgagaaagatag

SEQ ID NO: 5770 - DNA, 983 bp, Trifolium pratense
caaattagcacacaatcaacaagtatgaagtatcaagcggcggtgttatctttggtggtggcaatttacacctcggcggtgatcggcgacgataacctaatccctcctcgccgtgaagtctacaataatggaaaaatcttcgatattactcacaggtatcaaccggacatgccagcttttgagtctagcgatggtatcggtcaatttctatggcttccaaagagcatgaaaaacggttccatcgctaataactctgaaatgaagcttccaactcataccggtactcatgttgatgctcctggtcacgtctttgatcattactttgatgctggcttcgatgttgattccctcgatttgcatatactcaatggtcctgctcttttagttgatgttccaagagatagtaatataactgctgaagttatgaagtcattaaacattcccaggggtataacacgcgtactattccgaacattaaatacagacaggcggcttatgtttcagaaggaatttgactcaagctatgtgggattcacagtggatggagcaaaatggctagtggagaacactgacatcaaacttattggtgttgattacctatctgttgcttcttatgactacttgattccatctcaccttgtgtttttaaaagacagggaaatcattctcgttgaaagcctgaagctagatgatgtcccagcaggattatattcagtccattgtttacctctaaggttggctggtgctgagggatcaccaatccgatgcattgtaatcaagtattaggaagcagtgctgtctcaaatgccacaggaggagtggatcatcaatgatgtatgtatgtttagagcaagaggtagagagatgcagcaatctgatagcattactttgaatatagttttattttgcctgctaggttgaaccaaataaattgctgcaatggtgtccttatggagttagatagtaagtagtaacaataccgc

SEQ ID NO: 5771 - DNA, 1467 bp, Cicer arietinum
tgatatgaaaggcaactgctattgctatttattccttacaattaaataaaaaaaatctgtagacacagtactgaaattagtaagcgataaatcaaaactatgaagtgtgaagctgttgcgttcatcttagttgtagcgattttagcgtctgcggtcaccggcgacgatgaccttatccctccgcggcgagaagtttacgacaatggacgaatattcgatatcactcacaggtatcaaccagatatgccagaatttgagtctaagcatggtataggccagttcttatggcttccaaagagcatgaaaaacaattccatcgctaacaattccgaaatgaaacttccaactcataccggtactcatgttgatgcccctggccacgtctacgatcattacttcgatgctggttttgatgtcgattccctcgatttgcacatccttaatggtcctgctcttttagttgatgttccaagagattctaatattaccgctgaagtaatgaagtcattaaacattccaaggggtgtaaagcgtgtactgttccgaacattgaataccgacaggcggcttatgtttcagaaggaatttgactcaaactatgtgggattcacagtggacggagcaaaatggctagtggagaacactgatatcaaacttgttggtattgattacctatctgttgcttcttacgattacttgattccatctcaccttgtgtttttaaaagacagggaaatcattcttgttgaaagcctgaagcttgatgatgtcccagcaggattatattcagtccattgcttacctcttaggttggctggtgctgagggatcaccaatacgatgcattcttatcaagtattagggaagcagtgttgtatcaaatgccatgggagctgtcgattatcaatggtgtatgtatgttttagagcaagtggtagagagatgcagctatctaatagcattatgttgaatatagttttaatctgtctgttaggttgaaccaaataaattgccgtagtggtgtccttatggagctacatagtaacaatacttcacttcaactttagtgggcatatgtttacgttccacttaaattctgtctgttcctcgaatttttcaaaactccatcgtgaacaacaatgcaaacagatactaagcatatgtttggtttggcagtgagattgcagtaacaccgcaggcaatccagaaatttaacacagtatgctttaaaagcaaaaccaaacatatcctcagtcattttggaaaagcaaagagtatacttgtcaattattttcccatagcaatatatcatttttaattacagaacaataaaaaaaagtattgcacaaaaaactgcacgtttcggtcaatggcgaatttagtgttcagtattactatactagtggcaacaaaggcttcagtacattgtgtatgaattcaaatgaatccaagcactgcactgcagggt

SEQ ID NO: 5772 - DNA, 1113 bp, Trigonella foenum-graecum
gttggttaacgaaaatatttcgaaaaatattgttataaatacctatgaaatttactattctatctttgcaattaaattcgtggatagacacagtagtcacataagcaagaaatcgaaatatgaagtatgaagcgatagtagtgttagtcttggttgttacaatctcttcctcggcggtgaacggcgacgataatctcatccctcctcgccgggaagtatacgacaatggaagaatcttcgatatcactcacaggtatcaacctgacatgccagcttttgagactaaagatggtattggccaattcttgtggcttccaaagagtatgaaaaacggttccatcgctaataactctgagatgaagcttccaactcataccggtactcatgttgatgcacctggtcatgtcttcgatcactatttcgatgctggattcgatgttgattcccttgacttgcatatcctcaatggtcctgctctcttagttgatgttccaagaaattctaatataactgctgaagtaatgaagtcattaaatattcccaggggtgtaaagcgtgtactcttccgaacattgaataccgacaggaggcttatgtttcagaaggaatttgactcaaactatgtgggattcacagtggatggagcaaaatggctagtggagaacaccgatatcaaacttgttggtattgactacctatctgttgcttcttatgattacttgattccatctcatcttgtgtttttaaaagacagggaaatcattctcgttgaaagcctgaagcttgatgatgtcccagcaggattatattcagtccattgcttacctcttaggttggctggtgctgagggatcaccaatacgatgcattctaatcaagtattagggaagcacttctgtctcaaatgccatgggaggagtggaacatcaatgatgtatgtatgtttagagcaagaggtagagagatgcagcaatctaatagcactactttgaatatagttctattttgccttctaggttgaaccaaataaattgccgcaatgttgtctttatggagctagatagtaacaatactgcactttgagtttaacggcatacgtttacattacacttat

SEQ ID NO: 5773 - DNA, 1288 bp, Lotus japonicus
ctctttaatactgggcgcattgagtttaacaaataaaaaaaatcccaacgatgaagttcggagcattgttagtggcggtgtgcgccttaaccgtcgcggtttgtgcggaggcactgcccggcgacgagaacctcgtccctccccggcgggaagtgtacgacggcgggcgaatattcgacatcagtcaccggtaccacccggacatgccgtcatgggagtctgacgacggcatagggcagttcctgtggcttccgaagagcatgaagaacggttccatcgctaacaactccaagatgaagctcccgacccacaccggcacccacgtcgacgcccctggccacgtcttcgaccactacttcgacgccgggtttgatgtcgattcactggacttgcacatcctcaatggtcctgctctgctagttgatgttccaagagatagtaatctaactgctgaagccatgaagtcattaaatattccaaggggtgtgaagcgtgtgcttttccgaacgttaaatactgacaggcggcttatgtttaagaaggaatgggacacaagctatgtgggattcacgaaggatggagcaaaatggctagtggagaacactgatatcaagcttgttggaattgattacctatctgttgctgcttttgatgacttgattccatctcaccttgtttttttaaaagacaggaaatcattcttgttgaagccctcaagcttgatgatgtcccagcaggattatattcagtccattgcttgcctcttagattggctggtgctgagggatcaccaatccgatgcattctgattaagaattagggaagcattgctgtctgtctcgaatgctggacaaggtgtgatcatcagaggtgtatgtatgtttagattaagggggatgtagcttaatataattacactggatgtggttttctttggtgtgctaggttggcacagcggtgttattatggagctagatagtagtatcaatattgttggtggcatatgtttacacttattagaagtatgcataaacacttcaataagtcatcttgaaaaagaaaataatgtggtgtgtgtgtgtatagattatttgcacattgttgcacaaacaactacacattttggtctcagttcttagttgtcagtgacaggttgctcagttcttctactagtggcagccaaggctgcagtacatttcccctgaattatcacgtatccaaaccctgctgggttcctcatttcatgaagaaatgtcttaattggtgcatgcaaatcaatttctctttc

SEQ ID NO: 5774 - DNA, 1051 bp, Medicago truncatula
agaaagaaaaagaatcgaaaaatgaagtatcaagcggtagtagcattagccttggtggttacaatttccgtgacggcggttaacggcgacgataaccttatccctcctcgtcgggaagtatacgacaatggaaaaatcttcgatatcactcacaggtatcaaccagacatgccagcttttgagactaacgatggcatcggtcaattcttgtggcttccaaaaagcatgaagaatggttccatcgctaataactctgaaatgaagcttccgactcatactggtactcatgttgatgcccctggacatgtcttcgatcattacttcgatgccggttttgatgtcgattctctcgacttgcacgtcctcaatggtcctgctctattagttgatgttccaagagattctaatataactgctgaagttatgaagtctttaaatattcccagaggtgtaaagcgtgtactcttccgaacattgaataccgacaggcggcttatgtttcagaaggaatttgactcaagctatgtgggattcactgtggatggagcaaaatggctagtggagaacactgatatcaaacttgttggtattgattacctatctgttgcttcttatgattacttgattccatctcaccttgtgtttttaaaagacagggaaagcattctcgttgaaagcctgaaacttgatgatatcccaccaggattatattcagtccattgcttacctcttcggttggctggtgctgagggatcaccaataagatgcattctaatcaagtattagggtatgtgtgattttgaggaagcagtgctgtctcagaatccatgggaggagtggatcatcattgatgtatgtatgtctagagcaggaggtagagagatgaagcaatctatcagcactactttgaatatagttttattttgcttgttgaaccaaataaatagccgcaatggtgtccttatggagctagatagtaacaatatcgcactttaactttagtggcaaatgtttaccttacacttattagaaacattaaatatgttgggtc

SEQ ID NO: 5775 - DNA, 1038 bp, Medicago truncatula
aagcaagcaagaaagaaaaagaatcgaaaaatgaagtatcaagcggtagtagcattagccttggtggttacaatttccgtgacggcggttaacggcgacgataaccttatccctcctcgtcgggaagtatacgacaatggaaaaatcttcgatatcactcacaggtatcaaccagacatgccagcttttgagactaacgatggcatcggtcaattcttgtggcttccaaaaagcatgaagaatggttccatcgctaataactctgaaatgaagcttccgactcatactggtactcatgttgatgcccctggacatgtcttcgatcattacttcgatgccggttttgatgtcgattctctcgacttgcacgtcctcaatggtcctgctctattagttgatgttccaagagattctaatataactgctgaagttatgaagtctttaaatattcccagaggtgtaaagcgtgtactcttccgaacattgaataccgacaggcggcttatgtttcagaaggaatttgactcaagctatgtgggattcactgtggatggagcaaaatggctagtggagaacactgatatcaaacttgttggtattgattacctatctgttgcttcttatgattacttgattccatctcaccttgtgtttttaaaagacagggaaagcattctcgttgaaagcctgaaacttgatgatatcccaccaggattatattcagtccattgcttacctcttcggttggctggtgctgagggatcaccaataagatgcattctaatcaagtattagggaagcagtgctgtctcagaatccatgggaggagtggatcatcattgatgtatgtatgtctagagcaggaggtagagagatgaagcaatctatcagcactactttgaatatagttttattttgcttgttgaaccaaataaatagccgcaatggtgtccttatggagctagatagtaacaatatcgcactttaactttagtggcaaatgtttaccttacacttattagaaacattaaatatgtt

SEQ ID NO: 5776 - DNA, 876 bp, Vigna unguiculata
ataaaccaaacatgtgcgcgcccatatcagaactcgaacaggaagaactgctcgaaaaactagaggttttcaagatcaaaggccgtgacaagcatggccgcaagatccttcgcattatcggaaaattcttcccagcgcggttgatcactgttgaggtgctgaagaagtacctggaagagagggtttttccaaagttagggaagagaaaatttgccgtgctctatgtgcacaccgacgtgcagagaagcgagaatctgcccggaatatctgctctccggtcaatctacgacgcaattccgaccaacgtgaaggagaatctcgaagctttctattttattcacccgggcttacaggcacgtcttttccttgccaccttgggccgcttcctcttcaacgctgggctgtatggaaagttgaagtacattagcagggttgattttctatgggagcacgtgaggaggaacgaggtagagattccggaatttgtgtttgatcatgacgaggatctggaataccgtccgatgatggattacgggttagagagtgatcacgctagattgtacggtggtgctcccacaatggattcaccagtcaccacctattccatgaggtgcatctcataggatcccaccccaggagattgaataacccgtggtgtcttgttttgtgtgttaggtagactgggcctggctgttagttaaataggcccatagctacgtggatgttgatattgtgtagaaaaagaaaaaggaaaaagaaaaatgaaaagaatagtgcttttttaggttttgctaatgtggtaatacttatccaatagcattttcagttttggttggatgattcagatcaatgatattaaaaagaattccaccgact

SEQ ID NO: 5777 - DNA, 1253 bp, Glycine max
cttccatacctttccctccttctgagtccttaccttacccaattttttctttttcccttatttgttttctctcgaaatttgcccataacgttctctttgtacctcatcttatcctgcacacacccccccctccctcccttcctataagatttatttgcgtagcattcaccatcacaatcaatcttctttatccactctctcttaattaaattaaaacaaaaaatgtgcgctgccatatccgaagtggaacaagaagagttgctcgaaaaattggaggtgttcaagatcaaaggcagggacaagcatggccgcaagatccttcgcattatcgccaaattcttcccagcacggttggtgagtgttgaggttctgaaaaagtacctggaggagagggttttcccgaagctgatggggaagaggaaattcgcggtgctgtacgtgcacaccggcgtccagaggagcgagaattttcccggaatctccggtctccggtggatctacgatgcgattccggcgaacgtgaaggagaatctcgaagccgtttattttattcacccgggcttgcaggcccgccttttcctcgctacattcggccgcttcctctttaacgctgggctgtatggaaagctgaggtacgtaagcagggttgattatctgtgggagagtgtgaggaggaacgaggtggaaattccggagtttgtgtttgatcacgacgaggatttggattaccgtccgatgatggattacggattggagagcgatcacgctagagtgtacggtggtgctccaaccatggattcacccgtcaccacctactccatgaggtgcatctcataggattccaggagattcattaatcctctgcgcttcttgtttttgtgcgttaggtagactggggtccctgttagttaaatgggcccatagctatgtggttgttgatattgtgcagaaagaaaaggttaaaaaaaaaaagaagaagaaaaaatagtcgttttttttaggtcttgctaatgtgttaatacttatccaatagcgttttcagttttggttggatgattcagttcagtgatgatattttaaaaagaattccaccggctgattcttctgatattctttcggtataggtctttccgtccttcacattttcttattctttttataggtccaataaaagcttctcaatcttgccaaaacctctccactataatataatatccttcgaacgaaactaacttcgtatattgtgatacgcg

SEQ ID NO: 5778 - DNA, 1189 bp, Glycine max
tccatacctttccctccttctgagtccttaccttacccaattttttctttttcccttatttgttttctctcgaaatttgcccataacgttctctttgtacctcatcttatcctgcacacacccccccctccctcccttcctataagatttatttgcgtagcattcaccatcacaatcaatcttctttatccactctctcttaattaaattaaaacaaaaaatgtgcgctgccatatccgaagtggaacaagaagagttgctcgaaaaattggaggtgttcaagatcaaaggcagggacaagcatggccgcaagatccttcgcattatcgccaaattcttcccagcacggttggtgagtgttgaggttctgaaaaagtacctggaggagagggttttcccgaagctgatggggaagaggaaattcgcggtgctgtacgtgcacaccggcgtccagaggagcgagaattttcccggaatctccggtctccggtggatctacgatgcgattccggcgaacgtgaaggagaatctcgaagccgtttattttattcacccgggcttgcaggcccgccttttcctcgctacattcggccgcttcctctttaacgctgggctgtatggaaagctgaggtacgtaagcagggttgattatctgtgggagagtgtgaggaggaacgaggtggaaattccggagtttgtgtttgatcacgacgaggatttggattaccgtccgatgatggattacggattggagagcgatcacgctagagtgtacggtggtgctccaaccatggattcacccgtcaccacctactccatgaggtgcatctcataggattccaggagattcattaatcctctgcgcttcttgtttttgtgcgttaggtagactggggtccctgttagttaaatgggcccatagctatgtggttgttgatattgtgcagaaagaaaaggttaaaaaaaaaaagaagaagaaaaaatagtcgttttttttaggtcttgctaatgtgttaatacttatccaatagcgttttcagttttggttggatgattcagttcagtgatgatattttaaaaagaattccaccggctgattcttctgatattctttcggtataggtctttccgtccttcacattttcttattctttttataggtccaataaaagcttctcaatcttgccaa

SEQ ID NO: 5779 - DNA, 1182 bp, Glycine max
ctctgattactttcattcattttttctttccctccttctgactgagtcctttaccttacccatttatttttcccttatttgttttctctcgatatttgtccataataacgttctctttgtccctcatcttatcctgcacccactcccttataaccccccctacttcaccacttcacaatcaatcttctttatccactctctctctctctcttaaaattaaaactaagcatgtgctctgccatatcccaagtggaacaagaagagttgctcgaaaaattagaggtgttcaagatcaaaggcagggacaagcatggccgcaagatccttcgcattatcgccaaactcttcccagcgcggttggtgagtgttgatgttctgaagaagtacctggaggataaggttttcccgaagctggggaagaggaaattcgtggtgctgtacgtgcacaccggcgtccagaggagcgagaattttcccggaatctccggtctccggtggatctacgactcgattccggcgaacgtgaaggagaacctcgaagccgtttattttattcacccgggcttgcaggcccgccttttcctcgctaccttcggccgtttcctcttcaacgctgggctgtatggaaagctgaggtacgtgagcagggttgattatctgtgggagaatgtgaggaggaacgaagtggagattccggagtttgtgtttgatcacgacgaggatttggattaccgtccgatgatggattacggattggagagcgatcacgctagagtgtacggtggtgctccaactatggattcacccgtcaccacctactccatgaggtgcatctcataggattcccgattcctctccaggatatctgcgcctcttgttttttgtgcgttaggtagattgggcctccctgttagttatatgggcccatagctatgtggttgttgatattgtgcagaaagaaaaagtagtaaaacaagctttttttaggtcttgctaatgtgttaatacttatccaatagcattttcggttttcgttggatgattcagttcagtgatatttcaaaatgaattccaccggctgattcttttgatactctttaggtatataggtctttccattcttcacattttcttattcttttttaaaggtccaataaaagcttctcaatcttaccaaaacct

SEQ ID NO: 5780 - DNA, 1283 bp, Glycine max
gctgggatcgcgtatgcgtagggaacccagatgacactcacgtggggcccacagaaaggaagattctttcgaatataccttatggccgcgcaactgcagcatgctgattactttcattcattttttctttccctccttctgactgagtcctttaccttacccatttatttttcccttatttgttttctctcgatatttgtccataataacgttctctttgtccctcatcttatcctgcacccactcccttataaccccccctacttcaccacttcacaatcaatcttctttatccactctctctctctctcttaaaattaaaactaagcatgtgctctgccatatcccaagtggaacaagaagagttgctcgaaaaattagaggtgttcaagatcaaaggcagggacaagcatggccgcaagatccttcgcattatcgccaaactcttcccagcgcggttggtgagtgttgatgttctgaagaagtacctggaggataaggttttcccgaagctggggaagaggaaattcgtggtgctgtacgtgcacaccggcgtccagaggagcgagaattttcccggaatctccggtctccggtggatctacgactcgattccggcgaacgtgaaggagaacctcgaagccgtttattttattcacccgggcttgcaggcccgccttttcctcgctaccttcggccgtttcctcttcaacgctgggctgtatggaaagctgaggtacgtgagcagggttgattatctgtgggagaatgtgaggaggaacgaagtggagattccggagtttgtgtttgatcacgacgaggatttggattaccgtccgatgatggattacggattggagagcgatcacgctagagtgtacggtggtgctccaactatggattcacccgtcaccacctactccatgaggtgcatctcataggattcccgattcctctccaggatatctgcgcctcttgttttttgtgcgttaggtagattgggcctccctgttagttatatgggcccatagctatgtggttgttgatattgtgcagaaagaaaaagtagtaaaacaagctttttttaggtcttgctaatgtgttaatacttatccaatagcattttcggttttcgttggatgattcagttcagtgatatttcaaaatgaattccaccggctgattcttttgatactctttaggtatataggtctttccattcttcacattttcttattcttttttaaaggtccaataaaagcttctcaatcttaccaaaacct

SEQ ID NO: 5781 - DNA, 1273 bp, Cajanus cajan
gcccattctcaaaattatcattacgttcccttagtccctccctttctcatccacgtccaccttataaaacccctcattttctcaatcacaatcaatcttctctatccactccctctttctcttcttccactccagcttccttaaaaccaacatgtgcgctgtcgccatgtcgcacctccaacagctagagctgctccacaaattagaggtcttcaagatcaaaggcagggacaagcacggccgcaagatcctccgcattatcgccaaattcctcccagcgcgtttggtgagcgtggatgttctgaacaagtacctggaggagaggattttccccaagctggggaagaggaaattcgcggtgctctatgttcacaccggcgtccagaggagcgagaatttccccggaatctccggtctccggtggatctacgacgcgattccggccgccgtgaaggacaatctggaagccgtctatttcattcaccccggcctccaggctcgcctcttcctcgctacctttggccgtttcctcttcaacgctgggctctatgggaagctgaggtacgtgagcagggtggattacctgtgggagagtgttcgtaggaacgaggtggagattccggagtttgtgtttgatcacgacgaggacttggagtaccgtcccatgatggattacggcttggagagtgatcacgcgagagtgtacggtgctgctcccgcactggattcgcccgtcaccacctactccatgaggtgcatctcataggattagttacgtatatgatattgtgcagaaacataaacaaacaagaaaaaactttagtcctttttcttttttttactttttaggtcccgctagtgtgtccatacttatccaatagtattttcccttttgttttctaattctatcgctgttcctttcctatcattttacattctctctattatttctttaaaaggttaaaacggtgttctaaaatataaaacgcacccttccaagtacccgtgccatgatgtcaccagtaaaaaataaatgtgagatgagtcacgtgtaactgcatatgcattagagcattttttaatatgctttattattaattagtatgtaaaatttacattacatattacgagattgatgttttttcaatacatataaagtttattttaattgacaccgatcacacgaggggtttatttgaaattgctgtgtttgtttctaagaaattttaaagagaaagaacaagattaaataaagtgtaagggagaataattc

SEQ ID NO: 5782 - DNA, 1055 bp, Medicago truncatula
acaatcataatcatcacgattcgattcacaatcacacctttttcttctatcactacgccaataaaaaaaaacatgagcaccaccataactgaacttgaacaagaagaattgcttgagaaattggaagtcttcaagatcaaaggcagagataagcatggccgcaagatcctccgcattatcggaaaattcttcccagcgcgattggttagcgttgaggttctgaagaagtttttggaggagaggattttcccgaagctagggaagaagaaattcgctgtgttgtatattcacaccggcgttcagaggagcgagaattttgctggaatttcttctctccgatcggtttacgatgcgattccggcgaacgtgaaggagaatctagaagctgtttattttattcatcctggtttacaagctcgcctttttctcgctacgtttggccgttttctcttcaacgctgggttgtacaggaagctgaggtacatcagcagaattggttatctatgggagaatgttaggaggaccgaagtggagattccggagttcgtatacgaccatgatgaagatttggagtatcgtccgatgatggattatggattagagagtgatcatgctagggtttatggtactgctcctgcactagattcgcctgtgactacttactccatgaggtgtatctcgtagggtctaggatttgggttcactgtagccgttggatcggagtcattggattaagatgaaatgatttgtatcttaagttcagtaatgtgaaatataggccgtttgatctttttatccaataccaccgacttcttgattgcattgtgttttgactgcagtgaattcaaatctttgtgtttagtaaaacagagctttcaaatagttatggagggccatggttattgagatataatgtgcagaaagaaaaagatggaaacaatagttccattttgttttctttaggtcttgtcatgttttttgttttcttttttttaggtgctgtcaacatcttgatattaatagttatggaaggatattttcatttttttgttgga

SEQ ID NO: 5783 - DNA, 1240 bp, Medicago truncatula
tattttttcctccaattactttccctctttcttcctttttcgttatcttaatctcaaattaattttctgttttatttaattaacccattcattacgttaattgcataactccttataaattataatccctatccatccaaatccaccatcacaatcataatcatcacgattcgattcacaatcacacctttttcttctatcactacgccaataaaaaaaaacatgagcaccaccataactgaacttgaacaagaagaattgcttgagaaattggaagtcttcaagatcaaaggcagagataagcatggccgcaagatcctccgcattatcggaaaattcttcccagcgcgattggttagcgttgaggttctgaagaagtttttggaggagaggattttcccgaagctagggaagaagaaattcgctgtgttgtatattcacaccggcgttcagaggagcgagaattttgctggaatttcttctctccgatcggtttacgatgcgattccggcgaacgtgaaggagaatctagaagctgtttattttattcatcctggtttacaagctcgcctttttctcgctacgtttggccgttttctcttcaacgctgggttgtacaggaagctgaggtacatcagcagaattggttatctatgggagaatgttaggaggaccgaagtggagattccggagttcgtatacgaccatgatgaagatttggagtatcgtccgatgatggattatggattagagagtgatcatgctagggtttatggtactgctcctgcactagattcgcctgtgactacttactccatgaggtgtatctcgtagggtctaggatttgggttcactgtagccgttggatcggagtcattggattaagatgaaatgatttgtatcttaagttcagtaatgtgaaatataggccgtttgatctttttatccaataccaccgacttcttgattgcattgtgttttgactgcagtgaattcaaatctttgtgtttagtaaaacagagctttcaaatagttatggagggccatggttattgagatataatgtgcagaaagaaaaagatggaaacaatagttccattttgttttctttaggtcttgtcatgttttttgttttcttttttttaggtgctgtcaacatcttgatattaatagttatggaaggatattttcatttttttgttggataattcaatgatatatatagtaattttatcgataa

SEQ ID NO: 5784 - DNA, 1411 bp, Cicer arietinum
cctttccctcccaccttcctttttcatcctttctcccaaaatctcaattttctcctttttatttttatttttttatctcatttattatttctcctcccaatttttctacgtcttatcttaattattgttaacgttatcttttatcactctttataatccctatctatcccaattcacaatcacattcgcaatcataattacaccttaacgttctttatcgtctacttttaccctaaaaactttctcttcagtatcaaaaaaaaaaacatgagtaccgccataactgaacttgaacaagaagaattactcgagaaattagaggttttcaagatcaaaggcaaagacaaacatggccgcaagatcctccgcattatcggaaaattcttccctgcgcgattggttagcgttgacgttctgaagaaatatttggaacggaggattttcccgaaactcgggaagagaaaattctcggtactttatattcacaccggcgttcagagaagcgagaatttccccggaatctcttctctccgatctctttacgacgcgattccagcgaacgtgaaagagaatttagaagcagtttattttattcaccctggtttacaagcccgtcttttcctcgctacttttggccgttttctcttcaaagccgggttgtatggtaaactgaggtacgtgagcagggttgattgtctatgggaaaacgttcggaggaacaatgtggagattcccgagtttgtgtatgatcatgatgaggatttggagtaccgtccgatgatggattatggattggagagtgatcatgctagggtttacggtactgctccttcactggattcacccgtgactacttactcgatgaggtgtatctcgtagtcgtagggttcagttagtcctttgtttttgttggtttgtttagcttttagaggatttcgttgggtgtgttgcgtccaggatttgggttcacttcagccgttggattagagttgttggatttaagattgaatgattttgaatctcatcttcttcggtaattgaaatgtagaccgtatgatctttatccaatactagtgtcatttcgattagttatggagggccatacctatgtggatatatattattgagatgttatgaagaaagaaaagaatagttgcctttgttactcctttaggtattgtctttttatttatttatttataggtgttgtcgacatcttgttaatagatagtaatggaaggtcattttcaattttgtcgttggataattcgatgatatttagagcaatttcattgattttcttttgcatttacaagagttactgttttattatcattgaccttatttatgcaccagacgtctgaatttattttttgaaaaataataaatggaatgtctttcattttagaaa

SEQ ID NO: 5785 - DNA, 723 bp, Lotus japonicus
cccccaaaactcgtgtccctctctcaatctcaatctctttctctctgtttcctcaaaaccaaaccagaagaatcaacaaatcaatcaaatgaatccttcaaattcaatatctcaatttgaacaggaagagttactcgacaaattggaggttttcaagatcaaaggcagagacaaacaaggccgcaagatcctccgcattatcggaaaattcttccctgcgcgcctggtgagtgttgacgttctgaagaagtacctagaggagaggattttcccgaagcttgtgaagaagaaattctcggtgctgtacgttcacaccgacgttcaccggagcgagaatttccccggaatctccgctctccgatctatctacgacgcgatcccggccaacgtcaaggagaatctggaagccgtctatttcattcaccctggcctccagtctcgcctcttcctcgccaccttcggccgcttcctcttcaacgccgggttgtacgggaagttgaggtacgtgagcagggttgattatctgtgggagagtgtacggaggaacgaggtggaggttccggagtttgtgtttgatcatgatgaagatttggagtaccggccgatgatggattacggcttggagagtgatcacgccagggtttacggcggagctccggcgatggattcaccggtcacaacttactccatgaggtgtatctcataggattaggatctcttttt

SEQ ID NO: 5786 - DNA, 686 bp, Glycyrrhiza uralensis
gaccatcgcaatcacacccttaaccttctttatctactctcttttctctttttcttcttcttccactctcttacgcaaaatcctttctcttttgcttccctgaaacaaacaaatcaataaaaaacatgagtgccgccatatctgaactcgcacaagaagagctgcttgaaaaattagaggtcttcaagatcaaaggcagagacaagcatggccgcaagatcctccgcattatcggcaaattcttccctgcgcggttggtgagcgttgaagttctgaagaagtacctggaggagagggttttcccgaaactcgggaagaagaagttctcggtgctgtacgtgcacaccggcgttcagaggagcgagaatttccccggaatctcttccctccgatcgatctacgacgcgattccggcgaacgtgaaggagaatctagaagccgtctattttattcaccctggcctacaggctcgccttttcctcgccaccttcggccgttttctcttcaacgctgggttgtacgggaaactgaggtacgtgagcagggttgactatctgtgggagaacgtgaggaggatcgacgtagagattccggagtttgtgtttgatcatgacgaggatttggagtaccgtccgatgatggattacgggttggagagtgatcacgctagggtttacggtggtgcg

SEQ ID NO: 5787 - DNA, 1009 bp, Arachis hypogaea
cttcgaatctgtccataacgcgaaacaattattactttcttggcttcatcatcttatattaaacgcttccacctctcaatccacacttgatcccttatcatcttgttccactttggagagaaattcataagaaaaagaaaaacaatgagcggtgtgagtagcatctcagaagctgaacaagaagagttgctggagaagttggaggttttcaaggtcaaaggcaaagacaaacaaggacgcaagatccttcgcattataggaaaattcttccccgcgcgatttgttagcgttgaggttctgaagaagtacctggaggagagggtgtttccgaaggtgggaaagaggaagttcacggtggtttacgtgcacactggggttcagaggagcgagaacttccccgggatctcggctctccgatcgatccacgacgccattccggcgaacgtgagggacaatcttgaagcagtttatttcatccatcctggactccaggcccgcctttttctcgctacgtttggtcgttttcttttcagttcgggggtgtacgggaagctgagatatgtgaccagggttgattacctgtgggagaatgtaaaaaggaacgaggtggagattccggagtttgtgttcgatcacgatgaggatttagagtaccgtccgatgatggattatggtttagagagtgatcatgcaagagtctacggtgtgccacccaccatggactcaccggtgagcacctactcaatgaggtgcatctcatagaatctccctctctatcggattccatgttgggacctacttagtttctttttcttttctctgtttgggtcttgatggggacgttagttggttagtgtattggtgctttgtttcttttttttttcggtttcttttatactgggcctcacaagtggttatcttggcgcgtccctttatggctgtttatattatatataattataaatataaataataaatattgtgcacttgtataaaggaaatcaaaatg

SEQ ID NO: 5788 - DNA, 1188 bp, Arachis hypogaea
aaaattataatttaatttcaagattttttcttcgaatctgtccataacgcgaaacaattattactttcttggcttcatcatcttatattaaacgcttccacctctcaatccacacttgatcccttatcatcttgttccactttggagagaaattcataagaaaaagaaaaacaatgagcggtgtgagtagcatctcagaagctgaacaagaagagttgctggagaagttggaggttttcaaggtcaaaggcaaagacaaacaaggacgcaagatccttcgcattataggaaaattcttccccgcgcgatttgttagcgttgaggttctgaagaagtacctggaggagagggtgtttccgaaggtgggaaagaggaagttcacggtggtttacgtgcacactggggttcagaggagcgagaacttccccgggatctcggctctccgatcgatccacgacgccattccggcgaacgtgagggacaatcttgaagcagtttatttcatccatcctggactccaggcccgcctttttctcgctacgtttggtcgttttcttttcagttcgggggtgtacgggaagctgagatatgtgaccagggttgattacctgtgggagaatgtaaaaaggaacgaggtggagattccggagtttgtgttcgatcacgatgaggatttagagtaccgtccgatgatggattatggtttagagagtgatcatgcaagagtctacggtgtgccacccaccatggactcaccggtgagcacctactcaatgaggtgcatctcatagaatctccctctctatcggattccatgttgggacctacttagtttctttttcttttctctgtttgggtcttgatggggacgttagttggttagtgtattggtgctttgtttcttttttttttcggtttcttttatactgggcctcacaagtggttatcttggcgcgtccctttatggctgtttatattatatataattataaatataaataataaatattgtgcacttgtataaaggaaatcaaaatgaaaattggaaaacaatatatgttttttgctttgttttgttttgtttatttcaccctttcacatttatggggatgccattttcagttctttttggataattcaatgatattaagaattagcgggtttctaggaaaggaacctggtttgcgg

SEQ ID NO: 5789 - DNA, 1124 bp, Lupinus angustifolius
gaattgaatgcattttgttttgtttatcaatgtcacctcttataatccctatccccattctccatcacaatcacaatcacaatcacaatcttctttatatactcgtctttctttcactaccacacgcaaattaaaccctctttctttctttataataattaataaaaatgagttccaatgctacaatttccgaaattgaacaggaagagttgcttgaaaaattacaagtcttcaaaatcaaaggcaaagacaaaaacggccgcaaaatccttcgcattatcggaaaattcttccctgcgcggttggtgagcgttgatgttttgaagaagtatttggaggagagggtttttccgaagcttgggaagaggaaattctcggtgctttatgttcacaccggcgtgaacaggagcgagaattttcccggaatctctggtctccgatcaatctacgacgcgattccggtgaacgtgaaggacaatctagaagccgtttatttcattcatccaggccttcagtcacgactttttctcgctaccttcggccgtttcctcttcagcgccgctgggctgtacgggaaagtgaggtacgtgagcagggttgattatctatgggagcacgtgaggaggaaggaagtggagattccagagtttgtgattgatcatgatgatgatttggagtaccgtcctatgatggattatggtttagagagtgatcatcctagagtctacggtgctccacccactgtggattcacctgtctctacctactccatgaggtgcatctcttagaattagataggatccatgaaggggccttgctactttttctaccacttcttctttcaactttcttcactgtcttgtgtcttgtatcttgtgcctacccaagttgttcttcaggcccatacatgttcatattgtgcagaatgagacatggaaaatgatagtttcaactttttgtttttttaaggttcttaatatttttgtcagcattcagtttttacttttttttaacattttacatacattaatgctgcttgaagttaaacgcatatccaaaaactttcttcgaagttaggatatgatactgatttgtatatatattaaaaggaaaacttgaaccaa

SEQ ID NO: 5790 - DNA, 946 bp, Lupinus angustifolius
tccatcgaatcgggtccacaacgatatcattgcactttgttttttttgtcaattcaaatcaatgtctcaactcttataatccataacaacacaatcttctttatatactcttcccttctttcttcaccacacgcaaataaaaatgaattgtaatgctatcatatctgaaattgaacaagaaaagttgcttgagaaattacaagtcttcaagattaaaggcaaagacaaacgttgccgtaaaatccttcgcattatcggaaagttcttcccagcgcggttggtgaacgttgacgtgatgaacaagtatttggaggagagggtttttccgaagcttgggaagaggaaattctgtgtgctgtatgttcacaccggcgtcaacaggaccgagaactttcccggaatatctgcactccgatcaatctacgatgcgattccggcgaacgtaaaggagaatctagaagccgtttatttcattcactcaggccttcaggcacgactttttctcgcaactttcggccgtttccttttcagcgctgggctgtacgggaaactaaggtacataagcagggttgattatctatgggagcatgtgaagagaaaagaagtggagattccagagtttgtgtttgatcatgatgatgatttggagaaccgtccaatgatggattatggtttggagagtgatcatgctagagttgatggtggtccacctacttttgattcacctatctctacctactccatgaggtgcatctcatagaataccaaacttagatgttcataatcatcttgtacaaaatgtgaaaagggtaatagaaaaattgtagttctttagcttttatgggtattgttcttttgattatacctatggtagatcatgtctcatacactgtttcgtgttaattgaaacatgtcatgtcaattaaaagttgtttttgttttacta

SEQ ID NO: 5791 - DNA, 860 bp, Glycine max
gtaacaaaaaggttcaaccacacaacatcgttgagaggccctgtagttgcaggggttcgtcgtttacccttccctaaagtatctggtgtgctttgttcggtaataacgaaaaacgatgggagctgaaactgaatcatcacaggaaaagccagcacaagagaggccaaaggctgctctctcacaggaacagttcctctcatggaaacgccacaaggacgctgcagtatcagccagaaaagctgaagtatccaggaagcgtgctgaagatattgcagcaggaactgtccaaatgaatggccgagaactgtttttacatgagccatgggtgtttgataattcacgttattgaggtttcttttcattggctcataattcataaaaactctttatggtcatgctttgaaaacttatatttcgggtcaaaatcttctctgtagcaagatatttttgaaatttaaagtttgtaccttttgcaaaggaaaggaaacaatgaaaagattgtttctggatgtcacaagggtggatctgtttcatgttaagaactttgtgaattatgagctgctggaaaattacaagttgttgtccatgtaatgacgaatttattctcttgagattaagtattttcatataggtgggcagttgaaatatcttctctggtattaacattacaaatttttattgcattgctctttagctatgctggagaggttttcggcagattcattagtacaaaggtacctagctacctgctatgtaccttttggtgtgtatgctatgaattattggtgaatatatagttctgtccacatgacgatttcttgattgattttgtaagtaaaaactgttagagatataaagac

SEQ ID NO: 5792 - DNA, 790 bp, Glycine max
gagaggccctgtagttgcaggggttcgtcgtttacccttccctaaagtatctggtgtgctttgttcggtaataacgaaaaacgatgggagctgaaactgaatcatcacaggaaaagccagcacaagagaggccaaaggctgctctctcacaggaacagttcctctcatggaaacgccacaaggacgctgcagtatcagccagaaaagctgaagtatccaggaagcgtgctgaagatattgcagcaggaactgtccaaatgaatggccgagaactgtttttacatgagccatgggtgtttgataattcacgttattgaggtttcttttcattggctcataattcataaaaactctttatggtcatgctttgaaaacttatatttcgggtcaaaatcttctctgtagcaagatatttttgaaatttaaagtttgtaccttttgcaaaggaaaggaaacaatgaaaagattgtttctggatgtcacaagggtggatctgtttcatgttaagaactttgtgaattatgagctgctggaaaattacaagttgttgtccatgtaatgacgaatttattctcttgagattaagtattttcatataggtgggcagttgaaatatcttctctggtattaacattacaaatttttattgcattgctctttagctatgctggagaggttttcggcagattcattagtacaaaggtacctagctacctgctatgtaccttttggtgtgtatgctatgaattattggtgaatatatagttctgtccacatgacgatttcttga

SEQ ID NO: 5793 - DNA, 849 bp, Glycine max
aagaaatgcaattaagcgaaagattaaaggacacatcgttgagaggccttgtagttgcaggggttcgtcgtgtacccttccctaaagtatctggtgctttggttgggaataacgaaacgatgggagctgaaactgaatcatcacaggaaaaacccgaacaagagaggccgaagcctactctctcacaggaacagtttctctcatggaagcgccacaaggacgctgcagtatcagccagaaaagccgaagtatccagtaagcgtgcagaagatattgctgcaggaactgtccaaatgaatggccgggagctatttttacatgagccatgggtgtttgataattcacgatattgaggtttcttactttcttttcattgcttcataattcataaaaactctttatggtcatgctttgagatattttatttttggatcaaaatcttttctgtaacaatatattttcgaaatatgaagtttgtacctttagcaaaggaaaggaaacaatgaaaagattgtttctatatgtcaccagggtggatctgtttcttaaaaatttgtgcattatgaacagctggaacataacaagttgttgtgtccatctagtgatgaatttcttctctgagataagacatttccatataggtgggcagttagatatcttctctgatattaacattacaaatttttaatttcattgctctttaaatatgctggagaggttttcgccagattcattagtacaagggtacctactatgtaccttttgttgtgtgaagtgtgaactacttatgaatatagttttttccacatgttgatttcttgattgattttacgagtacaaacttttcga

SEQ ID NO: 5794 - DNA, 840 bp, Glycine max
aagaaatgcaattaagcgaaagattaaaggacacatcgttgagaggccttgtagttgcaggggttcgtcgtgtacccttccctaaagtatctggtgctttggttgggaataacgaaacgatgggagctgaaactgaatcatcacaggaaaaacccgaacaagagaggccgaagcctactctctcacaggaacagtttctctcatggaagcgccacaaggacgctgcagtatcagccagaaaagccgaagtatccagtaagcgtgcagaagatattgctgcaggaactgtccaaatgaatggccgggagctatttttacatgagccatgggtgtttgataattcacgatattgaggtttcttactttcttttcattgcttcataattcataaaaactctttatggtcatgctttgagatattttatttttggatcaaaatcttttctgtaacaatatattttcgaaatatgaagtttgtacctttagcaaaggaaaggaaacaatgaaaagattgtttctatatgtcaccagggtggatctgtttcttaaaaatttgtgcattatgaacagctggaacataacaagttgttgtgtccatctagtgatgaatttcttctctgagataagacatttccatataggtgggcagttagatatcttctctgatattaacattacaaatttttaatttcattgctctttaaatatgctggagaggttttcgccagattcattagtacaagggtacctactatgtaccttttgttgtgtgaagtgtgaactacttatgaatatagttttttccacatgttgatttcttgattgattttacgagtacaa

SEQ ID NO: 5795 - DNA, 420 bp, Glycine max
gttgagaggccttgtagttgcaggggttcgtcgtgtacccttccctaaagtatctggtgctttggttgggaataacgaaacgatgggagctgaaactgaatcatcacaggaaaaacccgaacaagagaggccgaagcctactctctcacaggaacagtttctctcatggaagcgccacaaggacgctgcagtatcagccagaaaagccgaagtatccagtaagcgtgcagaagatattgctgcaggaactgtccaaatgaatggccgggagctatttttacatgagccatgggtgtttgataattcacgatattgagataattcaatgtcactcacaatttacttctttaacaatagtgtgtatattgtttacacaattttacaaataatgaaacttgagttatggcggttgtgggtaat

SEQ ID NO: 5796 - DNA, 1773 bp, Glycine max
gccttgtagttgcaggggttcgtcgtgtacccttccctaaagtatctggtgctttggttgggaataacgaaacgatgggagctgaaactgaatcatcacaggaaaaacccgaacaagagaggccgaagcctactctctcacaggaacagtttctctcatggaagcgccacaaggacgctgcagtatcagccagaaaagccgaagtatccagtaagcgtgcagaagatattgctgcaggaactgtccaaatgaatggccgggagctatttttacatgagccatgggtgtttgataattcacgatattgaggtttcttactttcttttcattgcttcataattcataaaaactctttatggtcatgctttgagatattttatttttggatcaaaatcttttctgtaacaatatattttcgaaatatgaagtttgtacctttagcaaaggaaaggaaacaatgaaaagattgtttctatatgtcaccagggtggatctgtttcttaaaaatttgtgcattatgaacagctggaacataacaagttgttgtgtccatctagtgatgaatttcttctctgagataagacatttccatataggtgggcagttagatatcttctctgatattaacattacaaatttttaatttcattgctctttaaatatgctggagaggttttcgccagattcattagtacaagggtacctactatgtaccttttgttgtgtgaagtgtgaactacttatgaatatagttttttccacatgttgatttcttgattgattttacgagtacaaacttttcgagatattataaagacattcatgtgccttcatctcataacttgatagtttaggctaattggtccttggcctggttttagaaaaaaatcacatgcctctatttaatgaccaagtgatcaatacttcaagacaaaataggtagacgtatgcatgtctatgcatccagtttaaattaaagctactcatgtgagggtgatattgtaggttaaactgtcatagttgttcaaccaagatcccttacacatttttaccctgttgctgaggcagtattccttaccttgagttgtgtttactatgcatttttttgtttagcacccttgacaattttgcaatgactagtgattacagggtgattaattaaaacccaagatttagttgtatattgatggatccaattgcaaggttcttatcatttattcccctaattgacatcaaaatagtattttctgcagttcttgccatagttaattgaacatataacatcaatcagcactacagcagtaatactgattcttttttttttttttttgctggccagataattcaatgtcactcacaatttacttctttaacaatagtgtgtatattgtttacacaattttacaaataatgaaacttgagttatggcggttgtgggtaatttagatgtattcttttattttccttgcaacatctccccccccccccccctccccctttactattttatattttaaaatttgatagaatactccgagcaatgtgtttgtgactagagaatgagagaaccaaatcttgaaatatttgttcatagtgatgagaacgtctagaaaataagaactatcaaaccaagatgctattattccattattggttataggttgcatcttgacacttgagtgaccttcccggacaattgaagagctagaatgataggattcagtgaacatgatcagcttcttcaacggtgctacttttcatgcaagaaaataa

SEQ ID NO: 5797 - DNA, 753 bp, Vigna unguiculata
agtccaaaactccaaagtcgaaaccctgtatgaacctgaagtgtctggcgaaacattggggagggaaatgggaatggcatggttgcagttgcagagaatcatcaccaaaggaggtgttaatttgatctcaacacttccacactcttcgccttgttcttcttctagattcttctctaaatcatccccctatatggtgaaggttggaataccagagtttctaaacggaattgggaaaggggttgagtcccacgttccaaagcttgaatccgaaatcggagatttccagaagcttcttgtcactcgcaccctcaagctcaagaagctgggtattccttgtaaacataggaagttaatattgaaatacacacacaagtacaggctgggattatggaggccacgtgttgagtccatcaaagcttgattgttctaaccagtaagcagttacagtttgttaggtcatattccaaatgtttagcagcagcagcagcagaatgacaatgctcgactttacatgaaaagatcaagtcactttctgtagagaccacagatcttttcaccacatttatctcttgcgcacagattttggtattttcaccagttatgtataatgaacttgtcttaatttacagttgttgtttgttatttcgtatctccggtgacatcattgcatgttatgtgatgcacaacttatttttagcgaaaagaatattgatgggcttaaatccaaagatgctattgcaatcttttgcagtc

SEQ ID NO: 5798 - DNA, 872 bp, Glycine max
tataaggcgtagttttgcatactccaaagtcgaaaccctgcacctgaagagcgagtgggagaggcagaaagaagagaaaaaaggggaatggcatggttgcagttgcagagaatcgtgaccaagggaggtgctaatttgatctcaccactcccactttcacgattcttctcgaaatcttcttccccctatgttgtgaaagttggaattccagagtttctaaacgggattgggaagggggttgagtcccacgttcctaagcttgaatccgaaatcggtgatttccagaagcttctcctcactcgcaccctcaaactcaagaagcttggcattccttgcaaacacaggaagttaatattgaaatacacacacaagtacaggctgggattatggaggccacgtgttgagtccatcaatgcctgattggtttctaattagtaagtagtcgctgtttgttagaccatattgcaaatgtttagccgcagcagaatgaaaagttcagctcactgtcttttaaggccacccatctttttcatcacattcatctctagtggacaaagtttggtttttgcaccggttatgtacaatggatttgtcttaattgacagtttgtgttagttatttcataattcatatcccgtgacatcattgcatattatgtaatgtatcagttgtttttagcgataagagtattgagggcttaggagtccgcaatgctttcatttatttcattgtagctgcgtttaaatccaaagatgctattgcagttttttgcatcccttattaattgttccgtgattgatcggatactgcatgataaaactagacattacttatctaatttgtggttgtcttggcaacttgcaacttccttc

SEQ ID NO: 5799 - DNA, 832 bp, Glycine max
caaagtcgaaaccctgcacctgaagagcgagtgggagaggcagaaagaagagaaaaaaggggaatggcatggttgcagttgcagagaatcgtgaccaagggaggtgctaatttgatctcaccactcccactttcacgattcttctcgaaatcttcttccccctatgttgtgaaagttggaattccagagtttctaaacgggattgggaagggggttgagtcccacgttcctaagcttgaatccgaaatcggtgatttccagaagcttctcctcactcgcaccctcaaactcaagaagcttggcattccttgcaaacacaggaagttaatattgaaatacacacacaagtacaggctgggattatggaggccacgtgttgagtccatcaatgcctgattggtttctaattagtaagtagtcgctgtttgttagaccatattgcaaatgtttagccgcagcagaatgaaaagttcagctcactgtcttttaaggccacccatctttttcatcacattcatctctagtggacaaagtttggtttttgcaccggttatgtacaatggatttgtcttaattgacagtttgtgttagttatttcataattcatatcccgtgacatcattgcatattatgtaatgtatcagttgtttttagcgataagagtattgagggcttaggagtccgcaatgctttcatttatttcattgtagctgcgtttaaatccaaagatgctattgcagttttttgcatcccttattaattgttccgtgattgatcggatactgcatgataaaactagacattacttatctaatttgtggttgtcttggca

SEQ ID NO: 5800 - DNA, 879 bp, Cajanus cajan
atagcaagttacagtaaaggtctttgttatgagttatgactaaacggcgtagttttgcagagtcccagctcgaactcgaaactccaaaccctgtacctgaacgcaagggttgaagcgaaacatgggaatggcatggttgcagttgcagagaatcatcaccaagatctcaccactcccacactctacgccttctagattcttctccaaatcatccccctatgttgtgaaggttggaataccagagtttctaagcggaattgggaatggggttgagtctcacgttgctaagcttgaatccgaaatcggtgatttccagaagcttctagtcactcgcactctcaaactcaagaagcttggtattccttgcaaacatagaaaattaattttgaaatacacacacaagtacaggctgggattatggaggccacgtgttgaatctatcaaagcctgattcgttttcaagtagtaagtagtcaatgttagaccatattgcaaatgtttagccgcagcagaatgataatgctcgactttacatgaaaagctcaagtcactcactggctttggagaccacctatctatttcatcacattcatcccttgtggacaaagtttggtatttacaccagttatgtacgatgatggacttgtcttaattgacagtctgtatttgttagtatttcatattcccggtgacatcatttcttgttttggcgaaaagaatattgagggcttaggagtcctccatgctttcatttatttcatgatagttgcggttaaatccaaagacactattgcaggcatatgttgtgcacgataaaagtagacattaattatataattaatggtagtcctagcacctagcaagttccactttgaataa

SEQ ID NO: 5801 - DNA, 657 bp, Cyamopsis tetragonoloba
gcattcgtactcggagctcgcagcgaggttttcagttgaagccaaagcagcaatatgaatataggtatggtgtggttgcagttgcagagaatcatcggaaagggaggttcaaatccgatctcaacactccctcactattcttcttctagattcttctccaaatcatcgccttacgctgtgaaggttggaatcccagagtttttgaatggaatagggaacggtgttgagtcccatgccgctaagcttgaaaccgaaatcggtgacttccagaagcttcttgttactcgcactctcaaactcaagaagctcggcattccttgcaaacataggaagttgatattgaaatacacacacaagtacaggctgggattgtggaggccacgtgctgaacccatcaaagcctaattgatttctgtgtagtaagtagcctttcttttcaagaccatatagtaaatatttagctatggcaggatgacaatgcttgatgttgcatgcaaatcattgactttggataccttccatctttttctcacattgatctcttgaagacaaaatttggtatttacaccagtttatgtacaatggacttgtcctaattgaaagtctgtgtttggtttttcataccttaagcgatatcattgatttcctgggttgtaa

SEQ ID NO: 5802 - DNA, 642 bp, Vigna unguiculata
gtatttgagaaaacgttgaagagaaaaatgggaatagcatggttgcagttgcagagaatcatcaccactccttgttcttcttctagattcttctccaaatcatcaccctatgttgtgaaggttggaatacccgagtttctaaatggaattgggaaaggggttgagtcccacgttcctaagctcgaatccgaaatcggagatttccagaaccttcttgtcactcgcaccctcaagctcaagaagctcggtattccttgcaaacataggaagttaatattgaaatacacacacaagtacaggttgggattatggaggccacgtgttgagtccatcaaagcttgattggtttctaaccaatacgtagtcactgtttgttaggtcatatttcaaatgtttagcagcagcagcagaatgcaatgctccactttacgatgctttcatatggttaagcagttaagcaggctgcggttaaatccaaagattctattgcaatctattgcagtctgacattaattgatgaacaattgattcagtactatgtgcagcatgatagaactaggtattattaataaggtattattaataaggatatgttcttagctatataagccatcaaatcttctaattgaaagttgattatgg

SEQ ID NO: 5803 - DNA, 913 bp, Glycine max
ctagaacgatgtcgtttattatgacggcgtagttttgcatagtcgaaagtcaaaaccctgcacccgaaggctgaagcgagtgggagaggcagcaagaagagaaaaaggggaatggcatggttgcagttgcagagaatcatcaccaataccaagggaggtgctaatttgatctcaccgctcccacgattcttctcgaaatgttccccctatgttttgaaagttggaataccagagtttctaaacgggattgggaagggggttgagtcccacgttcctaagcttgaatctgaaatcggtgatttccagaaacttctcgtcattcgaacccttaaactcaagaagctcggtattccttgcaaacataggaagttaatattgaaatacacacacaagtacaggctgggattatggaggccacgtgctgagttcatcactgcctgattggtttctaagtagtaagtagtcgctgtttgttagaccatattgcaaatgtttagccgcagcagaatgacaatgctctacttgaaaagatcaagtcgcactgtctttggagaccacccatcttttccatcacattcatctcttgtggacaaagtttggtttttgcaccagttatgtaatgtacaatggacttgtcttaattgacagtttgtgtttgttatttcataattcatatcccgtgacatcattgcatattatgtaatgtatcacttgtttttagccaaaagaatatttcgggcttaggagtccgcaatgctttcatttacttcatgatagctgcggttcaatccaaagatgctgttgcagtttttttgcatcccttattagttgttccatgattgaccggatactctgttgtgcatgataaaactagacattatttatctttgtggttgtcttagctattagcaat

SEQ ID NO: 5804 - DNA, 892 bp, Glycine max
tgacggcgtagttttgcatagtcgaaagtcaaaaccctgcacccgaaggctgaagcgagtgggagaggcagcaagaagagaaaaaggggaatggcatggttgcagttgcagagaatcatcaccaataccaagggaggtgctaatttgatctcaccgctcccacgattcttctcgaaatgttccccctatgttttgaaagttggaataccagagtttctaaacgggattgggaagggggttgagtcccacgttcctaagcttgaatctgaaatcggtgatttccagaaacttctcgtcattcgaacccttaaactcaagaagctcggtattccttgcaaacataggaagttaatattgaaatacacacacaagtacaggctgggattatggaggccacgtgctgagttcatcactgcctgattggtttctaagtagtaagtagtcgctgtttgttagaccatattgcaaatgtttagccgcagcagaatgacaatgctctacttgaaaagatcaagtcgcactgtctttggagaccacccatcttttccatcacattcatctcttgtggacaaagtttggtttttgcaccagttatgtaatgtacaatggacttgtcttaattgacagtttgtgtttgttatttcataattcatatcccgtgacatcattgcatattatgtaatgtatcacttgtttttagccaaaagaatatttcgggcttaggagtccgcaatgctttcatttacttcatgatagctgcggttcaatccaaagatgctgttgcagtttttttgcatcccttattagttgttccatgattgaccggatactctgttgtgcatgataaaactagacattatttatctttgtggttgtcttagctattagcaat

SEQ ID NO: 5805 - DNA, 589 bp, Medicago truncatula
agaaaaacggcttcagataccctaatcatctttctcgtgcgatctccgccgccgtgcacttcccgtccggccaagccacgtcattccggtgctctctcgcccatcactcgctcaccgccaccccggtcctccttatacttccagtttctggttgaccgctgataccatcttttgtttgggttttccctttgctttataggttgaagatcgaaagcaatatggcaatgtcgttatggttgcagatgcacagagtcataagaaacggaagtgttaatttgatttccacacacccacattcttcggcttacttttcttcgagatcctactccaaatcaacaccatacgttgtcaaggttggaataccggaatttcttaatggaattggaaagggagtcgaatctcatgtcgctaagctcgattctgaaattggtgacttccagaagcttctggttactcgaaccctcaaactcaagaagcttggtattccttgcaaacataggaagctaatattgaaacatgcacacaagtacaggcttggattatggaggccacgtgctgagccgatcaaagcatgatttgtttctatgta

SEQ ID NO: 5806 - DNA, 789 bp, Medicago truncatula
aaacggcttcagataccctaatcatctttctcgtgcgatctccgccgccgtgcacttcccgtccggccaagccacgtcattccggtgctctctcgcccatcactcgctcaccgccaccccggtcctccttatacttccaggttgaagatcgaaagcaatatggcaatgtcgttatggttgcagatgcacagagtcataagaaacggaagtgttaatttgatttccacacacccacattcttcggcttacttttcttcgagatcctactccaaatcaacaccatacgttgtcaaggttggaataccggaatttcttaatggaattggaaagggagtcgaatctcatgtcgctaagctcgattctgaaattggtgacttccagaagcttctggttactcgaaccctcaaactcaagaagcttggtattccttgcaaacataggaagctaatattgaaacatgcacacaagtacaggcttggattatggaggccacgtgctgagccgatcaaagcatgatttgtttctatgtagtaagtagcctttcgttgtgaaatcatattggaaatgtgtagccattttagaaggacagggctcgactttgcatgaaaataggaagtttttggctctggatacctcccatcctttttcatcacattaatatttgtcatttgcaccagtcaagaacgctgggttaatcttaattgctgtttgtgatttcacatgtctaataatttcactgcattttttgtcttgtatcactcttggcaaaagagattaacttggggatta

SEQ ID NO: 5807 - DNA, 1291 bp, Cicer arietinum
tcactcaatttaactttaacacgagagaccgaggatattaaggaaacaatgcaggggtataatatatttttgtggggtacatttaacaattattcgttatgattagtgggccaaaatgtaaatttgggccgtcatagcaagaccttatgaaagatcaacatatcgaaacgacgtggtttactataacagaacgtcgtttagtttaacggcggggttttgaactccatataccctggtttagcctccggcgtcgaaagacaagcaatattagggtgaaagatcaaaatcaacatggccacggcatggttgcagttacagagagtcctcagaaacggaggtgttaattcaatctccacactcccgccttcttcgaattacttctcttctagatccttttccaaatcaacaccctacgttgtcaaggttggaataccggagtttttaaccggaattggaaatggagttgaatctcatgttgctaagcttgattccgaaattggtgacttccagaagcttcttgaaactcgaacacttaaactcaagaagctcggtattccttgcaaacataggaagctaatattgaaatatgcacacaagtttaggctgggattatggaggccgcgtgagcccatcaaagcatgattagtttctatgtagtaagtagccttttgttgtgaaaaaccatattggaaatgtttagccagtgcagataacagttcttgactttacatgaaaagaggaagtcattggctctggatacctccgatcctttttcatcacattgacgtttgtcatttgcaccagtcaagtacaatggacttattttagtttgactcttttttattgtcatttcatatctccagcgatatcatttcattttcttttttaaagccaataaattcacggccttttttgtttttgcaaaaagagaattaactgagggctagaagttcacttgtgttgtatcccatccttccctgtatgcagcaatggtttttgtgagttgcttggcagagttaaatacaatgaattatctgaacttgaatatgtttaagtagaagcccatttgctaataagatttgagatgtttctttcagttatggttctgattgacatatgcaaataatttgttatcttatgaatcaacaacacttcaatagccaaaaattaaccaagaactgaaattaaaccactcaagcattttgccctctgcatggggccactgacacagccgactagagagtaataccgactccgattggttttgatggtcatactggagaatcgggag

SEQ ID NO: 5808 - DNA, 773 bp, Trigonella foenum-graecum
tgcgatcgtcgccgccgtgccaagccacgtcattccggtgctccttcctccgtcactcgctagccgccacgcctgtcatctttacacttccaggttgaagatcgaaagcaatatggcaacattatggttgcaaatgcagagagtcataagaaacggaagtgttaatttgatctccacacacccgcactcttcgtcttacttttcttctagatcctactccaaatcaacaccctacgctgtcaaagttggcataccagaatttctaaatggaattggaaaaggagtggaatctcatgtcgctaagcttgattccgaaattggtgacttccagaagcttctggttactcgaactctcaaactcaagaagctcggtattccttgcaaacataggaagctaatattgaaacatgcacacaagtacaggctgggattatggaggccacgtgctgagccgatcaaagcatgattagtttctatgtagtaagtagccattcagaatgtcagtgcttgactttgcatgaaaaaaggaagttataggctatgggtacctcccatcttttttcatcatatttatgtttgtcattggcaccggtcaagtacaatggactaatcttaattgactgtttgtgattgttatgtccaataattatactacattttttgtgctgtatcacttgtttttggcaaaacagaatttaactttgggcttaggcgttcgcaatggttaattttttagatgcggttaaatctaatgatgctcttccagcctttct

SEQ ID NO: 5809 - DNA, 1019 bp, Vigna unguiculata
gggaaaacacaagaagtatctgttggcatttattatctgaattaaaaatggcgtaagtattcaattttagtaaattggtgcaaagctatgtaatgtgaacagtgaagcaagcatagcagtgagcaagctcagcgacattagaaagaaagggagaacccatttttctctctgtttttaggtttcttctttctttcttttgcatctccaagaaaaaaaaaatcatgggttcaaccaatctagtactctcctcaaccctgttgctccttctggtcggttttgcaaactccgacatcacccaagacaaagcagattgtacggataaactgattggtctcgctggttgtctcacctacgccagcggcgacgcctcagctcccaccatggattgttgctctggtctcaaacaagttatcgacaagaacaagaggtgtctctgcatcctcatcaaggatcgtaacgacccaagtctcggcctcaagatcaacgtcaccctcgctcttaacctcccagaagtttgcaaaacacccaccaacataactcagtgtgttgatcttttgcatttgccacctaactcccccgacgccaaggtgtttgaaggctttgaaaaagccttgaccaacaaaactagcccctcttccgcccctgctggttctgcaaagggagaaacattaagtggtaatagcaagagtggagggtggggaaagaagtggttggtgacagaagtggtatgtggaattttacccttagtgttagtatcccatttggtgttgttcctggtgtgaaggttgaagatggaaatggaaggttggtagttgtgtgttttaatgttatgtggtttcatgttttgtgcatagatatgttgaggatgcaatatgtaatttgttgctactagtagctacctaggtggtgtgttgtccttttcctctagttattattatcttcagtgtgtgcccatcttcttttgtttctcggtgattaattttccaactaatggaaccattcagagggaccctttaatt

SEQ ID NO: 5810 - DNA, 911 bp, Glycine max
aaaaaaaatcatgtttatttttaaattatattttagttttatttgtacttttcataactaagaccaccatcatgaacgagggttaagaaaaaaaaaaaaaacacaacgtcacctgtgcgttcctggaatggtacatcagcagagggttctcttctgttctggttaggttatgctctatgcaaaacagtgccatggaagcctccaaactcagtagcagtgatcaaaacgttcgatgccatcactgcgcaggacccctttccaaagacatggaaaccagtcactggaccgtttcgcctctcattagggatagcttctccatgattggttctgccgttggcggcgttgcaagtgcattttatggattcaatcttgttatgccgattgtccaaagaaggatcaaaggacccatgtggttgcattttctcataggtgcaccacctgtgatagtattctcttcagcctgtgccggactggcgggtggggctgttcctgctgcagcacaacttgtttcctcatcttatcatgcagcttactcttctcctacctcacctccgccatcaaaggatgaaaatattcaaaggtcgagaaaatgatataatggacttctgagtctgaccattcattcatgatgggtgtgctgagagttttgtttttcttgtgtaaatactactctgagattggtatgtttggaacttggatgagaggaaagataatagtaaggagaaaaaacacatatgatgcattttattttgtttgattaaagtgaaagtgaaagatagatagagaaaaaaagtttattgtacttttgttttgcatacactgcgttcttgtttattggatgcaataaaataacaaatcgttggcagtttggttatttttgaaacataaatgatcatttttataatttttaa

SEQ ID NO: 5811 - DNA, 820 bp, Glycine max
accatcatgaacgagggttaagaaaaaaaaaaaaaacacaacgtcacctgtgcgttcctggaatggtacatcagcagagggttctcttctgttctggttaggttatgctctatgcaaaacagtgccatggaagcctccaaactcagtagcagtgatcaaaacgttcgatgccatcactgcgcaggacccctttccaaagacatggaaaccagtcactggaccgtttcgcctctcattagggatagcttctccatgattggttctgccgttggcggcgttgcaagtgcattttatggattcaatcttgttatgccgattgtccaaagaaggatcaaaggacccatgtggttgcattttctcataggtgcaccacctgtgatagtattctcttcagcctgtgccggactggcgggtggggctgttcctgctgcagcacaacttgtttcctcatcttatcatgcagcttactcttctcctacctcacctccgccatcaaaggatgaaaatattcaaaggtcgagaaaatgatataatggacttctgagtctgaccattcattcatgatgggtgtgctgagagttttgtttttcttgtgtaaatactactctgagattggtatgtttggaacttggatgagaggaaagataatagtaaggagaaaaaacacatatgatgcattttattttgtttgattaaagtgaaagtgaaagatagatagagaaaaaaagtttattgtacttttgttttgcatacactgcgttcttgtttattggatgcaataaaataacaaatcgttggcagtttggttatttttgaaaca

SEQ ID NO: 5812 - DNA, 861 bp, Glycine max
tttatgttttatttattctttttaaagttgtctttccaaatttatccttctaccttctccgaagctccaccgtcttcgatcacaacgactccaagtcccgccctccctcctccaccatcctttttatttgttctggctaggttatgcgctatgcaacacagtgccatggaagcctccaaattcagtaacagtgatcaaaacgttcgatgccatcactgcgcaggacccctttccaaagacatggaaaccagtcactggaccgtttcgcctctcattagggatagcttctccatgattggttctgccgttggcggcgtggcaagtgcattttatggattcaatcttgttatgccaattgtccaaagaaggatcaaaggacccatgtggttgcattttctcattggtgcaccacctgtgatagtattgtcttcagcctgtgcaggcctggcaggtggggctgttcctgctgcagcacaacttgtttcctcttcttatcatgcagcctactcatctcctatctcacctccgccatcaaaggatgaaaatattcaaaggtcaagaaaatgatataatggacttgtgtctgaccatgcattcatgatgggtgtgctgagagttttgtttttcttgtgtaaatactgctcttgagattggtatgtttggaacttgaatgagaggaaagatagtagaaaagagaaaaaacacgtataatgatgtattttattttgtttgattgaagttaaagtgaaagatagacagaaaaaagtttattgtactcttgttttgcattcaccgcgttcttgcttttggatgcaataaaataacaaatcgttggcagttttgttatttttgaaacataaa

SEQ ID NO: 5813 - DNA, 968 bp, Glycine max
agtttgagatggctgagactttttatttttatttttatgttttatttattctttttaaagttgtctttccaaatttatccttctaccttctccgaagctccaccgtcttcgatcacaacgactccaagtcccgccctccctcctccaccatcctttttatttgttctggctaggttatgcgctatgcaacacagtgccatggaagcctccaaattcagtaacagtgatcaaaacgttcgatgccatcactgcgcaggacccctttccaaagacatggaaaccagtcactggaccgtttcgcctctcattagggatagcttctccatgattggttctgccgttggcggcgtggcaagtgcattttatggattcaatcttgttatgccaattgtccaaagaaggatcaaaggacccatgtggttgcattttctcattggtgcaccacctgtgatagtattgtcttcagcctgtgcaggcctggcaggtggggctgttcctgctgcagcacaacttgtttcctcttcttatcatgcagcctactcatctcctatctcacctccgccatcaaaggatgaaaatattcaaaggtcaagaaaatgatataatggacttgtgtctgaccatgcattcatgatgggtgtgctgagagttttgtttttcttgtgtaaatactgctcttgagattggtatgtttggaacttgaatgagaggaaagatagtagaaaagagaaaaaacacgtataatgatgtattttattttgtttgattgaagttaaagtgaaagatagacagaaaaaagtttattgtactcttgttttgcattcaccgcgttcttgcttttggatgcaataaaataacaaatcgttggcagttttgttatttttgaaacataaataatcatttttatttctatctggtaatcatttatagtttggttcaataaagtttaatatcaaataatggctcaa

SEQ ID NO: 5814 - DNA, 767 bp, Cajanus cajan
atagagaaagttaaggagtatcctattaatgtgtttgataatgaagatgaagtgtgtgtgttgggttgggttaggttaggttaggttaggttattgtatgccatgagcatggaagcctccgaactgagcagcagtagtgaagacattcgatgccatcactgcgcaggacctctctccaaccagatggaaaccactcactggaccgtatcgcctcttatcagggatagcttttctatgattggttctgcggttggcggcactgcaagtgcattttatggattcaatctcgttatgccggttgtccagagaaggataaagggacccatgtggttgcattttctcattggtgcaccaccagtgatagtattctcttcagcttgtgcaggactggcaggtggggctgttcctgctgcagcacaacttgtttcctcgtcttataatgcagcatactcaacttctaccttacctccgccatcaaaggatggaaatattcaaaagtcaagaaaatgatataatatgctttcattctctgatcacgcattcatgatgagtgtgctgagagttttgtttttcatgtgtaaatactgctcttgaactcagtatgtttggatgagaggaaagataatagaaagggaaaaaaatacatagataacaatgttttttattttgtttgactgaagaggatgtaaaagaaaaataaagaaaaaaagttgatttctatattttttttattacttttcaattcaaaatttaaagttttacccccc

SEQ ID NO: 5815 - DNA, 2641 bp, Glycine max
attctgcatccatggaccaggttggaattggaagctcttctatctatctctattctctagtctttttcgcacaagtcatttctttctacttccattcaccataacgaaactgcaagctactagtacatacatacatgattcatctctctcacactctctaattttctctctctgtcccctaccactacacaaaacactcatccaatataatattctttttatctcaagcggtggaacactcttctccaccagtaccaccatccatcttcttcttcttcttctgtccaccatacatagtatttggctatttgtattatttatcatgttcattgcgcagtgaaaatttggaagtgttttgagtttggcatcttctgatgctgcttcatttataattattgtcatcaagtttcagtctcattctggatcagtgagctgattctcttaatgtcaagataaaaaaaacaacaacaaaggtttgatctttaattacccgaagcaattgatcacagtttcaatgaatttgtctatgaaatttgacaattgggtatgagtggtagtttcagatttttagcatagcttgaaaacatgaacagaagaagtgttaggactaggaaagctccaattccgattcagtagcacatgaaaaaaaagtaattgaagtttggtatagtcagaagtcagaaaagggtacattcatgtcgtttgtgtgtttgaaaaacagtttgtacagtaatagcccgagctcattatttttattattaaagtatctgaggagagtatcagctttctaattcacaaactctggcttcagtttcaatgagataaaaaaaaaggtagatgatgcagggaagcttgagaaatgcaaataaaagtggaaaagcttctagcagagaaagaaaattggctttgcaacaagatgtggataggttgaagaagcagcttaggcatgaagagaacattcatagagcattggagagggctttcaacagacccttgggagctttgcctcgtcttccgccttatctccctccctatatactagcccttctggctgaagtggcagttctagaagaggaaattgttaggcttgaagagcaggttgtgcatttcagacaggatttgtaccaggaagctgtctacatgtcatcttctatgaggaaattggaaaattcagtttcagctcctccaaacaagtcaaatccaacattagatagtcccaagttggataaattgaagtctcttacccaaacagctggtaattcaacagcaacatctgaaactaagcctaccacaacactcactgaggatagacaagggaaagagaatcaatcatgtactaattcttccaagagcaggcagcaatcatccaatcaaatgaacaaaactccaattaaaaacattgacagtaaatcattgcagaaaaggttggatcatccaaaaagaaagcaagaaccaagggtgaacaaccagcaaattgcagatgtaagaaatcatagtccacataaaaattcaccagaagctcagagtccaaatataatttcagaaaatattctgaagtgcttatcaaacattctcttgagaatgagtgccgtgaagaatccaggttctacatgtgacatggcacccttgtgggatctaaagcctcaaaactgtgatgaagaagcagatttttgggatccatatggcatctgtttggaatttgggaagagggatattggtccatacaggcaattatgtgcaattgatgccaaatctttcaatccaaaacgaactgcaaatactttatttttactacatcggttgaaactactttttaggaaagtagcctctgtcaacttggaaaacctcaaccatcaggagaagcttgcattctggatcaacatctacaattcgtgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggaaatttacgttttccaagggaacaaaaaatcatcaaatgacagcaagaagcatatatggactggaactgtcagaaccccttgtgacatttgctctctcttctggaacttggtcctctcctgctgtgagagtttacacagcatcccaggttgagaatgaactagaagtggccaaaagagagtacttacaggcagcaattggattttcaacttcaaagtttgctatcccaaagctgctggattggtatttgctgaactttgcaaaagacttggaatcattgctggattggatctgtctccagttaccaagtgaactggggaaagaagccattaaattccttgaggaaagaaaaaccgagcccttatcacaatttgtacaaattatgccatatgagttcagctttagatacttgatatgcacataatttcaccctcgttttctgtacattgcttcattgcaattttgtatacaacagtagatcatacatataaaaatgtacatgatcatctgttctctactccctttgggagaaatgttcagattccttcttaactaaagtgaataaaacaatcattgcataacctatggaatttgaacta

SEQ ID NO: 5816 - DNA, 1806 bp, Cajanus cajan
aatgtagatgatgaagggaagcttgagagttgcaaataaaagtggaaaagcttctagcagagaaagaaaattggctttgcaacaagatgtggataggttgaagaagaagcttaggcatgaggagaacatccacagggcattggagagggctttcaatagacccttgggagctttgcctcgtcttcctccttatctccctccctatatactagcccttctggctgaagtggcagttctggaagaggaaattgtgaggcttgaagagaaggttgtgcatttcagacaggatttgtaccaggaagctgtctacatgtcatcttcaatgaggaaactgcaacattcagtttcaccttctccagacaagtcaaatacaacaatggatagtcccaagttggataaattaaagtctcaatctggtaattcagcaacaacatctgcaactaggtctaccacaacactcactgaggatagacaagggaaagacaatcaatcctgtagtaattcttccaagagcaggcagcaatcctccaaccaaattaaaaaaactccaattaagaatattcattttgacaataaatcactgcagaaaagatgggatcatcctaaaaggaagcaagaaccaagggtgaacaaccagcaaattgcagatgtaagaagtcatagtgcacataaaaattcatcagaggctgagagtccaaatataatttcagaaaatattgtaaagtgcttatcaaacattctcttgagaatgagtgctgtgaagaatccaggttctgcaagtgacatacgacccttgtgggatctaaaacctcaaaactgtgatgaaggagcagattttggggatccatatggcatctggttggaatttggaaagagggatattggtccatacaagcaactatgtgcaattgatgctaaatctttcaatccaaaacgaactgcaaatactttgtttttactacatcggttgaaacttcttttaaggaaactagcctctgtcgacttggaaaacctcaatcatcaggagaagctcgcattctggatcaacatctacaactcgtgtatgatgaatacattcatagagaatggcatacaagagagtcctgaaatggctgttgcacttatgaggaaggcaacaataaatgtgggtggacacgtgctaagtgcaacaaccatagagcatttcattttaagacttccttatcactggagatttacgttttccaagggaacaaaaaatcatgaaatgacagcaagaagtatgtatggactggagctgtcagaacccttagtcacatttgctctctcttgtggaacttggtcttctcctgctgtgagagtttacacagcatcccaggttgagaatgaactggaagtggccaaaagagagtacttacaggcagcagttggaatttcagcttcaaagtttgctatcccaaagctgctggattggtatttactgaactttgcaaaagacttggaatcattgctggattggatctgtctccagttaccaagtgaactgggtaaagaagccattaaattccttgaggaaagaaaaactgagtccctctcacaatttgtgcaaattatgccatatgagttcaactttagatatttgatatgcacataatttcactccagttttctgtacattgctctattgcaattttgtatacatctgtagatcatacataataaaaatgtagatgatcatctgttctctcctcccattgggggtaaaaatgctcagattccttcttatcaatgaaacaatcacaatataaccggtggaatttgaactta

SEQ ID NO: 5817 - DNA, 1755 bp, Glycine max
tgatgcagggaagcttgagaaatgcaaataaaagtggaaaagcttctagcagagaaagaaaattggctttgcaacaagatgtggataggttgaagaagcagcttaggcatgaagagaacattcatagagcattggagagggctttcaacagacccttgggagctttgcctcgtcttccgccttatctccctccctatatactagctcttctggctgaagtggcagttctagaagaggaaattgttaggcttgaagagcaggttgtgcatttcagacaggatttgtaccaggaagctgtctacatgtcatcttctatgaggaaattggaaaattcagtttcagctcctccaaacaagtcaaatccaacattagatagtcccaagttggataaattgaagtctcttacccaaacagctgaggatagacaagggaaagagaatcaatcatgtactaattcttccaagagcaggcagcaatcatccaatcaaatgaacaaaactccaattaaaaacattgacagtcaatcattgcagaaaaggttggatcatccaaaaagaaagcaagaaccaagggtgaacaaccagcaaattgcagatgtaagaaatcatagtccacataaaaattcaccagaagctcagagtccaaatataatttcagaaaatattctgaagtgcttatcaaacattctcttgagaatgagtgccgtgaagaatccaggttctacatgtgacatggcacccttgtgggatctaaagcctcaaaactgtgatgaagaagcagatttttgggatccatatggcatctgtttggaatttgggaagagggatattggtccatacaggcaattatgtgcaattgatgccaaatctttcaatccaaaacgaactgcaaatactttatttttactacatcggttgaaactactttttaggaaagtagcctctgtcaacttggaaaacctcaaccatcaggagaagcttgcattctggatcaacatctacaattcgtgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggaaatttacgttttccaagggaacaaaaaatcatcaaatgacagcaagaagcatatatggactggaactgtcagaaccccttgtgacatttgctctctcttctggaacttggtcctctcctgctgtgagagtttacacagcatcccaggttgagaatgaactagaagtggccaaaagagagtacttacaggcagcaattggattttcaacttcaaagtttgctatcccaaagctgctggattggtatttgctgaactttgcaaaagacttggaatcattgctggattggatctgtctccagttaccaagtgaactggggaaagaagccattaaattccttgaggaaagaaaaaccgagcccttatcacaatttgtacaaattatgccatatgagttcagctttagatacttgatatgcacataatttcaccctcgttttctgtacattgcttcattgcaattttgtatacaacagtagatcatacatataaaaatgtacatgatcatctgttctctactccctttgggagaaatgttcagattccttcttaactaaagtgaataaaacaatcattgcataacctatggaatttgaacta

SEQ ID NO: 5818 - DNA, 2364 bp, Glycine max
attggaggcttccatgatattgattattgaatctgagaagcaagctgtgtcttattctgcatccagggccaggttggaattggaagctcttctatctatctctattttctattctctagtctttttctcacaacctgccatttctttctacttccattcaccataacgaaacgccaagctactagtaccttacacgattcatctctctctcatacactctatttttctctctgtcccctaccactctttcaaaataatattcttttttatctcaagcggtggaacactcttctccaccagtaccaccatccttcttcttcttcttctctccaccatatatagtatttgactatttgtaatattcatcatgttcattgtgcagtggtgaattgaagtgtttgagtttggcatcttctgatggtgctttatttataattattgtcatcaagtttcagactcattctggatcactgagttgattctcttaatgtcaagataaaaaaaataaaagagaaggtagatgatgcatggaagcttgagaaatgcaaataaaagtagaaaagcctctagcagagaaagaaaattggctttgcagcaagatgtggatacgttgaagaagaagctaaggcatgaagagaacattcatagagcattggagagggctttcaacagacctttgggagctttgcctcgtcttccgccttacctccctccctatataccagcccttctggctgaagtggcagttttggaagaagaaattgtaagacttgaagagcaggttgtgcatttcagacaggatttgtaccaggaagctgtctacatgtcatcttctatgaggaaattggaaaattcagtttccgctcctcctaacaagtcaaatccaacaatggatagtcccaagttggataaattgaagtctcttacccaaacaactggtaattcaacagcaacatctgcaactaagcctaccacaacactccctgatgataatagacaagggaaagagaaccaatcctgtactaattcttccaagagcaggaagcaatcctccaaccaaacgaacaaaactccaattaaaaaaattaacaatcaatcactgcagaaaaagttggatcatccaaaaaggaagaaagaaccaaaggtgaaaaaccagcaagttgcagatgtaagaaatcatagtccacataaaaattcaccagaagctcagagtccaaatataatttcagaaaatattctaaagtgcttatcaaacattatcttgagaatgagtgccttaaagaatccaggttctacatgtgacatgccacccgtgtgggatctaaaacctcacaaccgtgatgaaggaacagagtttggggatccatatggcatctgtttggaatttgggaagagggatattggtccatacaagcaattatggtcaattgatgttaaatctttcaatccaaaacgaactgcaaatactttgtttttactacatcggttgaaactactttttaggaaactagcctcggtcaacttggaaaacctcaaccatcaggagaagcttgcattctggatcaacatctacaactcttgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggagatttacattttccaagggaacaaaaaatcatgaaatgaaagcaagaagcatatatggaatggaactgtcagaacccctagtgacatttgctctctcttctggaacttggtcctctcctgctgtgagagtttacacagcatcccaggttgagaatgaactggaagtggccaaaagagagtacttacaggcagcaattggattttcaacttcaaagtttgctatcccaaagctactggattggtatttgctgaactttgcaaaagacttggagtcattgctggattggatctgtctccagttaccaagtgaattggggaaagaagcccttaaattccttgaggaaagaaaaaccgagcccttatcacaatttgtacaaattatgccatatgagttcagctttagatacttgatatgcacataatttcactcccttttggccattgcaattttgtatacagcagtagatcatacatataaaaatgtacatgatcatcttttctctactccctttgggagaaatgttcaggttccttcttttaactaaagtgaataaaagaatcattgtataacatggaatttgaactatgtaagtggctctatttggataaaattctcatttagtacataaaggaa

SEQ ID NO: 5819 - DNA, 2295 bp, Glycine max
gtgtcttattctgcatccagggccaggttggaattggaagctcttctatctatctctattttctattctctagtctttttctcacaacctgccatttctttctacttccattcaccataacgaaacgccaagctactagtaccttacacgattcatctctctctcatacactctatttttctctctgtcccctaccactctttcaaaataatattcttttttatctcaagcggtggaacactcttctccaccagtaccaccatccttcttcttcttcttctctccaccatatatagtatttgactatttgtaatattcatcatgttcattgtgcagtggtgaattgaagtgtttgagtttggcatcttctgatggtgctttatttataattattgtcatcaagtttcagactcattctggatcactgagttgattctcttaatgtcaagataaaaaaaataaaagagaaggtagatgatgcatggaagcttgagaaatgcaaataaaagtagaaaagcctctagcagagaaagaaaattggctttgcagcaagatgtggatacgttgaagaagaagctaaggcatgaagagaacattcatagagcattggagagggctttcaacagacctttgggagctttgcctcgtcttccgccttacctccctccctatataccagcccttctggctgaagtggcagttttggaagaagaaattgtaagacttgaagagcaggttgtgcatttcagacaggatttgtaccaggaagctgtctacatgtcatcttctatgaggaaattggaaaattcagtttccgctcctcctaacaagtcaaatccaacaatggatagtcccaagttggataaattgaagtctcttacccaaacaactggtaattcaacagcaacatctgcaactaagcctaccacaacactccctgatgataatagacaagggaaagagaaccaatcctgtactaattcttccaagagcaggaagcaatcctccaaccaaacgaacaaaactccaattaaaaaaattaacaatcaatcactgcagaaaaagttggatcatccaaaaaggaagaaagaaccaaaggtgaaaaaccagcaagttgcagatgtaagaaatcatagtccacataaaaattcaccagaagctcagagtccaaatataatttcagaaaatattctaaagtgcttatcaaacattatcttgagaatgagtgccttaaagaatccaggttctacatgtgacatgccacccgtgtgggatctaaaacctcacaaccgtgatgaaggaacagagtttggggatccatatggcatctgtttggaatttgggaagagggatattggtccatacaagcaattatggtcaattgatgttaaatctttcaatccaaaacgaactgcaaatactttgtttttactacatcggttgaaactactttttaggaaactagcctcggtcaacttggaaaacctcaaccatcaggagaagcttgcattctggatcaacatctacaactcttgtatgatgaatgcattcatagagaatggcataccagagaatcctcaaatggctgttgcactaatgcggaaggcaacaataaatgttggtgggcacgtgctaagtgcaacaaccatagagcatttcattttaagacttccttatcactggagatttacattttccaagggaacaaaaaatcatgaaatgaaagcaagaagcatatatggaatggaactgtcagaacccctagtgacatttgctctctcttctggaacttggtcctctcctgctgtgagagtttacacagcatcccaggttgagaatgaactggaagtggccaaaagagagtacttacaggcagcaattggattttcaacttcaaagtttgctatcccaaagctactggattggtatttgctgaactttgcaaaagacttggagtcattgctggattggatctgtctccagttaccaagtgaattggggaaagaagcccttaaattccttgaggaaagaaaaaccgagcccttatcacaatttgtacaaattatgccatatgagttcagctttagatacttgatatgcacataatttcactcccttttggccattgcaattttgtatacagcagtagatcatacatataaaaatgtacatgatcatcttttctctactccctttgggagaaatgttcaggttccttcttttaactaaagtgaataaaagaatcattgtataacatggaatttgaactatgtaagtggctctatttggataaaa

SEQ ID NO: 5820 - DNA, 1263 bp, Vigna unguiculata
gcaggggcagtgaaagaatagagtagaaaaaaatgatcagacgaaggttatctgttctctcaacgtcaatcatcagaagctcaactcatagcaaacccatactcagatgcccatctatccaatttcaaccctttcaactccctcattctcctaatgctcatcgaaaaattagttgttatgaattcccagattttcaaggctttagagcgtacagtcttctgagcttgaatgatttgagagataaggttcccaggaagcagccaacaaggaaggggcgtgggattgggtctggaaagggtaagactgctgggaggggtcacaagggtcagagagctagaaaaggtataaaattgggttttgaaggaggtcagacccctcttcgcagaagagtacccaaacgtgggttcaagaacccatttagcctaacttttcagccaataggtttgggtaaaattgcaaagtttattaatgctgggaagatagattcttccgaattgattacaatgaaaacactcaaggatgcaggggtacttgggaagcaatcgaaagatggagtgagattgatggggcgtggttcagagcagatcaagtggccaattcatctagaggtatcaagggttactgttagggctaaggaagcagttgaagcagctggtgggtctgtgagaagggtgtattacaataagttgggcttgagggcactgctgaagcctgagtggtttgaaaagaaaggaagattgttgcctaaagcagctagacctcctccaaagcaaaaggataaagttgatagcattggtcggttgccagcaccaacaaagccaattccatttttagttgaaacaaccaaggatcttccagttcagccatttagttaaactattttcaaaaaattttgtaattctctatggtgcaagtctggctcacaagtttttcatgcagttcatgcaattcagaattagataaatgaattccttggggacaaaggaaagggaaaatcttgtttattatttttatttgttttaaggatttgatctttgtcactcagttgaaaagagccttaggttattgtctctgtgctgggaatagaatcttagcttcttcattaagggtaatttgcaagaacactcttcactgtttacttttctctggttatggatggtgcttgttaaactgacttagctgaattttcataaatggacgattgtttccatccgaatttatcaatatacaacgttattattcactgataaaaaaaaaaaaaaa

SEQ ID NO: 5821 - DNA, 1581 bp, Glycine max
atgtttaaaaaataaactttggcactgatgacaggggagcaaaacgaggtcgtgttgcagaggccacaacgtttttcattagaaattttcagttccaccacattctctgaactgaagaaacctcttgcactgtggacgcagcctccgccggcgggcattaccgccattgaagctcattcaagctttttttcaccgttcctcacaagactaggtttgaagctgttatcattggaaattagcacttctttgttagtgaaagattagagcaggataaaaatgctcagacgaaggctatctgttctctcaacgtcaatcatcagaaggtcaaatcatagcaaacccattctcagatacccatctatccaatctcacccctttcagctccgtcactctcccagtgcttaccgaataattagtccaaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggtttgaaggaggccagacccctcttcgccgaagactacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagaggtatcgagggttactgttagggctaaggaagcagttgaagcagctggtgggtctgtgagaagggtgtattacaataagttgggcttgaaggcactggtgaagcctgagtggtttgaaaagaaaggaagattattgcctcgagcagctagacctcctcctaagcaaaaggacaaagttgatagcattggtcggttgcccgccccaacgaagccaattccatttttagttgaagcaagcaaagatcttccagttcagcatcttagttaaatagctaacatttttggcaccagtttttaggattttgtaattctgtgtggtgcaaacgtctgactcaaaagtttttcatgcagttcttgcaaatgctcaggtagttaattcaagaatgagataaatgaatttccttggggacaaatgaaagggaaaaatcttgtttattatttcatttcttttaaggatttgatcttggtcactcagttgaaaagagccatagtttcttgtgtatgtgtgcttggtgtaggatcatagcctcttcattaagggaaaattgtaagaacactcttcaatttttaacttttctccggatatggatggtacttgtcaaatgacttggctgaattttaataaatggacgattgtttcaatccgaatttgtattaatatacgacttgttattatccactgattcacatgtaaatagatactatttatttatttttcattagactgagg

SEQ ID NO: 5822 - DNA, 1525 bp, Glycine max
actgatgacaggggagcaaaacgaggtcgtgttgcagaggccacaacgtttttcattagaaattttcagttccaccacattctctgaactgaagaaacctcttgcactgtggacgcagcctccgccggcgggcattaccgccattgaagctcattcaagctttttttcaccgttcctcacaagactaggtttgaagctgttatcattggaaattagcacttctttgttagtgaaagattagagcaggataaaaatgctcagacgaaggctatctgttctctcaacgtcaatcatcagaaggtcaaatcatagcaaacccattctcagatacccatctatccaatctcacccctttcagctccgtcactctcccagtgcttaccgaataattagtccaaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggtttgaaggaggccagacccctcttcgccgaagactacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagaggtatcgagggttactgttagggctaaggaagcagttgaagcagctggtgggtctgtgagaagggtgtattacaataagttgggcttgaaggcactggtgaagcctgagtggtttgaaaagaaaggaagattattgcctcgagcagctagacctcctcctaagcaaaaggacaaagttgatagcattggtcggttgcccgccccaacgaagccaattccatttttagttgaagcaagcaaagatcttccagttcagcatcttagttaaatagctaacatttttggcaccagtttttaggattttgtaattctgtgtggtgcaaacgtctgactcaaaagtttttcatgcagttcttgcaaatgctcaggtagttaattcaagaatgagataaatgaatttccttggggacaaatgaaagggaaaaatcttgtttattatttcatttcttttaaggatttgatcttggtcactcagttgaaaagagccatagtttcttgtgtatgtgtgcttggtgtaggatcatagcctcttcattaagggaaaattgtaagaacactcttcaatttttaacttttctccggatatggatggtacttgtcaaatgacttggctgaattttaataaatggacgattgtttcaatccgaatttgtattaatatacgacttgttattatccactgattcacatgtaaata

SEQ ID NO: 5823 - DNA, 1655 bp, Glycine max
ttaagtgttaggggttgtattttttttatctttattttagtggttcggagaatgtcttggcatgttagtttgggtggaaatatcatttcccttttctattagaatttttcacttccaccgcattctctgaagaaacctcttgcactgtggacgcagcctccgccgcggggcattaccgccattgaagctgattcatgcttttttcaccgttcctcacaagaccaggtttgaagctattgccattggaaattaggacttcttttttgttactgaaaaattagagtagacaaaaaatgctcagacggaggctatctgttctctcaacatcaatcaccagaagctcaaattatagcaaacccagtctcggatacccatctatccaatctcatccctttcagctccctcactctcccagtgcttatcaaataattagtcctaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggttcgaaggaggtcagacccctcttcgccgaagattacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagaggtatcaagggttactgttagggctaaggaagcagttgaagcagctggtgggtctgtgagaagggtgtattacaataagttgggcttgaaggcactggtgaagcctgagtggtttgaaaagaaaggaagattgctgcctaaagcagctagacctcctccaaagcaaaaggataaagttgatagcattggtcggttgcctgccccaacaaagccatttccatttttagttgaagcaagcaaggatcttccagttcagcatcttagttgaataactaacatttttggcaccagtttttaggattttgtaattctgtgtggtgcaaacgtctgactcacaagtttttcatgcagttcttgcaaatgctcaggtagttaattcaagaatgagataaatgaatttccttggggacaaatgaaagggagaatcttgtttattatttaatttcttttaaggatttgatcttcgtcactcagttgaaaagagagccttagtttcttgtgtatgtgtgcttggagtaggatcttagccccttcatgaagggaaaattgcaagaacagtctgcaatgtttaacttttctccggatatggatggtacttgtcaaatgacttggctgaattttaataaatggacgattgtttcaatcggaatttgtattaatatacatacgacttgttattatccactgattacacatgtaacttctttcactgagtttaaaactagccacataacatacaagttttggtataggtagaggaagaaaacaagtagtttcctagatggat

SEQ ID NO: 5824 - DNA, 1524 bp, Glycine max
tttagtggttcggagaatgtcttggcatgttagtttgggtggaaatatcatttcccttttctattagaatttttcacttccaccgcattctctgaagaaacctcttgcactgtggacgcagcctccgccgcggggcattaccgccattgaagctgattcatgcttttttcaccgttcctcacaagaccaggtttgaagctattgccattggaaattaggacttcttttttgttactgaaaaattagagtagacaaaaaatgctcagacggaggctatctgttctctcaacatcaatcaccagaagctcaaattatagcaaacccagtctcggatacccatctatccaatctcatccctttcagctccctcactctcccagtgcttatcaaataattagtcctaatgcattcccggattttcaaggttttagagcttacagtcttctgagcttgaatgatctgagagataaggttcccagaaaacagccgacgaggaaggggcgtgggattgggtctggaaagggcaagactgcagggaggggtcacaagggtcagagagccagaaaaggtataaaattggggttcgaaggaggtcagacccctcttcgccgaagattacccaaacgtgggttcaagaacccatttagcctcacttttcagccaataggtttggggaaaattgcaaagtttattaatgctgggaagatagattcttctgaactgattacaatgaaaacactaaaggatgcaggggtactagggaagcaaatgaaagatggagtaagattgatggggcgtggttctgagcagatcaagtggccaattcatctagaggtatcaagggttactgttagggctaaggaagcagttgaagcagctggtgggtctgtgagaagggtgtattacaataagttgggcttgaaggcactggtgaagcctgagtggtttgaaaagaaaggaagattgctgcctaaagcagctagacctcctccaaagcaaaaggataaagttgatagcattggtcggttgcctgccccaacaaagccatttccatttttagttgaagcaagcaaggatcttccagttcagcatcttagttgaataactaacatttttggcaccagtttttaggattttgtaattctgtgtggtgcaaacgtctgactcacaagtttttcatgcagttcttgcaaatgctcaggtagttaattcaagaatgagataaatgaatttccttggggacaaatgaaagggagaatcttgtttattatttaatttcttttaaggatttgatcttcgtcactcagttgaaaagagagccttagtttcttgtgtatgtgtgcttggagtaggatcttagccccttcatgaagggaaaattgcaagaacagtctgcaatgtttaacttttctccggatatggatggtacttgtcaaatgacttggctgaattttaataaatggacgattgtttcaatcggaatttgtattaatatacatacgacttgttattatccactgatta

SEQ ID NO: 5825 - DNA, 1466 bp, Cajanus cajan
acgagataggttatggccgagcccaataatcttttgttgtctcatttgtgcaccaagcacgccgcaacccacatcttcggtggttgtcatcgacactgtcaagtgatcttcttctgttgcatcaactcttcattcttctctgcaatacgagcaaccactacctacgtattcatgttcagtcccttccacctgctaccatacatcacaggttgctgccattggaaattagcacttcttttttgttagcgaaaggttagagtagaaaaaaaaatgcttagacgaaggctttgtggtgtctcaacatcaatcatcagaagttcaaactatagcaaacccattttcagatacccatgtatccaatttcacccctttcagctccctcactctcccaatgcaacagttaggcctagttcgttcaagggttttgaaggttttagagcttatagtcttctgagcttgaatgatctaagagatagggttcccagaaagcagccaacgagaaaggggcgtggaattgggtctggaaagggcaagactgctgggaggggtcacaagggtcagagagctagaaaaggtatcaaattggggtttgaaggaggccagacccctcttcgccgaagagtaccgaaacgtggcttcaagaacccctttagcctcacttttcagccaataggtttggggagaattgcaaagcttattaatgctgggaagatagattcttctgaactgattacaatgaaaacactcaaggatgcaggggcactaggtaagcaaatgaaagatggagtaagattgatggggcgtggttctgagcagatcaagtggccaattcatctagaggtatcaagggttactgttagggctaaggaagcagttgaagcagctggtgggtctgtgagaagggtatattacaataagttggggttgagggcactgctgaagcctgagtggtttgaaaagaaaggaagattgttgcctaaagcagctagacctcctccaaaacaaaaggataaagttgatagcattggtcggttgcctgcaccaacaaagccaattccatttttagttgaagcaaacaaggatcttccaattcagcatcttagttaaataactaacatgtttggcaccattttttatggtttaaagggtctgactcaagttttcatgcagttcttgcaatgctctggttgttaattttgaatgagataaatgaatttccttggggataaatggaagggaaaatcttgtttattatataatttcttctaaggatttgatcttgttcactgcctaacagccataatttcttttgtatgtgtactggggtaggatcataggctcttcattaagggaaaattgcaagaacactttaaatattttcgtttttctccgattatgatggtacttgccaaatgacttggttgaatataataaaatggattattttatcattccgaatttgtatt

SEQ ID NO: 5826 - DNA, 1361 bp, Medicago truncatula
ccctaacctcgcgtccccgcccaacctccatctctctcagccgtgcgccgccacacacaccagtcaccaccaccaatcaaacctccatatatcctgtagttctcctttctttgattttttttattgaacaacagaagctgagaaagagaaaatgaaattgaaggtttgaagttattaccatctggaagtaacacttcctgtttgttagtgaaagattagagttgaagaaagatgctaaggagaaggctttctgttctctcaacttcaatcatcagaagttcgactcataacaaatccattctcggatatccgtctatccaatttcatcccttgcagctccctcactctctcaacgtttttgccacatttaatcccaatgctcgcccagattttcaaggttttagagcttacagtcttctggccttgaatgatctgagagataatgttccccgaaaacagaagacaaggaaaggtcgtggtattggatctggaaagggaaagactgctgggaggggtcacaaaggccagagagccaggaaaggttcaaagttggggttcgaaggaggccaaacccctcttcgccgtaggatgcccaaacgtggtttcaagaacccatttagcctcacttttcagccaataggtttgggaaaaattgcaacgtttatcaatgcaggcaagatagattcttctgaattgatcacaatgaaaacactcaaggatgcaggggtacttgggaagcaaattaaagatggagtaagattgatggggcgtggttctgagaaaatccaatggccaattcatcttgaggtgacaagggtcactgtcagggccaaggaagcagttgaagcggctggtggatccgtcagaaaggtgtattacaataagttaggctttcaggcactgttgaagcccgagtggtttgagaagaaaggaagattgttgcctaaagcagctagacctcctccaaagcaaaaggataaagttgatagcattggacgactgcctgccccgaagaagccaattccatttttagttgaaggaagcaaggatcttctagtaggtcagctcagttaaataactaacatgtttagtactcttttttctggaatttgtaattttttgtaagcggtttgccctaaaggtttttatacagtttctcacaatatcccggtagttcattcctaatagataaattaatttcatttgggacaaatgaaatgaggaaatcttgtttttttatgtaatttcttttcaagaaactagtgttgatcactcagctgaacagaactaatttttgtgtgtgctgggaggatgatgctagcctcttcaataatgaaaaatggctagaactatttcacctt

SEQ ID NO: 5827 - DNA, 1555 bp, Cicer arietinum
tccaaacccaacccacttcattttgaagtggcccataatccatcggcaaaacccgatcgaaccagtttagatcggccgtgtcacggaaccaaacctggccggtttaattttttattttggtatatccgcccggattaattaaacccccagattttttgttgctaaaaatccttttttttttaaattaaaaacctcttttttttaaagttttaacacccagttcaaaaaaacaatccctgatttcttcaggcagccgcacatcacagtgcagaaccggcaaccaccttcatcgctcggccacctccgtttccaaccaccacctcacgcgtccaattcgtgcaaaacaaagtgtagaaaaaaatatgctaaggagaaggctttctgttctctcaacttcaatcatcagaagttcgatttacaaccgatacccggctgttcaatttcaacccctgcaactcccacaacctctcaatcttcatgcaacatttagtaatctcaatgcacacacaaattttcaaggttttagagcttacagtcttctgagtttgaatgatctaagagataatgttccccgaaaacagaagacaaggaaaggtcgtgggattgggtctggaaagggtaagaccgctgggaggggtcataagggtcagagagctagaaaaggttcaaaattggggtttgaaggaggtcagacccctcttcgtcgtaggatgcctaaacgtggattcaagaacccgtttagcctcacttttcagccaataggtttgggaaaaattgcaacatttatcaatgctgggaagatagattcttctgaactgatcacaatgaaaacactcaaggatgcaggggtactcgggaagcaaatgaaagatggagtacgattgatgggtcgtggttccgagaagatccagtggccaattcatctagaggtatcaagggtcactgttagggccaaggaagcagttgaagcagctggtgggtctgtcagaaaggtgtattacaataagttgggcttccgggcactgttgaagcccgagtggttcgagaagaaaggaagattgttgcctaaagcagctagaccacctccaaagcaaaaggataaagtcgatagcattggtcggcttcctgccccaaccaagccaattccatttttagttgaagcaagcaaggatcttccagtaaaccagctgagttaaataactaatatgtttagtaccttttttctggaatctgtaatcctttttcatgtaagtagtttgattcaaaaggtttttatgtagtctcttgcatgtccttgtagttcattgataatagatcaaataatttcattttgggacagatgaaaagagggaatcttaaggcgtctgatgaatgtaacagattttcatgaatatctcaacatacttttttcatcttagaagggcagcattacaccctacattttataaaacttctgaaaacttgtaggaaaaaagtgttgctacaattcaccgtttgactaagccaagttcattgtgaataattatatatgtgtgatcaatgaagaataacaatg

SEQ ID NO: 5828 - DNA, 1427 bp, Medicago truncatula
gaaatggttacatcacactctccctcttcattctcatctctctcactgtcgcgaccagcaacctccctgacccccgcggagcatattctcctcttctccaccgtgccgtctaacactctcctccacctcaacattcttccacctagctgcgccaccggtatccatcacgccattccatattcacataagttccgcgtcagaatccgcatcagttccaccaactcttcgaaattaattggtttgaagttattaccatttggaagtaacacttcctgtttgttagtgaaagattagcgttgaagaaagatgctaaggagaaggctttctgttctctcggcttcaatcatcagaagttcgactcacaacaaatctgttttcggatacccgtctatccaatttcatcccttgcagctccctcactctctcaacgttcgtgccacatttaatcccaatgctcacccagattttcaaggttttagagcttacagtcttctggccttgaatgatctgagagataatgttccccgaaaacagaagacaaggaaaggtcgtggtattggatctggaaagggaaagactgctgggaggggtcacaaaggccagagagccaggaaaggttcaaagttggggttcgaaggaggccaaacccctcttcgtcgtaggatgcctaaacgtggtttcaagaacccatttagcctcacttttcagccaataggtttgggaaaaattgcaacgtttatcaatgcaggcaagatagattcttctgaattgatcacaatgaaaacactcaaggatgcaggggtacttgggaagcaaattaaagatggagtacgattgatggggcgtggttctgagaagatccaatggccaattcatcttgaggtaacaagggtcactgtcagggccaaggaagcagttgaagcggctggtgggtccgtcagaaaggtctattacaataagttaggctttcgggcactgttaaagcccgagtggtttgagaagaaaggaagattgttgcctaaagcagctagacctcctccaaagcaaaaggatagagttgatagtattggacggctgcctgccccgaagaagccaattccatttttagttgaaggaatcaaagatcttccagtaggtcagctcagttaaataactaacatgtttagtactcttttttgctggaatttgtaattttttgtaagcggtttgctctaaaggtttttatacaggctctcacgatgtctcggtagttcattcctaatagataaattaatttcatttgggacaaatgaaatgaggaaatcttgttttttatgtaatttcttttcaagaaactagtgttgatcactcagctgaacagaactaatttttgtgtgtgctgggaggatgatgctggcctcttcaataatgaaaaatggctagaacta

SEQ ID NO: 5829 - DNA, 1565 bp, Cicer arietinum
caataaaaaaaacccaaattcagtaaaactcattattcgatcttaaccgccgccgccgccaccaacaccaccggttcctcctacgcaaagcctcaacccacctccatcatttctgtttctaactaaacaaaaacttagccattggttccgtcgacgttaataccttatttcttttttcctttttcttctcatcaactgtaaatggagaaaagatgcttcgcaaacgcacttaggtactgaatctacggagcgtgccattatttctgtggtggaaggtcgtcatcactgagcaagaacaaaaagattagagtagaagaaaatatgctaaggagaaggctttctgttctctcgacttcaatcatcagaagttcgatttacaaccgatacccagctgttcaatttcaacccctgcaactcccacaacctcttgatgttcgtgcaacatttagtaatctcaatgcacacacaaattttcaaggttttagagcttacagtcttctgagtttgaatgatctaagagataatgttccccgaaaacagaagacaaggaaaggtcgtggaattgggtctggaaagggtaagactgctgggaggggtcataagggtcagagagctagaaaaggttcaaaattggggtttgaaggaggtcagacccctcttcgtcgtaggatgcctaaacgtgggttcaagaacccgtttagcctcacttttcagccaataggtttgggaaaaattgcaacgtttatcaatgctgggaagatagattcttctgaactgatcacaatgaaaacactcaaggatgcaggggtactcgggaagcaaattaaagatggagtacgattgatggggcgtggttccgagaagatccagtggccaattcatctagaggtatcaagggtcactgttagggccaaggaagcagttgaagcagctggtgggtctgtcagaaaggtgtattacaataaattgggcttccgggcactgttgaagcctgagtggttcgagaagaaaggaagattgttgcctaaagcagctagaccacctccaaagcaaaaggataaagtcgatagcattggtcggcttcctgccccaaccaagccaattccatttttagttgaaacaagcaaggatcttccagtaaatcagctgagttaaataagtaataagtttagtaccctttttctggaatctgtaatcctttttcatgtaaccagtttgattcaaaagatttttatgtagttcattgataatagataaaaaataatttaattttatcatttgggacaaatgaaatttggaaatctcatgttgtgcatcaaagatcacaagttgatgagaattataatttcatctctataatttgtattgaattgtaatattgtcaattgtcatgagtgaaaatttgaatttgtatatatgattgacgcatttataatgaccaaattggacatggtagccaagtgacacaacaatagaaaaataccatgttgaaccaaacattcaaagtttataaaatgggtctaataattacctcaaaaatggattagaaaatggcccaaaaatag

SEQ ID NO: 5830 - DNA, 1738 bp, Medicago truncatula
gatcaatctcaccgccatttacggggtccgttctaagccagagcaaagctatatgaacttagagcttcttttcttacactcatatttttcctctaaccttagggtcaccgtctcacactcactgcctctcacactcgccgtcgaacaaacccacaaccgtcgttcagacccatagctgtgaaagtttgaagggctatgcagcatgagagtttgtgaaataaggagttaagtctcgggagcttgcagtcatatccaaagaaacgtgaaagattagagttgaagaaagatgctaaggaaaaggctttctgttctctcgacttcgatcatcagaagttcgactcacaacaaatccgttctcggatacccgtctatccaatttcatcccttgcagctccctcactctctcaacgttcatgccacatttaatcccaatgctcacccagactttcaaggttttagagcttacagtcttctggccttgaatgatttgagagataatgttccccgaaaacagaagacaaggaaaggtcgtggtattggatctggaaagggaaagactgctgggaggggtcacaaaggccagagagccaggaaaggttcaaaattggggttcgaaggaggccaaacccctcttcgccgtaggatgcctaaacgtggtttcaagaacccatttagcctcacttttcagccaataggtttgggaaaaattgcaacgtttatcaatgcaggcaagatagattcttctgaattgatcacaatgaaaacactcaaggatgcaggggtacttgggaagcaaattaaagatggagtaagattgatggggcgtggttctgagaagatccaatggccaattcatcttgaggtgacaagggtcactgtcagggccaaggaagcagttgaagcggctggtgggtccgtcagaaaggtgtattacaataagttaggctttcgggcactgttgaagcccgagtggtttgagaagaaaggaagattgttgcctaaagcagctagacctcctccaaagcaaaaagataaagttgatagcattggacggctgcctgccccgaagaagccaattccatttttagttgaaggaagcaatgatcttccattagctgttgcaccattggaccattcataacttgcacaactatatgttgttcaccttagcaccaattggctggaatcaagtagttaatgaatctcattcaattcaggtcaaattggtcggaagtacttgggtttgatttgtgactgaaaccatctttagttagattttatctacctcacagttgaattttaggttaccaaagctcattcccaccgagaattggaggattaagtccatgaaaaaatgttcagctccaaagaaatttttcccggaatatcagtttgatgaaaacaattgaagcatatcaacgttggacaactgatcatttatgtgtgtggtcaagagtttaatttttgactcgtgcgtatgaaaagttatcattcgataacgttcttatatgtgttttaaatcattgaagtgattaatctctgcagctttgcacatagaataacctgaaaaactaaaatcactaaggcgtggtcattagtcgtaccatatcttaagtttgacctcaatagtaaggacctgcattctagatttttagtgcctctacctgcagcataaaagcagggctgaatccttatttgccattagagcagacatattagtgaggtagcaaactagtga

SEQ ID NO: 5831 - DNA, 1446 bp, Lupinus angustifolius
tttgtgtgggacataatttttcatttcaacatttccccatattctcataaaacctctgcagatgcagcctacaccaccctcttctgactgcagtgaagcctccattttcgaccgccattaaagcaccttcaagcttgttagtgtttccttacaaaatcaggtttgaatctgttaccatctgaaattggtacgtcctttttgtctacaagaagaaaaatgcttagcagaaggcttgctgttctctcaacatcagtcatcagaagctcaattcgcagcaaacccattctcacattcccatcggtccaatttcatccatcgcagcttcctcattcatccaactccgatgcaacatttatccccaatgcatttgtggattctctaggttttagagcttacagtcttttgagcttgaatgatctgagagataatattcccagaaaaaagcctacaaggaagggccgtggtattgggtctggaaagggtaagactgctgggaggggtcacaagggtcagagagccagaaaaggttcaaaattgggttttgaaggaggccagacgccacttcgtcgaagaatgcccaaacgtggtttcaagaacccatttagcctcacatttcagccagtaggtttgggaaaaattgcgtggcttatcaatgcagggaagatagattcttctgaactgattacaatgaagacactcaaggatacaggagcaatagggaagcaaataaaagatggagttagattgatgggacgtggtgctgagcagatccaatggccaattcatctagaggtatcaagagtcactgttagggccaaggcagcagttgaagcagctggtgggtctgtgagaagggtgtattacaataagttgggattccaggcactgctgaagcctgagtggttcgagaagaagggcagattgttgccgaaagcagctagacctcctccgaaacaaaaggataaagttgatagcatcggtcggttgcctgccccaacaaagccaattccatttttagttgaaggaagccatgatcttcaagttcagcctcttaattaaccaaagggacttgtttgataccagtttttttggaattttaattctttatgatgtcctctttcaagtttttttgcaatgcacaggtaattaattcagaatgggataaatccattgagacaaatggaatggaaaatccttttttgattttatatttcaatatcttttctttttaagaatctatgttggtcaatgaactgatgacagctatgttttcatatgtaatttgctctgagagtaagggtatgttagggagaaggtatcattgccaaaatctattgacagaatgcaagtcaaagagtcttcaatttttgtcttataactttttaaactatcaaacaatggaataacatgttctcttctattctattccattctttgacttttaat

SEQ ID NO: 5832 - DNA, 1053 bp, Lotus japonicus
cagagaaggaggctctctgctctctcgacatcgatcatcagaagctcaattcacagcaaacctgttataagacacccatctatccaacttcaccctgtgcagttccctcactctcgcaatgcttattcagcatttaatcccaatacactccagggttttcaaggttttagagcttacagtcttctgatgttgaatgatctgagagataatgttcccagaaaacagaagataaggagggggcgtgggattgggtctggaaagggaaagactgctgggttcggccacaaaggtcagagagccagaaaaggttcgaaattggggtttgaaggaggccagacccctcttcgtcgaagaatgccaaaacgtgggttcaagaacccttttagcctcacatttcagccagtagggttgggaaaaatcgcaaagcttatcaatgcagggaagatagattcttctgaactgattacaatgaaaacactcaaggactcaggggcaatagggaagcaaatacaagatggagtacggttgatggggcgtggctctgaacagattctgtggcccattcatctagaggtatcaagggtcactgttagagctaaggaagcagttgaagcagctggtgggtctgtgagaaaggtgtattacaataagttgggctttaaggcactgctgaagccagaatggtttgaaaagaagggaagattgttgcctaaagcagctagacctcctccaaagcaaaaggataaagttgatagcattggtcggctgcctgcaccaaccaagccaattccatttttagttgaaggaagcaaagatgttcccgttttatcagcttaattatgacatgtttggatcaacttcgatttccttaaaatcaattctgaaatccagaggctactcacagaagtttctctccataattgattatgattttagttattttatagttaattgtagaagaatttccaaacatgcgcttaataagtgtttggtgccagttttttagggagttgtaattctttatgatgtaaacggtcttagttagttacttcc

SEQ ID NO: 5833 - DNA, 1344 bp, Arachis hypogaea
ggggaagagggtttttgtcgaaacctctcttctctcccatttctcagccttaagcctgctcttcgtgccttcgtctctcgccgctcaccgtcgtccaaccgccacaccttcctcaccgtcgccgtttccgtctgacaggttagaagtagttaccggctgaattgtcactcttttcgtgggtgaaagattagagggaaaaaaaaagatgctcagaagaaggctcactgttctctcgacatcaattatcagaagctcagtttggggaaaacctagtcccacttgtccattggtccaatttcctcatccctcaaagctccttcaatattccaagtctcatgcaacactttaccccaaagtacacccagaatttcaaggttttagagcttacagtcttctagctttgaatgatctgagagataatgtgccgagaaaacagaagacaagaaagggccgtgggattgggtctggaaagggaaagactgctgggaggggtcataagggtcagagagccagaaaaggatcgaaattgggttttgaaggaggtcaaactccacttcgtcgaagaatgcccaaacgtggtttcaagaacccatttagtctcacttttcagccagtaggtttgggaaaaattgcatggcttatcaatgcagggaagatagattcttctgaattgattacaatgaaaacactcaaggatacaggagcaattgggaagcaaataaaagatggagtaagattgatggggcgtggcgctgatcagatcaagtggccaattcatctagaggtatcaagggttaccgtgagggctaaggaagcagttgaagcagctggtggttctgtaagaagagtgtattataacaagctgggcttgcgggcactgctgaagccggagtggttcgaaaagaagggaaggttgctgccaaaagcagctagacctccgccgaaactgaaggataaagtcgatagcattggccggttgccagcgccgactaaaccgatcccgtttttagttgaaggtagcaatgatattacacctcctcagcttagttaaactgagatcatggcattatttgtagaatttttagctaattcagaacgagagataaatgaatttccattggaaaaaatggaatgagaaattttcttgtgatttgtttttctttttgtatcaattttgttttaaggaactgagattggttacctaagagagccttgttttgatgtgtatgtggataggatctttgcttaattcagtcgattagggacctaaaccttgattaagtgtactaattacacgaattgattttccattccattaaccataggtcaacttaaaaggttgac

SEQ ID NO: 5834 - DNA, 1312 bp, Arachis hypogaea
tgatagagcgggtatcaacgcagagtacgggggaagagggtttttgtcgaaacctctcttctctcccatttctcagccttaagcctgctcttcgtgccttcgtctctcgccgctcaccgtcgtccaaccgccacaccttcctcaccgtcgccgtttccgtctgacaggttagaagtagttaccggctgaattgtcactcttttcgtgggtgaaagattagagggaaaaaaaaagatgctcagaagaaggctcactgttctctcgacatcaattatcagaagctcagtttggggaaaacctagtcccacttgtccattggtccaatttcctcatccctcaaagctccttcaatattccaagtctcatgcaacactttaccccaaagtacacccagaatttcaaggttttagagcttacagtcttctagctttgaatgatctgagagataatgtgccgagaaaacagaagacaagaaagggccgtgggattgggtctggaaagggaaagactgctgggaggggtcataagggtcagagagccagaaaaggatcgaaattgggttttgaaggaggtcaaactccacttcgtcgaagaatgcccaaacgtggtttcaagaacccatttagtctcacttttcagccagtaggtttgggaaaaattgcatggcttatcaatgcagggaagatagattcttctgaattgattacaatgaaaacactcaaggatacaggagcaattgggaagcaaataaaagatggagtaagattgatggggcgtggctctgatcagatcaagtggccaattcatctagaggtatcaagggttaccgtgagggctaaggaagcagttgaagcagctggtggttctgtcagaagagtgtattataacaagctgggcttccgggcactgctgaagccggagtggttcgaaaagaagggaaggttgctgccaaaagcagctagacctccgccgaaactgaaggataaagttgatagcattggccggttgccggcgccgactaaaccaatcccgtttttagttgaagggagcaatgatattacacctcctcagcttagttaaactgagatcatggtattatttgtagaatttttagctaattcagaacgagagataaatgaatttccattggaaaaaatggaatgagaaattttcttgtgatttgttttttctttttgtatcatttttgttttaaggaactgagattggttacctaagagagcctagttttgatgtgtatgtggatggatcttgcttaattcagtcgattagggacctaacttgattaagtgta

SEQ ID NO: 5835 - DNA, 721 bp, Vigna unguiculata
ggaccgaccgacatggcttccatcactccacttaacaccatgcttccaaacgttgctcccaaactccccgcatgtgtcgctgtttccaacactagggtttcgtttgcggccgcacctgtgttaccgtgcacctcgattcagaggaacaagagtagatcttccagggttgttgtttcggctgttggcgacgtttctgctgatagcaccgtttacctcgttgctggtgccgttgcagtggcactcgttggaaccgcattccccatcttcttctctcgcaaagacacatgtcctgaatgtgatggagcagggtttgttcgaaaggctgacgtgagattgagagcaaatgcagcacgaaaggatcaaactcaaatcgtttgtgctcgttgcaatggattgggcaaacttaatcaaattgacaaatagacataacaaaatcatttcttttcctcttaatatgtaactatttaagcataattatcccctccttcatcattttcttcttctgagatgaacaactttatagtatgtcatgataggagagaaaatcacaaatttacttgtttgcatttatcatttgttttgttctctcccatttcatgataccccaatgttcctaatgttttcatcaagtgtatatgttatatgtaattgaaacatatttgccaatacggatgttcaataatatatgatatgttggtgttcatccttcaaaaaaaaaaaa

SEQ ID NO: 5836 - DNA, 1113 bp, Vigna unguiculata
gggatcctttgactctttgtataaatagtctgtttccgggatgctccgagagacaatttgaatttgaagaataaatagccaccggcaaagattcggggaaaagctcaaaaaatttgtgtttcaaattgaatttgatgggaatgaagggtttggtatgtttgatgtggttgtcgatttgggtctcgcaatcccaaggccgattactgtcgatcccgtcaaaacccgacccaaataatgctgctgccactgctcgttggctcgtctctctcaatttctggggagtcttgaacactatctcagctgatttgggtggagctccctttgggaatgtggtgtcgtatagcgatggactccccggtgtaggcactggaatcccttacttttacttgacaagtctagacccaacagcaagaaatgcactgaaaaatgataaagcttcattcacaatcagtgaataccctcttggaacctgtggcaagaaagacccaatgaaccctacttgctcaaaaatttctctaaccggaaagctgaaattgattgatcaaaattccaaggaagcaggatttgctagaaaagctttgttctccaagcatccagagatgaatggctggccgaaggatcacaactttcaaatctttaaattagaaattgaaaatatatttctaattgattggtttggtggtccaaaaccacttacagtggaacagtaccttcatcccaaaatgaacgatgttgccttcattctgagtgctctttgaattgctattcctgttgtgggctgtaattgtgtcatggaattgtaaattgatatcctgtctttcgaattgtgtattccttccaaaatactcttgggccatggttctttattccgtgtatatttgaactctggacatgtttatgatcttggattcttgccctttgtgttgtggctattatctctgaaaatgctgcaatcatgaagagaaacaaaaggcatcagagagcaataatttgggaatggtttctgtcaaaacatttgctctggtaacagagaactcttaaactgtggtaatacttgaagctctcattggggcactgtataaaaagtttcctaataaaagtaacagattgttc

SEQ ID NO: 5837 - DNA, 958 bp, Vigna unguiculata
ccctttcgccgaggaaccaaaaacaccacctcgaaattctcagttagtgttttgttcctctctgttttaacacattccgtgtttcgttaattttcttcatctctctgtcaaatgcaaccctttcgattctgaattcaccttcttcgtccttttcatttaaaagggtgaaggaattcacaatcttttcatttttatttctttcaatttttcttgaattatatagcattgtgaagatatggagatgaaggtttctcggcgggtgaattggtggcggaacatgatgtacccccttcgacgggtttggttcagtgtcgccacgcgtttcggatttcgcaaaaatgggttgctgaaactaaggcatgatgtgagggcatgtgagtatgaggacattcaagtgatgtgggagatgctgaacagaaatgaatcagagtttggtcattcttcgaagaaatcgaacaaaaacaacagcaacaacaagaaaaagggacattgttggaagttgctgaactgggcaaggtgtgctccatattactacatgtgccgccgtgcctgatgatgatgatgattgttgtgtcggtgtttttcttctcttcacagaaaaagccaatacctgtgtgttggtgtggcttttgcttcaatcatgaataaaggggggtttgtgcagaacacatggtggttctccacttctttgaatcagccaactcaatgatccgttcgtgtatatatataatatatttatatgtagcaaccgcgttcaccaagtcgatgtgaccaccaaaactttgtatgcgtagctttgtgtcgtgtttcatcgtgatcttggaatgtttagcgagtcattcatgtattggttttagagatccatgaatagtgtgtctcaggctttcaaccagcttgattttgtatcagaaaaaactgtctgcattctgcagaatgcagagcagaatgcagagggagg

SEQ ID NO: 5838 - DNA, 1044 bp, Glycine max
gaagcgtcacaatctcaacgacagccacacagttcagcaacggaacatgagagagacacgtggtacacccacgatggcgctttccgttgcaacaagtccttgaatcgaagaagcatgagtttatgaaaacaacttacctggttgttccgttcctcacaacgattgagttgtccctcccttacgccgaggaacacacacacaaaaaaaaaaaaaacttatcgcattgtgagcatgatggaggagatggaagtttctcggcgggtggagtggtggcagaacatgatgtacccagtacgaagggtttggtttgtcgtcgccacgcgcctcggcattcgcaaaaatgggttactgaagctaaggcatgatgtgagggcatgtgaatatgaggacattcgagtgatgtgggagatactgaacagaaacgaatcagagtttggtcattcttctagctctaggaaaggcaacaacaacaataacaacaagaaggggcattgctggaagttgttgaggtgggcaaggtgtgctccatatatgtgccgcgcctgatcataattgctgtgtacgtgagtgagtcttttctcttcacagaacaaaaatccaacctgtgcgttgatttggtttttgcttcaatcatgaataaagagttctgagtcagaggggttcgtgtagaacacggttctcttttcctttgaatcaaccaactcaaccatatgtaaatatcaaccgcatgcatccaccaagtcgatgtgaccatctcttactccatccatgtgcttaattagtgtggtatcaaaattgttatatgtgtagtttgtgctgtgttttatcatcatcttggtatgttcaaccagaggttcatgtattgcttttagagatccatgaatcatgtctatctctggctttctgcttggtttttgtatcggaaactatctgcattcagaagaagaaggcatataaatatgtgtagttattataaatattcggaatctcatgtgcatcaaatacttcaatatgcatattatatgttcttttttaattattaag

SEQ ID NO: 5839 - DNA, 1298 bp, Glycine max
attttaacgtacaaaaaactagctttactccactcatttggaatcccgttttggatgaaacatttgacatttgagtaagggatagcaaatgtttggtccattcccccctctgggttcaaaatctcgcgggttgggggcacgtgggataatatcgtcacaaatcacaatggctgttcgaagcataagaagcaaccaccaatagctgctctccacatacataggaagcgtcacaatctcaacgacagccacacagttcagcaacggaacatgagagagacacgtggtacacccacgatggcgctttccgttgcaacaagtccttgaatcgaagaagcatgagtttatgaaaacaacttacctggttgttccgttcctcacaacgattgagttgtccctcccttacgccgaggaacacacacacaaaaaaaaaaaaaacttatcgcattgtgagcatgatggaggagatggaagtttctcggcgggtggagtggtggcagaacatgatgtacccagtacgaagggtttggtttgtcgtcgccacgcgcctcggcattcgcaaaaatgggttactgaagctaaggcatgatgtgagggcatgtgaatatgaggacattcgagtgatgtgggagatactgaacagaaacgaatcagagtttggtcattcttctagctctaggaaaggcaacaacaacaataacaacaagaaggggcattgctggaagttgttgaggtgggcaaggtgtgctccatatatgtgccgcgcctgatcataattgctgtgtacgtgagtgagtcttttctcttcacagaacaaaaatccaacctgtgcgttgatttggtttttgcttcaatcatgaataaagagttctgagtcagaggggttcgtgtagaacacggttctcttttcctttgaatcaaccaactcaaccatatgtaaatatcaaccgcatgcatccaccaagtcgatgtgaccatctcttactccatccatgtgcttaattagtgtggtatcaaaattgttatatgtgtagtttgtgctgtgttttatcatcatcttggtatgttcaaccagaggttcatgtattgcttttagagatccatgaatcatgtctatctctggctttctgcttggtttttgtatcggaaactatctgcattcagaagaagaaggcatataaatatgtgtagttattataaatattcggaatctcatgtgcatcaaatacttcaatatgcatattatatgttcttttttaattattaagtttcacttcatttggagaatatacgttatatat

SEQ ID NO: 5840 - DNA, 4145 bp, Glycine max
ccacatcacacaagctccaaaacccgcacatataaaaaggacacacaaaacacacacattcccagagagaagagtggcgacgcaagtcagtctctcatcacatcatcatcaaaaaccaaaaaccctaaccccccggtgtgttttctcgtcgtcgctcttcttcttctctgtcgtcgccgccgccgccgccatggatcctgaggtgcagcaatcgcaggtcgccgccattcttggcgccgatccctcccccttccagacactgatctcgcacctcatgtcctcctccaacgagcaacgctcccacgcagagactcttttcaacctctgcaagcaaaccgatcccgataacctctccttaaagcttgcacatctccttcactcctcgccgcaccaggaggcacgggccatgtccgccatcctcctccggaaacagctcacccgcgacgactcttacctctggccgcgcctctcccctcagacgcagtcttccctcaaatcgctcctcctctcctcgattcaatcggaaaacatcaaatccatctccaagaagctctgcgacaccatctctgaactcgcctctggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatatctttttacagtgcctcacgaacgctaccgttaaccctgacgtccgaattgcggcgcttaacgccgttatcaatttcatccagtgcttatccggttccgccgatcgcgaccgcttccaggacctgctgcccgcgatgatgcggacgttgaccgaggcgcttaattccggccaggaggccaccgctcaggaggcgctcgagcttctcatcgagctcgccgggaccgagccgaggtttctgcggaggcagcttgtggatgtcgttggtgctatgttgcagattgctgaggccgagtcgcttgaggaagggactcggcatttggcgattgagtttgtgattaccctcgcggaggcgagggagcgcgcccccgggatgatgaggaagttgccgcagtttattagtaggttgttcaccatactcatgaaaatgcttcttgatatcgaggatgatcctgcgtggcacagtgctgagactgaggatgaggatgctggtgaaaccagtaattatagtgtgggacaagagtgcttggataggctctctatatctttgggtggaaacaccattgttcctgttgcgtctgaacagttgcctgcttacttggctgctcccgaatggcagaaacgccatgctgcacttattgcacttgctcagatagctgagggctgctcaaaggtcatgataaagaatttggagcaagtggtggctatggtcctgacttccttccctgaccaacacccccgtgtaaggtgggcagctattaatgcaattgggcagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatggaatagttagcaaactacttgtacttcttcagaatggtaagcagatggtgcaagaaggtgccttaactgctttggcatcagttgctgattcttctcaggaacacttccaaaaatattatgatgctgtaatgccatatctgaaagctatattggttaatgcaaccgacaagtctaaccgtatgcttcgtgctaagtccatggagtgtataagtttagttggaatggctgttgggaaggagaagtttagggctgatgctaagcaggttatggaagttcttatgtcccttcaagtatctcaaatggagacagatgatccaacaacaagttacatgctacaggcatgggctagactctgcaaatgtctgggacaagattttcttccttacatggagtttgtcatgcctccactacttcaatctgctgcacttaagcccgatgtaaccattacatcagcagattcagacaatgatattgaggattctgatgatgaaagtatggagactattactcttggggacaagcgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctattgagaagggacaatctcaaggtcgggacgtaacctatttgaaatttttgactgacagtatcatcccagctttggtggaagcattgcacaaggaacctgacacagagatttgtgcaagcatgttggattcattaaatgaatgcttacagatatctggaatgcttttggacgaaagccaggtcagatccatcgtggatgagataaaacaggtgatcacagctagttcaagtagaaaacgagagagagcagagaggacccaagctgaagattttgatgctgaagagggggacctgattaaagaggaaaatgaacaagaggaagaagtttttgatcaagtgggtgagatattaggaactttaatcaaaaccttcaaagccaacttcttgcctttctttgatgaactatcatcatatctgacacctatgtggggaagggacaagactcctgaagagagaagaattgcaatttgtatttttgatgatgttgcagagcagtgtcgtgaagctgctattaagtattatgatacctatctcccattcctgttggaggcttgtaatgatgagactcctgatgtcagacaggcagctgtgtatggtctcggtgtttgtgcagagtttggtggatctgtgttcaaacctctggttggagaggctcttttgaggttaaatgctgtgatccagcatcctaatgctcttcattcagataatgtaatggcatatgacaatgccgtttccgctctgggaaaaatttgccaatttcatcgtgacagtattgattctgcccaggtagttcctgcatggctaaactgtttgccaatcaaaggtgatttgattgaggccaaagttgtgcatgatcaactttgttcaatggctgagagatctgacagtgagctgttgggtccaaacaatcaataccttccaaaaatagtttcagtgtttgctgaggttttatgtgctggtaaggaccttgcaacagaacagacagctggtcgtatggttaatttactcagacagctccagcaaactttaccaccctctacacttgcttctacttggtcatctttgcagccccagcaacagcttgcattgcaatctatcctttcttcatagttttcattgctttgctgcatatccatcatttcttcatagcatctggcttggcagttggtgtcttgctctttttgggaacaagctttttccagtttggtggtctccatatttgttacccattctttttaccatacggtggtttccatcattcattcttgcatggtgttctatagcaacatggcttcagttttgagattgcagagtcaattgtgattggaaagggaactttctgtagaatgtgtatattatgagtgttaatagtgcgattgagtccaaaagaggaggttagggaattgtggcgtgggagcttctcgttgtattcctctattgttttttcttaccatattgcgtgagaatatagggttgtctgtggggcaattcttgcagttttggccgattgtattggttttatttccttatcagtatgaagttgtaccatatgaaatttgaatgctatttattaacttttcagacaattgtttcttcaaacaacaatttgttcttaatctgggtcttgcaatttttaaattttttttttcgtgtttgtaagatttggatccccatgtaaaaagatatgtgaagtgtgggtgtatccacccttgatttcaaa

SEQ ID NO: 5841 - DNA, 4125 bp, Glycine max
aagctccaaaacccgcacatataaaaaggacacacaaaacacacacattcccagagagaagagtggcgacgcaagtcagtctctcatcacatcatcatcaaaaaccaaaaaccctaaccccccggtgtgttttctcgtcgtcgctcttcttcttctctgtcgtcgccgccatggatcctgaggtgcagcaatcgcaggtcgccgccattcttggcgccgatccctcccccttccagacactgatctcgcacctcatgtcctcctccaacgagcaacgctcccacgcagagactcttttcaacctctgcaagcaaaccgatcccgataacctctccttaaagcttgcacatctccttcactcctcgccgcaccaggaggcacgggccatgtccgccatcctcctccggaaacagctcacccgcgacgactcttacctctggccgcgcctctcccctcagacgcagtcttccctcaaatcgctcctcctctcctcgattcaatcggaaaacatcaaatccatctccaagaagctctgcgacaccatctctgaactcgcctctggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatatctttttacagtgcctcacgaacgctaccgttaaccctgacgtccgaattgcggcgcttaacgccgttatcaatttcatccagtgcttatccggttccgccgatcgcgaccgcttccaggacctgctgcccgcgatgatgcggacgttgaccgaggcgcttaattccggccaggaggccaccgctcaggaggcgctcgagcttctcatcgagctcgccgggaccgagccgaggtttctgcggaggcagcttgtggatgtcgttggtgctatgttgcagattgctgaggccgagtcgcttgaggaagggactcggcatttggcgattgagtttgtgattaccctcgcggaggcgagggagcgcgcccccgggatgatgaggaagttgccgcagtttattagtaggttgttcaccatactcatgaaaatgcttcttgatatcgaggatgatcctgcgtggcacagtgctgagactgaggatgaggatgctggtgaaaccagtaattatagtgtgggacaagagtgcttggataggctctctatatctttgggtggaaacaccattgttcctgttgcgtctgaacagttgcctgcttacttggctgctcccgaatggcagaaacgccatgctgcacttattgcacttgctcagatagctgagggctgctcaaaggtcatgataaagaatttggagcaagtggtggctatggtcctgacttccttccctgaccaacacccccgtgtaaggtgggcagctattaatgcaattgggcagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatggaatagttagcaaactacttgtacttcttcagaatggtaagcagatggtgcaagaaggtgccttaactgctttggcatcagttgctgattcttctcaggaacacttccaaaaatattatgatgctgtaatgccatatctgaaagctatattggttaatgcaaccgacaagtctaaccgtatgcttcgtgctaagtccatggagtgtataagtttagttggaatggctgttgggaaggagaagtttagggctgatgctaagcaggttatggaagttcttatgtcccttcaagtatctcaaatggagacagatgatccaacaacaagttacatgctacaggcatgggctagactctgcaaatgtctgggacaagattttcttccttacatggagtttgtcatgcctccactacttcaatctgctgcacttaagcccgatgtaaccattacatcagcagattcagacaatgatattgaggattctgatgatgaaagtatggagactattactcttggggacaagcgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctattgagaagggacaatctcaaggtcgggacgtaacctatttgaaatttttgactgacagtatcatcccagctttggtggaagcattgcacaaggaacctgacacagagatttgtgcaagcatgttggattcattaaatgaatgcttacagatatctggaatgcttttggacgaaagccaggtcagatccatcgtggatgagataaaacaggtgatcacagctagttcaagtagaaaacgagagagagcagagaggacccaagctgaagattttgatgctgaagagggggacctgattaaagaggaaaatgaacaagaggaagaagtttttgatcaagtgggtgagatattaggaactttaatcaaaaccttcaaagccaacttcttgcctttctttgatgaactatcatcatatctgacacctatgtggggaagggacaagactcctgaagagagaagaattgcaatttgtatttttgatgatgttgcagagcagtgtcgtgaagctgctattaagtattatgatacctatctcccattcctgttggaggcttgtaatgatgagactcctgatgtcagacaggcagctgtgtatggtctcggtgtttgtgcagagtttggtggatctgtgttcaaacctctggttggagaggctcttttgaggttaaatgctgtgatccagcatcctaatgctcttcattcagataatgtaatggcatatgacaatgccgtttccgctctgggaaaaatttgccaatttcatcgtgacagtattgattctgcccaggtagttcctgcatggctaaactgtttgccaatcaaaggtgatttgattgaggccaaagttgtgcatgatcaactttgttcaatggctgagagatctgacagtgagctgttgggtccaaacaatcaataccttccaaaaatagtttcagtgtttgctgaggttttatgtgctggtaaggaccttgcaacagaacagacagctggtcgtatggttaatttactcagacagctccagcaaactttaccaccctctacacttgcttctacttggtcatctttgcagccccagcaacagcttgcattgcaatctatcctttcttcatagttttcattgctttgctgcatatccatcatttcttcatagcatctggcttggcagttggtgtcttgctctttttgggaacaagctttttccagtttggtggtctccatatttgttacccattctttttaccatacggtggtttccatcattcattcttgcatggtgttctatagcaacatggcttcagttttgagattgcagagtcaattgtgattggaaagggaactttctgtagaatgtgtatattatgagtgttaatagtgcgattgagtccaaaagaggaggttagggaattgtggcgtgggagcttctcgttgtattcctctattgttttttcttaccatattgcgtgagaatatagggttgtctgtggggcaattcttgcagttttggccgattgtattggttttatttccttatcagtatgaagttgtaccatatgaaatttgaatgctatttattaacttttcagacaattgtttcttcaaacaacaatttgttcttaatctgggtcttgcaatttttaaattttttttttcgtgtttgtaagatttggatccccatgtaaaaagatatgtgaagtgtgggtgtatccacccttgatttcaaa

SEQ ID NO: 5842 - DNA, 4106 bp, Glycine max
cacacaaaactcacacctctctcgagagaagagtgctccgcgagtctagtctctctaatcacatcatcataaatcaaaaaccctaacccgcgcgcgtgctcacttgtcatccctctctcttcttcttcttcttctttatcgtggccgccatggattccgaggtgcagcaatcgcaagtcgccgccatcctcggcgcggatccctcccccttcgagacgttgatctcgcacctcatgtcctcctccaacgagcaacgctcccacgcggaggccctgtttaacctctgcaagcaaaccgatcccgatagcctctccttgaagctcgcgcacctcctccactcctcgccgcacgaggaggcgcgtgccatgtccgccatcctcctccggaaacagctcacgcgcgacgactcctacctctggccgcgcctctcccctcacacgcagtcttccctcaaatcgctccttctctcctcgattcaaaaggagaacatcaaatccatctccaagaagctctgcgacaccatctccgaactcgcctccggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatattttcctgcagtgtcttacgaacgcttccgttaaccctgacgtccgaattgcggcgcttaacgccgttatcaatttcatccagtgtttgtccggttccgccgatcgcgaccggttccaggacctgctgcccgcaatgatgcggacgttgaccgaggcgcttaattccggccaggaggccaccgcccaggaggcgctcgagcttctcatcgagctcgccgggactgagcctcgttttctccggcgccagcttgtggatgtcgttggcgccatgttgcagattgccgaggctgaatcccttgaggaagggactcggcatttggcgattgagtttgtgattactctcgcggaggcgagggagcgcgcccccgggatgatgaggaagttgccgcagtttattagtaggttgtttgcgatactcatgaagatgcttcttgatattgaggatgatcctgcgtggcacagtgctgagacagaggatgaggatgctggtgaaaccagtaattatagcgtgggacaagagtgcttggatagactctctatatctttgggtggaaacaccattgttcctgttgcgtccgaacagttgcctgcttacttggctgctccagaatggcagaaacggcatgctgcacttattgcacttgctcagattgctgagggctgttcaaaggtcatgataaagaatttggagcaagtggtggctatggtcctgaactccttccctgaccaacacccccgtgtaagatgggcagctattaatgcaattggccagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatgggatagttagcaaactacttgtacttcttcagaatggtaagcagatggtgcaagaaggtgccttaactgctttggcatcagttgctgattcttctcaggaacacttccaaaaatattatgatgctgtaatgccatacctgaaggctatattggttaatgcaactgacaaatctaaccgtatgcttcgtgctaagtccatggagtgtataagtttagttggaatggctgttgggaaggagaagtttagggctgatgcgaagcaggttatggaagttcttatgtcccttcaagtatctcaaatggagacagatgatccaacaacaagttacatgctacaggcatgggctagactttgcaaatgtctgggacaagattttcttccttacatggagtttgtcatgcctccactgcttcaatctgcttcacttaagcctgatgtaaccattacatcagcagattcagacaatgagattgaagattctgatgacgaaagtatggagactattactcttggggacaaacgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctatagaaaaggggcaatctcgtggtcgggatgttacctatttgaaatttttgactgacagtatcatcccagctctggtggaagcattgcacaaggaacctgacactgagatctgtgcaagcatgttggattcattaaatgaatgcttacagatctctgggatgcttttggatgaaagccaggtcagatccatcgtggatgagataaaacaggtgatcacagctagttcaagtagaaaacgagagagagcagagaggacccgagctgaagattttgatgctgaagagggggaactgattaaagaggaaaatgaacaagaggaggaagtttttgatcaagtgggtgagatattgggaactttgatcaaaaccttcaaagccaacttcttgcctttctttgatgaactatcatcatatctgacacctatgtggggaagggacaagactccagaagagagaagaattgcaatttgtatttttgatgatgttgcagagcagtgtcgtgaagctgctgttaagtattatgatacctatctcccattcctgttggaggcttgtaatgatgagactcctgatgtcagacaggcagccgtgtatggtctcggtgtttgtgcagagtttggtggatctgtgttcaaacctctggttggagaggctctttcgaggttaaatgctgtgatccagcatcctaatgctcttcattcagataatgtaatggcatatgacaatgctgtttccgctttgggaaaaatttgccaatttcatcgtgacagtattgattctgcccaggtagttcctgcatggctaaactgtttgccaataaaaggtgatttgattgaggccaaagttgtgcatgatcaactttgttcaatggctgagaggtctgacagtgagctgttgggcccaaacaatcagtaccttccaaaaatagtttcagtgtttgctgaggttttatgtgctggtaaagaccttgctacagaacaaacagctggtcgtatggttaatttactcagacagctccagcaaactttaccaccctctacactcgcttctacttggtcatctttgcagccgcagcaacaacttgcattgcaatctatcctttctacatagttgtcattgctttgctgcatatccatcatttcttcatagcatctggcttggcagttggtgtcttgctctttttgggaacaagctttttccagtttggtggtctctatatttgtacccattctttttgccataagatggtttccatcattcattcttgcatggtgttctatatcagttttgagaatgcagagtcaattgtgattggaaagggaactttctctagaatgtgtatattatgagtgttaatagtgcgattgagtccaaaagaggaggttagggaattgtggcgtgggagcttctcgttctattcctcaattgttttttcttaccatattgcgtgagaatatagggttgtctgtggggcaattcttgcagttttggcctattgtattggttttatttccttatcagacagcatgaagttgtaccatatgaaattttaatgctatttatttattaagtttgcagacaattgtttcttcaaacaataatttattcttaattaagggcagggaaaagcatatgatttgtatgtagtatggggaatgcacttaatctgggtcctgcaaattttttgtattcgagtttttaagatttggatcctcatgtaaa

SEQ ID NO: 5843 - DNA, 4100 bp, Glycine max
ccttttcccactgatattatgacagtaaaccacaacacaacactccctcactccgcaaccgtatataaaacgacacacaaaactcacacctctctcgagagaagagtgctccgcgagtctagtctctctaatcacatcatcataaatcaaaaaccctaacccgcgcgcgtgctcacttgtcatccctctctcttcttcttcttcttctttatcgtggccgccatggattccgaggtgcagcaatcgcaagtcgccgccatcctcggcgcggatccctcccccttcgagacgttgatctcgcacctcatgtcctcctccaacgagcaacgctcccacgcggaggccctgtttaacctctgcaagcaaaccgatcccgatagcctctccttgaagctcgcgcacctcctccactcctcgccgcacgaggaggcgcgtgccatgtccgccatcctcctccggaaacagctcacgcgcgacgactcctacctctggccgcgcctctcccctcacacgcagtcttccctcaaatcgctccttctctcctcgattcaaaaggagaacatcaaatccatctccaagaagctctgcgacaccatctccgaactcgcctccggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatattttcctgcagtgtcttacgaacgcttccgttaaccctgacgtccgaattgcggcgcttaacgccgttatcaatttcatccagtgtttgtccggttccgccgatcgcgaccggttccaggacctgctgcccgcaatgatgcggacgttgaccgaggcgcttaattccggccaggaggccaccgcccaggaggcgctcgagcttctcatcgagctcgccgggactgagcctcgttttctccggcgccagcttgtggatgtcgttggcgccatgttgcagattgccgaggctgaatcccttgaggaagggactcggcatttggcgattgagtttgtgattactctcgcggaggcgagggagcgcgcccccgggatgatgaggaagttgccgcagtttattagtaggttgtttgcgatactcatgaagatgcttcttgatattgaggatgatcctgcgtggcacagtgctgagacagaggatgaggatgctggtgaaaccagtaattatagcgtgggacaagagtgcttggatagactctctatatctttgggtggaaacaccattgttcctgttgcgtccgaacagttgcctgcttacttggctgctccagaatggcagaaacggcatgctgcacttattgcacttgctcagattgctgagggctgttcaaggtcatgataaagaatttggagcaagtggtggctatggtcctgaactccttccctgaccaacacccccgtgtaagatgggcagctattaatgcaattggccagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatgggatagttagcaaactacttgtacttcttcagaatggtaagcagatggtgcaagaaggtgccttaactgctttggcatcagttgctgattcttctcaggaacacttccaaaaatattatgatgctgtaatgccatacctgaaggctatattggttaatgcaactgacaaatctaaccgtatgcttcgtgctaagtccatggagtgtataagtttagttggaatggctgttgggaaggagaagtttagggctgatgcgaagcaggttatggaagttcttatgtcccttcaagtatctcaaatggagacagatgatccaacaacaagttacatgctacaggcatgggctagactttgcaaatgtctgggacaagattttcttccttacatggagtttgtcatgcctccactgcttcaatctgcttcacttaagcctgatgtaaccattacatcagcagattcagacaatgagattgaagattctgatgacgaaagtatggagactattactcttggggacaaacgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctatagaaaaggggcaatctcgtggtcgggatgttacctatttgaaatttttgactgacagtatcatcccagctctggtggaagcattgcacaaggaacctgacactgagatctgtgcaagcatgttggattcattaaatgaatgcttacagatctctgggatgcttttggatgaaagccaggtcagatccatcgtggatgagataaaacaggtgatcacagctagttcaagtagaaaacgagagagagcagagaggacccgagctgaagattttgatgctgaagagggggaactgattaaagaggaaaatgaacaagaggaggaagtttttgatcaagtgggtgagatattgggaactttgatcaaaaccttcaaagccaacttcttgcctttctttgatgaactatcatcatatctgacacctatgtggggaagggacaagactccagaagagagaagaattgcaatttgtatttttgatgatgttgcagagcagtgtcgtgaagctgctgttaagtattatgatacctatctcccattcctgttggaggcttgtaatgatgagactcctgatgtcagacaggcagccgtgtatggtctcggtgtttgtgcagagtttggtggatctgtgttcaaacctctggttggagaggctctttcgaggttaaatgctgtgatccagcatcctaatgctcttcattcagataatgtaatggcatatgacaatgctgtttccgctttgggaaaaatttgccaatttcatcgtgacagtattgattctgcccaggtagttcctgcatggctaaactgtttgccaataaaaggtgatttgattgaggccaaagttgtgcatgatcaactttgttcaatggctgagaggtctgacagtgagctgttgggcccaaacaatcagtaccttccaaaaatagtttcagtgtttgctgaggttttatgtgctggtaaagaccttgctacagaacaaacagctggtcgtatggttaatttactcagacagctccagcaaactttaccaccctctacactcgcttctacttggtcatctttgcagccgcagcaacaacttgcattgcaatctatcctttctacatagttgtcattgctttgctgcatatccatcatttcttcatagcatctggcttggcagttggtgtcttgctctttttgggaacaagctttttccagtttggtggtctctatatttgtacccattctttttgccataagatggtttccatcattcattcttgcatggtgttctatatcagttttgagaatgcagagtcaattgtgattggaaagggaactttctctagaatgtgtatattatgagtgttaatagtgcgattgagtccaaaagaggaggttagggaattgtggcgtgggagcttctcgttctattcctcaattgttttttcttaccatattgcgtgagaatatagggttgtctgtggggcaattcttgcagttttggcctattgtattggttttatttccttatcagacagcatgaagttgtaccatatgaaattttaatgctatttatttattaagtttgcagacaattgtttcttcaaacaataatttattcttaattaagggcagggaaaagcatatgatttgtatg

SEQ ID NO: 5844 - DNA, 4069 bp, Cajanus cajan
ctctctccctcgctccctcgctccaaaacccaaacccgcaacgcaaccatataaaacgacacacacacacacacaccccgagagagagagagagaagagtggcgacctcataatccaatcatcaatcaaaaccaaaaccaaaaccaaaaaccctaaccgcgcgtcgctcatctcctcctcgccgccatcgatggatcccgcggtgcagcaatcgcaggtggcggccgttctcggcgccgatctctcgcagttcgagacgctgatctcgcacctgatgtcctcctccaacgagcagcgctcccacgccgaggcgctcttcaacctctgcaagcagaccgatcccgataacctctccctcaagctcgcgcacatcctccactcctcgccgcagcaggaggcgcgcgccatgtccgccatcctcctccgcaagcagctcactcgcgacgactcctacctctggccgcgcctctcccctcacacgcagtcctccctcaaatcgctcctcctctcctcgattcaaaccgaaaacaccaaatccatctccaagaagctctgcgacaccatctccgaactcgcctccggtatcctcccggacaacgcctggcctgaactcctccctttcatgttccagtgcgtctcctccgattcccctaagcttcaggaatctgccttcttaatcttcgcgcagttatctcagtacatcggcgattccctcactcctcatatcaagcacctccacgacatcttcctccagtgcctcaccaatccctccgttaaccccgacgtccgaattgccgctctcaacgccgttatcaatttcatccagtgcctctccggctctgccgatcgcgaccgcttccaggatttactccctgcgatgatgcggactctcaccgaggcgctcaattccggccaggaggccaccgctcaggaggctctggagcttctcatcgagctcgccggcaccgagccgcggtttctgcggcgggagctcgtggatgtcgttggcgccatgctgcagattgcagaggcggagtctcttgaggaagggactcggcatttggcgattgagtttgttattaccctcgccgaggcgagggagcgcgcccctgggatgatgaggaagttgccgcagtttattagtaggttgtttgccattctcatgaagatgcttcttgatgttgaggatgatcctgcgtggcacagcgcggagactgaggatgaggatgctggtgaaaccagtaattacagcgtgggacaagagtgtttggataggttatctatttctttgggtggaaacactattgttcctgttgcttctgaacagttgcctgcatacttggctgctccggagtggcagaagcgccatgctgccctaattgcacttgcgcaaatagccgagggctgctccaaggtcatgattaaaaatttggagcaagtggtggctatggtactgaactccttccccgaccaacatccacgggtaaggtgggcagccattaatgcaattgggcaactgtctactgatttgggtccggacttgcaagttaaatatcatcaaggagtgttgccagcactagccagtgccatggatgattttcagaaccctcgtgtacaggcacatgctgcttcagcagttctcaacttcagtgagaactgcacacctgatatcttaacgccgtacttggatggaatagttagcaaactacttgttcttcttcagaatggtaagcagatggtgcaagaaggtgccttaactgctttggcatcagttgctgattcttctcaggagcacttccaaaaatattatgatgctgtaatgccatatctgaaggctatattggttaatgcaaccgacaaatctaaccgtatgcttcgcgctaagtccatggagtgtataagtttagttggaatggctgttgggaaggagaagtttagggctgatgctaagcaggttatggaggttctgatgtcccttcaagtatctcaaatggagaccgatgatccaactacaagttacatgctacaggcatgggctagactatgcaaatgtctgggacaagattttcttccttacatggagtttgtcatgcctccactgcttcaatctgctgcacttaagcctgatgtaaccattacatcagcagattcagacaatgatattgacgattctgatgatgaaagtatggagactattactcttggggacaagcgaattggaatcaagactagtgttcttgaggaaaaagctacagcatgtaacatgctttgttgctatgctgatgagctgaaggaaggattctttccatggattgatcaggttgctgcaactttagttccgctccttaaattttatttccatgaagaggttagaaaagcagcagtttcagcaatgccggagctattacgatctgcaaaattagctatagagaagggtctatctctaggtcgggatgtatcttatttaaaatttttgactgacactatcatcccagcactggtggaagcattgcacaaggagcctgacacagagatttgtgcaagcatgttggattcattaaatgaatgcttacagatctctgggatgcttttggatgagagccaggtcagatccattgttgacgagataaaacaggtgatcacagctagttcaagtagaaaacgagagagggcagagagaacccaagctgaagattttgatgctgaagagggggaactgattaaagaggaaaatgaacaagaggaagaagtttttgaccaagtgggtgagatattgggaactttaatcaaaactttcaaagccaacttcttgcctttctttgatgaactgtcatcatatctgacacctatgtgggggagggacaagactcccgaagagagaaggattgcaatttgtatttttgatgatgttgcagagcagtgtcgtgaagctgctattaagtattatgatacctttctcccattcctgttggaggcttgtaatgacgagactcctgatgtcagacaggcagctgtgtatggccttggtgtttgtgcagagtttggtggatctgtgttcaaacctctggttggagaggctctttcgagattaaatgctgtgatccagcatcctaatgctcttcaaccagataacgtaatggcatatgacaatgctgtttccgctctgggaaaaatttgccaatttcatcgtgacagtattgattctgcccaggtagttcctgcgtggctaaactgtttgccaataaaaggtgatttgatcgaggccaaagttgttcatgatcaactatgttcaatggcggaaaggtctgacagggagctgttgggcccaaataatcaataccttccaaaaatagtttcagtgtttgctgaggttttatgtgctggtaaagaccttgcgactgagcaaacagctggccgtatgattaatttactgagacagctccagcaaactttaccaccttctacacttgcttctacatggtcatctttgcagccgcagcaacagcttgcactgcaatctatcctttcttcgtagttttcattactttgctgcattacaatccgtcatttcttcatagcatctgggttggcagtcggtgtcttgctctttttgggaacaaggtttttccagtttggtgatctctatatttgttacccattctttttgccataagatggtttccatcattcattcatgcatggttttatagcaacatggcttcagttttgagaatgcagagtcaattgtgattggaaagggaactttttgtagaatgtgtaaattatgagtgttaatagtgcgattgagtccaaaaaggaggttaggctattgtggcgtgggagcttctcgtgctattcctcttattgtttttttcttaccgtattgcgtgagaatatagggttgtctatggggcaattcttgcagttttggcctattgtattgtttttttttttttgctttcttccaccagacagtatgaagtgtaccatatgaaattctaatgctatttattcattaaggttgcagacaattgttttttttatccataatttgttctcattttagggg

SEQ ID NO: 5845 - DNA, 4317 bp, Cicer arietinum
cataaccctaatcatgatccatgacctacaaaaacaaaacacagctaataaaaaccgtctatcaccgcaagttgctctgccctaattagccccactccagcatatcctaacttattttaatttatttctcaatttcccctaccaaaggcaaaaaccacaacaaccccacagtgcatagccaacatcatggatcattctaattctaaaacccgcgaccatatataaaaagagatatatcgatagtagagcacgaagtagcgagtgattctctacatcataaaattaacactatagctcataattgaatcaaaagagggaaccctaacacactttcgctccctctttcactcgccgccaatcgtcatggatcccgagtcaactcagttacagcaatcccaactcgcggcgattctcggtgccgatccatcaccgttcgaaagtctgatctcacagttgatgacatcgtcgaacgaagaacgttcacaagccgaagctctcttcaacctctgcaaacaaaccgatcccgatggactcgtcttgaaactcggccatctccttcactcttcacctcatcaagaagctcgcgccatgtccgctattctcctcaggaagcaactcactcgcgatgattcctttctttggccgcgtttatcgcctcatactcaatcttctctcaaatcacttctactttcatcaatccaaaccgaaaacgcgaaatcgatttccaagaagctttgcgataccatctccgaactcgcttctagtattctacccgataacgcttggcctgaattgcttcctttcatgttccagtgcgtttcttctgattcacctaagcttcaagaatccgcgttcttgattttcgctcaattgtcgcagtacatcggtgattcactcacgccgcatatcaaacaccttcatgatatcttccttcagtgccttacttcatctgttgttaatcccgatgttcgaatcgccgcacttaacgctgttatcaatttcattcagtgtctttctggttcctccgatcgtgataggtttcaagacttgctgccggcgatgatgagaacattgactgaagcgctgaattccggtcaggaggcgactgcacaagaggctcttgaattgcttattgagctcgccggaactgaacctagatttctccggaggcagattgttgatgttgttggggcaatgcttcaaatcgcagaggcagagtcgttggaggaagggactaggcatttggctattgagtttgtgataactctcgccgaagcgagggagcgggctcctggtatgatgaggaagatgccgcagtttattagcaggctgtttgcgattcttatgaagatgcttttggatattgaggatgatccagcttggcacactgcggagactgaggatgaagatgctggtgaaactagcaattatagtgttggacaggaatgtttggataggttatctatatctttgggaggaaataccattgttcctgttgcttctgaacaattacctgcatatttggctgcgcctgagtggcaaaaacgacatgctgcattgattgctcttgctcagatagccgaaggatgctcaaaggtcatgataaagaatttggagcaagtggtggctatggtattgaattcgtttcctgatcaacatcctcgtgtaaggtgggcagctattaatgcaatcgggcaactgtccactgatttgggtccagatttgcaagttcaataccatcaaggggtgttgccagcactagctgctgcgatggatgattttcagaatcctcgtgtacaggctcatgctgcttcagctgtgctcaacttcagtgagaattgcacacctgatattttaacgccatacttggatggaatagttagcaaactgcttgtacttcttcagaacggtaaacaaatggtgcaagagggagccttaactgctttggcatcagttgctgattcatctcaggaacactttcagaaatactatgatgctgtcataccgtacctgaaggctatattggtcaatgcaactgataagtctaaccgcatgctccgtgctaagtctatggagtgtataagtttggttggaatggctgtcgggaaggaaaagtttagggctgatgctaagcaggtcatggaagttcttatgtccttgcaagtatctcaaatggagacagatgatccaacaacaagttacatgctacaggcatgggctagactctgcaagtgtcttggacaagattttcttccttatatggaatttgtcatgccaccattgcttcaatctgcttcacttaagcctgacgtaaccatcacatccgctgattcggataatgagatagaggactctgatgatgaaagtatggagactatcactctcggggacaaaagaattggaatcaagactagtgttctagaggaaaaagctacggcatgtaacatgctttgttgctatgccgacgagttgaaggaaggattctttccatggattgaccaggttgcaggaactttggttcctctccttaaattttatttccatgaggaggttagaaaagcagctgtttcagcaatgccggaactattacgatctgcaaagttagccattgagaaagggcaatctcaaggtcgggatgtgagctatttgaagtttttgactgacagtatcatccctgctttggtggaagcgttgcataaggaacctgacacagagatttgtgcaagcatgttagattcactaaatgaatgcttacagatctctgggatgcttttagatgaaaagcaggtcagatcaattgttgaagagataaaacaagtgatcacagctagttcaagtagaaaaagagagagagcagagagggcccaagctgaagattttgatgctgaagaaggggagctgattaaagaggaaaatgaacaagaggaagaagtttttgaccaagtgggtgagatattaggaaccttgatcaaaaccttcaaagcctccttcttgcctttctttgaagaactgtcatcttatttgacacctatgtggggaagggacaagactcctgaagagagaaggatcgcaatttgcatttttgacgatgttgcagagcagtgccgtgaagcagctataaagtattatgatacatatcttccattcctgttggaggcatgtaatgatgagactcctgatgtcagacaggcggctgtgtatggccttggtgtttgtgcagagtttgggggttctgtgttcaaacctcttgttggagaggctctatcgaggttaaatgctgtgatccaacatcctaatgcacttcattcagataatgtaatggcatatgacaatgcagtttctgctctgggaaaaatttgccaatttcaccgggacagtattgattctgctcaggtagttccagcatggttgaactgtctgccaataaaaagtgatttgattgaggcaaaagttgttcacgatcaactttgttcaatggcggaaaggtctgacagtgagttgttaggtccaaacaatcaataccttcccaaaattgtctcggtgtttgctgaggttttatgtgctggtaaagatcttgcaacagaacaaacagctggccgaatggtgactctactcagacagctccagcaaacactaccgcccgctacccttgcctccacttggtcatctttgcaaccacaacaacagcttgctttacaatccatcctttcttcgtagttttcatctctttgctgcatcgcagtccatcatttcttcattgcatctgggttggcagttggtgtcttgcactttttgggaacaagatttttccggtttggtggtctattattgttacccattctttttgccataagatggtttcccatcattcattcttgcatggtgtttttatagcaacatggctccagttttgagaatgcagagtcaattgtgattggaaaggaaactttctgtagaatgtgtatattattatgagtgttcatggtgcgattgagtctaaaaggaggttaagcagttgtggtgttggagcttcacctgctattcctgttttttttgttcttacattattgcgtgagaatatagggttgtctgtgtggcaattcgtgcagttttggcctattgtattgttttttcgggtgtcagattctgacttgtaaaatattgaaataccgatgctatttattcatcaaggttgcaaacatttgtttatcaattaaataatttgtcttcagtcaaaattattgcacctacatttctgaaattgtcttgtgtagtgtatgagttgaatgcagttgattaaattttatgtttgcaaag

SEQ ID NO: 5846 - DNA, 4055 bp, Medicago truncatula
cccaaacccctttttcttcctaaaccaaacccatagtgcggcaacatcattcatcattctaaattctacccgcgagcgtatataaaaaacacaagtaacgaatcgtaattctcattctcatcattgaatcaaaagagcgaaaccctaaaactatttttcgctcttcttctctctcgccgccacaatcatcatcatcgtcatggatcccgagtcaactcagttgcaacaatcccaactcgcggcgattctcggcgccgatccatcaccgtttgagactctgatctcacacttgatgtcttccaccaacgaagaacgttctcaagccgaagctctcttcaacctctgcaaacaaaccgatccagacgcactcgttttgaagctaggtcatcttcttcattcttcacctcatcaagaagctcgcgctatgtctgctattcttcttcggaagcaactcacgcgtgatgattcattcctctggcctcgtctttcgtccaacactcaagcttctctcaaatcgcttctgctttcatcgattcaatccgagaatgcgaaatcgatttcgaagaagctttgtgatacaatctctgaactcgcttccagtattttaccagataacggttggcctgaattgcttccgtttatgtttcagtgcgtttcgtctgattcggccaaattacaagaatctgcgtttttgattttcgctcaattgtcgcagtatattggtgattctctcacgccgcatatcaaacaccttcatgatatttttcttcagtgtcttactagctctgctgttaatcctgatgtcagaattgctgctttgaatgctgttattaattttattcagtgtttatctggttccgccgatcgagataggtttcaggatttgttacctgcgatgatgactacgctgacggaggcgttgaattcaggtcaagaggcgactgctcaagaggcgcttgagttgcttattgagctggcagggactgagccgaggtttttgaggaggcagattgttgatgttgttggggcaatgcttcagattgcggaggcagagtcgttggaggaagggaccaggcatttggctattgagtttgtgattactcttgctgaagctagggagcgtgctcctggtatgatgaggaagatgccgcagtttattagtaggttgtttgctattctgatgaagatgcttttagatattgaggatgatccggcgtggcacactgcggatactgaggatgaggatgctggtgaatctagcaactatagtgttggacaggagtgtttggataggttatctatatctttgggaggaaatacgatcgttcctgttgcttctgaacaattacctgcgtatttggctgcaccggagtggcaaaaacgccatgctgcattgattgctcttgctcagatagccgagggaagttcaaaggtcatgataaaaactttagagcaagtggtggctatggtattgaattcctttcctgatcaacatccccgtgtaaggtgggcagccattaatgcaattggacaattgtctaccgatttgggtccggatttgcaagttcaatatcatcaaggggtgatgccagccctagctgctgccatggatgattttcagaatcctcgcgtacaggctcatgctgcttcagcagtgctcaacttcagtgagaattgcacgcctgaaattttaacgccatacttggatggaatagttagcaaattgcttgtacttcttcagaatggtaaacaaatggtgcaagagggagccttaactgctttggcatcagttgctgattcatctcaggaacacttccagaaatattatgatgctgtcataccgtacctgaaggctatattggtcaatgcaactgacaagtctaaccgcatgcttcgtgctaagtctatggaatgcataagtttggttggaatggctgtcgggaaggagaaatttagggctgatgctaagcaggtcatggaagttcttatgtccttgcaaggatcacaaatggagacagatgatccaacaacaagttacatgctacaggcatgggctagactctgcaagtgtcttgggcaagattttcttccttatatggaatttgtcatgccacctttgcttcagtctgcttcacttaaacctgatgttaccatcacatctgctgattcagacaatgatatagatgattctgatgatgaaagtatggagactatcactctcggtgacaaaagaattggaatcaagactagtgttctagaggaaaaagctacagcatgtaacatgctttgttgttatgccgatgagttgaaagaaggattctttccatggattgatcaggttgcaggaactttggttccactccttaaattttatttccacgaggaagttagaaaagctgccgtttcagcaatgccggaactattacgatctgcaaagttagccattgagaaagggcaatctcaaggtcgggatgtgagctatttgaagtttctgactgacagtatcatcccagctttggtggaagcattgcataaggaacctgacacagaaatttgtgcaagtatgttggattcagtaaatgaatgcttacagatctcggggatgcttttggatgaaaagcaggtcaagtcaattgttgaagaggtaaaacaggtgatcacagctagttcaagtagaaaaagagagagagcagagagggcccaagctgaagattttgatgctgaagagggggagctaattaaagaggaaaacgagcaggaggaagaagtttttgaccaagtgggcgagatattgggaactttgatcaaaaccttcaaagcatccttcttgcctttctttgaagaattgtcatcttatttgactcctatgtggggaagggacaagactcctgaagagagaaggattgcaatttgcatttttgatgatgttgcagagcagtgtcgtgaaggagctattaagtattatgatacgtatcttccatttttgttggaggcatgtaatgatgaaactccagatgttagacaggcagcagtatacggcctcggtgtttgtgctgagtttgggggttctgtgttcaagcctcttgttggagaggctctatcgaggttaaatgctgtgatccaacatcctaatgcgcttcatccagataatgtaatggcatatgacaatgcagtttctgctctgggaaaaatttgccaatttcaccaggacagtattgactctgcccaggtagttccggcatggttgaactgtctgcccataaaaggtgatttgattgaggctaaagttgttcatgatcaactttgttctatggcggagaggtctgacagctctctcttagggccaaacaatcaataccttcccaaaatagtagcggtatttgcagaggttttatgtgctggtaaagacctggcaacagaacaaacagctggccgaatggttagtttactcagacagctccaacaaacattaccgcctgctacccttgcttccacctggtcatctttgcagccgcaacaacagcttgctttacaatccatcctttcttcatagtttgctgtttgcaattcatcgtttctccatagcatctgggttggcagttggtgtctcgcacttttttggggaacaagctttttccagtttggtggtctatatatttgttacccattctttttgccataagatggtttccatcattcattcttgcatatggtgtttttatagcagcatggcttcagttttgagaatgcagagtcaattgtgaatgtgtatattgagtgttcatggtgcgattgagtccaaaaggaggttaggcagttgttgcatcggagcttcacgtgctattcctctttttattttgttcttgccgtattgcgtgagaatatagggttgtctgtggggcaattcgtgcagttttggcctgttgtattgtttttttcttcttctttcttttctttctttttctcttctttctgatatcagattcagaagtgtatcatatgaattaccgatgttatttatcaagtttgctgacattttatttatccaagtaata

SEQ ID NO: 5847 - DNA, 4081 bp, Medicago truncatula
tccagcataccccaaacccctttttcttcctaaaccaaacccatagtgcggcaacatcattcatcattctaaattctacccgcgagcgtatataaaaaacacaagtaacgaatcgtaattctcattctcatcattgaatcaaaagagcgaaaccctaaaactatttttcgctcttcttctctctcgccgccacaatcatcatcatcgtcatggatcccgagtcaactcagttgcaacaatcccaactcgcggcgattctcggcgccgatccatcaccgtttgagactctgatctcacacttgatgtcttccaccaacgaagaacgttctcaagccgaagctctcttcaacctctgcaaacaaaccgatccagacgcactcgttttgaagctaggtcatcttcttcattcttcacctcatcaagaagctcgcgctatgtctgctattcttcttcggaagcaactcacgcgtgatgattcattcctctggcctcgtctttcgtccaacactcaagcttctctcaaatcgcttctgctttcatcgattcaatccgagaatgcgaaatcgatttcgaagaagctttgtgatacaatctctgaactcgcttccagtattttaccagataacggttggcctgaattgcttccgtttatgtttcagtgcgtttcgtctgattcggccaaattacaagaatctgcgtttttgattttcgctcaattgtcgcagtatattggtgattctctcacgccgcatatcaaacaccttcatgatatttttcttcagtgtcttactagctctgctgttaatcctgatgtcagaattgctgctttgaatgctgttattaattttattcagtgtttatctggttccgccgatcgagataggtttcaggatttgttacctgcgatgatgactacgctgacggaggcgttgaattcaggtcaagaggcgactgctcaagaggcgcttgagttgcttattgagctggcagggactgagccgaggtttttgaggaggcagattgttgatgttgttggggcaatgcttcagattgcggaggcagagtcgttggaggaagggaccaggcatttggctattgagtttgtgattactcttgctgaagctagggagcgtgctcctggtatgatgaggaagatgccgcagtttattagtaggttgtttgctattctgatgaagatgcttttagatattgaggatgatccggcgtggcacactgcggatactgaggatgaggatgctggtgaatctagcaactatagtgttggacaggagtgtttggataggttatctatatctttgggaggaaatacgatcgttcctgttgcttctgaacaattacctgcgtatttggctgcaccggagtggcaaaaacgccatgctgcattgattgctcttgctcagatagccgagggaagttcaaaggtcatgataaaaactttagagcaagtggtggctatggtattgaattcctttcctgatcaacatccccgtgtaaggtgggcagccattaatgcaattggacaattgtctaccgatttgggtccggatttgcaagttcaatatcatcaaggggtgatgccagccctagctgctgccatggatgattttcagaatcctcgcgtacaggctcatgctgcttcagcagtgctcaacttcagtgagaattgcacgcctgaaattttaacgccatacttggatggaatagttagcaaattgcttgtacttcttcagaatggtaaacaaatggtgcaagagggagccttaactgctttggcatcagttgctgattcatctcaggaacacttccagaaatattatgatgctgtcataccgtacctgaaggctatattggtcaatgcaactgacaagtctaaccgcatgcttcgtgctaagtctatggaatgcataagtttggttggaatggctgtcgggaaggagaaatttagggctgatgctaagcaggtcatggaagttcttatgtccttgcaaggatcacaaatggagacagatgatccaacaacaagttacatgctacaggcatgggctagactctgcaagtgtcttgggcaagattttcttccttatatggaatttgtcaaaccacctttgcttcagtctgcctcacttaaacctgatgttaccatcacatttgctgattcagacaatgatatagatgattctgatgatgaaagtatggagactatcactctcggtgacaaaagaattggaatcaagactagtgttctagaggaaaaagctacagcatgtaacatgctttgttgttatgccgatgagttgaaagaaggattctttccatggattgatcaggttgcaggaactttggttccactccttaaattttatttccacgaggaagttagaaaagctgccgtttcagcaatgccggaactattacgatctgcaaagttagccattgagaaagggcaatctcaaggtcgggatgtgagctatttgaagtttctgactgacagtatcatcccagctttggtggaagcattgcataaggaacctgacacagaaatttgtgcaagtatgttggattcagtaaatgaatgcttacagatctcggggatgcttttggatgaaaagcaggtcaagtcaattgttgaagaggtaaaacaggtgatcacagctagttcaagtagaaaaagagagagagcagagagggcccaagctgaagattttgatgctgaagagggggagctaattaaagaggaaaacgagcaggaggaagaagtttttgaccaagtgggcgagatattgggaactttgatcaaaaccttcaaagcatccttcttgcctttctttgaagaattgtcatcttatttgactcctatgtggggaagggacaagactcctgaagagagaaggattgcaatttgcatttttgatgatgttgcagagcagtgtcgtgaaggagctattaagtattatgatacgtatcttccatttttgttggaggcatgtaatgatgaaactccagatgttagacaggcagcagtatacggcctcggtgtttgtgctgagtttgggggttctgtgttcaagcctcttgttggagaggctctatcgaggttaaatgctgtgatccaacatcctaatgcgcttcatccagataatgtaatggcatatgacaatgcagtttctgctctgggaaaaatttgccaatttcaccaggacagtattgactctgcccaggtagttccggcatggttgaactgtctgcccataaaaggtgatttgattgaggctaaagttgttcatgatcaactttgttctatggcggagaggtctgacagctctctcttagggccaaacaatcaataccttcccaaaatagtagcggtatttgcagaggttttatgtgctggtaaagacctggcaacagaacaaacagctggccgaatggttagtttactcagacagctccaacaaacattaccgcctgctacccttgcttccacctggtcatctttgcagccgcaacaacagcttgctttacaatccatcctttcttcatagtttgctgtttgcaattcatcgtttctccatagcatctgggttggcagttggtgtctcgcacttttttggggaacaagctttttccagtttggtggtctatatatttgttacccattctttttgccataagatggtttccatcattcattcttgcatatggtgtttttatagcagcatggcttcagttttgagaatgcagagtcaattgtgaatgtgtatattgagtgttcatggtgcgattgagtccaaaaggaggttaggcagttgttgcatcggagcttcacgtgctattcctctttttattttgttcttgccgtattgcgtgagaatatagggttgtctgtggggcaattcgtgcagttttggcctgttgtattgtttttttcttcttctttcttttctttctttttctcttctttctgatatcagattcagaagtgtatcatatgaattaccgatgttatttatcaagtttgctgacattttatttatccaagtaataatttgccgtcgatcaa

SEQ ID NO: 5848 - DNA, 3837 bp, Citrullus lanatus
ccatacccatttctctttctctttgaagtttgatcttcaatggatcctcagtccacccagctgcagcaagcccagcttgcagctattctgggtcctgaccttgccccttttgaaacccttctctcccaccttatgtcatcctctaacgagcaacgatcgcaggctgaactcgtcttcaatttatgcaagcagaccgatcccgattctctctcactcaagctcgctcatcttcttcagttctctcctcaacccgaggcccgtgccatgtctgctgttctcctccggaagcagctaactcgcgatgattcatatctatggcctcgcctcaatccctcctctcagtcctcccttaaatccatacttttgtcctgtattcaacgcgaggaatccaaatccatatccaagaaattgtgtgatacggtttccgagctggcttctggaatcttgccggataacggctggccagaattgttgcctttcatgtttcagtgtgtatcgtcggattctcccaagctgcaagaatcggctttcttgatctttgcccaactttcgcattatattggggataccttggtgccccatattaagcacttgcacggtgtgtttttgcagtgcttgacgtcaacctcttcgagcaccgatgtgaagattgcggccctcaatgctgttatcagcttcatacagtgcttgtccaactctgctgatcgcgacaggtttcaggatttgctgccaccgatgatgcggacactaatggaggcgttgaataacgggcaggaggcaacagcgcaagaggcacttgaattgttgatcgaattagccgggacggagccgaggtttttgaggcggcaattagtagatgtagtgggatcgatgttgcaaattgcagaagctgagtcgttggacgaaggaacgaggcacttggcgattgaatttgtgatcactcttgcagaagccagggagcgggcacccggaatgatgagaaagatgccacagtttatatccaggttgttcgccatattgatgaaattgctcttggatattgaagatgatccggcgtggcacgctgctgagaacgaagacgaggatgcaggcgagaccagtaactacagtgttgggcaggagtgtttggataggcttgcaatttctctgggtggcaataccattgtccctgttgcttctgagctgtttcctgcttacttagctgctccagagtggcagaatcgccatgcggcattgatcgcaatggcccaaattgcggagggttgttcaaaggttatgataaaaaatttagaacaagtggtggcaatggtcttgaactcatttcaagatccacatcctcgtgttaggtgggcagcgattaatgcaattggacagttatctacagacttaggtccagatctgcaagttcaataccatcagcaggtgcttcctgcacttgctacagcaatggatgatttccagaaccccagagtacaggctcatgctgcatctgcagttcttaacttcagtgagaactgtactccagatatcttgacaccttatttagatgggatagttggcaaattgcttttacttttacagaacgggaagcaaatggtgcaagagggggccttgactgctttggcttcagttgctgattcatctcaggagtatttccaaaagtattatgacgctgtcatgccatacctaaaagcaatcttagttaatgccactgataagaccaaacgcatgcttcgtgccaaatccatggagtgcatcagtttggttgggatggcagttggaaaggagaagttcagggatgacgccaagcaggttatggaggtgctgatgtcattgcaaggatctcagatggaggcagatgatccgactacaagttacatgttacaagcatgggcacggctttgcaagtgtttgggacaagatttcctcccttatatgagtgtggtcatgcctcctttgcttcagtctgcccagcttaagcctgatgtaaccatcacatctgctgattctgataatgatatcgaggactctgatgatgatagtatggaaacaattactcttggggacaaaagaataggaatcaagactagcgttcttgaggaaaaagctacagcttgtaacatgttgtgttgctatgcagatgagttgaaggaaggattttttccatggattgatcaggtcgccccgaccttagtcccactccttaaattttactttcatgaagaagtcaggaaagcagctgtttcagcgatgccggagcttatgcgatctgcaaagctagctgttgaaaaggggcttgctcaaggacgtaatgagacctatataaaacagctgtcagattatattgttccagccttagttgaagctttacataaggaacacgatacagagatttgttctagtatgctggaggcgttaaatgaatgcttacagatatctggaccacttcttgatgaaagccaagtcagatccatagttgatgagataaaacaggtgattactgccagttccagtagaaagagagagagagcagagagggccaaggcggaggattttgatgcagaggagggagaattgattaaagaggaaaatgaacaagaggaagaagtctttgatcaagttggtgaaatattgggaactttgataaaaacattcaaagcgtctttcttgcctttctttcaagaactgtctacatatctaacgcctatgtgggggaaagataagacgcctgaagaaagaaggattgcaatttgcatctttgatgatgttgcagaacagtgtcgcgaagcagcgctgaaatattacgatacatatcttcccttcctacttgaagcttgcaatgatgagaatcctgatgtcagacaggctgctgtgtatgggcttggtgtctgtgcagagtttggtggatccgtgtttaaaccacttgttggagaggctctgtcaaggttaaatgttgtattgcgacatcctaatgctctacaacctgaaaatgtaatggcatatgacaatgctgtttcggctttggggaagatttgtcaatttcatcgtgacagtattgattcggctcaggttgttccagcatggttaaactgcttaccaataaaaggtgatttggttgaagcaaaaatcgtgcacgaccagctttgttctttggtggagaggtcggatatggagcttttgggcccaaataatcaatatcttcccaaaatagttgcagtatttgccgaggttttatgtgcgggaaaggatttagcaacagagcaaactgccagccgaatgataaatttgttgagacaaatgcaacagaatttaccgccttctactttggcctctacttggtcctcgttgcagccccaacaacaacttgctttgcagtctattctttcatagtttcatgaaggtgactctggattttgctgctgcccgcgagatgcacactttttatgttcttgtttgtgtgaaatatattcgtccccattctttgccataaatgctctcaagcatgagttttgtctttgaaatctgatgatgagtgaaaatcattgttgctgctgaaaaggaatgtgttaagaaaaaaaaaaaaattgtgtatatttcattgtttaattctaagtggggtgggttcaggtccgaggtgtcattgtggtttttgtttcgggtgggtcgccatggaggcaatccttttacagttttgttttggtccaaattaatgagtatcattgtcattataaattttcgttgcagtttaagaatatatcaaattaattttgtgattggcgtttgctttatttgttttgaattttatttccaattagcaatgaaacttgacgtcttcta

SEQ ID NO: 5849 - DNA, 3711 bp, Manihot esculenta
aaaccctaattctctataccatggacgattcaactcagcaactccagcaagctcaactggccgccatactcggccaggaccctgcccctttcgaaaccctaatctcctctctcatgtcttcctccaacgagcaacgatcgcaggctgagctcgctttcaatctctgcaagcagaccgatcccgattctctctcccttaaactcgctcaccttcttcagttctctcctcacgccgaggctcgcgctatggccgccgtcctccttcgcaagctccttacccgcgatgacgcttatctctggcctcgtctctcccctgcaacgcagtcttctatcaaatctattctcttgacttgtattcagcacgaccagactaaatctattgttaagaagttgtgcgatactgtttctgagcttgcctctggtattttgcctgagaatggctggcctgagcttttgccttttatgttccagtgcgtttcttctgattctccaaagctacaggaatcggcgttctttatttttgctcagttgtctcagtatattggcgagacgttagttccgtttattaaggagttgcactcggtatttttgcagtgtttgggatcatcgccgaattttgatgttaagattgcggccttgaatgcggttatcaattttattcagtgtttgagtagctcgtcggatcgggataggtttcaggatttgttgccggcgatgatgtctacgttgactgaagctttgaataatgggaatgaggccacggcgcaggaggctttggagcttcttatcgagttggcaggtacagagccaaggtttctgcgtcggcaattggtggatgtggttggttccatgttgcagattgctgaggctgagagtttagaagaagggactcgccacttggctattgagtttgttatcactttagctgaggcaagggagagggcgccaggaatgatgagaaagttgccacagtttataagcaggttgttcgccatattgatgagaatgttgttggatgttgaggatgatccagcatggcatagtgccgagaccgaggacgaagatgcaggagagaccagcaattatagcgttggacaggagtgtttggataggttggccatttcattgggtgggaatactattgttccagtggcttctgagcagttgcctgcatatttggctgctccggaatggcagaagcatcatgctgccctcattgctcttgctcaaattgctgagggttgttccaaggtaatgataaaaaatctggaacaaattgtctcaatggttctaaactcattccacgatcctcatcctcgtgtgagatgggcagctattaatgcaattggacagttgtccactgatttgggtccagatttgcaaaatcaatatcatcaaagggtgttgccagcacttgcaagtgcaatggatgatttcccaaatcctcgagtgcaggctcatgctgcttcagcagtgctcaacttcagtgagaactgtactccagatattttaacgccttacttagatggcatagtgagcaaattacttgtactattacagaatggaaaacaaatggtgcaagagggagccttgactgccttggcctcagttgctgactcatcccaggagcatttccaaaagtactatgatgcagtaatgccatacttgaaggctatcttagtgaatgcaacagacaaatctaaccgtatgcttcgtgccaaatccatggagtgcattagcctggttgggatggcagttgggaaggataaatttagagaggatgctaagcaggttatggaagtccttatgtctttgcaaggatctcaaatggagacggatgacccaacaacaagttacatgttacaagcttgggccaggctctgcaagtgtttggggcaagattttcttccttatatgacagttgttatgccacctctgcttcaatctgcacagctcaagccagatgtaaccattacatctgctgattcagataatgatattgatgactcagatgatgaaagtatggagactatcacccttggagacaagagaatagggataaaaactagtgtcctggaagaaaaagcaactgcatgtaacatgttatgttgttatgctgatgagcttaaggaaggcttctttccatggattgatcaggttgccccaaccttagttcctcttctgaaattttatttccatgaagaggtcaggaaagcagctgtttcagccatgccggagcttctgcgttctgcaaaattagctgtagagaaggggttgtctcaaggtcgcaatgagtcctatgtaaaacagttgtctgactatattattccagctttggtggaagcattacataaggaacctgatactgagatttgtgcaaatatgttggatgcattaaatgaatgcttacagatatctggaccacttgttgatgaaggtcaggtgcgatctattgtagctgagataaaacaggtgatcacagctagttctagtaggaaaagagagagagcagagagaaccaaagctgaagactttgatgctgaggagggagagttgattaaagaggaaaatgagcaagaggaagaagtttttgatcaagtgggtgagatcttgggaactttgataaaaacatttaaagtctctttcttgcctttctttgacgagctatcaacatatcttactcctatgtggggcaaggataagactcctgaggagaggaggattgcaatttgcatttttgatgatgtggcagagcaatgtcgtgagacagcgcttaaatactatgatacatatcttccattcctattagaggcttgcaatgatgataatcctgatgttagacaggcagccgtatatggacttggagtttgtgcagagtttggtcgatctgtatttaaacctcttgtcggagaggctctatccagactaaatgttgtgatagggcatcctaatgcgaagcaacctgaaaatgtcatggcatatgataatgctgtttctgcattgggaaaaatttgccagttccatcgtgaaagtattgattcaactcaggttgttccagcatggttaaactgtttgccaataacaggtgatttgattgaagcaaaagttgtccatgaacagctttgttcaatggtggagaggtcagacagtgagcttctgggccccaacaatcagtatctacctaagatcgtttcagtatttgcagaggttctatgcggtaaggatctggccacagaacaaactgcaagccgaatggtaaacctgttgagacaccttcagcagactttaccaccagcaacattggcttcgacttggtcaatgttgcatccccagcaacaaatggcattgcaatcaattctgtcatcatagtctgtggtatggcatcggcaagctcttctcaatattcagtcttcagtcagtctgtgtgaaagtatatttattacccattcttttccataagatggttcccatcatttgtttttgcctgatgttctgcacaacctggtatcggttggatggagtgtgaaagctgatacattgagattgaggtgaatccttttttgtagaatgtgtatattatttataattgtttatttacagttggaatcaagtcaacgaggaagaaaagaagtgtaggtatttgtgttttgtttttttaaccattttggttggtgcgtgaggttggagggttgtcattgaggcaattcttgtc

SEQ ID NO: 5850 - DNA, 3997 bp, Prunus persica
accccaaaaatcaaaactatagtgaagtgagaggggagagagagagagagagagcgccagccacctttgcaggctctctcacatacactcatccgcagccaaaagcctcagaaagccctaaaaccgtaactgagtggtgaggttgtttgttgcagcaatggccgactcgactcagctacagcatgcccaactggcgacgattctcggccccgacccggcccctttccaaaccctaatctcccacctcatgtcctcctccaacgagcagcgatcccaagccgagctcctcttcaacctctgcaagcagaccgatcccgactcgctttccctcaaactcgcccaccttctccagttctctcccgccccggaggcccgagccatgtccgccattctcctccgcaagcagctcactcgcgacgactcgtacctctggccccgcctctcccccaccacccaatccaatctcaaaaccattctcttgacctgtattcagcgcgaggacaccaaatccatatccaagaagctctgcgacaccatttccgagctcgcctccgggattttgcctgataacgcctggcccgagctcttgcctttcatgttccaatgcgtctcctccgattcgcccaagcttcaagaatcggcgtttttgatattcgctcagctttcgcagtacatcggcgacaccttggtgccgcatataaaggaattgcactccgtgttcttgcatagtttgggaaactcgtcaagcgccgaagtgaagatcgcggccttgaacgccgtcatcaatttcatccagtgtttgacgagctctgccgatagggataggtttcaggacctgttgccggcgatgatgaggacgctgatggaggctttgaacaacgggaacgaggccacagcgcaggaggctctcgagttgttgatcgaattggccgggaccgagcccaggttcctcaggcggcagattgtggaggtggtcgggtctatgctgcagattgccgaggccgagtcgttggaagaagggaccaggcacttggccattgagttcgtcatcacgctcgccgaggccagagagcgcgcgcctgggatgatgaggaagttgccgcagtttataagccgattgttcgctattttgatgagtatgcttttggatatccaggacgatcccgcatggaatacagcagagactgaagatgaggaagcgggtgagaccagtaattacagtgtggggcaggagtgtttggatcggcttgctatatccctgggtgggaataccattgttccagtcgcttccgagcagttgccggcatatttggctgcccccgagtggcagaagcaccatgctgcgttgattgcactagctcagattgccgaaggttgcgctaaggtaatgattaaaaatttagagcaagtggtggcaatggtcttgaactcatttcaagatccacatcctcgtgtaaggtgggcagctattaatgcaattgggcagttgtctacggatttgggcccagatctgcaagttcaatatcatcagcaggtgctcccagcattggctgcagctatggatgattttcagaaccctcgtgttcaggcacatgctgcttcagcagtgctcaacttcagcgagaattgtactccggatattttaacaccttatttggatggagtagtgagcaaattgctagtacttctgcagaatgggaaacaaatggtgcaagagggagccttgactgctttggcatcagttgctgattcatctcaggagcatttccaaaaatactatgatgcagttatgccttacctaaaagctatcttgatgaatgcaactgataaatctaatcgtatgcttcgcgccaaatccatggagtgcattagtttggttggtatggctgttggaaaggataaattcagggatgatgctaagcaggtcatggaagtgttgatggctttgcaaggatctcaaatggagacagatgatccaactacaagttacatgctacaagcatgggctagactttgcaagtgtttaggacaagatttcctcccctacatgagtgttgtaatgcctcctttgcttcagtctgctcaacttaagccagatgtaaccattacatctgcagatgacaatagtgatattgatgactctgatgatgaaagtatggaaacaattactcttggggataaacggattggaatcaagactagtgtcctggaggaaaaagctacagcttgcaatatgctgtgttgctatgctgatgagttgaaagaaggattctttccgtggattgatcaggttgccccaactttggttccacttcttaaattttatttccatgaagaggttaggaaggcagctgtttcagcaatgccggagctactgctttctgcaaaattagctatagagaaagggcaagctcaaggtcgtaatgaaacctatataaagcaattgtctgactacattgtcccagctctggtggaagcattacacaaggaacctgatacagaaatatgtgcaaatatattggacgcattaaatgaatgcttacagatatctggaccacttttagatgaaagccaggtcagatccattgtggaggagataaagctggtgataactgccagttcaagtagaaaaagagaaagagcagaaaggaccaaagccgaagattttgatgctgaggaaggggagctcattaaagaggaaaatgaacaagaggaagaagtttttgatcaagtgggagagatcttgggaactttgatcaaaacgtttaaagcctctttcttgcctttctttgacgagctatcatcatatctgacacctatgtgggccaaggataaaacacctgaagagagaaggattgcaatatgcatctttgatgatgttgcagagcagtgtcgcgaggcagctgtaaaatattacgacacatttcttccttttctattggaggcttgcaatgacgataaccctgatgttcgacaggcagctgtatatggacttggtgtctgttcagagtttggcgggacagtaattaaacctcttattggcgaggctctttcgaggctaaatgttgtgattcagcatcctaatgccgtgcaaccggaaaacctaatggcatatgataatgccgtttctgctctaggaaaaatatgtcaatttcatcgcgacagtattgatgcagctcaggttattcctgcatggttgaactgtttaccgattaaaggtgacttgattgaagccaaagttgttcatgatcagctgtgttctatggtagaaaggtctgacagggaacttttgggtcccaacaatcagtatcttcccaaaattgtcgcagtgtttgccgaggttctttgtgctggcaaggatttagcaacagaacaaactacaagccggatgataaatctattacggcagcttcagcagactttgccaccagctaccttggcctccacttggtcctccttacaaccccagcaacagcttgcactgcaatctatcctgtcctcatagtatgttggccttgcaatgtgcatgttgctgctttcagatacaccatccctgtcttgtgtgttagttgcatctgtcaccaattcttttccataagatggtacccatcagtcatttttgcgtaaagttttacagcgagccagcatctgattaaacgtggaagtcatcattgcgatctgttcaatcagacccttttttgtaggatgtgtatatgcaagtgtcaagtgttaatttattagtgcaattttgagtccaaaagaagaaaggaaggcaggtaattgtggtttgtgcgcttgtgcgcttgttctttttggtttttggtggtgcctaaggttctgagggtggttggtgagaaaattcttgtatcagttttggtcttgtgttttggtgtttcctacgcctccattatgagaatccgttgactaaactttcgatggcaattctttcattatgtttgcaatcttgatcccaaaaggcaataaattggcttatggt

SEQ ID NO: 5851 - DNA, 3984 bp, Gossypium raimondii
tattttcccccacactcccactcaagaagacgcccaacaaaacacagagcaaaagcattaacaaagaggcgacaaaggaatcaattccatcattttctccgtctccgtttcctcctccttctccttcgccgccatggaccagcaatcgcagctcgccctcatcctaggacctgacccgattccatttgaaaccctagtctcccacttgatgtcatcatcaaacgaacaacgttctcacgctgaggccttgtttaatctatgcaagcaatcggaccctgacgccctctgcctccgcctcgcccaccttctccaagtctgcactcagcccgagattcgtgccatggcagctattctcctccgtaagttgttgacgcgtgacgactcttatatctggcctcgcctcaacatttctacacagtcttccctcaaatccgtgcttctgtctcaaatccaagtggaaaccaccaaaaatttatctaaaaagctgtgcgatactgttgcggagcttgcttccagtattttgccggagaatgggtggccagagctcttgccgtttatgttccagtgtgtctcttcggattcccctaaattacaggagtctgcttttttgatattcgcgcagctgagtcaatatattggggatgtgttgactccttttataaaggatctacacactgtgttcttgaggtgcctgagtgaaagttctaatgccgatgtcaaaattgctgcgttgaatgcggtcatcaactttattcagtgtttgaccagctcatccgatcgggataggtttcaggatcttttgccggcaatgatgaggaccttgacagaggctttaaataacgggaatgaggccactgctcaggaggcacttgagttgttgatcgagttggcaggtaccgagccacggtttcttaggaggcagcttgttgatgtagtgggttcgatgctgcagattgcagaggcagaatctcttgaggaagggacacgtcatttggcgattgaatttgtggtgactttggcggaagcaagggagcgtgctcctggaatgatgcggaagttgccgcaatttattagtaggttatttgcaatattgatgagaatgctgttagatattgaggatgatgcagcatggcacacagcagaatctgaggatgaggatgctggagagaccagcaattacagtgtcggacaggagtgtttggatcgtttggcaatttccttaggtgggaacacaattgttcctgttgcatctgagcagttgcctgcttatttggctgcttctgagtggcaaaagcatcatgctgcactaattgcccttgctcagattgctgaggggtgtgccaaggttatgattaaaaatctggaacaagtggtttccatggttttgaactcatttcatgattctcatcctcgtgtaaggtgggcagctattaatgcaattgggcaattgtctaccgacttaggaccagatttgcaaaaccaatatcaccaaagagtattgcctgcattagctggcgctatggatgattttcagaatccacgagtacaggcccatgctgcttcagctgtactcaactttagtgagaactgcactccagaaattttaacaccttacttggatggaatagtcagcaaattgcttgtacttttacagaatgggaaacaaatggtgcaagaaggtgccttgactgctttggcatcagttgccgactcatctcaggagcacttccaaaaatattatgatgcagttatgccttacctgaaagcaatcttggtaaatgcaactgacaaatctaatcgtatgctacgtgccaaatccctggagtgtattagtcttgttggaatggctgttggaaaagagaagttcagagatgatgctaagcaggttatggaagtgcttatgtcattgcaaggatcccaaatggaaacagatgatccaacgacaagttacatgctgcaagcatgggctagactctgcaagtgtttgggacaagacttcctcccttacatgagtgttgtcatgcctccccttcttcagtctgctcagcttaagccggatgtaactattacatctgcagattcagataatgacatagaggactccgatgatgaaagtatggaaaccattacgcttggggacaaaagaattgggatcaagacaagcgttctggaggagaaggctacagcatgtaacatgctatgttgctatgccgatgagttgaaggaagggttttttccatggattgatcaggttgctccaactttagttcctcttcttaaattttatttccacgaggaagttagaaaagctgctgtttcagccatgccggagttattgcgttctgcaaaattagctgtggagaagggaatggctcaagggcgtaatgagacctatgtgaagcaattgtctgattacattattccggctcttgtggaggcattacataaggaacctgatacagaaatatgtgcaagcatgttggacgcattgaatgaatgcatacagatctctggtccacttttagatgaaagccaggttagatctattgtggatgagataaaacaagtaatcacagctagtgcaagcaggaaaagggagagagctgaaagagccaaagctgaagactttgatgctgaggagggagaattgattaaagaggaaaatgagcaagaggaagaagtttttgaccaagtgggagaaatcttgggaactttggtcaaaacatttaaagcctctttcttgcctttctttgatgagctatcttcatatcttacacctatgtggggcaaagataagacagctgaagaaagaagaattgctatttgtatttttgacgatgttgctgagcagtgtcgtgaggcagctataaaatattatgatacatatcttcctttcatattggaggcttgcaatgatgagaatccggatgtgcgacaggcagcggtgtatggactgggtgtttgtacagaatttggtggacctgtatttaagccgcttgtaggagaggctctatcaaggttaaatgctgtaatccggcatcccaatgctttgcaacctgaaaatgtaatggcatatgataatgctgtttctgctttaggaaaaatatgcctgttccatcgtgacagtattgatgcagctcagattgttcctgcatggttaaactgcttgccgataaagggtgatctgatagaagccaaagttgttcatgaacaactttgttcaatggtagagaggtcagacagtgaagttttgggtcccaaccatcagtatcttcctaagatagttgcagtgtttgctgaggttctatgtggtaaggatctagctacagagcaaactgcaagtaggatgctgaatttactgaggcagcttcagcaaactttgccagcggcaacattggcctcaacttggtcgtccttgcagccacaacaacagcttgccttgcaatccatgctctcctcatagtatatcggccagacattgacaggcatctatctttctggttttgaaggaatgcaatatccagtccatgtgttgaaagcatatttattaccaattcttttccctgagaaggttcccattgtttttgcatgatgttttactcgcaggcaggggaagctttgagtgagtgtgaaaaagtcgtcagagcggttgaaatgaatctttactcggtaggatgtgtatattacaagtgtcgatttttaatacggggtattgagtctgggaaagaagaataatgtgattttatggtttgggagcatttttgcttttcttttatgggtaaatgcctgaggttttagggttgtcatttgtagcagttttggtgtcaaatgcgttttcggtttcagtttgcacaaaatattttgctcgattgtgattattacagagttgtggaccgaaattttgaatggttattctttgtttgcaattccctttttatcttaaaaagctagcaataaaaaacaaaatggatatttttttgaatt

SEQ ID NO: 5852 - DNA, 3946 bp, Gossypium hirsutum
tttgtgacgcccaacaaaacacagagcaaaagcattaacgaagaggtgacaaaggaatcaatttcatcattttctccgtctccgtttcctcctccttctccttcgccgccatggaccagcaatcgcagctcgccctcatcctaggacctgacccgattccatttgaaaccctagtctcccacttgatgtcatcatcaaacgaacaacgttctcacgctgaggccttgtttaatctatgcaagcaatcggaccctgacgccctctgccttcgcctcgcccaccttctccaagtctgcactcagcccgagactcgcgccatggcagctattctcctccgtaagttgttgacgcgtgacgactcttatatctggcctcgcctcaacatttctacacagtcttccctcaaatccgtgattctgtctcaaatccaagtggaaaccaccaaaaatttatctaaaaagctgtgcgatactgttgcggagcttgcttccagtattttgccggagaatgggtggccagagctcttgccgtttatgtttcagtgtgtctcttcggattcccctaaattacaggagtctgcttttttgatatttgcgcagctgagtcaatatattggggatgtgttgactccttttataaaggatctacacactgtgttcttgaggtgcctgagtgaaagttctaatgccgatgtcaaaattgctgcgttgaatgcggtcatcaactttattcaatgtttgaccagctcatccgatcgggataggtttcaggatcttttgccagcaatgatgaggaccttgacagaggctttaaataacgggaatgaggccactgctcaggaggcacttgagttgttgatcgagttggcaggtaccgagccacggtttcttaggaggcagcttgttgatgtagtgggttcgatgctgcagattgcagaggcagaatctcttgaggaagggacacgtcatttggcgattgaatttgtggtgactttggcggaagcaagggagcgtgctcctggaatgatgcggaagttgccgcaatttattagtaggttatttgcaatattgatgagaatgctgttagatattgaggatgatgcagcatggcacacagcagaatctgaggatgaggatgctggagagaccagcaattacagtgtcggacaggagtgtttggatcgtttggcaatttccttaggtgggaacacaattgttcctgttgcatctgagcagttgcctgcttatttggctgcttctgagtggcaaaagcatcatgctgcactaattgcccttgctcagattgctgaggggtgtgccaaggttatgattaaaaatctggaacaagtggtttccatggttttgaactcatttcatgattctcatcctcgtgtaaggtgggcagctattaatgcaattgggcaattgtctaccgacttaggaccagatttgcaaaaccaatatcaccaaagagtattgcctgcattagctggcgctatggatgattttcagaatccacgagtacaggcccatgctgcgtcagctgtactcaactttagtgagaactgcactccagaaattttaacaccttacttggatggaatagtcagcaaattgcttgtacttttacagaatgggaaacaaatggtgcaagaaggtgccttgactgctttggcatcagttgccgactcatctcaggagcacttccaaaaatattatgatgcagttatgccttacctgaaagcaatcttggtaaatgcaactgacaaatctaatcgtatgctacgtgccaaatccctggagtgtattagtcttgttggaatggctgttggaaaagagaagttcagagatgatgctaagcaggttatggaagtgcttatgtcattgcaaggatcccaaatggaaacagatgatccaacaacaagttacatgctgcaagcatgggctagactctgcaagtgtttgggacaagacttcctcccttacatgagtgttgtcatgcctccccttcttcagtctgctcagcttaagccggatgtaactattacatctgcagattcagataatgacatagaggactctgatgatgaaagtatggaaaccattacgcttggggacaaaagaattgggatcaagacaagcgttctggaggagaaggctacagcatgtaacatgctatgttgctatgccgatgagttgaaggaagggttttttccatggattgatcaggttgctccaactttagttcctcttcttaaattttatttccacgaggaagttagaaaagctgctgtttcagccatgccggagttattgcgttctgcaaaattagctgtggagaagggaatggctcaagggcgtaatgagacctatgtgaagcaattgtctgattacattattccggctcttgtggaggcattacataaggaacctgatacagaaatatgtgcaagcatgttggacgcattgaatgaatgcatacagatctctggtctacttttagatgaaagccaggttagatctattgtggatgagataaaacaagtaatcacagctagtgcaagcaggaaaagggagagagctgaaagagccaaagctgaagactttgatgctgaggagggagaattgattaaagaggaaaatgagcaagaggaagaagtttttgaccaagtgggagaaatcttgggaactttggtcaaaacatttaaagcctctttcttgcctttctttgatgagctatcttcatatcttacacctatgtggggcaaagataagacagctgaagaaagaagaattgctatttgtatttttgacgatgttgctgagcagtgccgtgaggcagctataaaatattatgatacatatcttcctttcatattggaggcttgcaatgatgagaatccggatgtgcgacaggcagcggtgtatggactgggtgtttgtacagaatttggtggacctgtatttaagccgcttgtaggagaggctctatcaaggttaaatgctgtaatccggcatcccaatgctttgcaacctgaaaatgtaatggcatatgataatgctgtttctgctttaggaaaaatatgcctgttccatcgtgacagtattgatgcagctcagattgttcctgcatggttaaactgcttgccgataaagggtgatctgatagaagccaaagttgttcatgaacaactttgttcaatggtagagaggtcagacagtgaagttttgggtcccaaccatcagtatcttcctaagatagttgcagtgtttgctgaggttctatgtggtaaggatctagctacagagcaaactgcaagtaggatgctgaatttactgaggcagcttcagcaaactttgccagcggcaacattggcctcaacttggtcgtccttgcagccacaacaacagcttgccttgcaatccatgctctcctcatagtatatcggccagacattgacaggcatctatctttctggttttgaaggaatgcaatatccagtccatgtgttgaaagcatatttattaccaattcttttccctgagaaggttcccattgtttttgcatgatgttttactcgcaggcaggggaagctttgagtgagtgtgaaaaagtcgtcagagcggttgaaatgaatctttactcggtaggatgtgtatattacaagtgtcgatttttaatacggggtattgagtctgggaaagaagcataatgtgattttatggtttgggagcatttttgcttttcttttatgggtaaatgcctgaggttttagggttgtcatttgtagcagttttggtgtcaaatgcgttttcggtttcagtttgcagaaaatattttgctcgattgtgattattacagagttgtggaccgaaattttgaatggttattctttgtttgcaattccctttttatcttaaaaagctagcaataaaaaactaaatgg

SEQ ID NO: 5853 - DNA, 4130 bp, Prunus mume
cacaaataagacatacagctaatgatccattggataatcaaagtctttgcgcttccttttccctaattaggagccccactcctctacacccactcctacttttagcgcaccgcaccctttctcccaaaaaaccccaaaaatcaaaactatagtgaagtgagaggagagagagagagagcgccagccacctttgcaggctctctcacatactcatccgcagccaaaagcctcaaaaagccctaaaaccgtaactgagtggtgtggttgtttgttgcagcaatggccgactcgactcagctacagcatgcccaactggcgacgattctcggccccgacccggcccctttccaaaccctaatctcccacctcatgtcctcctccaacgagcagcgatcccaagccgagctcctcttcaacctctgcaagcagaccgatcccgactcgctctccctcaaactcgcccacctcctccagttctctcccgcccctgaggctcgagccatgtccgccattctcctccgcaagcagctcactcgcgacgactcgtacctctggccccgcctctcccccgccacccaatccaatctcaaaaccattctcttgacctgtattcagcgcgaggacaccaaatccatatccaagaagctctgcgacaccatttccgagctcgcctccgggattttgcctgataacgcctggcccgagctcttgcctttcatgttccaatgcgtctcctccaattctcccaagcttcaagaatcggcgtttttgatattcgcgcagctctcgcagtacatcggcgacaccttggtgccgcatataaaggaattgcacgccgtgttcttgcatagtttgggaaactcgtcaagcgccgaagtgaagatcgcggccttgaacgccgtcatcaatttcatccagtgtttgacgagctctgctgatagggataggtttcaggacctgttgccggcgatgatgaggacgctgatggaggctttgaacaacgggaacgaggccacagcgcaggaggctctcgagttgttgattgaattggccgggaccgagcccaggttcctcaggcggcagattgtggaggtggtcgggtctatgctgcagattgccgaggctgagtcgttggaagaagggaccaggcacttggccattgagttcgtcatcacgctcgccgaggccagagagcgcgcgcctgggatgatgaggaagttgccgcagtttataagccgattgttcgctattttgatgagtatgcttttggatatccaggacgatcccgcatggaatacagcagagacagaagatgaggaagcgggtgagaccagtaattacagtgtggggcaggagtgtttggatcggcttgctatatccctgggtgggaataccattgttccagtcgcttccgagcagttgccggcatatttggctgcccccgagtggcagaagcaccatgctgcgttgattgcactagctcagattgctgaaggttgcgctaaggtaatgattaaaaatttagagcaagtggtggcaatggtcttgaactcatttcaagatccacatcctcgtgtaaggtgggcagctattaatgcaattgggcagttgtctacggatttgggcccagatctgcaagttcaatatcatcagcaggtgctcccagcattggctgcagctatggatgattttcagaaccctcgtgttcaggcacatgctgcttcagcagtgctcaacttcagcgagaattgtactccggatattttaacaccttatttggatggagtagtgagcaaattgctagtacttctgcagaatgggaaacaaatggtgcaagagggagccttgactgctttggcatcagttgctgattcatctcaggagcatttccaaaaatactatgatgcagttatgccttacctaaaagctatcttgatgaatgcaactgataaatctaatcgtatgcttcgcgccaaatctatggagtgcattagtttggttggtatggctgttggaaaggataaattcagggatgatgctaagcaggtcatggaagtgctgatggctttgcaaggatctcaaatggagacagatgatccaactacaagttacatgctacaagcatgggctagactttgcaagtgtttaggacaagatttcctcccctacatgagtgttgtaatgcctcctttgcttctgtctgctcaacttaagccagatgtaaccattacatctgcagatgacaatagtgatgttgatgactctgatgatgaaagtatggaaacaattacccttggggataaacggattggaatcaagactagtgtcctggaggaaaaagctacagcttgtaatatgctgtgttgctatgctgatgagttgaaagaaggattctttccgtggattgatcaggttgccccaactttggttccacttcttaaattttatttccatgaagaggttaggaaggcggctgtttcagcaatgccggagctactgctttctgcaaaattagctatagagaaagggcaagctcaaggtcgtaatgaaacctatataaagcaattgtctgactacattgtcccagctctggtggaagcattacacaaggaacctgatacagaaatatgtgcaaatatattggacgcattaaatgaatgcttacagatatctggaccacttttagatgaaagccaggtcagatccattgtggaggagataaagctggtgataaccgccagttcaagtagaaaaagagaaagagcagaaaggaccaaagccgaagattttgatgctgaggaaggggagctcattaaagaggaaaatgaacaagaggaagaagtttttgatcaagtgggagagatcttgggaactttgatcaaaacgtttaaagcctctttcttgcctttctttgacgagctatcatcatatctgacacctatgtgggccaaggataaaacacctgaagagagaaggattgcaatatgcatctttgatgatgttgcagagcagtgtcgcgaggcagctgtaaaatattacgacacatttcttccttttctattggaggcttgcaatgacgataaccctgatgttagacaggcagctgtgtatggacttggtgtctgttcagagtttggcgggacagtaattaaacctcttattggcgaggctctttcgaggctaaatgttgtgattcagcatcctaatgccgtgcaaccggaaaacctaatggcatatgataatgccgtttctgctctaggaaaaatatgtcaatttcatcgtgacagtattgatgcagctcaggttattcctgcatggttgaactgtttaccgattaaaggtgacttgattgaagccaaagttgttcatgatcagctgtgttctatggtagaaaggtctgacagggaacttttgggtcccaacaatcagtatctttcgaaaattgtcgcagtgtttgccgaggttctttgtgctggcaaggatttagcaacagaacaaactgcaagccggatgataaatctattacggcagcttcagcagactttgccaccagctaccttggcctccacttggtcctccttacaaccccagcaacagcttgcactgcaatctatcctctcctcgtagtatgttggccttgcagtgtgcatattgctgctttcagatacaccgtccctgtcgtgtgtgttagttgcatttgtcaccaattcttttccataagatggtacccatcagtcatttttgcgtaaagttttacagcgagccagcatctgattaaacgtggaagtcatcattgcgatctgttcaatcagacccttttttgtaggatgtgtatatgcaagtgtcaagtgttaattattagtgcaattttgagtccaaaagaagaaagaaaggcaggtaattgtggtttgtgcacttgttctttctggtttttggtggtgcctaaggttctgagggtggttggtgagaaaattcttgtatcagttttggtcttgtgttttggtgtttcctacgcctccattatgagaatccgttgactaaactttcgatggcaattctttcattatgtttgcaatcttgatcccaaaaggcaataaattggcttatggtatgctattgtgttggatcct

SEQ ID NO: 5854 - DNA, 3809 bp, Malus domestica
cacgcaaaaaccctaattccgatggccgagtcgactcacttacagcaagcccaactggcgaccattctcggccccgacccggcccctttccagaccctaatctcccacctcatgtcttccgccaacgagcagcgctcccaggccgagctcctcttcaacctctgcaagcagaccgatcccgactccctctccctcaagctcgcccacctcctccagttctgccccgccgccgaggcccgcgccatgtccgcgattctcctccgcaagcagctcacccgcgacgactcttacctctggccccgattgaatcccacgacccaatcgacgctgaagacgattctgctcacgtgtattcagcaggaggacacgaaatccatctccaagaagctatgcgatacgatttccgagctggcctccgggattttgccggataacgggtggccggagctcttgccctttatgttccagtgcgtttcgtccgattcgcccaagcttcaagaagcggcgttcttgatattcgctcagttatcgcagtacatcggcgacaccatggtgccgcacataaaggaattgcacgccgtgttcttgcatagcctggggaattcgccgagccctgacgtgaagatcgcggctttgaacgctgtcatcaatttcattcagtgtttgaccagctctgcggatagggataggtttcaggacctgttgccagcgatgatgaagacgttgatggaggctctgaacaacgggaacgaggccaccgcgcaggacgctcttgaattgttgattgaattggctgggaccgagccgaggttcctgaggcggcagattgtggaagtcgttggggcaatgttacagattgctgaggccgattcattggaagaagcgacaaggcacttggccattgagttcgtcatcactctggccgaggcccgagagcgtgctcctggcatgatgaggaagttgccgcagtttataagccgattgttttccattttaatgaaaatgcttctggatattgaggacgaaccggcatggcatgcggcagagagtgaagatgaggatgcgggtgagactggtaattacagtgttgggcaggagtgtttggataggcttgccatatccctgggtgggaataccattgttcccgtggcgtctgagcaattgcctgcatatttggctgcccctgagtggcagaagcaccatgctgcattgattgccctggctcagattgctgagggttgtgccaaggtaatgattaaaaatttggagcaagtggtagcaatggtcttgaactcatttcaagatccacatcctcgtgtaaggtgggcagcgataaatgcaattgggcagttgtctactgatttgggcccagatctgcaagttcaatatcaccaacgggtgctcccggcattggctggagctatggatgattttcagaaccctcgtgttcaggcacatgctgcttcagcagtgctgaatttcagtgagaattgcacaccggatattttaactccatatttggatggagtagtgagcaaattgcttgtacttctgcagaatggaaaacaaatggtacaagagggtgccttgactgctttggcatccgttgctgattcatctcaggagcattttcaaaaatactatgatgcagttatgccttacctgaaagctatcttggtgaatgccactgataagtctaatcgcatgcttcgtgccaaatcgatggagtgtattagtttggttggaatggcagttggaaaagagaaattcagggaagatgctaagcaagtcatggaagtgctgatggctttgcaaggatctcacatggagacagatgatccaactacaagttacatgttacaagcctgggctagactctgcaagtgcttaggacaagatttcctcccatacatgagtgttgtaatgcctcctttgcttcaatctgctcaacttaagccagatgtaaccatcacatctgcagatgacgaaaatgatattgatgactctgatgatgatagtatggaaacaattactcttggggataaaaggattggaatcaagactagtgtcttggaggagaaagctacagcttgcaatatgctgtgttgctatgctgatgagctgaaagaaggattctttccctggattgatcaggttgccccaactttggttccacttcttaaattttatttccatgaagaagttaggaaggcagctgtttcggcaatgccggagctactgcgttctgcaaagttagcaatagagaaaggccaagctcaaggtcgtaatgaaacatatataaagcaattgtctgactacattgttccagctctggtggaagcattacataaggaacctgatactgaaatctgtgcgaatatattggatgcattaaatgaatgcttacagacatctggaccacttttagatgaaggccaggtgagatccatcgtggaggagataaagcaggtgatcactgccagttctagtagaaaaagagagagagcagaaaggaccaaagcagaagactttgatgctgaggaacaggagctaattaaagaggaaaatgaacaagaggaagaagtttttgatcaagtgggagaaatcattggaactttgattaaaacgtttaaagcctctttcttgcctttctttgatgagctatcatcgtatttaacacctatgtgggccaaggataaaacacctgaagagagaaggattgcaatatgcatctttgatgaagtagcagagcagtgtcgtgaagcagctgtaaaatattatgacacatttcttccttttctgttggaggcttgcaatgacgaaaaccctgatgttcgacaggcagctgtatatggacttggtatttgttcagagtttggtggagcaataattaaacctcttgttggcgaggctctatcaaggctgaacgctgtgattcagcatcctaatgcccaacaatctgaaaatgtaatggcatatgataatgctgtttctgctttaggaaaaattagccaattccaccgtgacagtattgatgcagctcaggtcattcctgcatggttgaactgtttaccgattaaaggagacttggttgaagccaaagttgttcatgaccaactttgttctatggtagagaggtctgatcgggaacttttgggtcccaacaatcagtatcttcccaaaattgttgcagtgtttgcagaggttctatgtgctggtaaggatctggcaactgaacagactgcaaaccgaatgattaaattgctaaggcagcttcagcagactttgccaccagctacattggcttcaacgtggtcgtccttgcaaccccagcaacagcttgctctgcaatccatcctctcctcataaatactctggcttgcattgtgcacattgctgctttcagatgcactgttccctgtcttgctatgtttcccatgtcatttatgcgaaaagttttacagtggcccgtcagcatcgattgagcgtggaagtcattggtgcggtttggtcaaaccattttttgtagggtgtatatgaaagtgttaatttatagtggcgattttgagttgaaaagaaaccaagacttgttcctgctcgtgagggtttctttcattttctttttgtcggtgcccgaggttattagggctgttggtgagaaaattctcgtgggagttttgatctcatcctgttttgtattttcctatacatgcgttgtaagaatctgttgatgaaattatcgatggcgattctttcgttatgttttcaattttgatccccaaaaggcaataaaattggcttttatggta

SEQ ID NO: 5855 - DNA, 4317 bp, Theobroma cacao
ggcaaagtagtgcattaagaactgctggtttcgtactcaaagtcggagcgtgtaagcgatggggcataataataaaaagatttaagacagactagtattggtccctagattaagcatggaccaaatctaatgcaggcaccaaaattggggcagtctgaaatgcattcctccgtcaatggtttgaaaataaaagccatatgataatattggtatggaaaggtaattctagtactagtattagcagtggtattgagtgtattttccctccaaaaaatgggaaaaaaccgaagacggtgggcactcacattaatcatcatgacacataaaaacacagctaatcaaaccctccttttctttgtcagccctaattagctctctcttaaaatccctcatttttgcccacgcacacgcactctctctcaacacaacagaagaaaaacacacacaaagccagagagagagagagagggatcaatatcatcatcatcatcatccgcatcatcttcttcttcttcttctttttttcttctccttcgcgcagcctccgccatggaccagcaatctcagctcgccgtcatcttaggacccgaccccgctcctttcgaaaccctaatctcccacttgatgtcctcctccaacgaacaacgttctcacgccgaggtcttattcaatctttgcaagcagtcggacccagacgccctctgtctccgcctcgctcacctcctccaagtctgcgctcaacctgagactcgtgccatggccgctattctcctccgtaagctcttgacacgtgacgactcttatatctggcctcgcctcaacatctccacccagtcctccctcaaatcggtgcttttggctcaaatccaagtcgaaaacactaaaactttgtctaaaaagttgtgcgacactgttgcggagcttgcttccagtattttgccagagaatggctggccggagcttttgccgtttatgttccagtgtgtctcttcggattcccctagattgcaggaatccgcctttttgatattcgctcagctgagtcagtatatcggtgatgtcttgactccttttataaaggatctacacgctgtgttcttgaggtgcttgagtgaaagttctaatgccgacgtcaaaatcgccgcgttgaatgctgtcatcaactttattcagtgtttgaccagcttatctgatagggataggtttcaggatcttttgccggcgatgatgaggaccttgacggaagctttgaataacgggaacgaggccaccgctcaggaagcgctggagttgttgattgagttggcagggacggagccacggtttcttcggaggcagcttgttgatgtggtggggtctatgctgcagattgcggaggcagaatcacttgaggaagggacacgtcacttggcgattgagtttgttattaccttggcagaagcaagggaacgtgcccctggaatgatgaggaagttgccgcagtttattagcaggctatttgcaattttgatgggaatgttgctggatattgaggatgatccagcatggtacactgcagaaactgaggacgaagatgctggagagactagcaattacagtgttgggcaggagtgtttggatcgtttggctatatccttgggtggaaatacaattgttccagttgcatccgagcagttgccagcttatttggctgcttctgagtggcaaaagcaccatgctgcattgattgcccttgcacagattgctgagggttgtgccaaggtcatgattaaaaatctggaacaagtggtttcgatggtcttgaactcctttcatgattcccatccccgtgtgaggtgggcagctattaatgcaattggacaattgtctactgatttgggcccggatttgcaaaaccaatatcatcaaagagtattaccagcactagctgctgccatggacgacttccagaatccacgagtacaggcacatgctgcttcagctgtgctcaacttcagtgagaactgcactccggaaattttaacaccttacttggatggaatagttagcaaattacttgtacttttacagaatgggaaacaaatggtgcaagaaggtgccttgacagctttggcatcagttgctgactcatctcaggagcacttccaaaaatattatgatgcagttatgccttacctgaaaactatcttggtgaatgcgactgacaaatctaaccgcatgcttcgtgccaaatccatggaatgcattagtcttgttggaatggctgtcgggaaggagaagttcagagatgatgccaagcaggttatggaagtgcttatgtcattgcaaggatcccaaatggaaacagatgatccgacaacaagttacatgctgcaagcatgggccagactgtgcaagtgtttgggacaagacttcctcccttacatgagagttgtcatgcctccccttctccagtctgctcaacttaagccagatgtaactattacatctgcagattcagataatgacattgaggactctgatgatgaaagtatggaaaccattactcttggggacaaaagaattgggatcaagactagcgtcctggaggaaaaggctacagcatgtaacatgctgtgctgctatgctgatgagttgaaggaaggattttttccatggatagatcaggttgccccgactctagttcctcttcttaaattttatttccatgaggaagttagaaaagctgctgtttcagctatgccggagttactgcgctctgcaaaattagctgtggagaaggggatggctcaggggcgtaatgagacttatgtaaagcaattgtctgacttcattattccagctctggtggaggcattacataaggagcctgatacggaaatatgtgcaagcatgttggatgcattgaacgaatgcttgcagatcactggtccacttttagatgaaggccaggttagatctattgtggacgagataaaacaagtaatcacagctagtgcgagcagaaaaagggagagagctgaaagagccaaagctgaagactttgatgctgaggagggagagtttgttaaagaggaaaatgagcaggaggaagaagtttttgaccaagtgggtgaaatcttgggtactttgataaaaacatttaaagcctctttcttgccattctttgatgagctatcttcatatcttacacctatgtggggcaaggataagacagctgaagaaagaagaattgcaatttgtatttttgatgatattgcagagcagtgtcgtgaggcagctctaaaatattatgagacatatcttcctttcatattggaggcttgcaatgatgagaacccagatgtgcgacaggcagcagtatatgggcttggtgtttgtgcggaatttggtgggcctgtatttaaacctcttgttggagaggctctatcaaggttaaatgttgtaatacggcatcctaatgctttacaacctgaaaatgtgatggcatatgataatgctgtttctgcattaggaaaaatatgcctgttccatcgtgacaggattgatgcagctcaggttgttcctgcatggttaaactgcttgccaataaaaggtgatctgattgaagccaaagttgttcatgaacaactttgttcaatggtagagaggtcagacaatgaagttttgggtcccaaccatcagtatcttcctaagattgttgcagtatttgccgaggttctatgtggtaaggatctagccacagaacaaactgcaagtcggatggtgaatctactgaggcagcttcagcagacgttgccaccagcaacattggcctcaacttggtcatctttgcagccacagcaacagcttgctttgcaatccatcctctcatagtatattggtttgacaggcatctttctggttttggaggaatgcagtgtcctgtctgtgttggaagcatattttatttattacccaattcttttctcggaggaggttcccattgttttttgcatgatgttttacatcaatccagcaaaggtttgattgaaggtgaaaaagtcatcagtgcgattgaagtgaatcttttgttctttttgttagaatgtgtatattaaaagcgtctatttataatatggggtatggtatcgagtctggagaagaaacaataggtgatttgtggtttgtgagcatttttgtgggtttgaggggttgctagtgagggcaattcctgtagcagttttggtcccagaatgtggctttttgtttttccgtcggagttttacacaaaagttccgtttgtgattatatatggactgaaattttgaatggtta

SEQ ID NO: 5856 - DNA, 4092 bp, Theobroma cacao
attaatcatcatgacacataaaaacacagctaatcaaaccctccttttctttgtcagccctaattagctctctcttaaaatccctcatttttgcccacgcacacgcactctctctcaacacaacagaagaaaaacacacacaaagccagagagagagagagagggatcaatatcatcatcatcatcatccgcatcatcttcttcttcttcttctttttttcttctccttcgcgcagcctccgccatggaccagcaatctcagctcgccgtcatcttaggacccgaccccgctcctttcgaaaccctaatctcccacttgatgtcctcctccaacgaacaacgttctcacgccgaggtcttattcaatctttgcaagcagtcggacccagacgccctctgtctccgcctcgctcacctcctccaagtctgcgctcaacctgagactcgtgccatggccgctattctcctccgtaagctcttgacacgtgacgactcttatatctggcctcgcctcaacatctccacccagtcctccctcaaatcggtgcttttggctcaaatccaagtcgaaaacactaaaactttgtctaaaaagttgtgcgacactgttgcggagcttgcttccagtattttgccagagaatggctggccggagcttttgccgtttatgttccagtgtgtctcttcggattcccctagattgcaggaatccgcctttttgatattcgctcagctgagtcagtatatcggtgatgtcttgactccttttataaaggatctacacgctgtgttcttgaggtgcttgagtgaaagttctaatgccgacgtcaaaatcgccgcgttgaatgctgtcatcaactttattcagtgtttgaccagcttatctgatagggataggtttcaggatcttttgccggcgatgatgaggaccttgacggaagctttgaataacgggaacgaggccaccgctcaggaagcgctggagttgttgattgagttggcagggacggagccacggtttcttcggaggcagcttgttgatgtggtggggtctatgctgcagattgcggaggcagaatcacttgaggaagggacacgtcacttggcgattgagtttgttattaccttggcagaagcaagggaacgtgcccctggaatgatgaggaagttgccgcagtttattagcaggctatttgcaattttgatgggaatgttgctggatattgaggatgatccagcatggtacactgcagaaactgaggacgaagatgctggagagactagcaattacagtgttgggcaggagtgtttggatcgtttggctatatccttgggtggaaatacaattgttccagttgcatccgagcagttgccagcttatttggctgcttctgagtggcaaaagcaccatgctgcattgattgcccttgcacagattgctgagggttgtgccaaggtcatgattaaaaatctggaacaagtggtttcgatggtcttgaactcctttcatgattcccatccccgtgtgaggtgggcagctattaatgcaattggacaattgtctactgatttgggcccggatttgcaaaaccaatatcatcaaagagtattaccagcactagctgctgccatggacgacttccagaatccacgagtacaggcacatgctgcttcagctgtgctcaacttcagtgagaactgcactccggaaattttaacaccttacttggatggaatagttagcaaattacttgtacttttacagaatgggaaacaaatggtgcaagaaggtgccttgacagctttggcatcagttgctgactcatctcaggagcacttccaaaaatattatgatgcagttatgccttacctgaaaactatcttggtgaatgcgactgacaaatctaaccgcatgcttcgtgccaaatccatggaatgcattagtcttgttggaatggctgtcgggaaggagaagttcagagatgatgccaagcaggttatggaagtgcttatgtcattgcaaggatcccaaatggaaacagatgatccgacaacaagttacatgctgcaagcatgggccagactgtgcaagtgtttgggacaagacttcctcccttacatgagagttgtcatgcctccccttctccagtctgctcaacttaagccagatgtaactattacatctgcagattcagataatgacattgaggactctgatgatgaaagtatggaaaccattactcttggggacaaaagaattgggatcaagactagcgtcctggaggaaaaggctacagcatgtaacatgctgtgctgctatgctgatgagttgaaggaaggattttttccatggatagatcaggttgccccgactctagttcctcttcttaaattttatttccatgaggaagttagaaaagctgctgtttcagctatgccggagttactgcgctctgcaaaattagctgtggagaaggggatggctcaggggcgtaatgagacttatgtaaagcaattgtctgacttcattattccagctctggtggaggcattacataaggagcctgatacggaaatatgtgcaagcatgttggatgcattgaacgaatgcttgcagatcactggtccacttttagatgaaggccaggttagatctattgtggacgagataaaacaagtaatcacagctagtgcgagcagaaaaagggagagagctgaaagagccaaagctgaagactttgatgctgaggagggagagtttgttaaagaggaaaatgagcaggaggaagaagtttttgaccaagtgggtgaaatcttgggtactttgataaaaacatttaaagcctctttcttgccattctttgatgagctatcttcatatcttacacctatgtggggcaaggataagacagctgaagaaagaagaattgcaatttgtatttttgatgatattgcagagcagtgtcgtgaggcagctctaaaatattatgagacatatcttcctttcatattggaggcttgcaatgatgagaacccagatgtgcgacaggcagcagtatatgggcttggtgtttgtgcggaatttggtgggcctgtatttaaacctcttgttggagaggctctatcaaggttaaatgttgtaatacggcatcctaatgctttacaacctgaaaatgtgatggcatatgataatgctgtttctgcattaggaaaaatatgcctgttccatcgtgacaggattgatgcagctcaggttgttcctgcatggttaaactgcttgccaataaaaggtgatctgattgaagccaaagttgttcatgaacaactttgttcaatggtagagaggtcagacaatgaagttttgggtcccaaccatcagtatcttcctaagattgttgcagtatttgccgaggttctatgtggtaaggatctagccacagaacaaactgcaagtcggatggtgaatctactgaggcagcttcagcagacgttgccaccagcaacattggcctcaacttggtcatctttgcagccacagcaacagcttgctttgcaatccatcctctcatagtatattggtttgacaggcatctttctggttttggaggaatgcagtgtcctgtctgtgttggaagcatattttatttattacccaattcttttctcggaggaggttcccattgttttttgcatgatgttttacatcaatccagcaaaggtttgattgaaggtgaaaaagtcatcagtgcgattgaagtgaatcttttgttctttttgttagaatgtgtatattaaaagcgtctatttataatatggggtatggtatcgagtctggagaagaaacaataggtgatttgtggtttgtgagcatttttgtgggtttgaggggttgctagtgagggcaattcctgtagcagttttggtcccagaatgtggctttttgtttttccgtcggagttttacacaaaagttccgtttgtgattatatatggactgaaattttgaatggttattctttcgccactgtttgcaaaattttgatcctgaaaaaaagcaataaaaatgttaatgggattgtcaagtttttgatca

SEQ ID NO: 5857 - DNA, 3942 bp, Malus domestica
agagcgaaagtgaggagagagaaaaaagacatcttctcttcgcgggctcatcactgacaccaatctacagccaaggcaggcaaaaaccctaaacaaccgcagctggttgcgatggccgagtcgactcagttacagcaagcccaactggcgacgattctcggtcccgacccggcccctttccaaaccctgatctcccacctcatgtcttccgccaacgatcagcgctctcaggcggagctcctcttcaacctctgcaagcagaccgatcccgactccctctccctcaagctcgcccacctcatccagttctcccccgccgccgaggcccgcgccatgtccgcgattctcctccgcaagcagctcacccgcaacgactcgtatctctggccccgattgaatccgacgacccaatcaacgctgaagacgattctgctgacgtgtattcagcaggagggcacgaaatccatctccaagaagctctgcgatacgatttccgagctcgcctctgggattttacccgataacggatggccggagctgctgccgtttatgttccagtgcgtctcgtctgattcgccaaagcttcaagaagcggcgttcttgatattcgctcagttatcgcagtacatcggcgacatcatggtgccgcacataaaagaattgcacgccgtgttcttgcatagcctggggaattcgccgagccccgacgtgaagatcgcggctttgaacgccgtcatcaatttcattcagtgtttgaccagctctgcggatagggataggtttcaggacctgttgccggcgatgatgaagacgttgatggaggctctgaacaacgggaacgaagccaccgcgcaggacgctcttgaattgttgattgaattggctgggactgagccgaggttcctaaggcggcagattgtggaagtcgttggcgcaatgttacagattgctgaggccgattccttggaagaatcaacaaggcacttggccattgagttcgtcatcactctggctgaggccagagagcgtgctcctggcatgatgaggaagttgccgcagtttataagccgattgtttgccattttaatgaaaatgcttctggatattgaggacgaaccggcatggcatgcggcagagagtgaagatgaggatgccggtgagaccactaattacagtgttggtcaagagtgtttggatcggctttcgatttcccttggtgggaataccatagttccagtagcttctgagcaattgcctgcatatttggctgcccctgagtggcagaagcaccatgctgcattgattgcccttgctcagattgctgagggttgtgctaaggtaatgattaaaaatttggagcaagtggtagcaatggtcttgaactcttttcaagatccacatcctcgtgtaaggtgggcagcgattaatgcaattgggcagttgtctactgatttgggcccagatctgcaagttcaatatcaccaaagtgtgctcccagcattggctggagctatggatgattttcagaaccctcgtgttcaggcacatgctgcttcggctgtgctgaatttcagtgagaattgcactccggatattttaacaccgtatttggatggagtagtgagcaaattgcttgtacttctgcagaacggaaaacaaatggtgcaagagggtgccttgactgctttggcatccgttgctgattcatctcaggagcattttcaaaaatattatgatgcagttatgccttacctgaaagctatcttggtgaatgccactgataagtctaatcgcatgcttcgtgccaaatcgatggagtgtattagtttggttggaatggcagttggaaaagagaaattcagggaagacgctaagcaagtcatggaagtgctgatggctttgcaaggatctcacatggagacggatgatccaactacaagttacatgttacaagcctgggctagactctgcaagtgcttaggacaagatttcctcccatatatgagtgttgtaatgcctcctttgcttcagtctgctcaacttaagccagatgtaaccatcacatctgcagatgacgacaatgatattgatgactctgatgatgatagtatggaaacaattactcttggggataaaaggattggaatcaagactagtgtcttggaggagaaagctacagcttgcaatatgctgtgttgctatgctgatgagctgaaagaaggattctttccctggattgatcaggttgcccccactttggttccacttcttaaattttatttccatgaagaagttaggaaggcagctgtttcagcaatgccggagctactgcgttctgcaaagttagctatagagaaaggccaagctcaaggtcgtaacgaaacatatataaagcaattgtctgactacattgttccagctcttgtggaagcattacataaggaacctgatactgaaatctgtgcaaatatattggatgcattaaatgaatgcttacagacatctggaccacttttagatgaaagccaggtcaaatccattgtggaggagataaagcaggtgatcactgccagcgccagtagaaaaagagagagagcggaaaggaccaaagcagaagactttgatgctgaggaacaggagctgattaaagaggaaaacgaacaagaggaagaagtttttgatcaagtgggagagatcattggaactttgattaaaacgtttaaagcctctttcttgcctttctttgatgagctagcattgtatttaacgcctatgtgggccaaggataaaacacctgaagagagaaggattgcaatatgcatctttgatgaagttgcagagcagtgtcgtgaagcagctgtaaaatattatgacacatttcttccttttctgttggaggcttgcaatgacgaaaaccctgatgttcgacaggcagctgtatatgggcttggtgtttgttcagagtttggtggagcagtaattaaacctctcgttggcgaggctctatcaaggctgaacgctgtcatccagcatcctaacgcccaacaatctgaaaatgtaatggcatatgataatgctatttctgctttaggaaaaattagccaattccaccgtgacagtattgatgcagctcaggtcattcctgcttggttgaactgtttaccgattaaaggtgacttggttgaagccaaagttgttcatgaacaactttgttctatggtagagaggtctgatcgggaacttttgggtcccaacaatcagtatcttcccaaaattgttgcagtgtttgcagaggttctatgtgccggtaaggatctagcaacagaacaaactgcaagccgaatgattaatttgttaaagcagcttcagcagacgttgccaccagctacattggcctcaacgtggtcgtccttgcaaccccaacaacagcttgcactgcaatctatcctctcctcataagtaccttggcttgcattgcgcacattgctgctttcagatacactgttccctggcctgcgtgttcattgtacgtcaccaattcttttccataatatgtttcccatcagtcatttttgcgaaaagttctacagcaacccctcagcatctgatcaagcgtggaagtcattgttgcggtttggtcaaatcattttttgtagggtgtatatgaaagtgttaatttatagtgacgattttgagtctaaaagaaaagaagacttgctgttcctgttggtgcgggttttttttttttttttttttttttgttggtgcccgaggttatgagggctgttggtgagaaaattctcgtgggagttttggtctcatcctgtctttgtattttcctatacctgcgatgtaagaatctgttgatgaaattatcgatggcgattctttcattatgttttcaattttgatccccaaaggcaataaaattggctttatggt

SEQ ID NO: 5858 - DNA, 3447 bp, Citrus clementina
gacatttcaaattcccccttcatcatcaaattcatcactcacatttcacatcacaaaaacaaattccacgcggaaaaccctagtaaactcgccgccatggccgccgagtcaactcacctccaacaatcccaactcgcggtgatcctcggccccgactctgccccattcgaaaccctaatctctcacctcatgtccacctccaacgagcaacgatccgaagccgaactgctcttcaacctctgcaagcaacaggatcccgattccctcactctcaaactcgctcacctcctccaacgctcccctcaccccgaggcacgtgccatggccgctgtcctccttcgcaagcttcttacgcgcgacgactcctttctctggccgaggctctctctacacactcagtcctctctcaaatcgatgcttctccaatcgatacaactcgagagcgccaagtcgatttcgaagaaactatgcgacaccgtttcggaattggcctcaaatattttgcccgagaacgggtggcctgagttgttgccgtttatgttccaatgcgtgtcgagtgattccgttaagttgcaggaatccgcgtttttgatcttcgcgcagttgagtcagtacattggggacaccctcacgcctcatctaaagcacttgcacgccgtgtttttgaattgtttgacgaattcgaataatcctgatgtgaaaatcgcggctttgaatgcagttattaattttatccagtgtctgacgagctctgcagatcgggataggtttcaggatttgttgccgttgatgatgaggacgttgacggagtcgttgaataatggaaacgaggcaacggcgcaggaggcgttggagttgttgattgagttggcggggactgagccgaggtttttgaggaggcagttggtggatgtggtcgggtccatgttgcagatagctgaggcggagagtttagaggaagggacacgtcatctggcaattgagtttgtgattacattagcagaggctagggagcgggcaccggggatgatgaggaagttgccgcagtttataaataggttgtttgctatattgatgagtatgttgttggatattgaggatgatcctttgtggcatagtgcagagaccgaggacgaggatgcgggtgagtcgagtaattatagtgttggtcaggagtgtttggatagattggctattgctttaggtgggaatacaatagttcctgttgcttctgagcagttgccagcttacttggctgcacctgagtggcagaagcaccatgctgcgttgattgcactggctcagattgctgagggttgtgctaaggtaatggtaaaaaatttggagcaagtgttgtcaatggttctaaactcatttcgcgaccctcaccctcgtgtaaggtgggcagcaatcaatgcaattggtcagctgtcaacggacttggggccagatttgcaaaatcaattccacccacaggttctaccagcactagctggagcaatggatgatttccagaatcctcgagtacaggcacatgctgcatcagcagtgcttaacttcagtgagaactgtactccagaaattttaaccccgtatttggatggtatagtgagcaaattgctagtacttctgcagaatggaaaacaaatggtgcaagaaggagcattaactgctttggcatctgttgctgactcatctcaggagcacttccaaaaatactatgatgccgttatgcctttcctgaaagctatcttggtaaatgcaactgacaaatcaaaccgcatgcttcgtgccaaatcaatggagtgcattagtctggttggaatggctgttggaaaggacaagttcagggatgatgccaagcaggtcatggaagtgcttatgtcattacaaggatctcaaatggagacagatgatccaactacaagttacatgctacaagcatgggccaggctttgcaagtgtttgggacaggattttcttccttatatgagtgttgtgatgccacctttgctccaatctgctcagcttaagccagatgtaacaattacatctgcagattcagacaatgaaatcgaagactctgatgatgatagtatggagaccattacacttggggataaaagaataggaattaagactagtgtcttggaggaaaaagctactgcttgcaacatgctatgttgctatgctgatgagttgaaggaaggattctttccatggattgatcaggttgctccaactcttgttcctctccttaaattctatttccatgaagaagttaggaaagcagctgtttcagccatgccggagttattgcgttctgcaaaattagctatagagaaaggcctagctccaggtcgtaatgagtcctatgtaaagcaattgtctgattttatcattccagctctggtggaagctctgcataaggaaccagataccgagatctgcgccagtatgttggactcattgaatgaatgcatacagatctcggggccacttctggatgaaggccaggtcagatccattgtagatgagataaaacaggtgatcacagccagctctagtagaaagagagagagagcagagagggccaaagctgaagactttgatgctgaggagtcagaattgattaaagaggagaatgaacaagaagaagaagtttttgaccaagtgggtgaaattttgggaactttgatcaaaacatttaaagctgctttcttgccattctttgatgagctatcttcgtatctgacacctatgtggggcaaggataagactgctgaagagagaaggattgcaatctgcatttttgatgatgttgctgagcagtgtcgagaggctgctcttaagtattacgagacatatcttccattcttgttggaggcctgcaatgatgagaaccaagatgtccgacaggcagctgtatatgggcttggtgtttgtgcagagtttggtggatctgtagttaaaccacttgttggcgaggctttatcaaggctaaatgttgtaatacggcatcctaatgctttgcaacctgagaatttgatggcttatgataatgctgtttctgcattgggaaaaatatgccagtttcatcgtgacagtattgacgcagctcaggttgttcctgcatggttaaactgcttgccaataaaaggtgatttgattgaggctaaaattgttcatgaacagctttgttcaatggtagagaggtcagacagtgatcttctgggtcccaaccatcaatatcttcctaaaattgtttcagtgtttgctgagatcctttgtggtaaagatctagcaactgaacaaacattaagtcgaatagtcaatcttctgaagcaacttcagcagacattgccgccagctaccttggcttcaacatggtcatccttgcaaccccaacaacagcttgcgcttcaatcaattctctcgttggtctga

SEQ ID NO: 5859 - DNA, 3937 bp, Citrus sinensis
gacatttcaaattaccccttcatcatcaaattcatcactcacatttcacatcacaaaaacaaattccacgcggaaaaccctagtaaactcgccgccatggccgccgagtcaactcacctccaacaatcccaactcgcggtgatcctcggccccgactctgccccattcgaaaccctaatctctcacctcatgtccacctccaacgagcaacgatccgaagccgaactgctcttcaacctctgcaagcaacaggatcccgattccctcactctcaaactcgctcacctcctccaacgctcccctcaccccgaggcacgtgccatggccgctgtcctccttcgcaagcttcttacgcgcgacgactcctttctctggccgaggctctctctacacactcagtcctctctcaaatcgatgcttctccaatcgatacaactcgagagcgccaagtcgatttcgaagaaactatgcgacaccgtttcggaattggcctcaaatattttgcccgagaacgggtggcctgagttgttgccgtttatgttccaatgcgtgtcgagtgattccgttaagttgcaggaatccgcgtttttgatcttcgcgcagttgagtcagtacattggggacaccctcacgcctcatctaaagcacttgcacgccgtgtttttgaattgtttgacgaattcgaataatcctgatgtgaaaatcgcggctttgaatgcagttattaattttatccagtgtctgacgagctctgcagatcgggataggtttcaggatttgttgccgttgatgatgaggacgttgacggagtcgttgaataatggaaacgaggcaacggcgcaggaggcgttggagttgttgattgagttggcggggactgagccgaggtttttgaggaggcagttggtggatgtggtcgggtccatgttgcagatagctgaggcggagagtttagaggaagggacacgtcatctggcaattgagtttgtgattacattagcagaggctagggagcgggcaccggggatgatgaggaagttgccgcagtttataaataggttgtttgctatattgatgagtatgttgttggatattgaggatgatcctttgtggcatagtgcagagaccgaggacgaggatgcgggtgagtcgagtaattatagtgttggccaggagtgtttggatagattggctattgctttaggtgggaatacaatagttcctgttgcttctgagcagttgccagcttacttggctgcacctgagtggcagaagcaccatgctgcgttgattgcactggctcagattgctgagggttgtgctaaggtaatggtaaaaaatttggagcaagtgttgtcaatggttctaaactcatttcgcgaccctcaccctcgtgtaaggtgggcagcaatcaatgcaattggtcagctgtcaacggacttggggccagatttgcaaaatcaattccacccacaggttctaccagcactagctggagcaatggatgatttccagaatcctcgagtacaggcacatgctgcatcagcagtgcttaacttcagtgagaactgtactccagaaattttaaccccgtatttggatggtatagtgagcaaattgctagtacttctgcagaatggaaaacaaatggtgcaagaaggagcattaactgctttggcatctgttgctgactcatctcaggagcacttccaaaaatactatgatgccgttatgcctttcctgaaagctatcttggtaaatgcaactgacaaatcaaaccgcatgcttcgtgccaaatcaatggagtgcattagtctggttggaatggctgttggaaaggacaagttcagggatgatgccaagcaggtcatggaagtgcttatgtcattacaaggatctcaaatggagacagatgatccaactacaagttacatgctacaagcatgggccaggctttgcaagtgtttgggacaggattttcttccttatatgagtgttgtgatgccacctttgctccaatctgctcagcttaagccagatgtaacaattacatctgcagattcagacaatgaaatcgaagactctgatgatgatagtatggagaccattacacttggggataaaagaataggaattaagactagtgtcttggaggaaaaagctactgcttgcaacatgctgtgttgctatgctgatgagttgaaggaaggattctttccatggattgatcaggttgctccaactcttgttcctctccttaaattctatttccatgaagaagttaggaaagcagctgtttcagccatgccggagttattgcgttctgcaaaattagctatagagaaaggcctagctccaggtcgtaatgagtcctatgtaaagcaattgtctgattttatcattccagctctggtggaagctctgcataaggaaccagataccgagatctgcgccagtatgttggactcattgaatgaatgcatacagatctcggggccacttctggatgaaggccaggtcagatccattgtagatgagataaaacaggtgatcacagccagctctagtagaaagagagagagagcagagagggccaaagctgaagactttgatgctgaggagtcagaattgattaaagaggagaatgaacaagaagaagaagtttttgaccaagtgggtgaaattttgggaactttgatcaaaacatttaaagctgctttcttgccattctttgatgagctatcttcgtatctgacacctatgtggggcaaggataagactgctgaagagagaaggattgcaatctgcatttttgatgatgttgctgagcagtgtcgagaggctgctcttaagtattacgagacatatcttccattcttgttggaggcctgcaatgatgagaaccaagatgtccgacaggcagctgtatatgggcttggtgtttgtgcagagtttggtggatctgtagttaaaccacttgttggcgaggctttatcaaggctaaatgttgtaatacggcatcctaatgctttgcaacctgagaatttgatggcttatgataatgctgtttctgcattgggaaaaatatgccagtttcatcgtgacagtattgacgcagctcaggttgttcctgcatggttaaactgcttgccaataaaaggtgatttgattgaggctaaaattgttcatgaacagctttgttcaatggtagagaggtcagacagtgatcttctgggtcccaaccatcaatatcttcctaaaattgtttcagtgtttgctgagatcctttgtggtaaagatctagcaactgaacaaacattaagtcgaatagtcaatcttctgaagcaacttcagcagacattgccgccagctaccttggcttcaacatggtcatccttgcaaccccaacaacagcttgcgcttcaatcaattctctcgtgatagtatcttggcaaacaatgaatcatcttgctggtctttcagaaaatgcaatgcctgcctttttgtgtcgatgaaagtatactatataatacccattctttttccataaaggtggttcccctattgattgtccttgcgtgaggtttgacaacagcccagcatcagttggtttgagcatgaaagtcgtcgaagcgactgaaatgatatcacttgtagaatgtgtataatacagttgagttgatatcgagtctgaaagaagaaaaggaaaagtcgtttgtgttttgtgactggcttttgtcagtcaggttgtgaggtttgagggttgcgagcaatgcaaggcaattcctatagcagttttgatccagttgtgattctcacgtcaatttggtggtacaaactttggtgattgtgattgtatttaaactgaaattttggatggtgattctttcattaagtatgcaattttttcttttaatctaaatgagcagttaataga

SEQ ID NO: 5860 - DNA, 3843 bp, Fragaria vesca
taaaaacgcgccggtttcaaatggccgagtcgactcagctccagcaggcgcaactcgcgacgattctcggccccgacccggcccctttcgaaaccctaatctcccacctgatggcctccgccaacgagcagcgatcccaggccgagctcctcttcaacctctgcaagcagaccgatcctgactcgctctcgctcaaactcgctcacctcctccaattctcgccggcgcaggaggcccgcgccatgtccgccatcctcctccgcaagcagctcacccgcgacgacacctatctctggccgcggctctccccgaacactcagtccaccctcaaatcgattctcctgtcgtgtatccaacgcgaggaggtcaaatccatctccaagaagctctgcgacaccatctccgagctcgcctccggaatcctgccggagaacggctggccggagctcctcccgttcatgttccaatgcgtctcctccgattccccgaagcttcaggagtcggcgttcctgatattcgcgcagctctcgcagtacatcggcgactcgctggtcccttacataaaggaattgcacaccgtgttcctgcagtgcttgagctcctccaccaactccgacgtcaagatcgccgcgttgaacgccgtgattaatttcattcagtgtttgaccagctccggagatagggacaggttccaggacctgttgccggcgatgatgaggactctgatggagtcgttgaacaacgggaacgaggccacggcgcaggaggcgcttgagttgttcatcgaattggctgggactgagcccaggttcctcaggaggcagattgtggaggtcgttgggtctatgctgcagattgccgaagctgattccttggaagaagggaccaggcacttggccatagagtttgtaatcactctggccgaggccagggagcgagccccggggatgatgaggaagttgccgcagtttattagtaggttgtttgccattttgatgaatatggttttggatattgaggatgatccgtcgtggcatacggccgagactgaagatgaggatgctggtgagagtggcaattacagtgttggtcaggagtgtttggataggcttgccatttccttgggtgggaatacaattgttcccgtcgcatccgagcagttgcctgcctatttggctgcccccgagtggcagaagcaccacgccgcattgattgcccttgcacagattgctgagggttgttctaaggtaatgataaaaaatttggagcaagtggtggcaatggtgttgaactcttttcaagatcctcatcctcgtgtaaggtgggcagctattaatgcgattgggcagttatctactgatctgggcccagacctgcaagttcaatatcatcaacgggtgcttccagcgttagcttccgccatggatgattttcagaatcctcgtgtgcaggcacatgctgcttcagcagtgctcaacttcagtgagaactgtacaccggatattttgacaccttatttggatggcatagtgagcaaattgcttgtacttctgcagaatgggaaacaaatggtgcaagagggggcattaactgctttggcatctgttgctgattcatctcaggagcatttccaaaaatactacgatgctgttatgccttacctgaaagctatcttggtgaatgcaactgataaatctaatcgcatgcttcgggctaaatccatggaatgtattagtttggttggtatggctgttggaaaggaaaaattcagggatgacgctaagcaggtcatggaggtgctgatgtcattgcaagggtctcaaatggagacagatgacccgactacaagttacatgctacaagcctgggctcgactctgcaaatgtttaggacaagattttctcccatacatgagtgttgtaatgcctcctttgcttcagtctgctcaacttaagccagatgtaactattacctccgcagatgacaatagtgatattgatgactctgatgatgatagtatggaaacaattactcttggagataaaaggattggaatcaagactagtgtattggaggaaaaagctacagcttgcaatatgctgtgttgctatgcagatgaattgaaagaaggtttctttccttggattgatcaggttgccccaactttagtgccgcttcttaaattttatttccatgaagaagtgaggaaggcagctgtttcagcaatgccggagctactgctttctgcaaagttagctatagagaaagggctagctcaaggtcgtaatgaaacctatataaagcaattgtctgactacatcgttccagctctggtggaagcattgcataaggaacctgatacagaaatctgtgcaaatattttggatgcgataaacgaatgcatacagatatctggaccacttttagatgagagccaggtcagatccattgtggaggagataaagcaggtgatcactgccagttcaagtaggaaaagagagagagcggaacgaactcaagcagaagattttgatgatgaggaaagggaactgattaaagaggaaaatgaacaagaggaagaagtttttgatcaagtgggagaaattttgggaactttgattaaaacgttcaaagcctctttcttgcctttctttgatgagctagcaacatatctaacacctatgtggggcaaagataaaacacctgaagagagaaggattgcaatatgcatctttgatgatgttgcagagcaatgtcgtgaagctgctctgaaatattatgacacatttcttccctttctattggaggcttgtaatgatgagagccctgatgttcgacaggcagctgtatatggacttggtgtttgtgcagagtttggtggaactgtaattaaacctcttataagcgtggctctttcaaggctaaatgttgtgattcagcatcccaatgcccagcaacctgacaacataatggcatatgataatgcggtttctgctttagggaagatttgtcaatatcaccgtgacagtattgatgcagctcaggttatccctgcgtggctgaactgtttaccgataaaaggtgacttgattgaagccaaagttgttcatgatcagctttgctctatggttgagaggtctgacggtgatattttgggtcccaacaatcagtatctatccaaaattgttcaagtgtttgcagaggttttatgcgctggtaaggagttggcaaccgaacaaacagcaagccggatgataaatctattaaaacagcttcagcagactttaccaccgcaaaccttggcctcaacttggtcttccctgcaaccccagcaacagcttgcactgcagtctatcctttcctcatagtatcttggcgtggagtagtcatattacttctttcagatacaccgtatctgacatgtgtgttacttgtatttgcctccaattcttttccatgagattgtcgtcatcagtcagttttgcatggagtgttacagtgacccagcatttgatgaagtgtgaaaggggtcatcattacaatttcatcaagccttttttggtaggatgtgtatacccaagtgtcaatttatagtgcaattttgagtctaaaagaaaagaaggataggtgattgtggtatgtgagtcttttcttttctcagtacctttggttggtgcctgagtttagagggtttgttggtgaggattctagttgtgtttttgatgttttctgcgcatacatttgtcgactggattattattaatggtgattcttgatatttgcaattttgatcccaaggaaataaaatggcttatagtgtttcggtgttgcactcttgtgaat

SEQ ID NO: 5861 - DNA, 3978 bp, Gossypium raimondii
aaccctaattggctcgctctcttaaaatccctcatttctctctttcctacactcctcctaaaaccctctcagccacccccccctctctctctctctctgtcacacacagcagccaagcaaacgcagaatacacgcataaaaagggagagaggaatcaatttaaccatcctcttcttcatcttcatcgctgttatcgatcatcttcttcgccgccgccgtcgccaccatggaccagcaatctcagctcgctgtcatcttaggatccgacccggtcccattcgaaaccttaatctctcacttgatgtcatcttccaacgagcaacgttcacacgccgaggctttattcaatgtttgcaagcaatctgatcctgatgctctctgcctccgccttgctcaccttcttcaggtctgtgctcaaccggatactcgtgccatggctgctattctccttcgtaagctgttgactcgtgatgattcctatatctggcctcgtctcaacgtttccactcattcctctatcaaatctgtgctcttgaatcaaatccaagtcgaaactgctcaatctttgtctaaaaagttatgcgatactgtttcggagcttgcttctagtattttgccggagaacggatggccagagctgttgccgtttatgtttcaatgtgtttcttccgattcccctagattacaggagtctgcttttttgatatttgcgcagttgagtcagtatattggtgatgtgttgactcctttcataaaggatctgcacactgttttcttgaagtgtttgagtgaaaattctaatgcggatgtcaaaatcgcggccttgaatgcggttatcaattttattcagtgcttgaccagctcatctgatcgggataggtttcaggatcttttaccagcaatgatgaagaccttgacggaggctttgaataacgggaatgaggctacggctcaggaggcgctagagttgttgattgagttggcagagacggagcctcggtttcttaggaggcagattgttgatgtggtgggttctatgctgcagattgcggaggcagaatcacttgaggaaggaactcgtcacttggcaattgaatttgtagttaccttggcagaggccagggaacgggctcccggaatgatgaggaagctgcctcagtttattagtagattatttgcaatattgatgagattgttgcttgatattgaggatgatgcagcgtggcacactgcagaagtcgaggatgaggatgctggagaaactagcaattacgctgtgggacaggaatgtttggatcgtctagcaatttccttaggtggaaatactattgttcctgttgcatctgagcaattttcaacttatttagctgctcctgagtggcaaaagcatcatgctgcgttgattgcccttgcacagattgccgagggttgttccaaggttatggttaaaaatctggaacaagtggtttctatggttttgaactcctttaaccattctcatccccgtgtgaggtgggcagctattaatgcaatcgggcaattgtctaccgacttgggtcctgatttgcagaaccaatatcaccaaagagtattgcctgccttagcagctgctatggatgacttccaaaatcctagagtacaggcccatgctgcttcagctgtgctcaacttcagtgagaattgcactccagaaattttaacaccttacttagatggaatagttagcaaattgcttgtacttttacagaatgggaaacaaatggtgcaagaaggggccttgactgcattggcatcagttgctgactcatctcaggagcacttccaaaaatactatgatgcagttatgccttacctgaaagctatcttggtgaatgcaactgacaaatctaatcgtatgcttcgtgccaaatccatggagtgtattagtcttgttggaatggctgttggaaaggagaagttcagagatgatgctaagcaggttatggaagtgcttatgtcattgcaaggatcccaaatggaaacagatgacccgacaacaagttacatgctgcaagcatgggccagactctgcaagtgtttgggacaagacttcctcccttacatgagtgttgtcatgcctccccttctccagtctgctcaactgaagccagatgtgactattacatctgcagattcagataatgatatcgaggactctgacgatgaaagtatggaaaccattaccctcggggataaaagaattgggatcaagactagcgtcctggaggaaaaggcaacagcatgtaacatgctttgttgctatgctgatgagttgaaggaaggattttttccttggattgatcaggttgccccgactctagttcctcttcttaaattttatttccacgaagaagttagaaaagctgctgtttcagctatgccggagttattgcgttctgcaaaattagctgtggagaagggaatggctcaagggcgtaatgagacctatgtaaagcaattgtctgattacattattccggctctagtggaggcattgcataaggaacctgatacggaaatatgtgcaagcatgttagatgcattgaatgaatgtgtacagatctctggtcctctgctagatgaaagtcaagttaggtctattgtggatgagataaagcaagtaatcacagctagtgctagcagaaaaagtgagagagctgaaagagccaaagctgaagactttgatgctgaggagggagagttgattaaagaggaaaatgaacaagaggaagaagtttttgaccaagtgggtgaaatcttgggaactttgatcaaaacatttaaagcctctttcctgcctttctttgatgagctatcttcatatcttacacctatgtggggcaaagataagacacctgaagaaagaagaattgcaatttgtatttttgatgatgttgccgaacagtgtcgtgaggcagctttaaaatattatgacacatatcttcctttcatattggaggcttgcaatgatgagaacccagatgtgcgacaggcagcagtatatgggcttggtgtttgtgcagaatttggtggacctgtatttaagccacttgttggagaggctttatcaaggttaaatgctgtaattcgacatcctaatgcttcgcaacctgaaaatgttatggcatatgataatgctgtttctgctttgggaaaaatatgtctgttccaccgagacagtattgatgcaactcaggttgttcctgcatggttaaactgcttgccaataaaaggtgatctgattgaagccaaagttgttcatgaacaactttgttcaatggttgaaaggtctgacaatgaagttttgggtcccaaccatcatttccttcctaagattgtttcagtttttgctgaggttttatgtggtaaggatttagccacagaacaaaccgcaagtaggatggtgaatctactgaggcaacttcaacagactttaccaccagcagcattggcttcaactttatcatctttgcagccgcaacaacagcttgctttacaatccatcctctcctcctagttaacattggctcgatactcatccgtcttgtgcatcaatgcatatatttattttatataccaaattcttttcacggagaaggttccctttgtttttgcatcatgttctttttactccctcggtgattgaaatgaactttcctccccagatatataaattttatagaatgtgtatatcatgaaagtatctatttatggaacaagaagcgagagtggtgattcgtgtggttggtgagcatattttttgtgttaaaaaagtgcatttaggtttgagaagtcaaatgttcttgtagcagttttggtctcatgtgtgtctcttcgtttcaaattttacagagaatttggattgtaattctttcattatgcttgcaatttggatcataaaaaagaacaataatattatgtgttgtcggttttctagta

SEQ ID NO: 5862 - DNA, 4226 bp, Gossypium raimondii
tagaaattcgcatataacaaagttaacaaatattaatttttcattcattgagataaattaattaaaatacaaatttaaagactaacaaaaattaaacaaaggactaaatgttttatttttattttcatttttgttgtcaaccctaattggctcgctctcttaaaatccctcatttctctctttcctacactcctcctaaaaccctctcagccacccccccctctctctctctctctgtcacacacagcagccaagcaaacgcagaatacacgcataaaaagggagagaggaatcaatttaaccatcctcttcttcatcttcatcgctgttatcgatcatcttcttcgccgccgccgtcgccaccatggaccagcaatctcagctcgctgtcatcttaggatccgacccggtcccattcgaaaccttaatctctcacttgatgtcatcttccaacgagcaacgttcacacgccgaggctttattcaatgtttgcaagcaatctgatcctgatgctctctgcctccgccttgctcaccttcttcaggtctgtgctcaaccggatactcgtgccatggctgctattctccttcgtaagctgttgactcgtgatgattcctatatctggcctcgtctcaacgtttccactcattcctctatcaaatctgtgctcttgaatcaaatccaagtcgaaactgctcaatctttgtctaaaaagttatgcgatactgtttcggagcttgcttctagtattttgccggagaacggatggccagagctgttgccgtttatgtttcaatgtgtttcttccgattcccctagattacaggagtctgcttttttgatatttgcgcagttgagtcagtatattggtgatgtgttgactcctttcataaaggatctgcacactgttttcttgaagtgtttgagtggaaattctaatgcggatgtcaaaatcgcggccttgaatgcggttatcaattttattcagtgcttgaccagctcatctgatcgggataggtttcaggatcttttaccagcaatgatgaagaccttgacggaggctttgaataacgggaatgaggctacggctcaggaggcgctagagttgttgattgagttggcagagacggagcctcggtttcttaggaggcagattgttgatgtggtgggttctatgctgcagattgcggaggcagaatcacttgaggaaggaactcgtcacttggcaattgaatttgtagttaccttggcagaggccagggaacgggctcccggaatgatgaggaagctgcctcagtttattagtagattatttgcaatattgatgagattgttgcttgatattgaggatgacgcagcgtggcacactgcagaagttgaggatgaggatgctggagaaactagcaattacgctgtgggacaggaatgtttggatcgtctagcaatttccttaggtggaaatactattgttcctgttgcatctgagcaattttcaacttatttagctgctcctgagtggcaaaagcatcatgctgcgttgattgcccttgcacagattgccgagggttgttccaaggttatggttaaaaatctggaacaagtggtttctatggttttgaactcctttaaccattctcatccccgtgtgaggtgggcagctattaatgcaatcgggcaattgtctaccgacttgggtcctgatttgcagaaccaatatcaccaaagagtattgcctgccttagcagcggctatggatgacttccaaaatcctagagtacaggcccatgctgcttcagctgtgctcaacttcagtgagaattgcactccagaaattttaacaccttacttagatggaattgttagcaaattgcttgtacttttacagaatgggaaacaaatggtgcaagaaggggccttgactgcattggcatcagttgctgactcatctcaggagcacttccaaaaatactatgatgcagttatgccttacctgaaagctatcttggtgaatgcaactgacaaatctaatcgtatgcttcgtgccaaatccatggagtgtattagtcttgttggaatggctgttggaaaggagaagttcagagatgatgctaagcaggttatggaagtgcttatgtcattgcaagtatcccaaatggaaacagatgacccgacaacaagttacatgctgcaagcatgggccagactctgcaagtgtttgggacaagacttcctcccttacatgagtgttgtcatgcctccccttctccagtctgctcaactgaagccagatgtgactattacatctgcagattcagataatgatatcgaggactctgacgatgaaagtatggaaaccattaccctcggggataaaagaattgggatcaagactagcgtcctggaggaaaaggcaacagcatgtaacatgctttgttgctatgctgatgagttgaaggaaggattttttccttggattgatcaggttgccccgactctagttcctcttcttaaattttatttccacgaagaagttagaaaagctgctgtttcagctatgccggagttattgcgttctgcaaaattagctgtggagaagggaatggctcaagggcgtaatgagacctatgtaaagcaattgtctgattacgttattccggctctagtggaggcattgcataaggaacctgatacggaaatatgtgcaagcatgttagatgcattgaatgaatgtgtacagatctctggtcctctgctagatgaaagtcaagttaggtctattgtggatgagataaagcaagtaatcacagctagtgctagcagaaaaagtgagagagctgaaagagccaaagctgaagactttgatgctgaggagggagagttgattaaagaggaaaatgaacaagaggaagaagtttttgaccaagtgggtgaaatcttgggaactttgatcaaaacatttaaagcctctttcctgcctttctttgatgagctatcttcttatcttactcctatgtggggcaaagataagacacctgaagaaagaagaattgcaatttgtatttttgatgatgttgccgaacagtgtcgtgaggcagctttaaaatattatgacacatatcttcctttcatattggaggcttgcaatgatgagaacccagatgtgcgacaggctgcagtatatgggcttggtgtttgtgcagaatttggtggacctgtatttaagccacttgttggagaggctttatcaaggttaaatgctgtaattcgacatcctaatgcttcgcaacctgaaaatgttatggcatatgataatgctgtttctgctttgggaaaaatatgtctgttccaccgagacagtattgatgcaactcaggttgttcctgcatggttaaactgcctgccaataaaaggtgatctgattgaagccaaagttgttcatgaacaactttgttcaatggttgaaaggtccgacaatgaagttttgggtcccaaccataatttccttcctaagattgtttcagtttttgctgaggttttatgtggtaaggatttagccacagaacaaaccgcaagtaggatggtgaatctactgaggcaacttcaacagactttaccaccagcagcattggcttcaactttatcatctttgcagccgcaacaacagcttgctttacaatccatcctctcctcctagttaatattggctcaatactcatccgtcttgtgcatcaatgcatatatttattttatataccaaattcttttcacggagaaggttccctttgtttttgcatcatgttctttttactccctcggtgattgaaatgaactttcctccccagatatataaattttatagaatgtgtatatcatgaaagtatctatttatggaacaagaagcgagagtggtgattcgtgtggttggtgagcatattttttgtgttaaaaaagtgcatttaggtttgagaagtcgatgttcttgtagcagttttggtctcatgtgtgtctcttcgtttcaaattttacagagaatttggattgtaattctttcattatgcttgcaatttggatcataaaaaagaacaataatattatgtgttgtcggttttctaatatgtttatatttgcattttctttttggtcagttctcatcattagtccttgaattatttttatattctaatctggtcattttagtatgcttttttaaggagtgtggcgggcac

SEQ ID NO: 5863 - DNA, 3840 bp, Aquilegia formosa
aaaaaccctaattcttgctctaatggattccgattcaactcagcttcaacaagctcaacttgcagcgattcttggacctgatccaagttcttttgaaaccctagtttctcatcttatgtcatcaggtaacgaacaaagatctcaagcagaagttttattcaatctttgtaaacaaaatcatccagatgctttatctttaaagcttgttcatcttcttgaatcttcatctcatgttgaaattcgagctatgtctgcaattcttcttcgtaaacaacttactcgtgatgattcttacatctggcctcgtttatctccatctacacaaactgctttaaaatctcatctattggtttgtgttcaaagagaagatactaaatcgattactaagaaactttgtgacaccgtttctgaacttgcttctgggattttgcctgatggtggttggcctgaattacttccttttatgtttcaatgtgttacttctgattcgcctaaacttcaagaatctgctttattgatgtttgctcaattgtctcagtatattggtgaaaccctaattcctcatttgaatactttacactcagtcttctttcagtgtttgtcttcttcatctaatgctgatgttcgtatagcttcacttggtgcttctattaattttattcagtgtttgtcaagtgcatctgatagggataagttccaagaccttttgccttccatgatgcagactttgacagaggcgttgaactctggtcaagagtctattgcacaagaggctttggagttattgattgaattagcagggacagaaccaaaattcttgaggagacaattggttgacgtggttgggtccatgttacaaattgctgaggcagaatccctagaggagggaactcgtcaccttgctattgagtttgtgattactcttgctgaggcaagggagagggcacctggaatgatgaggaagttgccccaattcataagcaggttatttgcaattttgatgaagatgcttcttgatattgaggacgatgctgcgtggcatactgcagacagcgaggacgaggatgctggggagagcagtaattacagtgttgggcaggaatgcttggatcgtctatccatttcgttgggtgggaatacaattgttcctgttgcatcagaggtgttgccagcttatttggctgctccagagtggcagaaacaccatgcagcacttattgcactcgctcaaattgcagaaggatgctcaaaggttatgactaaaaatctggagcaagtggtgattatggtattgaactcattccaagatcctcatcctcgagttcggtgggctgctatcaatgcggttgggcaactttctacggacttagggccagatttgcaagtgcaataccaccagcaggtgctacctgccctggccttagcaatggatgatttccaaaatcctcgagtacaggcacatgctgcttcagccgtccttaatttcagcgaaaactgcacacctgatattttaacaccttatttggacgggattgtgagcaagttgcttgtgctcctacagaacgggaaacaaatggtacaagagggtgctttgacagctttggcgtcagttgctgattcatcacaggaacacttccagaagtattatgactccgttatgccttatctaaaagctatattgatgaatgccactgacaaatctaaccgcatgcttcgcgccaaatctatggagtgcatcagtttggttggaatggctgttggcaaggataagtttagagacgatgcaaagcaggtaatggaagttcttatgactttgcaaggatctcagatggagacagatgatccaacaacaagttacatgctacaagcatgggccaggctctgcaagtgccttgggcaggatttcctcccttacatgagtgttgtgatgcctccattacttcagtctgctcaacttaaacctgatgtgaccataacttctgcagattcagatgcagatatcgatgtatcagatgatgaaagtattgaaactattacccttggggacaaaaggataggtatcaagactagcgtcttagaagagaaagctacggcttgcaacatgctatgttgttatgctgatgagttaaaagaagggttctatccatggattgatcaggttgctcctacattagtgcctcttctaaaattttatttccatgaagaggtcaggaaagctgctgtttcagccatgccggagctattgcgttcagctaaattagctatagagaaggggcaagccccaggtcgcaatgagtcatatattaagcagttgtctgactatataatacctgcattagtggaagctttacataaggaacctgagacagaaatttgtgcaagtatgctggatgctttgaatgagtgtgtacaggtatctggaccacttcttgatgagagtcaggtgagatgcattgtggatgagataaagcaagtcatcacagccagctcaactagaaagagagaaagagcagagagggccaaagcagaggactttgatgctgaggaaggggaattgctcaaagaagaaaatgagcaagaagaagaagtgtttgatcaagttggtgattgtttgggcactctaattaaaacattcaaggcatcatttttacctttctttgatgaactttcgtcatatatcacacctatgtggggaaaggataaaacagctgaagagagaaggattgctatttgcattttcgatgatgttgcagagcagtgccgagaagctgctctcaagtactatgatacatatcttcctttcttgttggaagcttgcaacgatgagaacccagatgttagacaggctgctgtttatggaatcggtgtgtgcgcagaatttggtggcactgtttttcgacctctagttggagaggctctttccaggctaaatattgtgataaggcatcctaatgcactacatgcggacaatttaatggcctatgacaacgctgtttcagcacttgggaagatatgccagttccaccgggacagtatagatgctgcccaggttgttcctgcttggttaagttgcttgccaataaaaggtgatttgattgaagctaaacttgtgcacgaccagctatgttcaatggttgaaaggtcagatggtgagcttttgggtccgaacaatcaatatcttcctaaaattgttgccgtctttgctgaggtcctatgtgcgggtaaagatttggctacggaacaaactgctagtcggatgattaatcttttaaggcaactgcagcagacattgccaccctctaccctggcatcaacttggtcttccttgcagccccagcagcagcttgctttgcaatccatcctctcatcttagtaaattcaattcatggttatggtgttgcttctcaaggagatattgctgtcgggtcagtttgtgtctcctttatatttgttacccattctttcccataaagcatttcccatcagtttatttggtctgggttttgtcaatgcggtgtcttattgtttgtggttggtcatgggtgaaaaatttgtgcgaccgaatgaaaaaagacagtgaggatgaaaagttttggatgtacaatgtgtagattaaaaggcatgatttatggtccagcactacagttaccctaatagatggtcaatgcaatctggggcttttggcgtcgaggtttttgtttgttcatggttggttggtggggttggaagatgtcagtgagttgctatttgtatcagttttggcgttcaatttttattatattgattgtgacaaccttcatcagaagtggacatgaaatctattttattcttatagtctgg

SEQ ID NO: 5864 - DNA, 3292 bp, Manihot esculenta
aaccctaatactttctaaccatggacgattcaactcagcagctccaacaagctcaactcgccgccatactcggccaggaccctacccctttcgaagctctaatatcctctcttatgtcttcctccaacgagcaacgatcacaggcagagctcgctttcaacctctgcaagcagaccgatccggattctctctccctcaaacttgctcacctccttcagttctcttctcacgccgaggctcgcgctatgtccgccgtcctccttcgcaagcttcttacccgggatgatgcttatctctggcctcgtctctccctcgcagctcagtcttctatcaaatctattctattgacttgtattcagcatgagcagaccaaatcgattgttaagaagctgtgtgatactgtttctgagcttgcttctggtattttgcctgagaacggctggcctgagcttttgccttttatgtttcagtgcgtttcttctgattcgccgaagttacaggaatctgcgttcttgatatttgctcagttgtcacagtatattggcgagaccttaattccgtttattaaggagctacactcggtgtttttacagtgcttgggatcgtcttcgaattttgatgttaagattgcggctttgaatgcggttatcaattttatccagtgtttgaatagttcgtcagatcgggataggtttcaggatttgttgccggcgatgataaggacgttgactgaagctttgaataatggaaatgaggctacggcgcaggaggctttggagcttcttatcgagttggcaggttcagagccaaggtttctgcggcgacaattggtggatgtcgtcggttctatgttgcagattgctgaggctgagagtttagaagaaggcactcgacacttggctattgaatttgttattactttagctgaggctagggagagggcgccagggatgatgaggaagttgccacagtttattagcaggttattcgccattttgatgagaatgttgttagatattgaggatgatcctgcatggcatagtgcagaatctgaggatgaagatgcgggagagaccggtaactatagtgttggacaggagtgcttggataggttggccatttcattgggtgggaatactattgttccagtcgcttctgagcagttgcctgcgtatttagctgctccagaatggcagaagcaccatgctgccctcattgctcttgctcaaattgctgagggttgctccaaggtaatgataaaaaatctggaacaagtagtgtcaatggttctaaactcattctatgatccccatcctcgtgtgagatgggcagctattaatgcaattggacagttgtctactgatcttggtccagatttgcaaaatcaatatcatcagagagtgttgccagcacttgctagcgcaatggatgattttcccaaccctcgagtgcaggcacatgctgcttcagcagtgctcaacttcagtgagaactgtactccagagattttaactccttacttggatggaatagtgagcaaattgcttgtactattgcagaatggaaaacaaatggtgcaagagggagccttgactgccttggcctcagttgctgactcatcccaggagcacttccaaaaatattatgatgcagtaatgccttacttgaaggctatattagtgaatgcaacagacaaatctaaccgcatgcttcgtgccaaatcgatggagtgcattagtctggtagggatggcagttgggaaggataaatttagagaggatgctaagcaggttatggaagtccttatgtctttacaaggatctcaaatggaggcagatgatccgacgacaagttacatgttacaaccagatgtaacaattacatctgcggattcagataatgatattgatgattcagatgatgaaagtatggagactatcacccttggggacaaaagaattgcgatcaagactagtgtcctggaagaaaaagcaactgcatgtaatatgttatgttgctatgcagatgaacttaaggaaggcttctttccatggattgatcaggttgctacaacccttgttcctcttttgaaattttatttccatgaagaagttaggaaagcagctgtttctgccatgccggagctattgcggtctgccaaattagctgtagagaaggggttgtctcaaggtcgcaatgagtcttatgtaaagcagttgtctgactatattattccagcattggtggaagcattgcataaggaacctgatactgagatttgtgcaaatatgttagatgcattaaatgaatgcttacagatatctggaccccttgttgatgaaggtcaagtgaaatccatcatagatgagataaaacaggtgatcacagctagttctagtaggaaaagagagagagccgagagagccaaagctgaagactttgatgccgaggagggagagttgattaaagaggaaaatgagcaagaggaggaagtttttgaccaagtgggtgagatcttgggaacgttgataaaaacatttaaagcctctttcttgcctttctttgatgagctatcaacctatctaactcctatgtggggcaaggataagactgctgaggagagaagaattgccatttgcatttttgatgatgttgcagagcaatgtcacgaggcagcacttaaatactatgatacatatctcccattcctattagaggcatgcaatgatgagaatcctgatgttcgacaggcagctgtatatggacttggagtttgtgcagagtttggtgtatctgtatttaaacctcttgttggagaggctctttcaagactaaatgttgtgatacaacatcctaatgccaagcatcctgaaaatgtgatggcatatgataatgctgtttctgctttggggaaaatttgccagttccatcgtgcaagtattgattcagctcaggttgtcccagcatggttgaactgtttgccgataacaggtgatttaattgaagcaaaagttgttcatgagcagctttgtttgatggtggagcggtcggactcggagcttttgggtcccaacaatcagtatttacctaagattgtttcagtatttgctgaggttgtatgtggcaaggacctggcgacagaacaaactgcaagccgaatggttaacttattgaggcaccttcagcagactttaccaccagcaacattggcttcaacttggtctttgctgcatccacagcaacaaatggcactgcaatccattttgtcatcatagtccctggcattttggca

SEQ ID NO: 5865 - DNA, 4020 bp, Vitis vinifera
actttaaagccttcgccaaacgaggtcttggcttccctccctcacttcacatttgagcgagcgagagcggcagggttattggcggctctgcaaaaccctagttggctaccatggcttccgatcctactcctcttcagctaaaccaaatcgcggcgattctcggccctgatccagttcacttcgaagccctaatctcccacctcatggccaccgccaacgaccaacgctctcaggccgaggctctcttcaatctctgcaagcaaactcatcccgattctctcgttctcaaacttgcgatccttcttcagtcatctccgcatcctgaagcgcgagcaatggccgcgattctactcagaaagcaactcactcgagatgattcttacctatggccaaatctctctgccaccactcaggcgaatctcaaatcgattcttcttgactgtgttcaacgcgagaccgccaaaacgatatcaaaaaagttatgtgacactgtttcagaacttgcttctgggattttgcctgacggaggatggcctgagctattaccgttcatgtttcagtgcgttacttcatcgaactttaagctgcaagaggcggcgctgttaattttcgctcaattgtcgcagtacataggagaaaccctacttccgcatttggatactcttcactctgtgtttttgcagagtttggcttcatccatgaattctgatgttcgcatcgcggctcttggggcggcgatcaacttcattcagtgcttgtccaatgcggcggagcgggataagtttcaggaccttttgccattgatgatgcagacattgactgaggcgttgaattccagccaagaagcaactgcccaagaggcactggaattgttaattgagttagctgggacggagcccagatttctacggcgccaattggtggaagtggtgggttcaatgttgcaaattgcagaagcggagttgttggaggagggtacgcggcatctagccgtggaatttgttatcactttggctgaagcacgagagcgtgccccgggaatgataaggaagctgccacaatttatacaaaggttatttgcgatactgatgaagatgctgctggatatcgaggatgatcccgtatggcacagtgcagaggaggagcatgaggatgcgggtgagactagtaattatagtgttggacaggagtgtttggataggctctccatttctcttggtgggaataccattgtgccggtggcttctgaattgttgccggcttacttggcagctcctgaatggcaaaaacaccatgctgccctcattgcccttgctcaaattgcagagggttgctccaaggtgatgataaaaaatctagaacagatagtatcaatggtcttgaactcatttcaagatccacatcccagggtacgatgggcagctattaatgccattggacagttgtcaacggatttaggcccagagctacaagttaaatatcatcaacggctactgcctgcactagctgcagcaatggatgattttcagaatccccgagtacaggcccatgctgcttcagcagttctcaatttcagtgaaaattgcaccccagatatcttaaccccatacttagatggaattgtgagcaaactgcttgtactcctacagaatgggaagcaaatggttcaggagggggctttgacagctttagcatcagttgctgattcatcacaggtgcatttccagaagtactatgatgccgtaatgccttacctgaaagctattttagtgaatgcaaatgacaaatctaatcgtatgcttcgggctaagtcaatggagtgcattagtttggttggaatggctgttgggaaagagaagtttagggatgatgcaaagcaggttatggatgtacttatgtcattgcaaggatctcagatggaggcagatgatccaacaacaagctacatgttacaagcatgggccagactttgcaagtgccttggccaggatttccttccttacatgaatgttgtcatgccccccttgcttcaatctgctcagcttaagcctgatgttaccattacatctgcagattcggatgctgatatttatgactctgatgatgatagcattgagactattacacttggggataaaaggatagggatcaaaactagtgttttggaagaaaaggccacagcttgcaacatgctatgttgctatgctgatgaattaaaggaagggttttttccatggatcgatcaggttgctcctacattggttcctcttcttaaattttattttcacgaggaagttaggaaggctgctgtttcagccatgccggagctgttgcgatcagctaaattagctgtggagaaggggcagtctcaaggccggaatgagtcctatattaagcaattatctgattacataataccagccctggtggatgcgctacacaaggagcctgagacagagatctgtgcaagcatgttggattcgttgaatgaatgcatacagatttctggaccacttttggatgaaggccaagtgaggtccattgtggatgagataaagcaggtgatcacagccagctcatctagaaagagagagagagcagaaagggccaaagcagaggactttgatgcagaagaaggggaactgctaaaagaagaaaatgagcaagaagaagagctctttgatcaaatcggtgattgcttgggcactttgatcaaaaccttcaagtcttctttcttgcctttctttgatgagctttcatcttacctgatgcctatgtggggtaaagataaaacggccgaagagagaagaattgccatttgtatatttgatgatgttgctgagcaatgtcgagaatcagctcttaaatactatgatacttaccttcctttcctattggaagcctgcaatgatgagaacccacatgttcgtcaggcagctgtttatggaataggtgtttgtgcagaatttggtgggtctgcattcaaacctcttgttggagaggctctttccaggctggatgttgtaataagacactctaatgcacgggattcagataatgtaatggcttatgataatgctgtttccgcacttggaaaaatatgccagttccatcgcgatagtatagatgccgtgcagattgttcctgcttggttaagttgcttgcctttaaaaggtgatttgattgaggccaaagttgtgcatgaccaactatgttcaatggtggaaaggtcagatagggaacttttggggcccaacaatcaatatcttcccaaaatagttgcagtctttgctgaggtcctatgtgctggtaaagacctggcaactgaggaaaccacaagccgaatgattaatctgctgaggcaacttcggcagacattgtcgccctctgccctggcatcaacgtggtcatccttgcagcctcagcaacagctcgcgctgcagtccatcctatcaacttagttaatttcacaatggtgagtgtgatgttccaagattcccttgtgagatgctgctgtgtcgggtcggtccggtttgctttgtttgctgtgtgttaggtagtccattcttttccataatatgattcataattggttgggcaatgttacacatttgtaccaatgcagcagtgtgcattattgcttgattgctctgagggtgacgtgaaaaatatacgagttttggtgtagaatgtgtatattaaagtggtattcatcatccagtcctccctcgaaaggagaggaaaaaaagaaacgaaaagatcaatagttcatagtttgtggctctgtttgaacggtcggtgtgtgaatgcgatgttgaggcttgtttgtcaagcaaaatcagttttggtgatttttggacacacttctatacagtttctatccttttttctttggggaagtttcatgtctatttttagattgccggtgaggttttgtatagcttttctttattgggttattatctttactttcatgttttggttctgaaacaattaaggtggattcatggtgtggttgtt

SEQ ID NO: 5866 - DNA, 3927 bp, Vitis vinifera
ggcggctctgcaaaaccctagttggctaccatggcttccgatcctactcctcttcagctaaaccaaatcgcggcgattctcggccctgatccagttcacttcgaagccctaatctcccacctcatggccaccgccaacgaccaacgctctcaggccgaggctctcttcaatctctgcaagcaaactcatcccgattctctcgttctcaaacttgcgatccttcttcagtcatctccgcatcctgaagcgcgagcaatggccgcgattctactcagaaagcaactcactcgagatgattcttacctatggccaaatctctctgccaccactcaggcgaatctcaaatcgattcttcttgactgtgttcaacgcgagaccgccaaaacgatatcaaaaaagttatgtgacactgtttcagaacttgcttctgggattttgcctgacggaggatggcctgagctattaccgttcatgtttcagtgcgttacttcatcgaactttaagctgcaagaggcggcgctgttaattttcgcgcaattgtcgcagtacataggagaaaccctacttccgcatttggatactcttcactctgtgtttttgcagagtttggcttcatccatgaattctgatgttcgcatcgcggctcttggggcggcgatcaacttcattcagtgcttgtccaatgcggcggagcgggataagtttcaggaccttttgccattgatgatgcagacattgactgaggcgttgaattccagccaagaagcaactgcccaagaggcactggaattgttaattgagttagctgggacggagcccagatttctacggcgccaattggtggaagtggtgggttcaatgttgcaaattgcagaagcggagttgttggaggagggtacgcggcatctagccgtggaatttgttatcactttggctgaagcacgagagcgtgccccgggaatgataaggaagctgccacaatttatacaaaggttatttgcgatactgatgaagatgctgctggatatcgaggatgatcctgtatggcacagtgcagaggaggagcatgaggatgcgggtgagactagtaattatagtgttggacaggagtgtttggataggctctccatttctcttggtgggaataccattgtgccggtggcttctgaattgttgccggcttacttggcagctcctgaatggcaaaaacaccatgctgccctcattgcccttgctcaaattgcagagggttgctccaaggtgatgataaaaaatctagaacagatagtatcaatggtcttgaactcatttcaagatccacatcccagggtacgatgggcagctattaatgccattggacagttgtcaacggatttaggcccagagctacaagttaaatatcatcaacggctactgcctgcactagctgcagcaatggatgattttcagaatccccgagtacaggcccatgctgcttcagcagttctcaatttcagtgaaaattgcaccccagatatcttaaccccatacttagatggaattgtgagcaaactgcttgtactcctacagaatgggaagcaaatggttcaggagggggctttgacagctttagcatcagttgctgattcatcacaggtgcatttccagaagtactatgatgccgtaatgccttacctgaaagctattttagtgaatgcaaatgacaaatctaatcgtatgcttcgggctaagtcaatggagtgcattagtttggttggaatggctgttgggaaagagaagtttagggatgatgcaaagcaggttatggatgtacttatgtcattgcaaggatctcagatggaggcagatgatccaacaacaagctacatgttacaagcatgggccagactttgcaagtgccttggccaggatttccttccttacatgaatgttgtcatgccccctttgcttcaatctgctcagcttaagcctgatgttaccattacatctgcagattcggatgctgatatttatgactctgatgatgatagcattgagactattacacttggggataaaaggatagggatcaaaactagtgttttggaagaaaaggccacagcttgcaacatgctatgttgctatgctgatgaattaaaggaagggttttttccatggatcgatcaggttgctcctacattggttcctcttcttaaattttattttcacgaggaagttaggaaggctgctgtttcagccatgccggagctgttgcgatcagctaaattagctgtggagaaggggcagtctcaaggccggaatgagtcctatattaagcaattatctgattacataataccagccctggtggatgcgctacacaaggagcctgagacagagatctgtgcaagcatgttggattcgttgaatgaatgcatacagatttctggaccacttttggatgaaggccaagtgaggtccattgtggatgagataaagcaggtgatcacagccagctcatctagaaagagagagagagcagaaagggccaaagcagaggactttgatgcagaagaaggggaactgctaaaagaagaaaatgagcaagaagaagagctctttgatcaaatcggtgattgcttgggcactttgatcaaaaccttcaagtcttctttcttgcctttctttgatgagctttcatcttacctgatgcctatgtggggtaaagataaaacggctgaagagagaagaattgccatttgtatatttgatgatgttgctgagcaatgtcgagaatcagctcttaaatactacgatacttaccttcctttcctattggaagcctgcaatgatgagaacccacatgttcgtcaggcagctgtttatggaataggtgtttgtgcagaatttggtgggtctgcattcaaacctcttgttggagaggctctttccaggctggatgttgtaataagacactctaatgcacgggattcagataatgtaatggcttatgataatgctgtttccgctcttggaaaaatatgccagttccatcgcgatagtatagatgccgtgcagattgttcctgcttggttaagttgcttgcctttaaaaggtgatttgattgaggccaaagttgtgcatgaccaactatgttcaatggtggaaaggtcagatagggaacttttggggcccaacaatcaatatcttcccaaaatagttgcagtctttgctgaggtcctatgtgctggtaaagacctggcaactgaggaaaccacaagccgaatgattaatctgctgaggcaacttcggcagacattgtcgccctctgccctggcatcaacgtggtcatccttgcagcctcagcaacagctcgcgctgcagtccatcctatcaacttagttaatttcacaatggtgagtgtgatgttccaagattcccttgtgagatgctgctgtgtcgggtcggtccggtttgctttgtttgctgtgtgttaggtagtccattcttttccataatatgattcataattggttgggcaatgttacacatttgtaccaatgcagcagtgtgcattattgcttgattgctctgagggtgacgtgaaaaatatacgagttttggtgtagaatgtgtatattaaagtggtattcatcatccagtcctccctcgaaaggagaggaaaaaaagaaacgaaaagatcaatagttcatagtttgtggctctgtttgaacggtcggtgtgtgaatgcgatgttgaggcttgtttgtcaagcaaaatcagttttggtgatttttggacacacttctatacagtttctatccttttttctttggggaagtttcatgtctatttttagattgccggtgaggttttgtatagcttttctttattgggttattatctttactttcatgttttggttctgaaacaattaaggtggattca

SEQ ID NO: 5867 - DNA, 3879 bp, Cucumis sativus
ccaataatcctccatccatggcggccgccgatcccactcagcttcatcaactctccttgcttctgggttccgatcgtacccacttcgaaaccctaatttcccatcttatgtcctcttccaatgaccagcgttcacaggctgaatcccttttcaacctctgcaaacaagcacacccagatgctcttgctctcaaactcgccgatcttcttcacccttctgctcatcctgaggctcgtaccatgtctgccattctccttcgtcgtcaactcattcgtgatgattcttatctctggcctcgtctatctccttctactcaatctactcttaaatctgttttgctttcctcacttcaaacggaggaatctaaatctatttctaagaagctgtgtgatactattgctgaacttgcttctgggattttgcctgatggtggttggaatgaattgatgccttttatttttcagtgtgttacttctgatagttctaagttgcaggagtctgctttgttgatttttgctcaattggctcagtatattggtgaaaccctagttcctcatttggatacgcttcattctgtgttttctcagtgtttggcttcgtcaaaaactggggatgttaggattgcggctttgggtgctgcgattaattttattcaatgtttgtctagtgcttctgatagggataggtttcagaatctattgcctttgatgatgcagacgttgactgaggctttgaattctggtcaagaagctactgctaaagatgcgcttgagttgttgattgaattggcagggactgagcctagattcttgaggaggcaattggttgatgtggttggttcgatgttgcagattgctgaggccgattcccttgaagaatctactagacatttagctattgagtttgttataacgcttgctgaggctcgagagcgagctcctgggatgatgaggaagttgccacagtttataagtaggttgtttgggatacttatgaatatgttgttggatattgaggatgatcccgcgtggcatactgctgatactgaggatgaggatgcgggtgagagtgacaattatgggtttggccaagagtgtttggacagactttctatttcattgggtggaaattctattgtgcctgtagcctccgagatgtttccagctttcttggctgcacctgaatggcaaaagcaccatgcagcacttattgctctctcacaaattgcagagggttgctcgaaggtaatgataaagaatctcgagcaagtactctccatggttttgaattcattccaacatccacatccacgtgtaagatgggcagccattaatgcgattggccagttgtctactgatctaggtccagatttgcaggctcaatatcaccatctagttgtgccggctttggctggagctatggatgattttcaaaatccacgagtacaggcacatgctgcttcagcagttctcaatttcagtgagaattgcaccccagatattttaacaccttacttggatggaattgtgagcaagctccttgtacttctgcagaatggaaagcagatggtgcaggagggtgctttgactgctcttgcttctgttgctgattcatctcaggagcacttccagaagtactatgatgctgtaatgccttacttgaaagctattcttgtaaatgcaagtgataagtccaatcgtatgcttcgtgccaaatccatggagtgtatcagtttggttggcatggctgttggtaaagacaagtttaaggatgatgcaaaacaggttatggatgttctattgtcactacaaggatctccaatggaagcagatgatcccacaaccagctacatgttacaagcatgggcaagactctgcaaatgtcttggacaggattttcttccttacatgagtgttgtgatgccacctttgcttcaatctgcccaacttaaaccagatgtcacaatcacatctgctgattcagatgctgatatcgatgacgatgatgatagcattgaaacaataactctaggtgacaaaaggattggcatcaagactagtgttttggaggaaaaagccactgcttgcaacatgctgtgttgttatgctgatgaattaaaagaaggattttttgtctggattgatcaggttgctcctactttagttccacttcttaagttttatttccatgaagaagttagaagggctgctgtttcagccatgccggagctcctgcgttcagcaaaattggctgttgagaaagggcaatctcaaggtcgtgatgaatcctatgtaaaacagttgtcagattatattgtaccagctttggtggaggcattacacaaggagcctgaggtggagatatgtgccagtatgttggatgcattgaatgagtgtgtacagatctctggaccacttcttgatgaaagccaagtacggtgcattgtggatgagattaaacatgttataactgctagctcctcaagaaagcatgaaagaatggagagggcaaaagctgaagattttgatgcagatgagagagaattacttgatgaagaaaatgagcaagaagaagaagtttttgatcaggttggtgattgtttgggaactttgatcaagacttttaaggcctcgttcttgcctatgtttgatgaactctcatcatatttgacacctatgtggggtaaggatagaacagccgaggagaggagaatagcaatatgtatttttgatgatgttgtggaacattgccgtgaagcagccctcaggtactatgatacctaccttcctttcttgttggaggcatgcaatgacgagaatcctgatgtccgtcaggctgctgtttatggtattggtgtttgtgctgagtttggtggatctgtattcaaaccacttgttcaagaggcactttccaggttggatgttgtgatacggcacccgaatgcacaacattctgaaaacataatggcatatgacaatgctgtttcagctcttggaaagatatgtcagtttcacagagacagtataaatgcacctcagttggttcctgcttggctaggctgtttgcctatcaagggagatttaattgaggcaaagttggtgcatgatcagctttgttcaatggttgaaaggtccgataaagaactcttaggtcccaacaatcaatatcttcccaaaattgtttccatttttgctgaggttctatgcgcgggtaaggatcttgcgacggagcaaactgccagtagaatggtaaaccttttgaggcagcttcagcaaactctaccaccgtccacactggcatcgacctggtcatctttgcaaccacagcagcagcttgcacttcaatcaatcctctcatcttagtgtaattggaattggcaagacagatcattttgtgtcagatcctgagttggttaacatctcctgaatgggttggttggctgtgtgttttcttggtattttttgaagcattttagcccgataatgtcatcatcatcccttttgcattgcgaagcacagcagtcatcccttgaagaaatctgctgctgctgctgcggcattggcgtcgcgtgtttttgtgatcctgtctcataatgtattatttatttttttgcgcgcttgtttaaagcatcgattttgcatggtccaaaggcgacaagaaagagttgttatagtttgtgtgtatagtacaaaattattggtgtactagagtccctacccctcagaaaaaaaaaagtgaagcaagcaaaaaataatgtcgagtgggtaattgttattttgaggctttgaagttttggaaaagttgaggtcaaagcgtgtcattgaaacagagaacggttaagttttggtttttggttctttacatcttcagtatgattat

SEQ ID NO: 5868 - DNA, 3914 bp, Citrullus lanatus
tccaataatcctccatccatggcggccgatcccactcagcttcatcaactctccttgcttctgggttccgatcgtacccacttcgaaaccctaatttcccatctcatgtcctcctccaatgaccagcgttcacaagccgaatcccttttcaacctctgcaaacaagcccacccagatgctcttgctctcaaactcgccgatcttctccacccctctgctcaccctgaggcccgtaccatgtctgccattctcctccgccgtcaactcattcgtgacgattcttatctctggcctcgtcttactccctccactcaatctactcttaaatctgttttgctttcctcacttcaaaccgaggaatctaaatctatttccaaaaagttgtgtgataccatcgctgaacttgcttctgggattttgcctgatgggggttggaatgaattgatgccttttatttttcagtgtgttacttccgatagttctaagttgcaggagtctgctttgttgatttttgcgcaattggctcagtatattggtgaaaccctagttccgcatttggatacgcttcactctgtgttttcacagtgtttggcttcgtctaaaactggggatgtgaggattgcggctttgggtgctgccatcaattttattcaatgtttgtctactgcttctgatagggataggttccagaatctattacccttgatgatgcagacgttgactgaggctttgaattccggtcaagaagctactgcgaaagatgcgcttgaattgttgattgaattggctgggactgagcctagattcttgaggaggcagttggttgatgtggttggttccatgttgcagattgctgaggcggattcacttgaagaatctactagacatttagctattgagtttgttataacgcttgctgaggctcgagagcgagctcctgggatgatgaggaagttgccacagtttataagtaggttgtttgggatacttatgaatatgttgttggatatcgaggacgatcctgcctggcatactgcagataccgaggatgaggatgctggtgagagtgacaattatgggtttggccaagagtgtttggatagactttctatttcattgggtggcaattctattgtgcctgttgcctccgagatgtttccagctttcttggctgcacccgaatggcaaaaacaccatgcagcacttattgcactctcacaaattgcagagggttgctcgaaggtaatgataaagaatcttgagcaagtgctctctatggttttgaattcattccaacatccgcatccacgtgtacgatgggcagctattaatgcgattggccagttgtctactgacctaggcccagatttgcaggctcaatatcaccatctagttgtgcctgctttggctggagctatggatgattttcaaaatccacgagtacaggcacatgctgcttcagcagttctcaatttcagtgaaaattgcaccccagatattttaacaccttatttggatggaattgtgagcaaactccttgtactactgcagaatggaaagcagatggtgcaggagggtgctttgacagctcttgcatctgttgctgattcatctcaggagcacttccagaagtattatgatgctgtaatgccttacttaaaagcgattcttgtaaatgcaagtgacaaatccaatcgtatgcttcgtgccaaatccatggagtgtatcagtttggttggcatggctgttggaaaagacaagtttaaggatgatgccaagcaggttatggatgttttgttgtcactacaaggatctccaatggaagcagatgatcccacaaccagctacatgttacaagcatgggcaagactctgcaaatgccttggacaggattttcttccttacatgagcgttgtgatgccacctttgcttcaatctgctcaacttaaacctgatgtcacaatcacatctgctgattcagatgctgatattgatgatgacgatgatagcattgaaacaataactctcggtgacaaaaggattggcatcaagactagtgttttggaggaaaaagccactgcttgcaacatgctgtgttgttatgctgatgaattaaaagaaggattttttgtctggattgatcaggttgctcctactttagttccacttcttaaattttatttccatgaggaggttaggagggctgctgtttcagccatgccagagctcctgcgttcagcaaaattggctgttgagaaagggcaatctcaaggtcgtgatgaatcctatgtgaagcagctgtcagattatattgtaccagctttggtggaggcattacacaaggagcctgaggtggagatatgtgccagtatgttggatgcattgaatgagtgcgtacagatctctggaccacttcttgatgaaagccaagtaaggtgcattgtggatgagattaaacatgtcataactgctagttcctcaagaaagcatgaaagaatggagaggtcaaaagcagaggattttgatgcagatgagagagaattgcttgatgaagaaaatgagcaagaggaagaagtttttgatcaggttggtgattgtttgggaactttgatcaagactttcaaggcctcgttcttgcctatgtttgatgaactctcatcatatttgacacctatgtggggtaaggatagaacagcagaggagaggaggatagcaatatgtatttttgatgatgtcgtggagcattgccgtgaagcagccctaaggtactatgatacctaccttcctttcttgttggaggcttgcaatgatgagaatcctgatgtccgtcaggctgctgtttatggtattggtgtttgtgctgagtttggtggatctgtatttaaaccacttgttcaagaggccctttccaggttggatgttgtgatacggcacccaaatgcacaacattctgaaaacataatggcatatgacaatgctgtttcagctcttggaaagatatgtcagttccacagagacagtataaatgcacctcagttggttcctgcttggcttggctgcttacctatcaagggtgatttaattgaggcaaagctcgtgcacgatcagctctgttcaatggttgaaaggtccgataaagaactcttaggtcccaacaatcaatatcttcccaaaattgtttccatttttgctgaggttctatgtgccggtaaggatcttgcgacggagcaaactgccagtagaatggtaaaccttttgaggcagcttcagcaaactctaccaccctccacactggcatcgacctggtcatctttgcaaccgcaacagcagcttgcacttcaatcaatcctctcatcttagtgtaattggaattggaaaaacaggtcattctttgttccagattgtgtcagatcctgagttggttgcatctcttgaatgggttggctgtgtgttttctggtattttttcgaagcgttttaagcccgataatgtcatcccttttgcattgcaaagcacagcagtcatcccttgaagaaagctgctgctgcagcattggcgtcgcgtgttttccgtcatcctgtctcataatgtattatttattttttacggcttgtttaaaagcatcgattttgcatggtccaaaggcgactagatagagttgttaccgtttgtgtgtatagtacaaaattattggtgaactagagtccccatccctcagaaaaaagagtgaagcaagcaaaaataatgtcgagtggttattattattattttgaggctttgaagttttggaaaagtgaggtcaaagcgtgtcattgaaacagaattgttaagttttggtttttggttcatttggttttcatgagtattgagtatttttaaacagtagtcagttttttttttttttttttttttaa

SEQ ID NO: 5869 - DNA, 3782 bp, Chenopodium quinoa
aaaaaaggaaagagagagaaagagactagcacacaaaccttttagcgcctccacttctctctttcccccctctctctcaaaaattatccccaaaaaccctaattttccccagtatttgtgaggcgcaaacaaccctctcctacctccaaacctccatcaatggcgtccgagttgactcagttccaacacgcttcaatggcggcgattctcggccccgatccatcccatttcgaaaccctaatttcccaacttatgtccacaaacaacgaccaacgttctcaatccgaaaccctctacaatctctgcaagcagcatcaacctgacgctctctccctcaagcttgcgcaccttcttcagtcttctcctcaccctgaagctcgagctatggcggcgattctccttcgaaagctcttgactcgggatgactcgtttctatggccgaaactcagtggttcgactcagaataccctaaaatctgttcttcttgcttgtgttccgagggaagatgcgaagacgatttcgaagaagttgtgtgatactatttctgagcttgctgctggtattatccctgattatggttggcctgagcttttgccgtttatgtttcagtgtgttacttcggataatccgaagcttcgagaatctgcgttgttgatttttgcgcaattggcgcagtatattggggaaacattggttccgcatttggatacgctttataatgtgttttttcaatgtttgggtggaaattcgagtgccgaggttcggattgctgcgcttggagctacgattaatttcatacaatgcttaacgagtgcttcggatcgcgataggtttcaggatttgttacctccgatgatgcagacgttgacggaggctttgaattgtgggcaggaggcgactgctcaggaggcgcttgagttgttgattgatttggcagggaccgagccgaggtttttgaggaggcagttggttgatgttgttggggcaatgttgcagattgcggaggcggaaactcttgaggaagggacgaggcatttggcgattgagtttgtgattacacttgctgaggcgagggagagggcgccgggtatgatgaggaagttgccacagtttattcacaggttgtttgggatattgatgaagatgttgcttgatattgaggatgatcctgtgtggcatacggctgataccgaggacgaggatgccggggagtctagtaattatagtgttgcgcaggagtgtttggataggttgtcgatttcgttgggagggaataccattgttcctgttgcttcggaggtgttgccggctcatctggctgctccggaatggcaaaagcatcatgctgcattgatttgtttggctcaaattgcagagggttgctcaaaggtgatgataaagaacttagagcaagtggtgtcaatggtgttaaattcgtttcaagacccacatcctcgtgtgcgttgggctgctattaatgcaatcggtcaattatcaacggacttggggccagatttgcaaatgcaatatcacaatcgtgtcttgcctgctttggcatcttccatggatgatttccaaaatcctcgtgtccaggcacatgctgcttcagctgtgttgaacttcagtgaaaattgcactccagagatcttgacgccatacttagatggtattgtgagcaaattgctcgtccttttgcagaatggaaagcaaatggttcaggaaggggctttgactgcattagcatcagttgctgattcatcacaggagcttttccagaagtattatgatgctgttatgccataccttaaggctatactggtcaatgcaactgacaagtccaatcgtatgctacgtgcaaagtcaatggaatgtataagcttggttggaatggctgttgggaaagagaagtttagagatgatgctaagcaggtcatggacgttctgatgcagttacaaggatcacaaatggaagctgatgatccaacaactagttatatgcttcaggcatgggcaagactctgcaaatgtctggggcaagatttccttccttatatgagtgttgttatgcctccgttgcttcactctgctcaacttaagcctgatgtgacaatcacatcagcagattcagatgctgatattgatgaatctgatgacgagagcattgagaccatcaccctcggggacaaaaggattggaatcaagaccagtgttcttgaggagaaagctacggcttgcaacatgttgtgttgctatgctgacgagctaaaagaaggcttctttccgtggattgaccaggttgctcctacattggttccccttcttaaattttatttccacgaggaagttagaaaggcagcagtgtcagccatgccagagttgctgcgctctgctaagttagctgtggagaaggggttggcccaaggtcggaacgagtcttatgttaagcaattgtctgattatattatacctgctttggtagaggctttacacaaggaacctgaagtggagatctgttcaaacatgcttgatgcgcttaatgagtgcattcaggtatctggaacacttctggatgaaagccaagtaagaattatagtagatgagataaagcaggttattacagcgagcgcctccagaaaggcagagagagcagaaaggattaaagctgaggattttgatgctgaagaaggagaaattcttacggaagaaaatgagcaagaagaagaactttttgatcagattggtgattgcttaggcactttaatcaagacgttcaaggcatctttcttgcccttctttgatgagctctcgtcatacttgacacctatgtggggaaaggataaaacgacagaagaaagaagaatcgccatttgtatctttgatgatgttgtggagcattgtcgtgaagcagcacttagatactatgataccttccttcctttccttttggaagcttgcaatgatgacaactcagatgttcggcaggcggctgtttatggtcttggtgtttgtgccgagtttggtggatctgtgttcaagcctcttgttagagaggccctttcaagattggatgctgtgataaggcatcccaatgctacacgtgcagagaatgtgatggcatatgacaatgctgtttcagctcttgggaagatatgccaatttcatcgtgatagtatagatgctgctcaggttgttcctatgtggttaaattgcttgccgattaaaggagatctaattgaagccaaggtagtacatgatcaactttgttctatggttgagaggtctgatggagatttgttaggaccgaataatcagtacttgtccaaaatagtagcagtatttgctgaggtcttgtgtgcgggtaaagatcttgcaacagagcaaactgcaagccgaatggtcaatttattgaggcaacttcaacaaactctaccgccttcgactcttgcatcgacctggtcatcccttcaacctcagcaggtgttggccttgcagtcaattctgtcccaatagtttcatgtgtcgtttgtttcatctttatgtgaaagcctgctcaagatgtgagcaggtctattgtcttctatttcattattcttttttcatagcatatataatatcctcgatcgtaaattttgctggtggcatgtagttggtcaatgtgttgtcttggttggggaagatcagatatcagtgtacaatgtgtatattatgagttgtctgtaatcagttatcttgctatgatcttaagttacaacagatgaaaaggagatagaagagtgtgaggt

SEQ ID NO: 5870 - DNA, 3696 bp, Elaeis guineensis
gcaggagcaggagcagcagcagcaggtggcggcgatcatcggggcggcggacccggccccgttcgaggctctggtgtcccagctgatgtcctccgtcaacgagcagcgatcgcaggcagaggccctcttcaacctctgccgcgaccgccacccggattccctcgctctcaagctcgcccacctcctccactcctcctcccgcgtcgagatccgcgccatgtccgccatcctcctccgcaaggtcctcacccgtggctcctcctcgtctgacgccgccgccgtctcgccctcatatctctggccccgcctctcccctgcgacgcagtcctccctcaagtccctcctcctctccgccgtccagcgcgaggactcgaagtccatcgccaagaagctctgcgataccgtctccgagcttgcctccagcctcctccccgatgacgcctggccggaactcctccctttcatgttccaagccgtcacctccaccgacttcccccgcctccaggagtcctcccttttcatcttctcccagctcgcccagtacatcggcgacgccctcctcccccacctctccacccttcacggggtcttcctctcctccctctcccaccactcctcccctgatgtgcgcatcgccgccctcggcgccgccatcaacttcatccagtgcctcccctccgccactgaccgtgaccgcttccaggacctcctccccgccatgatgcgcaccctgaccgaggccctcaattctggccaggaggccactgcccaggaagcgctcgagctcctcatcgagcttgccagcacggagccccgcttccttcgtcggcagctccctgatgttgtcagtgccatgcttcagattgccgaggctgaccgcctcgaggacggcactcgccaccttgctgtcgagttcgtcatcacgcttgccgaggctcgtgagcgtgcccctggcatgatgcgccgccttccccagtacatcggccgcctctttgctgtcctcatgaagatgctgcttgacatccaggatgagcccgcctggcacagtgccgagaccgaggatgaagatgctggggagaccagcaactacagtgtcggccaggagtgccttgaccggctctccattgccctcggggggaacactatcgttcctgtcgtgtctgagctgcttccggcatacttggctgcacctgagtggcagaagcaccacgctgccctgatcatgcttgcgcagattgcagagggatgttcgaaggtcatgataaaaaatcttgaacaagtagtaaatgtggtcctgaacttgttccaagatccccatcctagagtacgttgggcagcgataaatgctgttgggcagctgtcaactgatttgggtcctgatttgcagatgcagtatcaccatcttgtgttgccagcactggcatctgctatggatgatttccagaatcctcgtgtacaggcccatgctgcctctgcaatcctgaatttcagtgaaaactgcactccagaaattttgacaccttacttggatggaattgtgagcaaattgcttgtgctgctacagaatgggaagcagatggtgcaagaaggagctttgacagctttggcatcagtggcagattcatcacaggagcacttccaaaagtactatgatgctgttatgccatacctgaaagctattttgatgaatgctactgacaagtcaactagaatgctccgtgccaaatccatggagtgcattagtttggtcggaatggctgtaggcaaggataagttcagggatgatgctaaacaggtaatggaagtgctgatgacattgcaaggatctcagttggagacggatgatccaataacaagctacatgctgcaggcatgggcaagactttgtaaatgcctaggccaggattttcttccatacatgaatgtggtcatgcccccattgcttcaatctgctcagctcaaaccggatgttacaattacttctgcagattcagatgatgatattgatgaatccgatgatgacagcattgaaacaatcactcttggggataaaaggattggtattaggacgagcatcttggaggagaaagctacagcatgcaacatgctttgttgctatgctgatgagctcaaggaggggttcttcccgtggattgatcaggttgctcctactttggtaccgctgctgaaattttatttccacgaagaagttaggaaggccgcagtttcagccatgccagagttactacgatcagccaagttggcagtggagaagggccaagctcaaggccgtgatgaatcgtatgttaaacagttatctgactatataattccagctctggttgaagctttgcataaggaacctgagacagagatttgtgcaagcatgctggattcgttgaatgaatgcatacagctttctggaatgcttcttgatgaaaaccaggtcagatgcatagtggatgaaatcaagcatgcgataacagctagcacaactagaaagagagagagagcagagaggacaaaagcagaggactttgatgctgaagaaggggaattactcagagaagagaatgaacaagaagaagaagtctttgatcaagttggtgattgtttgggcactttgatcaaaactttcaaggcttcttttataccattttttgatgagctttccatatatataacacctatgtggggtaaggataaaacagccgaagaaagaaggattgccatttgtatttttgatgatgttgcagaacaatgtcgagaagcagctcttaagtattatgatacatatcttcctttcttattagaagcttgcaatgatgaaaatgcagctgttagacaggctgcagtttacggtgttggggtttgtgcggagtttggtggttccgtatttagacctctagttggagaggctctctgtaggttaaataatgtgataagacatccgaatgcacttgattcagacaatgtaatggcttacgacaatgctgtttcagctctagggaaaatatgccagtttcatcgggataatattgatgcagctcaggtttttcctgcttggttaagctgcttgcctataaaaaatgatctgattgaggcaaaaattgtacacgaccagctctgttcgatggttgaaaggtctgatagggagcttttgggtcctaacaatcaatatctccccaagatcatttctgtttttgctgagattttatgtgggggcaaggatttggcgaccgaacagactgccagcaggatgattaatcttctgaggcagcttcagcagacattgcctccatccgttctcgcttcaacctggtcttccttacagccccagcagcagcttgcactgcattctgtcttgtcatcatagtatcttcagttgctgggcctgtgaactgcaaatcctgatttttaactgtgtatttatcattattactcaattctttgcctctgcatggtttgaatggattgcgtgtgagctgcatgtaacttgctgagggtcaaggttgtgagagtatggttgtgattttgctgtaaaatatgtatattatttattggtaagtgcgttgtgcgactgatctgttacaattgagaagataaaagaaaaaagtgtggttattggtggttttttcgttttctttttttttggctgggttctagagctgtgttttaataagaactcttagaatg

SEQ ID NO: 5871 - DNA, 4510 bp, Prunus mume
ctcgtccaaacaccgaaccctccacttttccccaactcttccctcctttctctctctctctctctgattctcggaggcgcaaaactcaaaaacacacaaaaacaaataaacgcctccgaccaaatcctttatccttttacttctccttccccaaaccctaagctcctccgatggccaccgatcctacccagcagcagcagcaactggccataattctgggccccgacccgacccactttgaaaccctaatctctcatcttatgtcctccagcaacgaccaacgatcccaggccgaagccctcttcaacctctgcaagcaggcccacccggatgccctccttctcaagctcctccacgtcttgcaatcctcgacccgacccgagtccaggaccatggccgtcatcctcctccgccgccagctcacccacgatgactccttcctctggccccgcctcacccccaacacccagtccaccctcaagtccctccttctctcctctctccaatccgagtcctccaaatccatgtccaagaagctctgcgataccatttccgagctcgcctcctcccttctccccgaaaaccagtggcccgagcttctccctttcatgttccagtgcgtcacctctgacaatcccaaactccaggaatcggctctcttgattttcgcccaattggcgcattacatcggcgaaaccctcgttcctcacttgactaccctccacgaggtcttcttccgatgcctgtccacctccgccaagagcgccgacgtcagaatcgctgcgctcggggcgtcagtgaatttcatccagtgcttgactagtgcggccgagagggacaggttccaggacttgttgccgctgatgatgcagacgttgaccgaggcgttgaattgcgggcaggaggcgactgcgcaggaggctctggagttgttgattgaattggcagggactgaaccgaggttcttgagaaggcagttggtggatgtggtggggtccatgcttcagattgccgaggccgagtccttggaggaagggacaaggcatctggccattgagtttgtgattaccttggccgaggccagggagagggcacctgggatgatgaggaagttgccgcagttcattcagaggttgtttgcgattctcatgaacatgttgttggacattgaggatgaacctgagtggcacgcggccgatacagagaatgaggatgccggggagacaagcaattacgggtttggacaggagtgtttggataggctctctatttccctgggtgggaataccattgtcccagttgcttcagaggttttcccagctttcttggctgctcctgagtggaaaaagcaccacgctgcacacattgcccttgctcagattgctgagggttgctccaaggtaatgataaagaaccttgaacaggtcgtgtcaatggtgttgaattcattccaagatccccatccgcgtgtgcgatgggcagcaattaatgcagttgggcaattgtcaacggatttaggcccagagttacaagtccagtatcaccagcgagtgctgcctgctttggctggagccatggatgacttccaaaatcctcgagtacaggcccatgctgcttcagcagtactcaatttcagtgaaaattgcaccccagatattttgacaccatacctggatggaattgtgagcaagcttcttgtacttctacagaatgggaagcagatggtgcaggagggtgctttaacagctttagcatcagttgccgattcgtcacaggagcaattccagaagtattatgatgctgtaatgccttacttgaaagctatcttgattaatgctaatgacaaatccaatcgcatgctacgtgccaaatccatggagtgtattagtttggttggaatggctgtcggaaaggataagttcagggatgacgctaagcagattatggaagtcttgatgtcattgcaaggatcacaaatggaggcagacgatcctacaacaagttacatgttacaagcatgggccagactttgcaaatgccttggacaggattttctcccttatatgaatgttgtcatgccctctttgcttcagtctgctcaactgaagcctgatgtgacaattacatctgcagattcagatgcagatattgatgaagatgatgatagcattgaaatgattactgttggtgataaacggataggaattaggactagtgtcctggaggaaaaagctacagcttgtaacatgctatgttgctatgctgatgaactgaaggaagggttctttccatggattgatcaggttgctccaacattggttcctcttctcaaattttatttccatgaagaagttaggaaggcagctgtttcagcgatgcctgagctgttgcgttcagccaaattagctgtagagaagggacttgcacaaggtcataatgagtcttatatcaagcagttgtctgattacataataccagcattggttgaagcactacacaaggagcctgaggtagaaatttgtgcaagcattttagatgcgttaaaggaatgtgtgcagatttctggagtacttcttgatgaaaaccaagttaggtgcatcgtggatgaaatcaaacaggtggttacagccagttcatcaagaaaacaagagcgagcagaaagggccaaggcagaggacttcgatgcagaagaaggagaactgcttaaggaagaaaatgaacaagaagaagaactttttgatctggtcggtgattgcttgggatcgttgattaagacattcaaggcatctttcatacctttctttgatgagctttcaacttacgtaacacttatgctgggtaaggataaaactgcggaagagaggcggattgccatttgtatatttgatgatatggcagagcattgccgtgaagcagctcttaaatactatgatacctacgttcctttcctattggaagcttgcaatgatgaaagttcagatgttcgtcaggctgcggtttatggggttggtctttgcgctgagtatggtggatctgtgtttaaaccgcttgttggagaagctctttctaggttggatatggtaatcaggcaccctaatgcacaacattctgacaatgtgatggcatatgacaatgctgtttcagcttttgggaaaatttgccagttccatcgtgacagtatagatgcaacacagcttgtcccagcctggttaagctgtttacctataaaaggtgatttgattgaggccaaggttgtccatgaccagctatgttcaatggttgaaaggtcagatagagagcttttagggcccaataatcaatatcttcccaaaatagttgcggtttttgctgaggttttatgcgctggtaaagatttggcaacagagcaaactgctagtcgtatggttagtctattaaggcagcttcaacaaactttaccgccctctaccctagaatcaacctggtcatccttgcagccccagcaacagcttgcattgcaatttatactctcatcataattctttagccttggcattgccttatgtttgtggaaactgctgcttctggtcattatatttccctttgcattggtgggatatgcaatttcatttatcaggaaagctcgtggggtgggcacatgattgtttggaagcggatgtctggtctgcgttttgatagtgcattcttttgattttgtgttccaaaattatttctcgtggtttggcgccaatgccttgttgcattttttagtcggcggaggatgaaaaaagttagggatagtgaaagttttgcaatacagtgtgcatattatagacgatccagtactcctaagcttcaaaagattgaagtcaacaaaaggattgtgtacaattgtggcttttagttttgtatgttaaaggtcaaggtgtgtgatgaagacatcttgtatcagttttggtgctttatatttttgaaatgtaaaacagtttaatataagtttgttttgcatttggtttcattgttcagcacatatccttgtcacccttgagcatctacttttgctatctgcactgcacttcaactacatttacgttgctggggcctatacatagcatcaatgattcttatgtgacttcgtacaatacatataatggttgggaatctccaagtcctttggaattagttagcagttatgtgagtcacaactaccggaggccaaaatgatttagtttggggttttcattccaaggaagtttggctcgttatatttagagtggtgaattgatgatggagacgtagtttgtttggccttcttcgtcattgtttgttatctacgtggcaggttttatcacaaaagttctcaatgtaaggattttattacaaaagaactcggtgtaagtgtaatttaagatgtcctacttctgactctattttaagcccgattagagttttctcgagcttaatttgatcttaatatttagagcagtgaaacaatggagttggtttggtcttgttttatcacaatagtagc

SEQ ID NO: 5872 - DNA, 3998 bp, Eutrema parvulum
aataaatatataattatctcttcagaaacctcatcccctcttcgttcctccttattccgcttactctctctctctctctagactcgaatcctaaggggagagagattagctagtgcgcttttttaaccctagttttttcccgccgccacctgccatggcttccgaggcgaatcagcttcagcaagcgcaactcgcgatggtccttggctccgattcggcgccgttcgagaccctcatctcccacctcatgtcctcttccaacgagcaacgctcctccgccgaggctctcttcaatctcgctaagcaaagcaatcccgataccctcgccttgaagcttgctcatcttctccagctctctccccatcccgagggccgcgccatggccgccgttctcctccgtaagctgctcacacgcgatgacgcctatctctggccgcgtctctctctccctactcaatcctccctcaaatcctcgatgctgtcttgtattcagcgtgaggaggccaagtcgatctctaagaagatttgcgacactgtctctgaacttgcatccgggatcctcccggagaacggatggcccgagttgctgccgttcgttttccagtgcgtctcgtccgattcatccaaattgcaggaatcggcgtttttaattttggcgcaattgtctcagtacgttggtgagactctgactcctcacatcaagcatctacacggcatctttctccagtgcttgagtagtaactctgctagctccgacgtcaaaatcgccgccctcaacgccgtcattagtttcgttcagtgtctctcgaactcgacggagcgggatagattccaagatgttctgcctgcgatgatcaggacgttgaccgaatcactcaacaacgggaacgaagcaactgcacaggaggcactggagcttttgattgaattggctggtactgagccacggttcctcagacggcagcttcttgacatagttagttcgatgcttcagatcgcagaggctgattccctcgaggagagtacgcgccacctcgcgattgagtttttggtaactctagctgaggcgcgtgagcgtgcccctggaatggtcaggaaactccctcagttcattgacaggttgttcgcggttcttatgaagatgctcgaggacatcgaggacgaccctgcctggtacagcgctgagaccgaggacgaggacgctggcgagacgagcaactacagcatgggtcaagagtgtttggatcggttagcaatttctttgggagggaacaccattgttccggttgcgtatcagcagttttctgcttatttggttgcctctgagtggcagaaacaccacgcatctttgattgcgcttgctcagattgctgaaggttgctcaaaggtgatgataaaaaatctagagcaagtggtgtccatggttttgagccaatttcagagtcctcatcctcgcgtaaggtgggcagccatcaatgcgattggacagttgtctacagatttgggtccagatttgcaaaaccaacatcatcagagagtgctccctgcacttgctgctgctatggatgatttccagaatccacgagtgcaggctcatgctgcttcagcagtactcaacttcagtgaaaattgtacacctgaaatattggcaccttatttagacggagtagtgagcaaattgcttgtgctactacaaaatggaaaacaaatggtgcaagaaggagctttaacagctcttgcttcagttgctgattcatcgcaggaacacttccaaaagtactatgatgttgtcatgccgtatctcaaaactattttgatgaacgcaactgacaaatctaagcggatgcttcgagccaaatccatggaatgcatcagccttgttggaatggcagttgggaaggacaaatttagggatgacgctagacaggtcatggaagttcttatgtcattgcaagggtctgaaatggaggcagatgatcctataacgagttatatgttacaggcatgggctaggctctgcaagtgtctaggccaagatttcctcccatacatgaatgttgtgatgcctcctttgcttcagtcagctcaacttaaaccagatgtaacaattacatctgctgattcagacgatgaagcagaggattctgatgatgaaagcatggagaccattatcctgggagacaaaagaataggaatcaaaacaagtgtcctagaggaaaaagccacagcttgtaacatgctttgttgctatgccgatgagttaaaagaaggattttttccctggattgatcaggttgcacctacacttgttcctttgctaaaattctattttcacgaagaagttagaagagcagctgtgtcagccatgccggaactaatgcgctcagccaaactggcaatagagaaaggaacatctcaaggacgcgatctatcctatttgaagcagctttctgactacattattccagccatgctggaagctttgcataaagaacctgatacggagatctgtgtgagtatgttggaagctatcaatgaatgcttgcagatctccggaaatcttttggacgaagggaaaattagatccatagttgatgaggtaaagcaagttatgacagcaagcgctagtaggaagcgagagaggggagagagggccaatgctgaagactttgacgctgaagagggagagcttattaaagaggaaaatgagcaagaagaagaaatttttgatcaggttggtgaaatattgggaacactggtaaagacattcaaggccgcgtttctgccattcttcgatgaattatcctcttacttaacacctatgtggggaagggataaaacagctgaggagagaaggattgcgatatgcatctttgatgatgttgcagaacaatgccgtgatgctgcctttaaatattatgatacttatcttccatttgtactggaagcttgcaatgacgagagcccagaagttcgacaggctgccgtttatgggcttggtgtttgtgctgaatttggcggatctgtattcaagcctcttgttggagaggctctatcaagattaaatgttgtgatacagcagccaaatgctcgacaatccgaaaatgccatggcatatgataatgctgtatctgctgtgggaaaaatctgccaatttcaccgtgacagtatcgattcttctcaggtacttcctgcgtggttgaactgtttgcctataagtaatgatgtcattgaagccaaagtggttcatgatcagctctgttcaatggttgagaggcaagatgtggagcttttaggccccaataacctatatcttccaaaaatcgtaacagtatttgctgaggtgcttacagggaaagatgtggtgacagaagagacggcaggtcgtatgattaatatactaaggcaacttcagcaaacgctgccaccatcgtcattggcctcaatatggtcgacactgaaacccgagcagcagcaggctctccaatccatgctttcctcctaaactcactccaatcgggtctctttgtcattttacagtcttgtgagcttcattgtcaccacaaagcgtcgtcagttttgcatttatgtgttttacattttttttttgcgtttgcatttttcaccatttgtttttttgggagggatgatgaatgggtctatccttcataagttatcaaatgaaatttcttctatctttgatggtaggaagtgtatattaggagggaaggagggattgtgaaactgttagtgaattgggaatttgggtaatgattccccaaaacacacaggtctcgtgttggtgttggtgttgggatgaagtttttggtgcgtatacgagaaacaaaacagaaagaaagggttgatttttgagtttttgtctttgtatgcaagtgagaattttggagaattattcttttctctcattgccattgtttatttgtactcttctgcttggctcttttttctgcttatattaaaatttatcttttttcatt

SEQ ID NO: 5873 - DNA, 3833 bp, Eutrema parvulum
aataaatatataattatctcttcagaaacctcatcccctcttcgttcctccttattccgcttactctctctctctctctagactcgaatcctaaggggagagagattagctagtgcgcttttttaaccctagttttttcccgccgccacctgccatggcttccgaggcgaatcagcttcagcaagcgcaactcgcgatggtccttggctccgattcggcgccgttcgagaccctcatctcccacctcatgtcctcttccaacgagcaacgctcctccgccgaggctctcttcaatctcgctaagcaaagcaatcccgataccctcgccttgaagcttgctcatcttctccagctctctccccatcccgagggccgcgccatggccgccgttctcctccgtaagctgctcacacgcgatgacgcctatctctggccgcgtctctctctccctactcaatcctccctcaaatcctcgatgctgtcttgtattcagcgtgaggaggccaagtcgatctctaagaagatttgcgacactgtctctgaacttgcatccgggatcctcccggagaacggatggcccgagttgctgccgttcgttttccagtgcgtctcgtccgattcatccaaattgcaggaatcggcgtttttaattttggcgcaattgtctcagtacgttggtgagactctgactcctcacatcaagcatctacacggcatctttctccagtgcttgagtagtaactctgctagctccgacgtcaaaatcgccgccctcaacgccgtcattagtttcgttcagtgtctctcgaactcgacggagcgggatagattccaagatgttctgcctgcgatgatcaggacgttgaccgaatcactcaacaacgggaacgaagcaactgcacaggaggcactggagcttttgattgaattggctggtactgagccacggttcctcagacggcagcttcttgacatagttagttcgatgcttcagatcgcagaggctgattccctcgaggagagtacgcgccacctcgcgattgagtttttggtaactctagctgaggcgcgtgagcgtgcccctggaatggtcaggaaactccctcagttcattgacaggttgttcgcggttcttatgaagatgctcgaggacatcgaggacgaccctgcctggtacagcgctgagaccgaggacgaggacgctggcgagacgagcaactacagcatgggtcaagagtgtttggatcggttagcaatttctttgggagggaacaccattgttccggttgcgtatcagcagttttctgcttatttggttgcctctgagtggcagaaacaccacgcatctttgattgcgcttgctcagattgctgaaggttgctcaaaggtgatgataaaaaatctagagcaagtggtgtccatggttttgagccaatttcagagtcctcatcctcgcgtaaggtgggcagccatcaatgcgattggacagttgtctacagatttgggtccagatttgcaaaaccaacatcatcagagagtgctccctgcacttgctgctgctatggatgatttccagaatccacgagtgcaggctcatgctgcttcagcagtactcaacttcagtgaaaattgtacacctgaaatattggcaccttatttagacggagtagtgagcaaattgcttgtgctactacaaaatggaaaacaaatggtgcaagaaggagctttaacagctcttgcttcagttgctgattcatcgcaggaacacttccaaaagtactatgatgttgtcatgccgtatctcaaaactattttgatgaacgcaactgacaaatctaagcggatgcttcgagccaaatccatggaatgcatcagccttgttggaatggcagttgggaaggacaaatttagggatgacgctagacaggtcatggaagttcttatgtcattgcaagggtctgaaatggaggcagatgatcctataacgagttatatgttacaggcatgggctaggctctgcaagtgtctaggccaagatttcctcccatacatgaatgttgtgatgcctcctttgcttcagtcagctcaacttaaaccagatgtaacaattacatctgctgattcagacgatgaagcagaggattctgatgatgaaagcatggagaccattatcctgggagacaaaagaataggaatcaaaacaagtgtcctagaggaaaaagccacagcttgtaacatgctttgttgctatgccgatgagttaaaagaaggattttttccctggattgatcaggttgcacctacacttgttcctttgctaaaattctattttcacgaagaagttagaagagcagctgtgtcagccatgccggaactaatgcgctcagccaaactggcaatagagaaaggaacatctcaaggacgcgatctatcctatttgaagcagctttctgactacattattccagccatgctggaagctttgcataaagaacctgatacggagatctgtgtgagtatgttggaagctatcaatgaatgcttgcagatctccggaaatcttttggacgaagggaaaattagatccatagttgatgaggtaaagcaagttatgacagcaagcgctagtaggaagcgagagaggggagagagggccaatgctgaagactttgacgctgaagagggagagcttattaaagaggaaaatgagcaagaagaagaaatttttgatcaggttggtgaaatattgggaacactggtaaagacattcaaggccgcgtttctgccattcttcgatgaattatcctcttacttaacacctatgtggggaagggataaaacagctgaggagagaaggattgcgatatgcatctttgatgatgttgcagaacaatgccgtgatgctgcctttaaatattatgatacttatcttccatttgtactggaagcttgcaatgacgagagcccagaagttcgacaggctgccgtttatgggcttggtgtttgtgctgaatttggcggatctgtattcaagcctcttgttggagaggctctatcaagattaaatgttgtgatacagcagccaaatgctcgacaatccgaaaatgccatggcatatgataatgctgtatctgctgtgggaaaaatctgccaatttcaccgtgacagtatcgattcttctcaggtacttcctgcgtggttgaactgtttgcctataagtaatgatgtcattgaagccaaagtggttcatgatcagctctgttcaatggttgagaggcaagatgtggagcttttaggccccaataacctatatcttccaaaaatcgtaacagtatttgctgaggtgcttacagggaaagatgtggtgacagaagagacggcaggtcgtatgattaatatactaaggcaacttcagcaaacgctgccaccatcgtcattggcctcaatatggtcgacactgaaacccgagcagcagcaggctctccaatccatgctttcctcctaaactcactccaatcgggtctctttgtcattttacagtcttgtgagcttcattgtcaccacaaagcgtcgtcagttttgcatttatgtgttttacattttttttttgcgtttgcatttttcaccatttgtttttttgggagggatgatgaatgggtctatccttcataagttatcaaatgaaatttcttctatctttgatggtaggaagtgtatattaggagggaaggagggattgtgaaactgttagtgaattgggaatttgggtaatgattccccaaaacacaggttgatttttgagtttttgtctttgtatgcaagtgagaattttg

SEQ ID NO: 5874 - DNA, 3627 bp, Papaver somniferum
ttatggcagcagggaatgaacaaaggtcacaagctgaaaatttattcaatatctgcaaacaagatcatccagatgctttaacactcaaacttgctcatgttcttcagaattctccgcatctcgaagccagagctatggctgcaattcttctccgaaaacaacttactcgggatgattcttacttatggcctcgtctttcacaatcaacacaatcagctcttaaatctcaacttctaatgtgtgttcaaaatgaagaagcaaaacaaatctcgaagaagttatgtgatacggtttctgagcttgctgctggtattttacctgaaaatcaatggccagaattacttccttttatgtttcaatgcgttacttctgatattccacgtcttcaggaatcttctctattgatgtttgctcagttgtcacagcacattggagataccctaattccacacattgatactcttcatagagtgtttttacagtgtttggcttcttcttctaatccagatgttcgaattgctgctcttggagcttctattaattttgtgcagtgtttgacgagtctctctgatagggataagtttcaagatcttttgccagtgatgatgaagacgttgaccgaggcgttgaattctggtcaagaggcgactgctcaagaggcgcttgagttgttaattgagttggctggaacagagccaaagttcctaaggcggcaactagtggatgttgtgggatctatgttgcagattgctgaggcagaatcattggaggaaggcactaggcaccttgcaatcgagtttgtgattactcttgctgaggcgagggaaagggctcctggtatgatgaggaaattgccgcagtttattagtagattgtttgcgattctgatgaagatgttgcttgatatcgaggatgatcctgtgtggcataaagctgatactgaagaagaggaggatgctggtgagactagcaattacagcgtaggacaagagtgtctagacagactttccattgctttgggtgggaatacaattgttcctgttgcttccgagcttttgccagtatttttagctgcaccagagtggcaaaaacaccatgctgcccttattgcccttgctcaaattgcagaaggctgctcaaaggtaatgacgaaaaatttggagcaagtggtcaacatggttttgaactcatttcatgatcctcatcctcgtgctagatgggcagctattaatgcgattgggcagttatctacggatttgggtcctgatttgcaattacagtaccatcaaagggtgctaccagcacttgcatcagccatggatgatttccagaatcctcgagttcaggcgcatgctgcttcagcggtcctgaacttcagcgagaattgcaccccagatattttaacaccttatttagatggaatagtgagcaaactgcttgtcctcttacagaatggaaagcaaatggtgcaggagggagctttgacagctctagcatcagtagctgattcatcacaggagcaatttcaaaaatattatgatgctgtcatgccttatctcaaagctatcttgttgaatgccactgacaagtctaaccgtatgctccgtgccaaatctatggagtgcattagtttggttggaatggctgttgggaaggacaagttcagagatgatgctaagcaggttatggaagttctcatgacactgcaaggagcagagttggacacagatgatcccacaattagttacatgctgcaagcgtgggcgagactctgcaagtgcttaggacaagattttctcccttacatgagtgttgtcatgcccccattgcttcactctgctcaacttaaacctgatgtaaccattacctctgcagactcggatgatgatatagatcaatcagacgatgaaagtatcgaaacaattacccttggagataagaggattggaattaagactagtgtgttggaagaaaaagctaccgcgtgcaacatgttatgctgctatgcagatgagttgaaagaggggttctacccatggattgatcaggttgctcctattttagttccacttttgaaattttattttcatgaagaggttaggaaggctgcagtttcagctatgcctgagcttctacgttcagccaaattagctgtggagaaggggcaagctcaaggtcgtaatgagacctatgttaagcaattgtctgattatattgtaccagccttggtggaagctcttcacaaggagcccgaaacagaaatttgtgcaagtatgttggatgcgttaaatgaatgtgtacaggtttctggaacactccttgatgagagtcaagtaagatccattgtggatggaataaaggaggtaattaccgctagctcaacaagaagacgagaaagggcagagaggacccaagcagaggatttcgatgcagaggaaggggaactgctcaaagaagaaaatgagcaagaagaagaagtgtttgatcaagttggtgatttgttgggaactttgatcaaaacatttaaagtctcttttctgcccttctttgatgaactttcatcatatctaacacctatgtggggtaaggataaaacagctgaagagagaagggttgctatctgcatttttgatgatgttgctgagcagtgtcatgaagctgctctcaaatattatgatacttatcttccgttcctattggaggcttgcaacgatgagaattcagatgttcgccaggctgctgtatatggagttggtgtttgcgcagagtttggtggagcaccgttcaaacctctagtaggagaggccctttccaggctaaatgttgtgattaggcatccaaatgcactatctacagacaatgttatggcgtatgacaatgctgtttcagctgttgggaaaatatgccggtaccatcgtgacagcattgattcatctcaggttgtccctgcctggttaagttgcttgccaatcaagggtgatttaattgaggccaaacttgttcatgaccagctttgttcaatggtcgaggggtcggatagagaccttctgggccctaataaccagtatcttcctaaaattgtttcggtctttgtggaggttctatgtgggggtaaggatttggcaacagatcaaacttccagccgtatgatagttttactgaggcaacttcaacaaacgttaccacctgacacactggcacaagcctggtcatccttgcagccgcaacaacagcttgcattgcaatcgatgctctcatcgtagttccttgctagggttggtcgcagaaaaatactgattggttcatttgtgtctattacccatttttttttgcctattgtatcctatttccatcggttttctatttttctggcaattgctgtcctgtttggttgaggttcctttgtgcgggtgaaacgatacaagttttcgtgtattgtgtatatttctgagagatttcttgattttggtgtggctacgtgccaacttaagtatgtgcactaaaacagtcaagcacctgatggtggtggtatttttgcttcttcaacagcgctttcactattgtatttcagttttcacatatcctattatcaccatatatacagacattaaaagtgaaatgagttat

SEQ ID NO: 5875 - DNA, 3653 bp, Silene vulgaris
cagcgattctcggtcccgatcctactcacttcgagactttaatctctcatctcatgtccaccaacaacgaccagcgttccaccgccgagtcactctacaacctctgcaaacaacaccagcctgactcgctctctctccaactcgctcgtatgactcagtcctctcctcatcctgaggcacgcgctatgtccgctattctcctccgaaaactcctaactcgtgatgactcgttcatctatcctaaactcgctcccgcaactcagtcctcgcttaaatctatcttgttagcgtgtattcaatcggaggataccaaaacgatttcgcggaagttgtgcgacaccgtttcggaactcgctgcgacgattgtgccggaacatcaatggccggaattgttaccgttcatgtttcagtgcgttacttcggataatccaaagcttcgagagatggcgctgttgattttcgcgcaattgtcgcagtacatcggcgaaaccctaattccgcacctcacaactctgcataacgtgtttttgcagtgtttatctggaaatactaccgccgatgttcgaattgcggcgctaagcgccacgattaactttattcagtgtttaaccacgtcttccgaccgcgataggttccaggatttgctccctccgatgatgcagactctaaccgaagcgctgaattccggccaggaggcgactgcgcaagaggcgttggagttgttgatcgatttggcggggacagagccgagattcttgcgtagacagctggtggatgtggttggtgcaatgctgcagattgctgaggccgaggcgttggaggaagggacgcggcatttggcgattgaattcgtgattacgctggcggaggcgagggagcgggctccagggatgatgaggaagttgccgcagtttattcagagattgtttgggatattgatgaaattgttgcttgatgttgaggatgatcctgtatggcatagtgcagttactgaggatgaggatgccggtgagacgagtaattatagtgttgctcaggagtgtttggataggctagcgatttcgttgggtggtaacaccattgtgcctgttgcgtccgagcttttaccggttttcttggctgctcctgagtggcagaagcaccatgctgcgctcatttgtttggctcaaattgctgagggttgcgcgaaggtgatgataaagaacttggagcaagtggtatctatggtcttgaattcattccaagatcctcatcctcgtgtacggtgggctgctatcaacgcgattggccaattgtccacggatttgggtccagatttgcagacacagtaccaccatcttgtcgtacctgcactagcctcagctatggatgattttcaaaatcctcgcgtgcaggcacatgctgcttcagcagtgttgaacttcagtgaaaattgtactccagagttattgacgccttacctagatggtatagtgagcaaattgcttgtcctcctgcagaatgggaagccaatggtacaagaaggtgctttaactgctttagcatcagttgccgattcatcacaggagctttttcagaagtattatgatgttgttatgccgtacttaaaagctatactagtgaatgctaccgacaaggcgaatcgcatgcttcgtgcaaagtccatggaatgtattagcctggttggaatggctgttggaaaagaaaagtttagggaggatgctaagcaggtcatggaagtacttatgcagttgcaaggatcacagatggaggcagatgatccaaccactagttacatgctccaggcatgggcaagactctgcaaatgcttagggcaggattttttgccatacatgaatgttgttatgccacccttgcttcactctgctcaactcaagcctgatgtgacaattacaagtgcagattcagatgttgatattgacgaatctgatgatgagtccattgaaactatcactgttggggacaaaaggattggaatcaaaacaagcgttctagaggagaaagctacagcttgtaacatgttatgttgctatgctgatgagctgaaagaaggtttctttccatggatagaccaggtcgctggtatattggttccactactaaaattttatttccatgaagaagtcagaaaggcggcagtttcagccatgccggagcttctgcgttctgcaaaattagctattgagaaggggctaggacaaggtcgcaatgaggcataccttaagcagttgtctgactatattatacctcctttggtggaggctttacacaaggaacctgaagtagaaatttgttcaagcatgctggatgctttgaaggagtgtatacaggttgttggaccactcttggatgaaaatcaagtgagaagtatagtgaacgagataaagcacactatcacagcaagctcatcgagaaaggccgatagagcagagagggccaaagcagaggattttgatgcagaagaaggtgaattacttagtgaagaaaatgagcaagaagaagagcttttcgaccaggttggtgattgtttgggcacattgatcaaaacattcaaggcatcattcttgcccttctttgatgagctatcttcgtacctgacacccatgtggggtaaggataaaacagcagaagaaagaaggattgctatttgtatatttgatgatgttgtggagcattgtcgtgaatcagccctcagatactatgatacattccttccttttcttttggaagcctgcaacgatgaaaatcctgatgttcgacaggcagctgtttatggtctcggcgtttgtgcggagcttggtggatctgtattcaagcctcttgttggagagagcctttcaagattaaatgttgtattaagtcacccaaatgcttcacattctgacaacgtgatggcatatgacaatgctgtttctgctctgggcaaagtttgccaattccatcgtgatagcattgatgctgctcagattgttcccatgtggctcaattacttgccgattaaaggagatttaattgaagcgaaggttgtgcatgaacaactttgttccatggtcgagaggtcagatggggatctgttagggccaaataaccactatctgcctaaaatagtggcagtctttgctgaggtcctatgtgctggcaaagatctggcaacagagcaaacagtgagccggatgattaatttattaaggcagcttcaacaaactctaccaccagccacccttgcctcaacttggtcatctcttcaaccgcagcagcaacttgccctccagtccatcctctctcagtaacatgatttgcgtttcctctcccaattcaacggggaagtctgcttgtggtgtgagatggtttgccgtcttctatttataatgattcgtttcttgtcattcatttcatccatgtgatcactttttcggtgctatgcatgtgtattaagggtcgatgtggtttttttggccgagtaatgtgagattttggtgtaagatgtgtatatcttgagcgacattcatgaaccatgattcggctattgctgtcatgccgatttatcaaattatatactaaaaagttgggatgtaatgtcaaagtttgggttaaagtgttccctattgatagcacttgagtaaaggattttt

SEQ ID NO: 5876 - DNA, 3513 bp, Eutrema halophilum
ataaatatataattatctcttcagaaacctcatccctcttcgctctcctcctcaatccgcttactctctctctctctagactcgcatcctaaggggagagagatagctagtgcgcttttttaaccctagtttttcccgccgccacctgccatggcttccgaggcgaatcagcttcagcaagcgcaactcgcgatggtcctcggctccgattcggcgcctttcgagacgctcatctcccacctcatgtcctcttccaacgagcaacgttcctccgccgaggctctcttcaatctcgccaagcaaagcaatcccgataccctcgccttgaagcttgctcatctcctccagctttctcctcaccctgaaggtcgtgccatggcggccgttctcctccgcaagctgctcacacgcgatgacgcctatctctggccgcgtctctccctctccactcaatcctctctcaaatcctcgatgatgtcctgtattcagcatgaggaggtcaaatcgatctctaagaagatttgcgacactgtctccgaacttgcatccgggatccttccggagaacggatggccggagttgctcccgttcgttttccagtgcgtatcttctgattcccctaaacttcaggaatcggcgtttttagtcctggcgcaattgtctcagtacgttggggagactctgacccctcacatcaagcttctccatggcgtgtttctccagtgcttgagtagtaactctgctagctccgacgtcaaaatcgccgctctaaacgccgtgattagtttcgttcagtgtctgacgaactcgacggagcgggatagattccaagatgtcctccctgcgatgatcaggacgttgaccgaatccctcaacaacgggaacgaagcaactgcgcaggaggcactcgagcttttaatcgaattggctggtaccgagccacggttcctcagacggcagcttcttgacatagttggttcgatgcttcagatcgcagaggctgattccctcgaggagagtacgcgtcatctcgcgattgagtttttggtaactcttgctgaggcccgtgagcgtgcccctgggatggtcaggaaactccctcagttcatcgacaggttgtttgcggttcttatgaagatgctcgaggatatcgaggacgatcctgcttggtacagcgctgagaccgaggacgaggacgctggcgagacgagcaactacagcatgggtcaagagtgtttggatcggttagcaatttctttgggagggaacaccattgttccagttgcataccgccagttttctgcttacttggctgcctctgagtggcagaaacaccatgcttccttgattgctcttgctcagattgctgaaggttgctcaaaggtgatgataaaaaatctggagcaagtggtgtccatggttttaagccagtttcaaagtcctcatgctcgcgtaaggtgggcagctataaatgcaattggacagttgtctacagatttgggtccagatttgcaaaaccaacatcatcagagagtgctccccgcacttgctactgctatggatgatttccagaatccacgagtgcaggctcatgctgcttcagcagtactcaacttcagtgaaaattgtacacctgaaatattggcaccttatttagacggagtagtgagcaagttgcttgtgttactgcaaaatggtaaacaaatggtgcaagaaggagctttaacagctcttgcttccgttgctgattcatcgcaggaacacttccaaaaatactatgatgctgtcatgccttatctcaaaactattttgatgaacgcaactgacaaatctaagaggatgcttcgtgccaaatccatggagtgcatcagtcttgttggaatggcagttgggaaggacagatttagggatgatgcgaggcaggtcatggaagtgcttatgtcattgcaagggtctgagatggaggcagatgatccaataacgagttacatgttacaggcatgggctaggctttgcaagtgtctaggtcaggatttcctcccatacatgagtgttgtgatgcctcctttgcttcagtcagctcaactaaaaccagatgtaacaattacatctgctgattcagatgatgaagcagaggattctgatgatgaaagtatggagaccattatccttggagacaaaagaataggaattaaaacaagtgtcctagaggaaaaagccacagcctgcaacatgctgtgttgctatgctgatgagttaaaagaaggattttttccctggattgatcaggttgcacctacacttgttcctttgctaaaattctattttcacgaagaagttagaagagcagctgtgtcagccatgccggagctaatgcgctcagccaagctggcaatagagaaaggcatatctcaagggcgcgatctatcctatctgaagcagctatcggactacattattccggccatgctagaagctttgcataaagaacctgatacagagatctgtgtgagtatgttggaggctatcaatgagtgcttgcagatctccggaaatctcttggatgaagggaaaattagatccattgttgacgaggtaaagcaagttatgaccgcaagctctagtaggaagcgagagaggggagagagggccaatgctgaagattttgacgctgaagagggagagcttattaaggaggaaaatgagcaagaggaagagatttttgatcaggtcggtgaaatattgggaacactggttaagacattcaaggcctcatttctgcctttcttcgatgaattatcctcttacttaactcctatgtggggaagggataaaacagctgaggagagaaggattgctatatgcatctttgatgatgttgcagaacaatgccgtgatgctgcctttaaatattatgatacttaccttccatttgtactggaagcttgtaatgacgagagcccagaagttcgacaggctgccgtttatgggcttggtgtttgtgctgagtttggcggatctgtattcaagcctcttgttggagaggctctgtcaagattaaatgttgtgatacagcagccaaatgctcggcaatctgaaaatgccatggcatatgataatgctgtatctgctgtgggaaagatctgccaatttcatcgtgacagtatcgattcttctcaggtacttcctgcttggttgaattgtttgcctataagtaatgatgtcattgaagccaaagtggttcatgatcagctgtgctcaatggttgagaggcaagatgaggaccttttagggcccaataaccaatatcttccgaaaatcttaatggtttttgctgaggtgcttacagggaaagatgtagtgacagaagaaacagcaggtcgtatgattaatatactaaggcatcttcagcagacactgccatcggcgttggcctcaacatggtcagcgctgaaacccgagcagcagcttgctctccaatccatgctttcctcctgaaatcaacttcaatcc

SEQ ID NO: 5877 - DNA, 4014 bp, Eutrema halophilum
aaatatataattatctcttcagaaacctcatccctcttcgctctcctcctcaatccgcttactctctctctctctagactcgcatcctaaggggagagagatagctagtgcgcttttttaaccctagtttttcccgccgccacctgccatggcttccgaggcgaatcagcttcagcaagcgcaactcgcgatggtcctcggctccgattcggcgcctttcgagacgctcatctcccacctcatgtcctcttccaacgagcaacgttcctccgccgaggctctcttcaatctcgccaagcaaagcaatcccgataccctcgccttgaagcttgctcatctcctccagctttctcctcaccctgaaggtcgtgccatggcggccgttctcctccgcaagctgctcacacgcgatgacgcctatctctggccgcgtctctccctctccactcaatcctctctcaaatcctcgatgatgtcctgtattcagcatgaggaggtcaaatcgatctctaagaagatttgcgacactgtctccgaacttgcatccgggatccttccggagaacggatggccggagttgctcccgttcgttttccagtgcgtatcttctgattcccctaaacttcaggaatcggcgtttttagtcctggcgcaattgtctcagtacgttggggagactctgacccctcacatcaagcttctccatggcgtgtttctccagtgcttgagtagtaactctgctagctccgacgtcaaaatcgccgctctaaacgccgtgattagtttcgttcagtgtctgacgaactcgacggagcgggatagattccaagatgtcctccctgcgatgatcaggacgttgaccgaatccctcaacaacgggaacgaagcaactgcgcaggaggcactcgagcttttaatcgaattggctggtaccgagccacggttcctcagacggcagcttcttgacatagttggttcgatgcttcagatcgcagaggctgattccctcgaggagagtacgcgtcatctcgcgattgagtttttggtaactcttgctgaggcccgtgagcgtgcccctgggatggtcaggaaactccctcagttcatcgacaggttgtttgcggttcttatgaagatgctcgaggatatcgaggacgatcctgcttggtacagcgctgagaccgaggacgaggacgctggcgagacgagcaactacagcatgggtcaagagtgtttggatcggttagcaatttctttgggagggaacaccattgttccagttgcataccgccagttttctgcttacttggctgcctctgagtggcagaaacaccatgcttccttgattgctcttgctcagattgctgaaggttgctcaaaggtgatgataaaaaatctggagcaagtggtgtccatggttttaagccagtttcaaagtcctcatgctcgcgtaaggtgggcagctataaatgcaattggacagttgtctacagatttgggtccagatttgcaaaaccaacatcatcagagagtgctccccgcacttgctactgctatggatgatttccagaatccacgagtgcaggctcatgctgcttcagcagtactcaacttcagtgaaaattgtacacctgaaatattggcaccttatttagacggagtagtgagcaagttgcttgtgttactgcaaaatggtaaacaaatggtgcaagaaggagctttaacagctcttgcttccgttgctgattcatcgcaggaacacttccaaaaatactatgatgctgtcatgccttatctcaaaactattttgatgaacgcaactgacaaatctaagaggatgcttcgtgccaaatccatggagtgcatcagtcttgttggaatggcagttgggaaggacagatttagggatgatgcgaggcaggtcatggaagtgcttatgtcattgcaagggtctgagatggaggcagatgatccaataacgagttacatgttacaggcatgggctaggctttgcaagtgtctaggtcaggatttcctcccatacatgagtgttgtgatgcctcctttgcttcagtcagctcaactaaaaccagatgtaacaattacatctgctgattcagatgatgaagcagaggattctgatgatgaaagtatggagaccattatccttggagacaaaagaataggaattaaaacaagtgtcctagaggaaaaagccacagcctgcaacatgctgtgttgctatgctgatgagttaaaagaaggattttttccctggattgatcaggttgcacctacacttgttcctttgctaaaattctattttcacgaagaagttagaagagcagctgtgtcagccatgccggagctaatgcgctcagccaagctggcaatagagaaaggcatatctcaagggcgcgatctatcctatctgaagcagctatcggactacattattccggccatgctagaagctttgcataaagaacctgatacagagatctgtgtgagtatgttggaggctatcaatgagtgcttgcagatctccggaaatctcttggatgaagggaaaattagatccattgttgacgaggtaaagcaagttatgaccgcaagctctagtaggaagcgagagaggggagagagggccaatgctgaagattttgacgctgaagagggagagcttattaaggaggaaaatgagcaagaggaagagatttttgatcaggtcggtgaaatattgggaacactggttaagacattcaaggcctcatttctgcctttcttcgatgaattatcctcttacttaactcctatgtggggaagggataaaacagctgaggagagaaggattgctatatgcatctttgatgatgttgcagaacaatgccgtgatgctgcctttaaatattatgatacttaccttccatttgtactggaagcttgtaatgacgagagcccagaagttcgacaggctgccgtttatgggcttggtgtttgtgctgagtttggcggatctgtattcaagcctcttgttggagaggctctgtcaagattaaatgttgtgatacagcagccaaatgctcggcaatctgaaaatgccatggcatatgataatgctgtatctgctgtgggaaagatctgccaatttcatcgtgacagtatcgattcttctcaggtacttcctgcttggttgaattgtttgcctataagtaatgatgtcattgaagccaaagtggttcatgatcagctgtgctcaatggttgagaggcaagatgaggaccttttagggcccaataaccaatatcttccgaaaatcttaatggtttttgctgaggtgcttacagggaaagatgtagtgacagaagaaacagcaggtcgtatgattaatatactaaggcatcttcagcagacactgccatcggcgttggcctcaacatggtcagcgctgaaacccgagcagcagcttgctctccaatccatgctttcctcctgaaatcaacttcaatccgggtctcttttgttcatttttacagtcttgtaagctctatttccaccacaaaagcgtcgtcagttttgcatttttgtgtttacagtttttagcatttttcaccatttctttttgggagggatgatgatgggtctagtccttcagaagttatcaaaaaaaaatgaaaatttctatcttgatggtaggaagtgtatattagaaggggaaggaaggattgtgaaattacatattcgtggaaagagtgtcattgggaaactgggtatggtttcccaaaaatacaggtttcgtgttgatgttggtttgggtttgagagagggatgaagttttggtgcttatacgagaaacaaaacagagaatggatttgatttttgagtttctttttcttttcttttgtatgcaattgagaattttgaagaaattattcttttctctcattgccattgttgatttgtactcttttggaaactcttgcccgttcttaaataaagaaattatattttatt

SEQ ID NO: 5878 - DNA, 3908 bp, Arabidopsis lyrata
tagctttagccactttttaaccctagtttttcccgccgccaccttccaccatggcttccgaggcgaatcagcttcaacaagcgcaactcgcgatggttctcggctccgattcggcccccttcgagacgctaatctctcacctcatgtcttcttccaacgagcaacgttcctccgccgaggctcttttcaatctcgctaagcaaagcaatcccgatacccttgccttgaagctagctcatcttcttcagctttctcctcatcctgaaggtcgtgctatggccgccgtccttctccgcaagttgttgacacgcgacgatgcttatctatggcctcgtctctccctatccactcaatcttccctcaaatcttcgatgttgtcttgtattcagcgtgaggaggctaaatcgatctctaagaagatttgcgatacagtctctgaacttgcatcggggattttgccggagaacggatggccggagttgcttccgtttgttttccagtgtgtttcatctgattcccctaaattgcaggaatcggcgtttttaatcttggcgcaattatcgcagtatgttggggaaactctgacccctcacatcaagcttctccatggcgtgtttctccagtgcctgagtagtaactctgctagctccgatgttaaaatcgccgctctgaacgccgtgattagtttcgttcagtgtctgtcgaactcaacggagagagatagattccaagatgttttgcctgccatgatcaggacgttgaccgaatctctgaacaacgggaacgaagcaactgcacaggaggctcttgagcttttgattgaattggctggtaccgagccacggttccttagacggcagcttcttgacatagttggttccatgcttcaaatcgcagaggctgattccttggaggaaagtacccgtcatcttgcgattgagtttttggtaactctggccgaggcgcgtgagcgtgcccctggtatggtcaggaagctccctcagttcattgacagattgtttgcggttcttatgaagatgctcgaggatattgaggacgatcctgcttggtacagcgctgagactgaggacgaagatgccggcgagaccagtaactacagcatgggtcaagagtgtttggatcggttggcaatttctttgggaggaaacaccattgttccggttgcatatcagcagttttctgcttacttggctgcctctgagtggcagaaacaccatgcttctttgattgcacttgctcagattgctgaaggttgctcaaaggtgatgataaaaaatctagaccaagtggtgtccatggttttgagccagtttcaaagtcctcatccccgcgtaaggtgggctgctataaatgcgattggacagttgtctacagatttgggtccagatttgcaaaaccaacatcatgagagagtgctccctgcacttgctgccgctatggatgatttccagaatccacgagtgcaggctcatgctgcttcagcagtactcaacttcagtgaaaattgtacacctgaaatattggcaccttatttagacggagtagtgagcaagttgcttgtgctactacaaaatggtaaacaaatggtgcaagaaggagctttaactgctcttgcttcagttgctgattcatcacaggaccactttcaaaagtactatgatgctgtcatgccgtatctcaaaactattttgatgaatgcaactgacaagtctaagcggatgcttcgtgccaaatccatggagtgcatcagtcttgttggaatggcagttggaaaggacagatttaaggatgatgctaggcaggtcatggaagtgctaatgtcattgcaagggtctcagatggaggcagacgatccaataacgagttacatgttacaggcatgggctaggctttgcaagtgtctaggtcaagatttcctcccatacatgagtgttgtgatgcctcctttgcttcagtcagctcaacttaagccagatgtaacaattacatctgctgattcagaagatgaagcagaagattctgatgatgaaagcatggagaccattatcctgggagacaaaagaatagggatcaaaacaagtgttctagaggaaaaggccacggcttgtaacatgctttgttgctatgctgatgagttaaaagaaggattttttccttggattgatcaggttgcacctacattggttcctctactgaaattctattttcacgaagaagttagaagagcagctgtttcagccatgccggaactaatgcgctcagccaagctggcaatagagaaaggggaatctcaagggcgcgatctatcctatttgaagcagctttctgactacattattccagccatgctggaagctttgcataaagaacctgatacagagatctgtgtgagtatgttggaagccatcaatgagtgcttgcagatctctggaaatcttttggatgaagggaaaattagatccatagttgatgagataaagcaagttatgaccgcaagctctagtaggaagctagagaggggagagagggcccatgctgaagacttcgacgctgaagagagagagcttattaaagaggaaaatgagcaagaggaagaaatttttgatcaagtcggtgaaatattgggaacactggttaagacattcaaggcatcatttctgcctttcttcgatgaattgtcctcttacttaactcctatgtggggaagggataaaacagcggaagagagaaggattgctatatgcatttttgatgatgtagcagaacaatgccgtgatgctgcctttaaatattatgatacctatcttccatttgtactggaagcttgcaatgacgagagtcctgaagttcgacaggctgccgtttatgggcttggtgtttgtgctgagtttggcggatctgtattcaagcctcttgttggagaggctctgtcaagattaaatgttgtgatacagcagccaaatgctcggcaatctgaaaatgccatggcatatgataatgctgtatccgctgtgggaaagatctgccaatatcaccgtgatagtattgattcttctcaggtacttcctgcgtggttgaactgtttgcctataagcaatgatgtcattgaagccaaagtggttcatgaacagctctgctcaatggttgagaggcaagatgtggaccttttaggccccaataaccagtatcttccgaaaatcttaatagtttttgccgaggtgcttacagggaaagatgtggtgacagaagagacagcaggtcgtatgataaatatattaaggcaacttcaacagacactgccaccatcggcgttggcctcaacatggtcaacgctgaaacccgaacagcaactcgctctccaatccatgctttcctcctaaaatcactccaatccgtctctctgtttattttacagtcttgtgagctctgttttcaccacagagcgtcgtcagttttgcatttatgtgtttacaaaaaaatttcttctttcacatttttcatcaaattcttttgggagggatgatgatgggtcggtctgtccttcacaagttacaaagtgaaagtttctatctttatggtaggaagtgtatattaggagggaaggatgaaattgtttgtgaaaaatgtgtcattgggaaattgggtatggttccccaaatacacaggtttggtgtcggtgttggtgttggtgtcggtttgggtttgagagagggatgaagttttggtgctttatacgagaaacagaaagatttgattttgaattttttgtttttgtatgcaattgagaattttggatgaatgattcttttctctcattgccattgttgatttgtacactcttttggacactctttggccttttcttaataaaagaaatgtttttttat

SEQ ID NO: 5879 - DNA, 3399 bp, Cucumis sativus
aaacccatttctctctttcaatggatcctcagtccacccagcttcagcaagcacagcttgcagctattcttggtcctgaccttgccccttttgaaacccttctctctcatcttatgtcctcctctaacgagcaacgatcccaggctgaactcgtcttcaatttatgcaagcagaccgatcctgattctctatctcttaagcttgcacatctccttcagttctctcctcaacccgaggcccgtgccatggctgctgttctcctccgtaagcagctaactcgcgatgattcatatctctggcctcgcctcaatccttcctctcagtcttcccttaaatctatactcttgtcctgtattcaacgtgaggactccaaatctatatctaagaaactgtgtgatacggtttccgagctggcttctggaattttgccggataatggatggccggaattgttgcctttcatgtttcagtgtgtatcctcggattcacccaagttgcaagaatcggctttcttgatcttcgcccaactttcgcattatattggggatacgctggtgcctcacattaagcacttgcacggtgtgtttttgcagtgcttgacgtcaaccacatcgagcaccgatgtgaagattgcggctttgaatgcagttattagcttcatacagtgcttgtccaactctgctgatcgcgataggtttcaggatttgctgccgcccatgatgcggacactgatggaggctttgaataatgggcaggaggcaacagcgcaggaggcacttgaattgttgattgaattggctgggacagagccgaggtttttgaggcggcaattagtagatgtagtggggtcgatgttgcaaattgcagaagctgagtcgttggacgaaggaacgagacatttggcgattgaatttgtgatcactcttgcagaagccagagagcgggcacccggaatgatgagaaagatgccacagtttatatccaggttgttcgccatattgatgaaattgctcttggatattgaagatgacccggcatggcacgctgctgagaacgaagatgaagatgctggtgagaccagtaactacagtgttgggcaggagtgtttggatagacttgcaatttctctgggtggcaatacaattgtccctgttgcttctgagctgtttccagcttacttagctactccagagtggcagaatcgccatgccgcactgatagcaatggctcaaattgcggaaggctgttcaaaggttatgataaaaaatttagaacaagtagtggcaatggtcttgaactcatttcaagatccacaccctcgtgtaaggtgggcagctattaatgcaattgggcagttatctacagacttgggtccagatctacaagttcaataccatcagcaggtgctccctgcacttgctacagcaatggatgatttccagaatcctcgagtacaggctcatgctgcatctgcagttctcaacttcagtgagaactgtactcccgacatcttgacaccttatttagatgggatagtaggcaaattgcttttacttttacagaacgggaagcaaatggtgcaagagggggccttgactgctttggcttcagttgctgattcatctcaggagtatttccaaaaatattatgacgctgtcatgccatacctgaaagcaatcttagttaatgccactgataagaccaaacgcatgcttcgtgccaaatccatggagtgcatcagtttggtcgggatggcagttggaaaggagaagttcagggatgacgccaagcaggttatggaagtgctgatgtcattgcaaggatctcagatggaggcagatgatccaactacaagttacatgttacaagcatgggcacggctttgcaagtgtttgggacaagatttcctcccttatatgagtgtggtcatgcctcctttgcttcagtctgcccagcttaaacctgatgtaaccataacatctgctgattctgataatgatatcgaggactccgatgatgatagcatggaaacaattactcttggagacaaaagaataggaatcaagactagcgttctcgaagaaaaagctacagcctgtaacatgttgtgttgctatgcagatgagttgaaggaagggttttttccatggattgatcaggttgccccaaccttagtccctcttcttaagttttactttcatgaagaagtcaggaaagcagctgtttcagcgatgccggagcttatgcggtctgcaaagttagccgttgaaaaggggcttgctcaagggcgtaacgagacctatataaaacagctgtcagattatatagttccagccttggttgaagctttacataaggagcatgatacagagatttgttctagtatgctggaggcgttaaatgaatgcttacagatatctggatcacttcttgatgaaagccaagtcaggtccatagttgatgagataaaacaggtgatcactgccagttccagtagaaagagagagagagcagagagggccaaggcggaggactttgatgcagaggaaggagaattgattaaagaggaaaatgaacaagaggaagaagtttttgatcaagttggtgaaatattgggaactttgataaaaacattcaaagcatctttcttgcctttctttcaagaactgtctacatatctaacgcctatgtgggggaaagataagacgcctgaagaaagaaggattgcaatttgcatctttgatgatgttgcagagcagtgtcgtgaagcagcgctgaaatattatgatacatatcttccttttttactggaagcttgcaatgatgagaatcccgacgtcagacaggctgctgtgtatgggcttggtgtctgtgcagaatttggtggatccgtgtttaaaccacttgttggagaggctctgtcaagattaaatgttgtattgcgacatcctaatgctcgacaacctgaaaatgtgatggcatatgacaatgctgtttctgctttggggaagatttgtcaatttcatcgtgacagtattgattcggctcaggttgttccagcgtggttaaactgcttaccaataaaaggtgatttggttgaagcaaaaattgtgcacgaccagctttgttctttggtggagaggcaagtcggatgtggaacttttgggcccaaataatcaatatcttcccaaaatagctgcagtatttgccgaggttctatgtgcgggaaaggatttagcaacagagcaaactgcaggccgaatgataaatttgttgagacaaatgcaaccgaatttaccgccttctactttaccctctacttggtcctccttgcagccctagcaacaacttgctttgcagtctattatttcataatttcatgaaggtgactctgaattt

SEQ ID NO: 5880 - DNA, 3938 bp, Arabidopsis thaliana
ctaccttcggaccttcctcattcctcctcttagctttagccactttttaaccctagtttttcccgccgccaccatcccccatggcttccgaggcgaatcagcttcagcaagcgcaactcgcgatggttctcggctccgattccgcgcccttcgagacgctaatctctcacctcatgtcttcttccaacgagcaacgttcctccgccgagtctcttttcaatctcgctaaacaaagcaatcccgataccctctctttgaagcttgctcatcttcttcagctttctcctcatcccgaaggtcgtgctatggccgccgtccttctccggaagttgttaacacgcgacgatgcttatctatggcctcgtctctccctctccactcaatcttccctcaaatcttcgatgttgtattgtattcaacatgaggaggctaaatcgatctctaagaagatttgcgatacagtctctgaacttgcatccgggattttaccggagaatggatggccggagttgcttccgtttgttttccagtgtgttacttctgttacccctaaattgcaggaatcggcgtttttaatcttggctcaattgtcgcagtacgttggggagactcttacccctcacatcaaggaactccatggcgtgtttcttcagtgcttgagtagtaattctgctagctccgatgttaaaatcgccgctctcaacgccgtgattagtttcgttcagtgtctggccaactcaacggagagagatagattccaagatgttttgcctgcgatgatcaggacgttgaccgaatctctgaacaatgggaatgaagcaactgcacaggaggcacttgagcttttgattgaattggctggtaccgagccacggttccttagacggcaacttgttgacatagttggttcgatgcttcagattgcagaggctgattccctcgaggagagtacacgtcatcttgcgattgagtttttggttactctggctgaggcgcgtgagcgtgcccctggtatggtcaggaagcttcctcagtttattgacaggttgtttgctgttcttatgaagatgctcgaggatattgaggacgatcctgcttggtacagcgctgagactgaggatgaagatgctggcgagacaagcaactacagcatgggtcaagagtgtttggatcggttagcaatttctctgggaggaaacaccattgttccggttgcatatcagcagttttctgcttacttggctgcctctgagtggcagaaacatcatgcttctttgattgcacttgctcagattgctgaaggttgttcaaaggtgatgataaaaaatctagaccaagtggtgtcaatggttttgagccagtttcaaagtcctcatcctcgcgtaaggtgggctgctataaatgcgattggacagttgtctacagatttgggtccagatttgcaaaaccaacatcatgagagagtgctccccgcacttgctgctgctatggatgatttccagaatccacgagtgcaggctcatgctgcttcagcagtactcaacttcagtgaaaattgtactcctgaaatattgtcaccttatttagacggagtagtgagcaagttacttgtgctactacaaaatggtaaacaaatggtgcaagaaggagctttaactgctcttgcttcagtggctgattcatcacaggaacactttcaaaagtactatgatactgtcatgccttatctcaaaactattttgatgaatgcaactgacaagtctaagcggatgcttcgtgccaaatccatggagtgcatcagtcttgttggaatggcagttggaaaggacagattcaaggaagatgctagacaggtcatggaagtgctaatgtcattgcaaggttctcagatggaggcagacgatccaataacaagttacatgttacaggcatgggctaggctttgcaagtgtctaggtcaagatttcctcccatacatgaaggttgtgatgcctcctttgcttcagtcagctcaacttaagccagatgtaacaattacatctgctgattcagaagatgaagcagaggattctgatgatgaaagcatggagaccattatcctgggcgacaaaagaatagggatcaaaacaagtgttctagaggaaaaggccacggcttgtaacatgctttgttgctatgctgatgagttaaaagaaggattttttccttggattgatcaggttgcacctacattggttcctttactgaaattctattttcacgaagaagttagaagagcagctgtttcagccatgccggaactaatgcgctcagccaagctggcaatagagaaaggggaatctcaagggcgagatctatcatatttgaagcagctttctgactacattattccagccatgctggaagctttgcataaagaacctgatacagagatctgtgtgagtatgttggaagctatcaatgaatgcttgcagatctctggaaatcttttggatgaagggaaaattagatccatagttgatgagataaagcaagttatgaccgcaagctctagtaggaagcgagagaggggagagagggcccatgctgaagactttgacgctgaagagggagagcttattaaagaggaaaatgagcaagaggaagaaatttttgatcaagtcggtgaaatattgggaacattggttaagacattcaaggcctcatttctacctttcttcgatgaactgtcctcttacttaactcctatgtggggaagagataaaacagcggaagagagaaggattgctatatgcatttttgatgatgtagcagaacaatgccgtgaagctgcctttaaatattatgatacctatcttccatttgtactggaagcttgcaatgacgagagcccagaggttcgacaggctgctgtttatgggcttggcgtttgtgctgagtttggcggctctgtattcaagcctcttattggagaggctctgtcaagattaaatgttgtgatacagctgccaaatgctcggcaatctgaaaatgccatggcatatgataatgctgtatcagccgtgggaaagatctgccaatttcaccgtgatagtattgattcttctcaggtacttcctgcgtggttgaactgtttgcctataagcaatgatgtccttgaagccaaagtggttcatgatcagctctgctcaatggttgaaaggcaagatgtagaccttttaggccccaataaccagcatcttccgaaaatcttaatagtttttgccgaggtacttacagggaaagatgtggtgacacaagagacagcaggtcgtatgataaatatattaaggcaacttcaacagacactgccaccatcggcgttggcctcaacatggtcaacgctgaaacccgaacagcagctcgctctccaatccatgctttcctcctaaattcaatccaatccgatctctctgtttatttttacagttttgtgagctctgttttcaccacaaagcgtcgtcagttttgcatttatgtgtttacaaaagtgtttcttcttcttttgcatttttcatctaattcttttgggagggatgatgatgggtcggtccatccttcagaagttacaaaatgaaaatttctatctttatggtaggaagtgtatattaggagggaaggatgaaattgttagtgaaatgtgtcattgggtatggttccccaaatacacaggtctgctgttggtgtcggtgttggtttgggtttgagagtgggatgaagttttggtgctttatacgagaaggaacaaaacagaaagatttgattttgaatttttgtttttgtatgcaattgggaattttggaagaatgattcttttctctcattgcctttgttgatttgtactcttttggacactcttctttggccttttcttaataaaagaaatgtcttttttattt

SEQ ID NO: 5881 - DNA, 3922 bp, Arabidopsis thaliana
ctcattcctcctcttagctttagccactttttaaccctagtttttcccgccgccaccatcccccatggcttccgaggcgaatcagcttcagcaagcgcaactcgcgatggttctcggctccgattccgcgcccttcgagacgctaatctctcacctcatgtcttcttccaacgagcaacgttcctccgccgagtctcttttcaatctcgctaaacaaagcaatcccgataccctctctttgaagcttgctcatcttcttcagctttctcctcatcccgaaggtcgtgctatggccgccgtccttctccggaagttgttaacacgcgacgatgcttatctatggcctcgtctctccctctccactcaatcttccctcaaatcttcgatgttgtattgtattcaacatgaggaggctaaatcgatctctaagaagatttgcgatacagtctctgaacttgcatccgggattttaccggagaatggatggccggagttgcttccgtttgttttccagtgtgttacttctgttacccctaaattgcaggaatcggcgtttttaatcttggctcaattgtcgcagtacgttggggagactcttacccctcacatcaaggaactccatggcgtgtttcttcagtgcttgagtagtaattctgctagctccgatgttaaaatcgccgctctcaacgccgtgattagtttcgttcagtgtctggccaactcaacggagagagatagattccaagatgttttgcctgcgatgatcaggacgttgaccgaatctctgaacaatgggaatgaagcaactgcacaggaggcacttgagcttttgattgaattggctggtaccgagccacggttccttagacggcaacttgttgacatagttggttcgatgcttcagattgcagaggctgattccctcgaggagagtacacgtcatcttgcgattgagtttttggttactctggctgaggcgcgtgagcgtgcccctggtatggtcaggaagcttcctcagtttattgacaggttgtttgctgttcttatgaagatgctcgaggatattgaggacgatcctgcttggtacagcgctgagactgaggatgaagatgctggcgagacaagcaactacagcatgggtcaagagtgtttggatcggttagcaatttctctgggaggaaacaccattgttccggttgcatatcagcagttttctgcttacttggctgcctctgagtggcagaaacatcatgcttctttgattgcacttgctcagattgctgaaggttgttcaaaggtgatgataaaaaatctagaccaagtggtgtcaatggttttgagccagtttcaaagtcctcatcctcgcgtaaggtgggctgctataaatgcgattggacagttgtctacagatttgggtccagatttgcaaaaccaacatcatgagagagtgctccccgcacttgctgctgctatggatgatttccagaatccacgagtgcaggctcatgctgcttcagcagtactcaacttcagtgaaaattgtactcctgaaatattgtcaccttatttagacggagtagtgagcaagttacttgtgctactacaaaatggtaaacaaatggtgcaagaaggagctttaactgctcttgcttcagtggctgattcatcacaggaacactttcaaaagtactatgatactgtcatgccttatctcaaaactattttgatgaatgcaactgacaagtctaagcggatgcttcgtgccaaatccatggagtgcatcagtcttgttggaatggcagttggaaaggacagattcaaggaagatgctagacaggtcatggaagtgctaatgtcattgcaaggttctcagatggaggcagacgatccaataacaagttacatgttacaggcatgggctaggctttgcaagtgtctaggtcaagatttcctcccatacatgaaggttgtgatgcctcctttgcttcagtcagctcaacttaagccagatgtaacaattacatctgctgattcagaagatgaagcagaggattctgatgatgaaagcatggagaccattatcctgggcgacaaaagaatagggatcaaaacaagtgttctagaggaaaaggccacggcttgtaacatgctttgttgctatgctgatgagttaaaagaaggattttttccttggattgatcaggttgcacctacattggttcctttactgaaattctattttcacgaagaagttagaagagcagctgtttcagccatgccggaactaatgcgctcagccaagctggcaatagagaaaggggaatctcaagggcgagatctatcatatttgaagcagctttctgactacattattccagccatgctggaagctttgcataaagaacctgatacagagatctgtgtgagtatgttggaagctatcaatgaatgcttgcagatctctggaaatcttttggatgaagggaaaattagatccatagttgatgagataaagcaagttatgaccgcaagctctagtaggaagcgagagaggggagagagggcccatgctgaagactttgacgctgaagagggagagcttattaaagaggaaaatgagcaagaggaagaaatttttgatcaagtcggtgaaatattgggaacattggttaagacattcaaggcctcatttctacctttcttcgatgaactgtcctcttacttaactcctatgtggggaagagataaaacagcggaagagagaaggattgctatatgcatttttgatgatgtagcagaacaatgccgtgaagctgcctttaaatattatgatacctatcttccatttgtactggaagcttgcaatgacgagagcccagaggttcgacaggctgctgtttatgggcttggcgtttgtgctgagtttggcggctctgtattcaagcctcttattggagaggctctgtcaagattaaatgttgtgatacagctgccaaatgctcggcaatctgaaaatgccatggcatatgataatgctgtatcagccgtgggaaagatctgccaatttcaccgtgatagtattgattcttctcaggtacttcctgcgtggttgaactgtttgcctataagcaatgatgtccttgaagccaaagtggttcatgatcagctctgctcaatggttgaaaggcaagatgtagaccttttaggccccaataaccagcatcttccgaaaatcttaatagtttttgccgaggtacttacagggaaagatgtggtgacacaagagacagcaggtcgtatgataaatatattaaggcaacttcaacagacactgccaccatcggcgttggcctcaacatggtcaacgctgaaacccgaacagcagctcgctctccaatccatgctttcctcctaaattcaatccaatccgatctctctgtttatttttacagttttgtgagctctgttttcaccacaaagcgtcgtcagttttgcatttatgtgtttacaaaagtgtttcttcttcttttgcatttttcatctaattcttttgggagggatgatgatgggtcggtccatccttcagaagttacaaaatgaaaatttctatctttatggtaggaagtgtatattaggagggaaggatgaaattgttagtgaaatgtgtcattgggtatggttccccaaatacacaggtctgctgttggtgtcggtgttggtttgggtttgagagtgggatgaagttttggtgctttatacgagaaggaacaaaacagaaagatttgattttgaatttttgtttttgtatgcaattgggaattttggaagaatgattcttttctctcattgcctttgttgatttgtactcttttggacactcttctttggccttttcttaataaaagaaatgtcttttttattt

SEQ ID NO: 5882 - DNA, 3838 bp, Silene vulgaris
ctctctctgtgtgtgtgggagaagaaagaaagaaaaaagaaaaaaaaacaagaggtgcaacaatggcgtccgagttgactcagcaacagcacgcacaaatggcggcgattctaggccccgatccaagccagttcgagaccttaatctcacacctaatgtcaaccaacaacgaccagcgttctgaagccgagttactctacaacctctgcaaacaacatcaacctgactcgctctctctcaaactcgctcatcttcttcaatcctcacctcacccggaggctcgcgccatggccgccatcctccttcgtaagcttctaactcgtgacgactcgttcatctaccctaaactcgccgcctcgactcaatccactctcaaatcaatcttattagcatcaattcagaccgaggataccaaaaccatttctcgtaagctttgcgacaccatttccgaactcgccgctacaattgtgccggataatcaatggccggagttgttaccgttcatgttccagtgcgttacgtcggataatccaaaacttcgagagatgtcgctcctaatattcgctcaattggctcagtacatcggcgaaacaacactggttcctcaccttactactctccacaatgtgtttcttcagtgcttgggtggggctactactgctgatgttcgtatcgcggcgttaagcgcaacaatcaacttcattcagtgcttgaacacggcttctgatcgtgataagttccaggatttgctccctcccatgatgcaaaccttaactgaagccctgaattctggtcaggaggccacggcgcaggaggcattggagttgttgattgatttggctgggaccgagcctcggttcttgaggcggcagctggtggatgtcgttggagcaatgctgcaaatcgccgaggctgagtcgcttgaggaagggactcgtcatttagccattgagtttgttatcactttggcagaggccagagaaagagccccagggatgatgaggaagttgccgcagtttatccacaggttgtttgggattcttatgaagttgttgctcgatatcgaggatgatcctgtgtggcacagtgcagatacagaggatgaggacgctggggagacgagtaactatagtgttggtcaagagtgtttggataggctggcgatttcgttgggtgggaatacgattgttcctgttgcatccgaggttttgccggtcttcttggctgcccccgagtggcagaagcatcatgctgcgctcatttgcttggcccagatcgctgagggttgctccaaggttatgataaagaacttggaacaagtggtgtctatggtcttaaattcattccaagatccacatccacgtgtaaggtgggctgctatcaatgccattggtcaattgtccactgatctgggcccagatttgcaaactcagtaccatcatcgtgtcttacctgcattggcctctgccatggatgattttcaaaatcctcgtgtgcaggcacatgcggcttcagctgtgttaaacttcagtgaaaattgtaccccagagatcttgacgccatacttagatggtatcgtgagcaaactgcttgttctcctgcagaatgggaagcctatggtgcaggaaggtgccttaactgccttagcatcagttgctgattcatcacaggagcttttccaaaaatattatgatgttgtcatgccatacttaaaagccatactggtaaacgcaactgacaaggccaatcgcatgctccgtgcaaagtcaatggaatgtattagcctggttgggatggctgttggaaaagagaagtttagggatgatgctaaacaggtaatggaagttcttatgcagttacaaggatcacagatggaggcagatgatcctactacaagctatatgctccaggcatgggcaagactttgcaagtgcctaggacaggattttcttccttatatgaatgttgttatgccacccttgcttcactctgctcaacttaagcctgatgtggtgatctcaaacacagattcagacattgatattgatgaatctgatgatgagaccattgagactatcactgttggggacaaaaggattggaattaagactagtgtgcttgaggagaaagctacagcatgtaacatgctatgttgctatgctgatgagctgaaagaaggttttttcccatggatagatcaggttgctggtatattggttccacttcttaaattttattttcacgaagaagtcagaaaagcggcagtttcagccatgccggagctgttgcgttctgctaaattggctattgaaaaagggctagcacaaggtcgcaatgaggcgtaccttaagcaattgtctgattatatgataccgccattggtagaggctttgaacaaggagcctgaagtagaaatttgttcaagcatactggattctatcaaggaatgtgtacaggttactggaccacttttagatgaaaaccaagtgagaggtattgtgaatgagataaagcacgtaattacagctagctcactgaggaaggcagagagagctgagagggccaaagctgaggattttgatgcagaagaaggagaactacttaatgaggaaaatgagcaagaagaagagctttttgatcaggttggtgactgtttgggcactttaatcaaaacattcaaggcatcattcctgcccttctttgatgagttatcatcatacctgacacctatgtggggtaaggataaaacaactgaagaaagaaggattgccatttgtatatttgatgatgttgtggagtattgtcgtgaagcagccctcagatactatacgaccttccttcctttccttttggaagcctgcaatgatgaaaatccagatgttcgacaggcagccgtgtatggtcttggcgtttgtgcagagcttggtggatctgtgttcaagcctcttgttggagagagcctttcaagattaaattcagtaataaggcacccgaatgctacacattctgaaaatgtaatggcatatgacaatgctgtctccgctctcgggaaaatatgccagttccatcgtgagaacattgatgcttctcagattgtgccgatgtggctaaattgcttaccaattaaaggagacttgattgaagccaaggttgtgcatgagcaactgtgttccatggttgagaggtcagatagagatctgttagggccaaacaacgagtatctgcctaaaatagtggctatctttgctgagatcctgtgtgcaggtaaagatcttgggacagagcaaactctgagccgaatgataaacttattaaggcagcttcaacaaacattgccaccagccaccttagcatccacttggtcatcgcttccaccacaacatcaacttgccctccaatcaatcctctctcaataatcctcgtagttaccttttttgattttatggggaagtctgcccgtggtatgagctcctccataacctcctatttcattattcttatcttcaataattttgggccacaatggtcaatgtttttggtgctatttttagttgggattgaatgggtgattttttgccagcaaagtaagagattttggtgtacgatgtgtatattgtgagtgttgtccatgatcggattattggttgttgtccatttatatcaacttatattggaaagaaacaaatagaaatgtacaaggtcatcactttggcttatagtgttctccacagatagcccttgagtgaaggattctgtaaacaattttgagaaattttggttgtcattcccctttgatgtattttgtagttgtggcttgactatatttcctactaaacaa

SEQ ID NO: 5883 - DNA, 3820 bp, Brassica napus
ctctctctcgactcgcatcatctggggagagagatagatagcatttcaaccctagttttttcccgccgccgcccaccatggcttccgatcagcttcagcaacaagcgcagctcgcgatggtcctcggctccgatacggcgccgttcgagactctcatctcccacctcatgtcctcttccaacgagcaacgctcctccgccgaggctctcttcaatctcgccaagcagaccagtcccgacaccctcgccttgaagctcgctcaccttctccagctctctcctcacccgaagctcgcgccatggccgccgtcctcctccgtaagcttctcacgcgcgacgacgcttacctgtggccgcgtctctctctccccactcaatcctccctcaaatcgtcgatgctgtcttgtatccagcgcgaggaggcgaaatcgatctccaagaagatttgcgatacggtctccgagctcgcctcggggatcctcccggagaacggatggccggagctgcttccgttcgttttccagtgcgtgtcgtcggattcgtcgaaattgcaggaatcggcgtttctgatcgtggcgcagttgtcgcagtatgttggggagactttgactcctcacatcaagcatctgcacggcgtgtttctccagtgcttgactagcgaatcagctagctcagacgtcaaaatcgccgctctcaacgcggtgattagtttcgttcagtgtttatcgaactctaatgagcgtgataggttccaagacgttttgcctgcgatgatcaggacgttgactgagtctcttaataacgggaacgaagcgacggctcaggaggcgctagagcttttgatcgaattggctgggactgagccacggttccttagacggcagcttcttgatatagttggctcgatgcttcagatcgcagaggctgagtctctcgaggagagcacgcgccaccttgcggttgagtttttggtaactttggctgaggcgcgtgagcgtgcccctgggatggttaggaagctacctcagtttattgacaggttgtttgcggttcttatgaagatgcttgaggatgttgaggacgatcctgcttggtatagtgctgagactgaggacgaggatgctggtgagacgagtaactacagcatgggtcaagagtgtttggatcggttagcaattgccttgggagggaacaccattgttccggttgcgtatcagcagttttctgcttacttggttgcctctgagtggcagaagcaccacgcttctttgattgcgcttgctcagattgctgaaggttgctcaaaggtgatgataaaaaatctagagcaagtggtgtccatggttttgagccaatttcaaagtcctcatcctcgcgtaaggtgggcagccataaatgccattggacaattgtctacagatttgggtcctgatttgcagaaccaacatcatgagatagtgctccctgcacttgctgctgctatggatgatctccagaatccacgagtgcaggctcatgctgcttcagcagtgctcaacttcagtgagaattgtacacctgaaatattggcaccttatttagacggaatagtgagcaagttactggtgctactgcaaaatggaaaacaaatggtgcaagaaggtgctttaacagctctagcttcagttgctgattcatcacaggaacacttccaaaagtactatgatgttgtcatgccttatctcaaaactatcttgatgaacgcaactgacaaatctaagcggatgcttcgtgctaaatccatggaatgcatcagtcttgttggaatggcagttggaaaggacaaatttaaggaggatgctagacaggtcatggaagttcttatgtcattgcaagggactgaaatggaggcagatgatccaataacgagctatatgttacaggcatgggctaggctttgcaagtgtctaggccaagattttctcccatacatggatgttgtgatgcctcctttgcttcagtcagctcaacttaaaccagatgtaacaattacatctgctgattcagaaaatgaagcagaggattctgatgatgaaagcatggagaccattatcctgggagacaaacgaataggaatcaaaacaagtgtcctagaagaaaaagccacagcttgtaacatgctttgttgctatgctgatgagttaaagaagggttttttccctggattgatcaggttgcacttacactggttcctttgctgaaattctattttcacgaagaagttagaagagcagctgtgtcagccatgccggaactaatgcgctcagctaagctggcgatagagaaaggagaagctcaagggcgcgatctatcctatttaaagcagctttctgactatataattccaaacatgctagaagcgttgcataaagaacctgatacagagatctgtgtgagtatgttggaagctatcaatgaatgcttgcagatctccggaaatctattggacgaagggaaaattagatccatagttgacgaggtaaagcaagttatgacagcaagctctagcaggaagcgagaaaggggagagagagctaatgctgaagactttgacgctgaagagggggagcttattaaagaggaaaatgagcaagaggaagaaatttttgatcaggtcggtgaaatattgggaacactggttaagacattcaaggcctcgtttctacctttcttcgatgagttatcctcttacttaactcctatgtggggaagggataaaaccgctgaagagagaaggattgcgatatgcatttttgatgatgttgcagagcaatgccgtgatgctgccttcaaatattacgatacttatcttccattcgtactggaagcttgcaatgacgagagcccagaagttcgacaggctgccgtttatgggcttggtgtgtgtgctgagtttggcggatctgtattcaagcctcttgttggagaggctctgtcaagattaaatgttgtgatacagcagccaaatgctcggcaatctgaaaatgccatggcatatgacaatgctgtatccgctgtgggaaagatctgcctatttcaccgtgacagtatcgattcttctcaggtacttcttgcgtggttgaactgtttgcctttaagtaatgatgttattgaagccaaagtggttcatgatcagctctgttcaatggttgagaggcaagatgtggaccttttaggccccaataaccagtatcttcctaaaattataacagttttcgctgaggtgcttacagggaaagatgtggtgacacaagagacggcaggtcgtatggttaatatactaaggcaacttcagcaaacactgccaccatcggcattgggctcaatatggtcaacactgaaacccgaacagcaacacgctctccaatccatgctttcatcctaaacccacaccaatctgttcatttacagtgtcttgtgagctttatttttccaccgcaaagcgtcgtcagttttgcattcatgtgtttacattatttttgggtttgcattattcaccatttgttgttgggagggatgaagaatgggtctagtccttcataagttatgaaatgaaatttctatctctatggtaggaaagtgtatattagaagggaaggaaagtttgtgaaattggtaagcgtcagttgggaatttggttgggttgtgactccctgaaaagacaggttcgatgttggctttatgtttgggagaaagatgaagtttttgttcttttttttttgtattaaagtgagaattttgaagtaaatcattctttacacatattgctattgttgatttgt

SEQ ID NO: 5884 - DNA, 3937 bp, Brassica rapa
ctcatctcgtcctcgcttactctctctttctctcctctctctcgactcgcatcatctggggagagagatagacagcatttcaaccctagttttttcccgccgccgcgcaccatggcttccgatcagcttcagcaacaagcgcagctcgcgatggtcctcggctccgatacggcgccgttcgagacactcatctcccacctcatgtcttcttccaacgagcagcgctcctccgccgaggctctcttcaatctcgccaagcagaccaatcccgataccctcgccttgaagcttgctcaccttctccaactctctcctcaccccgaagctcgcgccatggccgccgtcctcctccgtaagcttctcacgcgcgacgacgcttacctggggccgcgtctctccctccccactcaatcctccctcaaatcgtcgatgctgtcttgtatccagcgcgaggaggcgaaatcgatctccaagaagatttgcgatacggtctccgagctcgcctcggggatcctcccggagaacggatggccggagctgcttccgttcgttttccagtgcgtgtcgtcggattcgtcgaaattgcaggaatcggcgtttctgatcgtggcgcagttgtcgcagtacgttggggagactttgactcctcacatcaagcatctgcacggcgtgtttctccagtgcttgactagcgaatcagctagctcagacgtcaaaatcgccgctctcaacgcggtgattagtttcgttcagtgtttatcgaactctaatgagcgtgataggttccaagacgttttgcctgcgatgatcaggacgttgactgagtctcttaataacgggaacgaagcgacggctcaggaggcgctagagcttttgatcgaattggctgggactgagccacggttccttagacggcagcttcttgatatagttggctcgatgcttcagatcgcagaggctgagtctctcgaggagagcacgcgccaccttgcggttgagtttttggtaactttggctgaggcgcgtgagcgtgcccctgggatggttaggaagctacctcagtttattgacaggttgtttgcggttcttatgaagatgcttgaggatgttgaggacgatcctgcttggtatagtgctgagactgaggacgaggatgctggtgagacgagtaactacagcatgggtcaagagtgtttggatcggttagcaattgccttgggagggaacaccattgttccggttgcgtatcagcagttttctgcttacttggttgcctctgagtggcagaagcaccacgcttctttgattgcgcttgctcagattgctgaaggttgctcaaaggtgatgataaaaaatctagagcaagtggtgtccatggttttgagccaatttcaaagtcctcatcctcgcgtaaggtgggcagccataaatgccattggacagttgtctacagatttgggtcctgatttgcagaaccaacatcatgacatagtgctccctgcacttgctgctgctatggatgatctccagaatccacgagtgcaggctcatgctgcttcagcagtgcttaatttcagtgagaattgtacacctgaaatattggcaccttatttagatggaatagtgagcaagttactggtgctactacaaaatggaaaacaaatggtgcaagaaggagctttaacagctcttgcttcagttgctgattcatcacaggaacacttccaaaagtactatgatgttgtcatgccttacctcaaaactatcttgatgaacgcaactgacaagtctaagcggatgcttcgtgccaaatccatggaatgcatcagtcttgttggaatggcagttggaaaggacaaatttaaggaggatgctagacaggtcatggaagttcttatgtcattgcaagggactgaaatggaggcagatgatccaataacgagctatatgttacaggcatgggctaggctttgcaagtgtctaggccaagattttctcccatacatggatgttgtgatgcctcctttgctgcagtcagctcaacttaaaccagatgtaacaattacatctgctgattcagaaaatgaagcagaggattctgatgatgaaagcatggagaccattatcctgggagacaaacgaataggaatcaaaacaagtgtcctagaagaaaaagccacagcttgtaacatgctttgttgctatgctgatgagttaaaagaagggttttttccctggattgatcaggttgcacttacactggttcctttgctgaaattctattttcacgaagaagttagaagagcagctgtgtcagccatgccggaactaatgcgctcagctaagctggcgatagagaaaggagaagctcaagggcgcgatctatcctatttaaagcagctttctgactatataattccaaacatgctagaagcgttgcataaagaacctgatacagagatctgtgtgagtatgttggaagctatcaatgaatgcttgcagatctccggaaatctattggacgaagggaaaattagatccatagttgacgaggtaaagcaagttatgacagcaagctctagcaggaagcgagaaaggggagagagagctaatgctgaagactttgacgctgaagagggggagcttattaaagaggaaaatgagcaagaggaagaaatttttgatcaggtcggtgaaatattgggaacactggttaagacattcaaggcctcgtttctacctttcttcgatgagttatcctcttacttaactcctatgtggggaagggataaaaccgctgaagagagaaggattgcgatatgcatttttgatgatgttgcagagcaatgccgtgatgctgccttcaaatattacgatacttatcttccattcgtactggaagcttgcaatgacgagagcccagaagttcgacaggctgccgtttatgggcttggtgtgtgtgctgagtttggcggatctgtattcaagcctcttgttggagaggctctgtcaagattaaatgttgtgatacagcagccaaatgctcggcaatctgaaaatgccatggcatatgacaatgctgtatccgctgtgggaaagatctgcctatttcaccgtgacagtatcgattcttctcaggtacttcttgcgtggttgaactgtttgcctttaagtaatgatgttattgaagccaaagtggttcatgatcagctctgttcaatggttgagaggcaagatgtggaccttttaggccccaataaccagtatcttcctaaaattataacagttttcgctgaggtgcttacagggaaagatgtggtgacacaagagacggcaggtcgtatggttaatatactaaggcaacttcagcaaacactgccaccgtcggcattgggctcaatatggtcaacactgaaacccgaacagcaacacgctctccaatccatgctttcatcctaaacccacaccaatctgttcatttacagtgtcttgtgagctttatttttccaccgcaaagcgtcgtcagttttgcattcatgtgtttacattatttttgggtttgcattattcaccatttgttgttgggagggatgaagaattgggtctagtccttcataagttatgaaatgaaatttctatctctatggtaggtaagtgtatattagaaggcaaggaaagtttgtgaaattgtaagcgtcagttgggaatttgggttgtgactccctgaaaagacaggttcgatgttggctttatgtttgagagaaagatgaagtttttgtattttttgtacccaagtgagaattttgaagtaaatcattctttacacatattgctatttttttattagctctttttttcttcctctctaaattaaaactataatttactatttcgaaaagttattcgtattaaataactacatctacatttaaccctg

SEQ ID NO: 5885 - DNA, 3816 bp, Phalaenopsis aphrodite
ccctctcaaaccctaatcatatttgatcagagactctcgccagatagaggaggagaggaagaggaggtgcggcgcagaatcgctgccgtcctattccgtcttaatcctcgaattgttgtattttcacacttttcgatcagtcagtcgattgtgcagatcgatcccggtcgaagaacatcggagggatggatcagcaggttgcgattgtgctcggcgcggatcccgccgccttcgaggcattgatctctcagttgatgtcgtcggcgaatgagctacggtcgcaagcggaggcgcttttcaatctatgccgcgaccgccacccggatacacttgctctcaagcttgcacaagttctgcactcgtctcagtccctggagatccgcgccatggcggctgttctcctccgtaagcaagtcacctcgtcgtctggaggggattcggaggagtcgccgtcttatatctggtcacggctctcgcccgccacccaatcttctattaagtctcttcttctgtctgctgttcagagagaggagatgaagagtatcgctaagaagctctgcgatactgtctccgagcttgcttctaacctgcttcctgatggtacatggccggagctcctacctttcatgttccaggccgtgacctctgattctccgcgccttcaggaatccgccttgcttatcttctcgcagctcgcgcagtatatcggcgatatactccttccccacctcccgacgcttcactcggtcttcctcaactcgttatctaattctgtgtcgccggatgtacgcatcgctgcgcttggggcatcgatcaactttgtccagtgccttgagtctactgcagaccgtgagcgtttccaggacctccttcccgccatgatgcgaacacttacggaggcgctcaattctggaaacgaggccactgcccaggaggcccttgagctccttatcgagcttgcaggcacggagccacggtttctgaggcgccagctagctgatgtggttggttctatgcttcagattgctgaagccgatcgcttggaggaagggaccaggcatcttgcggttgagttcgtgattactcttgctgaagcccgtgagagagccccggggatgatgagaaggctgccccaattcattgggagcctctttgctgtgcttatgaagatgttgcttgacattgaggatgaccccgcttggcatggtgctgaaactgaggacgaggatgctggagagacgagtaactacagtgtggcacaagagtgtcttgatcggctatctattgccctgggagggaacaccattgttccggttgcctctgagttgcttccacaatacttagcagccccagaatggcagaaacgtcatgcagcattaattacttttgcacagattgcagaagggtgttccaaggtcatggttaaaaacttggagcaggtcgtctctatggttctaagctcttttagagatcctcatcctcgtgtacgctgggcagctataaatgctattggacagttgtccactgatttgggtcctgatcttcaagtccattatcaccagcaagtgcttccagctttagcctctgctatggatgattttcagaatccccgagtccaggcacacgctgcttcagctgtactcaatttcactgagagctgcacgcctgatactttatcaccttacctggatggcattgtcagcaaactgcttgtattgcttcagaatgggaagcagatggtgcaagaaggagcattgacagctttagcatcagttgctgattcatctcaggaacatttccaaaaatattatgatgctgtcatgccgtatcttaaagctattttgatgaatgccactgacaaatcaaatagaatgttgcgtgccaaatccatggagtgcatcagtctggttggaatggccgtgggcaaggataaatttagggatgatgctaagcaggtaatggaagtactgatgacgttgcaaggttcacagttggaaagcgatgatcctataacaagttacatacttcaggcatgggccaggctctgcaagtgtctaggtcaagattttcttccatacatgaatgttgtcatgcctccattgcttaaatctgctcagctaaaacctgatgttaccataacatcagcagacacagatgaggaagtagatgattcagatgatgacagcatagagacgattacccttggggataaaaggattgggatcagaactagtgtgttggaggaaaaggctacggcatgtaacatgcttggttgttatgctgatgagctcaaggagggtttctttccatggattgatcaggttgctcccacattggtccctcttctcaaattttattttcatgaagaagttaggaaggctgctgtatcagctatgccagagcttttgagatcagcaaagttagcagtagagaaggggcaagcatctggtcgtgatgagtcctatgttaagcagctgtcagattacataattccagctttagtggaagctcttcacaaggagcccgaggttgaaatatgtgcatcgatgttggattcattgaatgaatgtgcagagcttgctgggcagcttcttagtgagggccaggttcgatccattgtggatgaactcaaacatgtgataaccgcaagctccacaaggaaacgagaaagagctgagaggacaaaagcagaggattttgatgctgatgagggggatctgctcaaagaagaaaatgagcaggaagaggaagtttttaatcaggttggtgactgtttgggcacgttgattaaaacctttaaagcttctttcctgccattctttgacgagatttcaatttatgtaacagcaatgctgggcaaggataaaactcccgaggaaagaagaatagccatttgtattttcgacgatgttgctgaacaatgtcaagaagcagccctgaaatactatgttacttacgtgccattcttactagaagcctgtaacgatgaaaattcagatgttagacaggctgcagtttatggtattggtgtttgtgctgagtttggtggttctgtctttagacctcttgttggagaagctctctcccggttaaataatgtaatacggcatcctaatgctcagcattccgacaatataatggcatatgacaatgctgtttcggctctaggaaaactatgtcagtttcatcgtgatagcattgatgcagctcaggttgttccttcttggttaagctgcttgccaataaaaggcgatcttattgaggctaagctagtgcatgagcagctttgtatgatggtggaaaggtcggatggagagctcttgggtcctaacaatcaatatttgcccaaaattgtttcggtatttgcggaggttttatgtgctgggaaggatttagccacagagcagacagccagcagaatggtgaatctattacggcagctccagcaaactctgccgccggcagtcctcgcctcgacctggtccgccttgcatccgcagcagcagctcgcgctacaatccgtcctgtcgacgtagtacctgtttcggcgcgggcacgtattcttcgtcgaggaaaattggatccatatcgttcaatcgtttgctcccacccaatatttttatgtcaatcatttcttttgcatggattgcaggtgcaatcagcagctgctctattgtggtgctcgtttcagagcagaagcatgagagtctctcgtctctggttggggcttgtgttgtaccatgtgcataataggggtgataggaaatatcaccttctgtcctaagcatgcttagtgcgaaggggagtttatttttt

SEQ ID NO: 5886 - DNA, 3791 bp, Phalaenopsis aphrodite
cctctcaaaccctaatcatatttgatcagagactctcgccagatagaggaggagaggaagaggaggtgcggcgcagaatcgctgccgtcctattccgtcttaatccgcgaattgttgtattttcacacttttcgatcagtcagtcgattgtgcagatcgatcccggtcgaagaacatcggagggatggatcagcaggttgcgattgtgctcggcgcggatcctgccgccttcgaggcattgatctctcagttgatgtcgtcggcgaatgagctacggtcgcaagcggaggcgcttttcaatctatgccgcgaccgccacccggatgcacttgctctcaagcttgcacaagttctgcactcgtctcagtccctggagatccgtgccatggtggctgttctcctccgtaagcaagtcacctcgtcgtctggaggggattcggaggagtcgccgtcttatatctggtcacggctctcgcccgccacccaatcttctattaagtctcttcttctgtccgctgttcagagagaggagatgaagagtatcgctaagaagctctgcgatactgtctccgagcttgcttctaacctgcttcctgatggtacatggccggagctcctacctttcatgttccaggccgtgacctctgattctccgcgccttcaggaatccgccttgcttatcttctcgcagctcgcgcagtatatcggcgatatactccttccccacctccctacgcttcactcggtcttcctcaactcgttatccaattctgtgtcgccggatgtacgcatcgctgcgcttggggcatcgatcaactttgtccagtgccttgagtctactgcagaccgtgagcgtttccaggacctccttcccgctatgatgcgaacacttacggaggcgctcaattctggaaacgaggccactgcccaggaggcccttgagctccttatcgagcttgcaggcacggagccacggtttctgaggcgccagctagctgatgtggttggttctatgcttcagattgctgaagccgatcgcttggaggaagggaccaggcatcttgcggttgagttcgtgattactcttgctgaagcccgtgagagagccccggggatgatgagaaggctgccccaattcattgggagcctctttgctgtgcttatgaagatgttgcttgacattgaggatgaccccgcttggcatggtgctgaaactgaggacgaggatgctggagagacgagtaactacagtgtggcacaagagtgtcttgatcggctatctattgccctgggagggaacaccattgttccggttgcctctgagttgcttccgcaatacttagcagccccagaatggcagaaacgtcatgcagcattaattacttttgcacagattgcagaagggtgttccaaggtcatggttaaaaacttggagcaggtcgtctctatggttctaagctcttttagagatcctcatcctcgtgtacgctgggcagctataaatgctattggacagttgtccactgatttgggtcctgatcttcaagtccattatcaccagcaagtgcttccagctttagcctctgctatggatgattttcagaatccccgagtccaggcacacgctgcttcagctgtactcaatttcactgagagctgcacgcctgatactttatcaccttacctggatggcattgtcagcaaactgcttgtattgcttcagaatgggaagcagatggtgcaagaaggagcattgacagctttagcatcagttgctgattcatctcaggaacacttccaaaaatattatgatgctgtcatgccgtatcttaaagctattttgatgaatgccactgacaaatcaaatagaatgttgcgtgccaaatccatggagtgcatcagtctggttggaatggccgtgggcaaggataaatttagggatgatgctaagcaggtaatggaagtactgatgacgttgcaaggttcacagttggaaagcgatgatcctataacaagttacatacttcaggcatgggccaggctgtgcaagtgtctaggtcaagattttcttccatacatgaatgttgtcatgcctccattgcttaaatctgctcagctaaaacctgatgttaccataacatcagcagacacagatgaggaagtagatgattcagatgatgacagcatagagacgattacccttggggataaaaggattgggatcagaactagcgtgttggaggaaaaggctacggcatgtaacatgcttggttgttatgctgatgagctcaaggagggtttctttccatggattgatcaggttgctcccacattggtccctcttctcaaattttattttcatgaagaagttaggaaggctgctgtatcagctatgccagagcttttgagatcagcaaagttagcagtagagaaggggcaagcatctggtcgtgatgagtcctatgttaagcagctgtcagattacataattccagctttagtggaagctcttcacaaggagcccgaggttgaaatatgtgcatctatgttggattcattgaatgaatgtgcagagcttgccgggcagcttcttagtgagggccaggttcgatccattgtagatgaactcaaacatgtgataaccgcaagctccacaaggaaacgagaaagagctgagaggacaaaagcagaggattttgatgctgatgagggggatctgctcaaagaagaaaatgagcaggaagaggaagtttttaatcaggttggtgactgtttgggcacgttgattaaaacctttaaagcttctttcctgccattctttgacgagatttcaatttatgtaacagcaatgctgggcaaggataaaactcccgaggaaagaagaatagccatttgtattttcgacgacgttgctgaacaatgtcaagaagcagccctgaaatactatgttacttacgtgccattcttactagaagcctgtaacgatgaaaattcagatgttagacaggctgcagtttatggtattggtgtttgtgctgagtttggtggttctgtctttagacctcttgttggagaagctctctcccggttaaataatgtaatacggcatcctaatgctcagcattccgacaatataatggcatatgacaatgctgtttcggctctaggaaaactatgccagtttcatcgtgatagcattgatgcagctcaggttgttccttcttggttaagctgcttgccaataaaaggcgatcttattgaggctaagctagtgcatgagcagctttgtatgatggtggaaaggtcggatggagagctcttgggtcctaacaatcaatatttgcccaaaattgtttcggtatttgcggaggttttatgtgctgggaaggatttagccacagagcagacagccagcagaatggtgaatctattacggcagctccagcaaactctgccgccggcagtcctcgcctcgacctggtccgccttgcatccgcagcagcagctcgcgctacaatccgtcctgtcgacgtagtacctgtttcggcgcgggcacgtattcttcgtcgaggaaaattggatccatatcgttcaatcgttcgctcccacccaatatttttatgtcaatcatttcttttgcatggattgcaggtgcaatcagcagctgctctattgtggtgctcgtttcagagcagaagcatgagagtctctcgtctctggttggggcttgtgttgtaccatgtgcataataggggtgataggaaatatcaccttctgtcctaagcatgctt

SEQ ID NO: 5887 - DNA, 3970 bp, Lotus japonicus
ttcgtttcgagcgtaaaactcttccctccctttctcctccctcaccgcaccgccactcaactcaaataaccaccaccaccaatccacggcggcgatggatccaaaccaagtagctctcatcctcggccctgattcatctcatttagaatccctaatttcaaacttcatctccaccggcaacgagcaacgttctcaggccgaaactctcttcaatctctgcaaacaaacccaccccgattccctcatcctccgtctcgctcagcttctccactcttcccccaaccccgaaacccgaaccatggccaccatcctcctccgccgccacctcacgcgccaccacgatgattccttcctctggcctcacctctccccacccacgcgctctaccctctgctccctcctcctctcctcgctccaccgcgagccgcagaagtctatctccaagaagctatgcgacaccgtttctgaacttgcctctgctttgctccctgatgaccccgccgcctggccggagctgctgccgcttttgttccagtgggtcacctcgccggaccccaggctgcaggaaattgcgctgcttgtgtttgctcagttggctcattatattggtgaaaccctagtacctcaattgaccacgctgcaatctgtgttcctccgctgcctgagctcctccacgtcgtctgatgtccgcatcgccgccctcgccgctagcgtcaactttgtccagtgcctctctagtccttctgaccgggataggttgcaggatttgctgcccctcatgatgcagacattgacagaggcactgaattctggtcaggaggcaactgcgcaggaggctctcgagctccttattgagcttgcaggaaccgagcctaggttcctgcggaggcagattgtcgatgttgttggctccatgctgcaggttgctgaggccccttcccttgaggaaggaacgcgccatttagctattgagtttgtcgtgacacttgctgaggcgagggagcgcgccccggggatgatgaggaagctgccgcagtttatccagaggctgtttggtgtgctgatgaatttgttgctggatattgaagatgagccggcttggcacgccgccgagactgaggacgaggttgctggtgagaccagtaattatggatttgggcaggagtgtttggatagactttcgatttctttgggtgggaacacgatagtgccagttgcttcggagttgttgcctgcttacttggctgctcctgaatggcaaaagcatcatgctgcactcattgcacttgcacagattgcagagggttgttcaaaggtgatgataaagaatctggagcaagtattgtcaatgattttaaattcatttcacgatcctcaccctcgagtgagatgggcagccataaatgcaattgggcaattgtccacagacttggggccagacttgcaggttaaatatcaccacttagtgctgcctgcattagctggagccatggacgattttcaaaatcccagagtacaggctcatgtggcttctgccgtgctgaacttcactgaaaattgtaccccagatatcctaacaccttatttagatgggattgtgagcaaacttctcgtacttctgcagaatgggaagcaaatggttcaagaaggggcattgacagcattagcatcagttgctgattcttcacaggagcaatttcagaaatactatgatgctgttatgccatacttaaaagctattttgatgaatgcaaatgataagacaaatcgtatgcttcgtgccaaagcaatggagtgcattagtttggtaggaatggctgttggaaaggagaagttcagggatgatgccaaacaggtcatggatgtcttgatgtcacttcagcaatctcaactggaggctgacgatcctactgcaagctacatgttacaagcatgggcacggctttgcaaatgccttgggcaggattttctcccatatatgaattttgtcatgcctcctttgctccagtctgcacaacttaagcctgatgtgaccattacatcagcagattctgatgctgaatttgatgaagatgatgacagcattgaaacaatcactctcggggataaaaggataggcattaaaaccagtgtcttggaggagaaggcgactgcttgtaacatgctatgctgctatgctgatgaattgaaggaaggatttttcccatggattgaccaggttgctttcacattggttcctcttcttaagttttacttccatgaagaagtcaggaaggcagcagtttcagctatgccggaactgttgtcctcggcaaaatcagctgtagagaagggacaatcacagggtcgtgatgagacttacgtaaaacagttgtctgattatataattccaaatttggtggaatctttacataaggagccagaagtagaaatttgtgcaaacattttggacgcactgaatgaatgcatacaggtatctggatcacatctagatgaaaagcaagttaggagcattgttgacgagattaaacaagtccttactgccagttcatcaagaaaacatgatagagcagatagggccaaagaagaggattttgatgctgaagaaagagaacttctcaaggaagaaaatgagcaagaagaagaactttttgatcaagttggtgattgcttggggactttgataaaaacattcagggcatcttttttgcctttctttgatgagctttcgtcatacctaacacctatgtttggtaaagataaaaccccagaagaaagaagaattgccatttgtatatttgatgatgttgctgagcactgtcgtgaaacagctcttaagtattatgattcgtaccttccattcttgcttgaagcttgcaatgatgaatgttcagatgttcgacaggcagctgtttatggggttggtgtttgtgctgagtttggtggatctgttttcaaaccccttgttggagaggctctctcaaggttaaatgctgttatagggcatcccaatgcactacattcagataatgtaatggcatatgacaatgctgtttcagctcttggaaaaatatgccagttccatcgtgatagcataaatgcaacacaggttgttcctgcctggttaagttgcttgcctctaaaaggtgatttaattgaggctagggttgtgcatgatcaactgtgttcaatggttgaaagatctgatagagaacttctaggccccaacaatcaatatctttcaaaaattgttgcagtttttgctgagattttatgcgcgggaaatagtctggcaactgaacaaaccgttagtcggatgattaatttattgcggcagcttcaacaaactttgccaccttctacccttgcttcaacctggtcatccttgcagccccagcaacagcttgccttacagtcaatcctatcatcttagctttttctggtctggattgttgcgtcttccattaccctcagatgatgcgcatctagtgtcatgggatgtcacagcttccttctgggaaggtgctgtgtcaggtcaaatttgttcctttagcagtggagtctggagtgtctgttcttagaccagcagctgcatctgattggtgtttcatggtgctgggaataatgcaacacaacttctgaggtatgtatgggtttgatgcagaggttgcgagttggttgggatgaaaaacaaagttttggtgtcagaatatgtatattgaagtcttatatcaaaagggattcttcgtgtaaaaggaatgaattgcgtgactcgttcctgtctgaggatgatgggaacaaggtgaccctgagtcatgcatgacttaggaaaaccgaatagcattattttttgtttatctattttggggttgtaacagttttgacgagtcatttacttgtaaactgtgccatagattaatttatttgtatattcattggctgcggtagttgctcttccccatccatttat

SEQ ID NO: 5888 - DNA, 3942 bp, Brassica rapa
aacaaatatataattatctcttcggaaacctcatcgcctcctcgttcagcttactctctctctctctctctctctctctctatagactctcatcctaagaggagagagacagcttttttcaaccctagtttttcccgccgccgccacctgccacaatggcttccgagcaagcacaactcgcgatgatcctcggctccgattccgcgcccttcgagaccctcatctcccacctcatgtcctcttccaacgagcagcgctcctccgccgaggctctcttcaatctcgccaagcaaaccaatcccgacaccctcgccttgaagctcgctcacctcctccagctctcccctcaccccgagggccgcgccatggccgccgtcctcctccgcaagctcctcacgcgcgacgacgcttacctgtggccgcgtctctccctccccactcaatcctccctcaaatccacgatgctggcgtgtatccagcgcgaggaggtcaaatcgatctccaagaagatttgcgacaccgtctccgagctcgcctcggggatcctcccggagaacgggtggccggagttgctgccgtttgtcttccagtgcgtgtcgtccgattcgtctaaattgcaggaatcggcgtttttgattttggcgcaattgtctcagtacgttggggagactctgactcctcacatcaagcatctacacggcgtctttctccagtgcttgagtagtaactccgttagctcagacgttaaaatcgcttccctcaacgccgtgattagtttcgttcagtgtctatcgaactcgaccgagcgtgatcggttccaagactttttgcctgcgatgatcaggacgttgaccgagtctcttaataacggcaacgaagccaccgcgcaggaggcgttagagctgttcatcgaattggcgggaaccgagccacggtttctcagaaggcagctgatcgacgttgttggttcgatgcttcagatcgctgaggctgagtctctcgaggagagtacgcgccacctggcgattgagtttctggtgactctcgctgaggcacgtgagcgtgcacctgggatggttaggaagcttcctcagttcattgacaggctgtttgcggttcttatgaagatgcttgagggtattgagggcgatcctgcctggtacagcgctgagactgaggacgaggacgctggtgagacgagcaactacagcatggggcaagagtgtttggataggttagcaattgctttgggagggaacacgattgttccggttgcgtatcagcagttctctgcttacttggttgcctctgagtggcagaaacaccatgcgtctgtgattgcgcttgcgcagattgctgaaggttgctcaaaggtgatgataaagaatcttgagcaagtggtgtccatgattttgagccaatttcagagtcctcatccccgtgtaagatgggcagcaataaacgcgattggtcagttgtctacagatttgggtcctgatttgcaaaaccaacatcatcatatagtgctccccgcacttgctgctgcgatggatgatatccagaatccgcgagtgcaggctcatgctgcttcagcagttctcaacttcagtgaaaattgtacacctgaaatattgacaccttatttagacggaatagtgagcaagttgcttgtgctactgcaaaatggaaaacaaatggtgcaagaaggagctttaacagctcttgcttcagttgctgattcatcgcaggaacacttccaaaagtactatgatgttgtcatgccatatctcaaaactattttgatgaacgcaacggacaaatctaagcggatgcttcgtgccaaatccatggaatgcatcagtcttgttggaatggcagttggaaaggacaaatttagggatgatgctagacaggtcatggaagtgcttatgtcattgcaagggtctgaaatggaggcagatgatccaataacgagttacatgttacaggcatgggctaggctttgcaagtgtctaggccaagatttcatcccatacatggatgttgtgatgcctcctttgctgcagtcagctcaacttaaaccagatgtaacaattacatctgctgattcagaagatgaagcagatgattctgatgatgaaagcatggagaccattatactgggagacaagagaataggaatcaaaacaagtgtcctagaggaaaaggccacagcttgtaacatgctttgttgctatgctgatgagttaaaagaaggatttttcccctggattgctcaggttgcacctacactggttcctttgctaaaattctattttcacgaagaagtcagaagagcagctgtgtcagctatgccggaactaatgcgctcagccaaactggcaatagaacaaggaaaatctcaaggacacgatctatcctatttgaagcagctttctgactacattattcccgccatgctggaagctttgcataaagaaccggataccgagatctgtgtgagtatgttggaagccattaatgaatgcttgcagatctctggaaatcttctggacgaaggaaaaattagatccatagttgatgaggtaaagcaagttatgacagcaagctctagtagaaagcgagaaaggggagagagggccaatgctgaagactttgatgctgaagagggagagcttattaaagaggaaaatgagcaagaggaggaaatttttgatcaggtcggtgaaatattggggacactggttaagacattcaagtcttcgtttctgcctttcttcgacgaattatcctcgtacttaactcctatgtggggaagggataaaacagccgaagagagaaggattgcgatatgcatctttgatgatgttgcagaacaatgccgcgatgccgcctttaaatattatgatacatatcttccatttgtactggaagcgtgcaatgacgagagcccagaagttcgacaggctgctgtttatgggcttggagtttgtgctgagtttgggggatctgttttcaagcctcttgttggagaggctctgtcaagattaaatgttgtgatacagcagccaaatgctcgccaatctgaaaatgcaatggcatatgataatgctgtatccgctgtgggaaagatctgccaatttcaccgtgacagcatcgatgcttctcaggtacttcctgcgtggttgaactgtttgcctcttagtaatgatgtgattgaagccaaagtggttcatgagcagctctgttcaatggttgagaggcaagatgtggacctgttaggccccaataaccagtatctaccaaaaatcttaacagtatttgctgaggtgcttacaaggaaagatgtggtgacagaagagacggcaggtcgtatgataaatataataaggcaacttcagcaaacactgccaccatcggcattggcctcagtatgggcatcattgactcccgagcagcaggtcgctctccaatctatgctttccacctgaacccattccaaatcgggtctgattgttcatttaccacagtgtctttattttccaccacaaagcgtcgtcagttttgcatttgtttcaccatttgtttttgggagggatgatgaatgggtctatccttcataagtcatgaaatgaaatatcttccatctttaagggaaggagggaagagttgtcaattggggaatctgggtaatgattccccaataaaacacaaaggtttggtgttgtcttgggtttttggggagagggatgaagtttttgatgcttatacgtgaaacaaaacagaaacaaagtgtcgattttttgaatttttgtttttttgtatacaatgagaattttggatgaattattcttttctctcattgccattgttgaaagttgatttgtagtcttttgctttccttttgttgttattgcgatttaaggttatagtattgaaaca

SEQ ID NO: 5889 - DNA, 3960 bp, Sciadopitys verticillata
ggcaggtccgagatttaagtctctgttggctgagcttccaaaaaccctcagaagaaaggcgcaagaaaacctctgtgttttttggtctctggttttttctttattattttctggttatggagcagcagcagcaggcacagataaatgccgtgctcggcgccgatccggcggcgttcgagtccctgattacacatttgatgagcgccggcaacgagcagcgcggccaggcggaggttctcttcaacatctgcaaagaaaagcacccggacgcgctggcgttaaagctcgtgcacgttctgcaatcttgcggcaaggtggaaatccgggcgatggcggcgatacttctgcggaagcagatcacgcgagacgagacgtatatctggccgcgcctccaggccgccactcagaccgccgtcaaagcgcacctcctcctctgcgtgcagcgcgaggaagcgaagacgatcgtgaagaagctctgcgacacggtggcggagctggcggcgtcgatcatggaggaagggcaatggcccgagcttttgcccttcatgttccagtgcgtcagctccgattcgcccaagcttaaggaatctgcgctcttgatgtttgcgcagctctcgcaatacattgccgatcacctccacccgcaccttacgacgctccacgccgtcttccaccagtgcctctcgccgcccgcgccgtcggacgttcgaatcgccgcactcggcgccaccactaattttgtccagacgatcgactcccagcccgacagggaacgatttcaagacctcctgcccgccatgatggaaaccctaactgaggcgctcaaccgcaacgaggaggccaccgcccaggaggcgctcgagatgtttatcgaactcgccggcacggagccccgctttctccgccgccagatcgtcgacgtggtgggctccatgctgcaaatcgccgaggccgagagcctcgaagagggcacgcgccacctggcgatcgagttcattattaccctcgcagaggcccgcgagcgtgcccctggcatgatgaggaagttgccgcagtttattgggaggcttttttccattctgatgaagatgcttcttgatatcgaggacgaccctgcgtggcatgcggcaaataccgaggacgaggatgcaggggagtctagtaattataaatgttgggcaggagtgtttggatcggttggctatttctcttggggggaatactattgttcctgttgcttctgagttgcttcctgtttatttggctgatcctgattggcgcaagcatcatgctgctcttattactcttgcccagattgcagaaggctgtgcaaaggtgatgattaagaatctcgagcaagtagtcaatatggttttgaagtccttccaggacccacatccccgagtgcgatgggcagccatcaatgctattggtcagctttcaactgacctgggcccggatttgcaacaacaataccatcagctggttttgcctgcacttgctggagcaatggacgattttcagaatcctagagtgcaggcacacgcagcttcagcagtgctaaactttagtgagaattgtacaccagatattttaacaccctatttggatggaatcgtgagcaagctgcttgttcttttacagaatgggaagcagatggtgcaggagggtgctttgacagctttagcatctgttgctgattcctctcaggagcaatttcagaagtattatgatgcagtcatgccttatttgaaagctatattactaaatgccacagacaaatccaaccgtatgctacgtgccaaggccatggaatgcattagcttagttggaatggctgttgggaaggataaatttagagatgatgctaaacaggtaatggaggtgctcatgacactacaaggatctcagatggaagctgatgacccaaccataagctacatgctacaagcatgggcaagactttgcaagtgtctgggacaggatttccttccctatatgaatgttgttatgcctccactccttcagtctgctcagctaaagccagatgtgaccatcacttctgcagattctgataatgacattgatgattctgatgatgagagtgtggagactattacactcggagataaaaaaattggtatcaagacaagtgttttggaggagaaggctacagcttgtaatatgttatgttgctatgctgatgaactaaaagagggcttctttccatggattgatcaggttgcaccaacactggttcctcttctgaaattttacttccatgaagaagttcgcaaagctgctgtttcagccatgccggagctattgcaatctgccaaactggctgtggagaagggacaggctcagggcagggatcaaacctatgttaagcagttgtcagattacattatacctgccttggttgaagctttgcacaaggagcctgaaactgaaatctgttccagcatgctggatgcattgaatgaatgcatacagatatcaggcaccttacttgatcaaggacaagtaaagtcaatagtggatgaactcaagcaagtcataacagcgagtgcaactagaaagagggaacggacagaaaggactaaagcagaggactttgatgcagaggaaggagaaatacttcaagaggaaaatgagcaggaagaagaagtctttgatcaagttggtgaatgcatcggaacactcattaagacctttaagtcctctttcttgccattctttgatgagctttcttcttatataacacctatgtgggggaaggataaaacagcagaagaaagaagaattgccatctgtatttttgatgatgtggctgaacagtgtcaagaagctgctgtaaaatattatgacacatatctacctttcttactggaagcttgcaatgattctaatgcagatgtgcgacaggctgctgtttatggtattggtgtttgtgctgaatttggtggatccaaattcaagcctcttgttggagaggcactctcaagactgaacgtggtaataactcaaccaaatgctcgagatgctgataatgtaatggcaactgataatgcagtttccgctctagggaaaatctgtcaatttcatcgtgatcgcattgatgcagcgcaggttattcctgcttggctaagttgtttgcctataaaaggtgatgtaattgaagccaaaattgtccatgaacaattgtgttccatggttgagcggtctgatgcagagcttctgggacccaacaatcagtatttacccaaaatagtttctgtatttgccgaggttttatgtgctggcaaggaacttgcaacagagcagactattgctcgcatggtgaatctgttgagacaattacagcaaacactttccccatctgctcttgcttctacttggtcttccctgcaacctcagcagcagttggccttgaattcaattttgtcttcataatttattcacatagagtagccagtgtatgcatttttactcttggtctttaccggacttgtcgtgtggactgaactgctttagcggggtgtcttattggtcattcttttatgtagtcattcatttcaggagggctttctgtaaggcaggtatgcaattgttcaatgtctgaagagttttgttagtcagtcctacgcccataatatgaaatgggtatacatagtgcagagttcttgtatcatattctctcccatctggcagagaaatgtagatgtctttgagatgtgtgttgccatcaaagttaaatgcacgagtttttacaaactcgtattttatttgtcttgtatcttgtggatacgtaaagcgagctgtatgctggaagagaatgctactgtgaaatgccataagcttccttttgtatccagtattctagtgtcaagttggaggcgctatgtagtcgcctacaagaatcattaaaaggcctttgagcaggagattgtcattgga

SEQ ID NO: 5890 - DNA, 4199 bp, Glycine max
aagcggcccaacccagaagccattagaaagaactgtaaaagaaccgtaggataaggaacctgagagaaaggcatatatcgaaacccgccatttaaaatccccccctgaaagtggcaaacccttgcagttttggtcttccctcgctttcttcagagagagagcaagcgatggcgagtgatccgatgcaacaagtggccctaatcctgggcccggactcagcccagctggaatccctaatctcccaattgatgtcttcgtccaaccaccaccgctcccaggcggagtccttattcaacctctgcaagcaggcccgcccggaggccctccttttgggcctggcccatctcctccactcctccccgaaccccgagagccgcaccatgtccgccatcctcctccgccgccacctcacgcgccaccacgactccttcctctggcccctcctctcccctcccgcccgctcctccctccactccctcctcctctcctccctccacaacgagcctctcaaatcaatcaccaagaagctctgcgacaccgtctcagagcttgccgccgccaccctccccgacgacgccgccgcctggcccgacctcctccccctcctcttccagtgggtcacctcccccgacccgaggctccaagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctggtcatccttgcagcctcagcagcagcttgcacttcagtccatcctatcatcctagtagttttggatcgtcaccttcagaagatgcgtgtctattgtcatgggatgtcatagttaccttttcagaagctgctttgtcaggtcaaattcattcctttggcatcttcggagtgtctttttttgaagcagctgtgtctggttcgtgtttcatgattgttgaatccatacttggttttgcaagccaggacttgagtaaggctttgttgcagaggcagagcagtgtcgagttggttggataggaaacagttttggtgtgaaatgtgcatactgtgttatagtcagaaggaattctcaaatgaacagtggctcgatcctgtctgtggatgatggggacgaggcgtgatcctgagtcatgcacgactcaggtaaatcgcatagcattcttttgtttattttgagttgtaacagttttgatgggtcatttcttttggaagttggaaacatattgtcatagtttaattaatttgtatatctgcatgtttctttccctgcgctttttccttcctacgtaccctaagttaggatagggaaaatagaagcgagtagggtagaaagatggaggtggcgaaaaaattaacataacttttaggttctttggagacggcaagcataacacctttcgcaccatgcagaagtacatcgttagattttataaattttgaatccatgggtgtgattttttctc

SEQ ID NO: 5891 - DNA, 4182 bp, Glycine max
aagcggcccaacccagaagccattagaaagaactgtaaaagaaccgtaggataaggaacctgagagaaaggcatatatcgaaacccgccatttaaaatccccccctgaaagtggcaaacccttgcagttttggtcttccctcgctttcttcagagagagagcaagcgatggcgagtgatccgatgcaacaagtggccctaatcctgggcccggactcagcccagctggaatccctaatctcccaattgatgtcttcgtccaaccaccaccgctcccaggcggagtccttattcaacctctgcaagcaggcccgcccggaggccctccttttgggcctggcccatctcctccactcctccccgaaccccgagagccgcaccatgtccgccatcctcctccgccgccacctcacgcgccaccacgactccttcctctggcccctcctctcccctcccgcccgctcctccctccactccctcctcctctcctccctccacaacgagcctctcaaatcaatcaccaagaagctctgcgacaccgtctcagagcttgccgccgccaccctccccgacgacgccgccgcctggcccgacctcctccccctcctcttccagtgggtcacctcccccgacccgaggctccaagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctggtcatccttgcagcctcagcagcagcttgcacttcagtccatcctatcatcctagtagttttggatcgtcaccttcagaagatgcgtgtctattgtcatgggatgtcatagttaccttttcagaagctgctttgtcaggtcaaattcattcctttggcatcttcggagtgtctttttttgaagcagctgtgtctggttcgtgtttcatgattgttgaatccatacttggttttgcaagccaggacttgagtaaggctttgttgcagaggcagagcagtgtcgagttggttggataggaaacagttttggtgtgaaatgtgcatactgtgttatagtcagaaggaattctcaaatgaacagtggctcgatcctgtctgtggatgatggggacgaggcgtgatcctgagtcatgcacgactcaggtaaatcgcatagcattcttttgtttattttgagttgtaacagttttgatgggtcatttcttttggaagttggaaacatattgtcatagtttaattaatttgtatatctgcatgtttctttccctgcgctttttccttcctacgtaccctaagttaggatagggaaaatagaagcgagtagggtagaaagatggaggtggcgaaaaaattaacataacttttaggttctttggagacggcaagcataacacctttcgcaccatgcagaagtacatcgttagattttataaattttgaatccat

SEQ ID NO: 5892 - DNA, 4196 bp, Glycine max
gaaagcgcattggaactgtaaaaaaaccgtaggttaggaacctgagagaaacggatatatcgaaacccgccatttaaaatccctccctcagcaacacaaacccaaacccttggcgttttcgtcttccctcgcattcttcagaacacagagagagggatggcgagcgattcgattcagcagagcgaagcccaagtggcgctaatcctgggcccggactcggcccacctggaatccctaatctcccaattgatgtcttcctccaacgaccagcgctcccaggcggagtccctcttcaacctctgcaagcaggcccgccctgaggccctcttattgggcctggcccacctcctccactcctccccgaacccggagacccgcaccatgtccgccatcctcctccgccgccacctcacgcgccaccacgactccttcctctggcctctcctctcccccccggcccgctcctccctccactccctcctcctctcctccctccacaacgagcccctcaaatccatcaccaagaagctctgcgacaccgtctccgagctcgccgccgccaccctccccgacgactctgccgcctggcccgacctcctccccctcctcttccagtgggtcacctcccccgaccccaggctccaagaaatctcgctccttattttcgcccaattggctcattacatcggccaaaccctactccctcaaatctccactctccactccgtcttcctccgctcccttcactcctccacccccgccgacgtccgcatcgccgccctcgccgccgccatcaacttcatccaatgcctcacgaattcctccgacagagaccgcttccaagacctcctccctctcatgatgcagaccctcaccgaggcgctgaactccggccaggaggccgtcgctcaggaggcgcttgagcttctcatcgagctcgctggcaccgagccgcgcttcctccggcgacaaattgtcgacgtcgtggggtccatgttacaggtcgcagaagctgagactttggaggaaggaacacggcacttggcgattgagtttgtggttactctcgccgaggcaagggagcgtgctcccggcatgatgaggaagtttccacagtttgtgaggaagctttttggtgtgttgatgaatttggtgcttgatatcgaggatgatcctgcgtggcacggtgcagtggatgaggatgaggacgccggcgagacgagtaactatggctttggacaggagtgtctggataggctttcgatttcgctcggtgggaacaccattgtgccggttgcctctgagttgctgcccacctacttggctgctcctgagtgggaaaagcaccatgctgcgctcattgctcttgcgcaaatcgccgagggttgttccaaggttatgataaagaatctggagcaggtattgtcaatgattttgaattcatttcgtgatcctcaccctcgagtgcgatgggcagctataaatgcaattgggcagttgtccacggatttggggccagacttgcaggttaaatttcaccacttagtgcttccggctttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgacagccttagcatctgttgcagattcttcagaggtgcaatttcagaagtattatgatgctgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaacttaagcccgatgtgaccattacatcagcggattctgatactgaatttgatgaagatgatgacagcattgaaacaattacacttggggataaaaggataggcattaagactagtgtgttggaggagaaggccactgcttgtaacatgctatgttgctatgctgatgagttgaaggaaggattttttccttggattgaccaggttgctttcacattggttcctcttcttaaattttacttccatgaagaagttaggaaggcagcagtttcagccatgccggaactgttgtcctcggcaaaatcagctgtagtgaagggacaatcacaaggtcgtgatgagacttatgtgaaacagctttctgattatataataccaaatttggtggaggctttacacaaggagccagaagtagaaatttgtgcaagcatgttggatgcattgaatgaatgcatacaggtctctggatcacatctagatgaaaagcaagttcggagcattgttgatgagattaaacaagtccttacggccagttcatcaagaaaacatgaaagagcagagagggccaaagaagaggactttgatgctgaagaaagagaactactcaatgaagaaaatgagcaagaagaggagctttttgatcaagttggtgattgcttgggaactttgataaaaacattcaggacatctttcttgcctttctttgatgagctgtcctcatacctaacacctttgtttggtaaagacaaaacctcagaggaaaggagaattgccatttgtatatttgatgatgttgctgagcacggtcgtgaagccgctcttaaatattatgattcttttcttccattcttactcgaagcttgcaatgatgaatatcccgatgttcgacaggctgctgtttatggtgttggtgtttgtgctgagtttggtggatctgttttcagcccccttgttggagaggcactttcaaggttagatgctgtgataaggcatccaaatgcactacatgctgataacataatggcatatgacaatgccgtctcagctcttggaaaaatatgccaattccatcgtgatagcataaatgcagcacaggttgttcctgcctggctaagttgcttgcctataaaaggtgatttaattgaagctaaggttgtgcatgaccaactttgttcaatggttgaaagatctgatagagaacttataggtcccaacaatcaatatctttccaaaattgttgcagtttttgccgagattttatgtgcgggaaatgatctggctaccgaacagactgttagtaggatgattaatttattgaggcagcttcaacagactttaccaccttctacccttgcttcaacctggtcatccttgcagcctcagcagcagcttgcacttcagtccatcctatcatcctagtagttttggtcagaagatgcgtgtctattgtcatgggatgtcatagttaccttttcagaagctgctttgtcaggtcaaattcattccttagcatcattggagtgtctttttttgagaagcagctgcgtctggttcgtgtttcatgattgctgattccatacttggttatgcaagccaggacttgaggtatggctttgtcacagaggcagagcattgttgagttggtttggatgggaaacagttttggtgtgaaatgtgtatactgtgttatagtcagaaggaattctcaaatgaacagtgactcgatcctgtctgtggatgatggggacgaggcgtgaccctgagtcatgcatggctcaggcaaatcgcatagcattcttttgtttatttttgagttgtaacagttttgatgggtcatttcttttggatgttggaagcaaattgtcatagttaaattaatttgtatatctgcatgcttctttccctgcgcttttccttcctatcacgtatcctatgttaggatagagaaaatagagatgagtagggcagaaagctgtaggtggcgaaaaagttaactttaggtttgtttggagacacggtgtctagggtgcacaagcataactcctttcgcaccatgcaaaagtatttcttcaccgttaaattttataaattttgaatccatg

SEQ ID NO: 5893 - DNA, 4092 bp, Glycine max
aacccttggcgttttcgtcttccctcgcattcttcagaacacagagagagggatggcgagcgattcgattcagcagagcgaagcccaagtggcgctaatcctgggcccggactcggcccacctggaatccctaatctcccaattgatgtcttcctccaacgaccagcgctcccaggcggagtccctcttcaacctctgcaagcaggcccgccctgaggccctcttattgggcctggcccacctcctccactcctccccgaacccggagacccgcaccatgtccgccatcctcctccgccgccacctcacgcgccaccacgactccttcctctggcctctcctctcccccccggcccgctcctccctccactccctcctcctctcctccctccacaacgagcccctcaaatccatcaccaagaagctctgcgacaccgtctccgagctcgccgccgccaccctccccgacgactctgccgcctggcccgacctcctccccctcctcttccagtgggtcacctcccccgaccccaggctccaagaaatctcgctccttattttcgcccaattggctcattacatcggccaaaccctactccctcaaatctccactctccactccgtcttcctccgctcccttcactcctccacccccgccgacgtccgcatcgccgccctcgccgccgccatcaacttcatccaatgcctcacgaattcctccgacagagaccgcttccaagacctcctccctctcatgatgcagaccctcaccgaggcgctgaactccggccaggaggccgtcgctcaggaggcgcttgagcttctcatcgagctcgctggcaccgagccgcgcttcctccggcgacaaattgtcgacgtcgtggggtccatgttacaggtcgcagaagctgagactttggaggaaggaacacggcacttggcgattgagtttgtggttactctcgccgaggcaagggagcgtgctcccggcatgatgaggaagtttccacagtttgtgaggaagctttttggtgtgttgatgaatttggtgcttgatatcgaggatgatcctgcgtggcacggtgcagtggatgaggatgaggacgccggcgagacgagtaactatggctttggacaggagtgtctggataggctttcgatttcgctcggtgggaacaccattgtgccggttgcctctgagttgctgcccacctacttggctgctcctgagtgggaaaagcaccatgctgcgctcattgctcttgcgcaaatcgccgagggttgttccaaggttatgataaagaatctggagcaggtattgtcaatgattttgaattcatttcgtgatcctcaccctcgagtgcgatgggcagctataaatgcaattgggcagttgtccacggatttggggccagacttgcaggttaaatttcaccacttagtgcttccggctttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgacagccttagcatctgttgcagattcttcagaggtgcaatttcagaagtattatgatgctgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaacttaagcccgatgtgaccattacatcagcggattctgatactgaatttgatgaagatgatgacagcattgaaacaattacacttggggataaaaggataggcattaagactagtgtgttggaggagaaggccactgcttgtaacatgctatgttgctatgctgatgagttgaaggaaggattttttccttggattgaccaggttgctttcacattggttcctcttcttaaattttacttccatgaagaagttaggaaggcagcagtttcagccatgccggaactgttgtcctcggcaaaatcagctgtagtgaagggacaatcacaaggtcgtgatgagacttatgtgaaacagctttctgattatataataccaaatttggtggaggctttacacaaggagccagaagtagaaatttgtgcaagcatgttggatgcattgaatgaatgcatacaggtctctggatcacatctagatgaaaagcaagttcggagcattgttgatgagattaaacaagtccttacggccagttcatcaagaaaacatgaaagagcagagagggccaaagaagaggactttgatgctgaagaaagagaactactcaatgaagaaaatgagcaagaagaggagctttttgatcaagttggtgattgcttgggaactttgataaaaacattcaggacatctttcttgcctttctttgatgagctgtcctcatacctaacacctttgtttggtaaagacaaaacctcagaggaaaggagaattgccatttgtatatttgatgatgttgctgagcacggtcgtgaagccgctcttaaatattatgattcttttcttccattcttactcgaagcttgcaatgatgaatatcccgatgttcgacaggctgctgtttatggtgttggtgtttgtgctgagtttggtggatctgttttcagcccccttgttggagaggcactttcaaggttagatgctgtgataaggcatccaaatgcactacatgctgataacataatggcatatgacaatgccgtctcagctcttggaaaaatatgccaattccatcgtgatagcataaatgcagcacaggttgttcctgcctggctaagttgcttgcctataaaaggtgatttaattgaagctaaggttgtgcatgaccaactttgttcaatggttgaaagatctgatagagaacttataggtcccaacaatcaatatctttccaaaattgttgcagtttttgccgagattttatgtgcgggaaatgatctggctaccgaacagactgttagtaggatgattaatttattgaggcagcttcaacagactttaccaccttctacccttgcttcaacctggtcatccttgcagcctcagcagcagcttgcacttcagtccatcctatcatcctagtagttttggtcagaagatgcgtgtctattgtcatgggatgtcatagttaccttttcagaagctgctttgtcaggtcaaattcattccttagcatcattggagtgtctttttttgagaagcagctgcgtctggttcgtgtttcatgattgctgattccatacttggttatgcaagccaggacttgaggtatggctttgtcacagaggcagagcattgttgagttggtttggatgggaaacagttttggtgtgaaatgtgtatactgtgttatagtcagaaggaattctcaaatgaacagtgactcgatcctgtctgtggatgatggggacgaggcgtgaccctgagtcatgcatggctcaggcaaatcgcatagcattcttttgtttatttttgagttgtaacagttttgatgggtcatttcttttggatgttggaagcaaattgtcatagttaaattaatttgtatatctgcatgcttctttccctgcgcttttccttcctatcacgtatcctatgttaggatagagaaaatagagatgagtagggcagaaagctgtaggtggcgaaaaagttaactttaggtttgtttggagacacggtgtctagggtgcacaagcataactcctttcgcaccatgcaaaagtatttcttcaccgttaaattttataaattttgaatccatg

SEQ ID NO: 5894 - DNA, 3784 bp, Podocarpus macrophillus
cctcggagaagggcgagacctgtattgctctcgtcttgcgtttcctttgattagggttttgtttgaagcgatggaacaggcgcagattaatgccgtgctgggagccgatccctcggcgttcgaggcgctgatgacgcacctcatgagcgctggcaacgagcaacgtggccaagcggaggcgttgttcaatctatgcaaagaaaacaccccgatgccctggcgctgaaactcgttcacgtcctccagtcatgcgccacggtagagatcagggccatggcggcgatcctacttcgcaaacagatcacccgcgacgaaacatatatctggccacgcctcgcccccgctacgcagaccgcggtcaaggcccacctccttctctgcgtccagcgtgaagaagtcaagaccatagtcaagaaactctgcgacaccgtagcggagctcgccgcctctatactagacgaaggtcaatggccggagctcttgcccttcatgttccagtgtgttagctccgattcaccgcggcttcaggagagcgcgttgctcatgttcgcgcaactttcgcagtacatcggagagcatctacagccgcacctggcaacgcttcatgcggtgtttaggcagtgcctatcgccgccctcgcccacggacgtgcgcatcgcggcgctgggcgcaactacgaattttgtgcagacgatcgagtctcagcaggaaagagagttgtttcaagacctgttgcctgcgatgatgcagacgctcacggaggcgcttaaccgccacgaggaagccacggcgcaggaggcgctggagatgtttattgagctcgccggcaccgagccaagattcctccgccgccagatcgtggacgttgtcggcagcatgttacagattgcggaggctgagtcgcttgaggaaggtacacggcatctagctattgagttcattattacgctcgctgaagccagggagcgcgcacctgggatgatgcggaagctgccgcagtttattgggaggctgtttgctattcttatgaagatgttgctggatatagaggatgatcccgcttggcatgcggccaataccgaggatgaggatgcaggggagtcgagtaattacaatgttgggcaggagtgcttggatcgcttggcgatatcgttagggggaaatacgattgtgcctgttgcgtcggagttgttgccggcttatttggcggatcctgattggaagaaacatcatgctgcacttattacacttgctcaaatcgcagaaggttgtgccaaggtgatgttaaaaactctggagcaagttgtcaatatggttttgaattcttttcaagatccacatgctcgagtgcgatgggcagccattaatgcaattggtcagctgtcaacagacttggggcctgacttgcaacaacaatatcaccaacgagttttgcctgcactcgctggagccatgaatgattttcaaaaccctagagtacaggctcatgcagcttcagcagttctcaacttcagcgaaaattgtacaccagatattttaacaccatatttggatggaatagttagcaagctgcttgttcttttacagaatgggaagcagatggttcaggagggtgctttaacagctttagcttctgttgctgattcatctcaggagcaatttcagaaatattatgaagtggttatgccttatttgaaagccatactactcaatgctacagacaaatctaaccgtatgctgcgggccaaggctatggaatgtattagcctagttggaatggcagttggaaaggagaagtttagagatgatgctaaacaggtcatggaggttttgatgacattgcaaggatcccagatggaggctgatgatccaacaataagctacatgctacaagcatgggcaagactttgcaagtgtttgggacaagatttccttccttatatgagtgtggtgatgcctccacttcttcagtctgcccagctgaagccagatgtgaccatcacctctgcagattctgataatgacattgatgattccgatgatgagagtgtggagactattactctgggagataaaaaattggtatcaagacaagtgttttggaggagaaggctacagcatgcaacatgctgtgttgttatgctgatgaactaaaagaaggcttctttccatggattgatcaggttgcaccaacactggttcctctactgaaattttatttccatgaagaagttcgtaaagctgctgtttcagcaatgccagagctgttgcagtctgctaaattggctgtggagaaaggacaggcccagggcagggatcatacctacatcaagcaattgtcagattacattatacctgccttggttgaagctttgcataaggagcctgaaactgaaatttgttcaagcatgctagatgcattgaatgaatgcatacagatatctggtaccttgcttgatcaaggacaagtaaagtcaattgtggatgaactcaagcaagttataacagccagtgcaactagaaagagggaacggacagaaaggactgcagcagaggactttgatgcagaggaaggggagatacttcaagaggaaaatgaacaggaagaagaagtatttgatcaagttggcgaatgcataggaacgctcattaagacatttaagagttcattcttgccattctttgaggagctttcttcttatataacacctatgtgggggaaggataaaacagcagaagaaagaagaattgcgatttgtatttttgatgatgtagctgagcagtgtcaggaagctgctgtaaaatattatgacacatatctacctttcttacttgaagcttgcaatgatcctaatccagatgtgcggcaggctgcagtttatggtattggtgtctgtgccgaatttggtgggtccaaattcaaacttcttgttggagaggcactgtccagactgaatgtggtgataagtcagccgaatgcacgggattctgataatgtcatggcaacggataatgcaatttctgctctagggaaaatctgtcaatttcatcgtgacagcattgatgcagcacaggttattcctgcttggctaagttgcttgcctatcaaaggtgatttgattgaagccaaaattgtccatgaacaattgtgttccatggttgagcggtctgatacagaacttcttggacccaacaatcagtatttacccaaaatagtttctgtatttgcagaggttttctgtgctggcaaggaccttgccactgagcagactatagctcgtatggtgaatctcttaagacaattacagaagacactttctccttctgctcttgcatctacatggtctacattgcaacctcagcagcaattggccttgcaatcagttttgtcatcataattttgcctcttttttactctttgatctgtatgggacttgtgttggctgaacttctaagttgggtgtcttattgctcattcttttatgtagttattcatttcacgagggctttctctaaggcagtatgaagttattcaatgtcgaaaagttttgtcagttctatgtgcccaaaaatataaaatgggtttacatggtgcagagttcttgtattataatctttgccacttggcagagaaatgtagatgtctttgaaatgtgtctcggtgtcaaaagttcagtgcaagagtttttgtgaacagtttgtcttgtatcttagatgcagaaattgagctatatgcaggaggagaatgctattgtttaattacaagcttccttttgtatctggc

SEQ ID NO: 5895 - DNA, 3946 bp, Phaseolus vulgaris
ttttggtcttccctcgctttcttcacagagagagatggcgaacgatcccagacagaacgaagcccaagtggcgttaattctgggtccggattcaactcatctggaatccctaatttcacagttaatgtgtacctccaacgagcagcgctctcaggcggagtctctcttcaacctctgcaagcaggcccgtccggaatccctcctcctcgccctggcccacctcctccacaccgcccccaacccggagacccgcaccatgtccgctatcctcctccgccgccacctcacgcgccaccacgactccttcctctggcctctcctctcccccgccgcccgctcctccctccactcccttctcctctcctccctccaacaagagcccgtcaaatccattgccaagaagctctgcgacaccgtctccgagctcgccgccgcaattctccccgaagaccccgccgcctggcccaacctcctccccctcctcttccagtgggtcacctcccccgaacccaggcttcaggaagtcgcgctcctcatattcgcccaattagcacactacatcggtcaaaccctactccctcaattgtccactctccactccgtcttcctccgctgcctccactcctccaccccatccgacgtccgtatcgcctccctcgccgcctccatcaacttcatccagtgcctcaccagttccgctgaccgcgaccgcttccaggacctcctccctctcatgatgcagacgctcaccgaggcactgaactccggccaggaggccgttgcgcaagaggcgctcgagcttcttatcgagctcgccggtaccgagccgaggttcctccgccgccagattgtcgacgtcgtgggcgccatgctgcaggtcgcggaagctgaggccttggaggaagggacgcggcacttggcgattgagtttgttgtcactcttgccgaggccagggaacgcgcccctgggatgatgaggaagttgccgcaatttgtgaggaagctttttggcgtgttgctgaatttgttgctggatattgaggatgctcctgcgtggcacgctgcagtggacgaggaagaggatgcgggtgagaccagtaactatgggtttggacaggagtgtttggataggctttcgatttctcttggcgggaacaccattgtgcctgttgcttctgagttgttgcccacttacttgtctgctcctgagtgggaaaaacaccatgctgcactcattgcgcttgcgcagattgcggagggttgttcgaaggtgatgataaagaatctcgaacaggtattgtcgatgattttaaattcattttgtcatccccatcctcgagtgcgatgggcagctataaatgcaattgggcagttgtccacggatttggggccagatttgcaggttaaatttcatcacttagtgctgccggctttggctggtgctatggatgattttcaaaatccaagagtgcaggcacatgctgcttctgctgtgctaaatttcactgagaattgtacccctgatattctaacgccttacttagaagggattgtgagcaaacttttggtactcttgcagaatggcaagcaaatggttcaagaaggggctttgacagctttggcatcagttgcagattcttcacaggagcaatttcagaagtattatgatgctgtgatgccatacttaaaagctattcttgttaatgcaaatgataaatctaatcgaatgcttcgagccaaagctatggagtgcattagtttggtagggatggctgttggaaaggagaagttcagggatgatgccaaacaggtcatggatgtcttgatgtcactgcaacagtctcaactggatcctgatgatccaactgctagttacatgttacaagcatgggcacggctttgcaagtgccttgggcaggattttctcccatatatgggttttgtgatgcctcctttgatccagtctgcacaacttaaacctgatgtgaccattacatctgcagattctgatactgaatttgatgaagatgatgacagcattgaaacaattacacttggggataaaaggataggcattaagactagtgtcttggaggagaaggctactgcttgtaatatgctatgttgctatgctgacgagttgaaggaaggattttttccttggattgaccaggttgctttcacattggttcctcttcttaaattttacttccatgaagaagtcaggaaggcagcagtttcagccatgccagaactgttaacctcagcgaaatcagctgtagagaagggacaatcacagggtcgtgatgagacttacataaagcagttatctgattatataataccaaatttggtggaggctttacacaaggagccagaagtagaaatttgttcaagcatgttggacgcattgaatgaatgcatacaggtctctggaccacatctagatgaaaagcaagtgcggagtattgttgacgagattaaacaagttcttacagccagttcaacaagaaaacatgaaagagcagagagggccaaagaagaggactttgatgctgaagaaagagagctactcaaggaagaaaatgagcaagaagaggatctttttgatcaagttggtgattgcttgggaactttgataaaaacattcaggacatccttcttgcctttctttgatgagctatcctcatacataacacctatgtttggtaaagataaaacctcagaggaaaggagaattgccatttgtatatttgatgatgttgctgagcactgtcgtgaaactgccctcaaatattacgattctttccttccattcttactagaagcttgcaatgatgaatatccagatgttcgacaggctgctgtttatggtgttggtgtttgtgctgagtttggcggatctgttttcaaaccccttgttggagaggcactctcgaggttagatgctgtgataaggcatccaaatgcacaactttctgataacgtaatggcatatgacaatgctgtttcagctcttggaaaaatatgccagtttcaccgtgatagcataaatgcgacacaggttgttcctgcctggctgagttgcttgcctataaaaggtgatttaattgaggctaaggttgtgcacgaccaactttgttcaatggttgaaagatcagatagagaacttataggtcccaacaatcaatatcttcccaaaattgtcgcagttttcgctgagattttatgtgcgggaaatgatctggcaactgaacaaactgtgagtcggatgattaatctattgaggcagctacaacagactttgccaccttcaacccttgcttcaacctggtcttccttgcagcctcagcagcagcttgcacttcagtccatcctctcatcctagttattttagattgtcaccttcagaagttgcacctctgttgtcatgtgatgtcattgttgctttttcagaagctgcattgtcaggtcaagttcattcctttagcaagacaggacttgtgaggtatggggttgtcgcagaggcagagcagtgttgcgttggttggatgggaaacagttttggtgtggaatgtgtatactatgttacagtcagaaggaattctgaaatgaacagggactccatcctgtctggatcatggggacggggcttgaccctgagtcatgcatcgcaaagatcgcatagcattcttttgtttatttttagttgtaacagttttgatgggtcgtttgtttctttggaaggtcggaaacagtttgtcatgtttaatttatttgtatatctgcatgctttttttccttttgcgttacccctcacctgctaatattctgatacaaaaaaggagtaacaaaatataacttttaggttgtttggattctcagaaaaagttgttacaaagtaatcttcattcgttcgcttctataaagtaatgagaagaaaaaa

SEQ ID NO: 5896 - DNA, 4162 bp, Phaseolus vulgaris
aaggggtgaaaggataaaccgcaattgaagtgtaaaaaaccgtaggagaagaaacctgagagaagcgcatatccaaaggcaacccgccatttaaaatccctggctcaaacatatcacaaacacaaaacacaaacccttgccgttccacctttgtttttggtcttccctcgctttcttcactcgtgttctctctacacaccacaccacacttgcacacttgctgaatttgtgaaaccttgaattcctctcttgttgaattcttaatctctacaacacagagagagatggcgaacgatcccagacagaacgaagcccaagtggcgttaattctgggtccggattcaactcatctggaatccctaatttcacagttaatgtgtacctccaacgagcagcgctctcaggcggagtctctcttcaacctctgcaagcaggcccgtccggaatccctcctcctcgccctggcccacctcctccacaccgcccccaacccggagacccgcaccatgtccgctatcctcctccgccgccacctcacgcgccaccacgactccttcctctggcctctcctctcccccgccgcccgctcctccctccactcccttctcctctcctccctccaacaagagcccgtcaaatccattgccaagaagctctgcgacaccgtctccgagctcgccgccgcaattctccccgaagaccccgccgcctggcccaacctcctccccctcctcttccagtgggtcacctcccccgaacccaggcttcaggaagtcgcgctcctcatattcgcccaattagcacactacatcggtcaaaccctactccctcaattgtccactctccactccgtcttcctccgctgcctccactcctccaccccatccgacgtccgtatcgcctccctcgccgcctccatcaacttcatccagtgcctcaccagttccgctgaccgcgaccgcttccaggacctcctccctctcatgatgcagacgctcaccgaggcactgaactccggccaggaggccgttgcgcaagaggcgctcgagcttcttatcgagctcgccggtaccgagccgaggttcctccgccgccagattgtcgacgtcgtgggcgccatgctgcaggtcgcggaagctgaggccttggaggaagggacgcggcacttggcgattgagtttgttgtcactcttgccgaggccagggaacgcgcccctgggatgatgaggaagttgccgcaatttgtgaggaagctttttggcgtgttgctgaatttgttgctggatattgaggatgctcctgcgtggcacgctgcagtggacgaggaagaggatgcgggtgagaccagtaactatgggtttggacaggagtgtttggataggctttcgatttctcttggcgggaacaccattgtgcctgttgcttctgagttgttgcccacttacttgtctgctcctgagtgggaaaaacaccatgctgcactcattgcgcttgcgcagattgcggagggttgttcgaaggtgatgataaagaatctcgaacaggtattgtcgatgattttaaattcattttgtcatccccatcctcgagtgcgatgggcagctataaatgcaattgggcagttgtccacggatttggggccagatttgcaggttaaatttcatcacttagtgctgccggctttggctggtgctatggatgattttcaaaatccaagagtgcaggcacatgctgcttctgctgtgctaaatttcactgagaattgtacccctgatattctaacgccttacttagaagggattgtgagcaaacttttggtactcttgcagaatggcaagcaaatggttcaagaaggggctttgacagctttggcatcagttgcagattcttcacaggagcaatttcagaagtattatgatgctgtgatgccatacttaaaagctattcttgttaatgcaaatgataaatctaatcgaatgcttcgagccaaagctatggagtgcattagtttggtagggatggctgttggaaaggagaagttcagggatgatgccaaacaggtcatggatgtcttgatgtcactgcaacagtctcaactggatcctgatgatccaactgctagttacatgttacaagcatgggcacggctttgcaagtgccttgggcaggattttctcccatatatgggttttgtgatgcctcctttgatccagtctgcacaacttaaacctgatgtgaccattacatctgcagattctgatactgaatttgatgaagatgatgacagcattgaaacaattacacttggggataaaaggataggcattaagactagtgtcttggaggagaaggctactgcttgtaatatgctatgttgctatgctgacgagttgaaggaaggattttttccttggattgaccaggttgctttcacattggttcctcttcttaaattttacttccatgaagaagtcaggaaggcagcagtttcagccatgccagaactgttaacctcagcgaaatcagctgtagagaagggacaatcacagggtcgtgatgagacttacataaagcagttatctgattatataataccaaatttggtggaggctttacacaaggagccagaagtagaaatttgttcaagcatgttggacgcattgaatgaatgcatacaggtctctggaccacatctagatgaaaagcaagtgcggagtattgttgacgagattaaacaagttcttacagccagttcaacaagaaaacatgaaagagcagagagggccaaagaagaggactttgatgctgaagaaagagagctactcaaggaagaaaatgagcaagaagaggatctttttgatcaagttggtgattgcttgggaactttgataaaaacattcaggacatccttcttgcctttctttgatgagctatcctcatacataacacctatgtttggtaaagataaaacctcagaggaaaggagaattgccatttgtatatttgatgatgttgctgagcactgtcgtgaaactgccctcaaatattacgattctttccttccattcttactagaagcttgcaatgatgaatatccagatgttcgacaggctgctgtttatggtgttggtgtttgtgctgagtttggcggatctgttttcaaaccccttgttggagaggcactctcgaggttagatgctgtgataaggcatccaaatgcacaactttctgataacgtaatggcatatgacaatgctgtttcagctcttggaaaaatatgccagtttcaccgtgatagcataaatgcgacacaggttgttcctgcctggctgagttgcttgcctataaaaggtgatttaattgaggctaaggttgtgcacgaccaactttgttcaatggttgaaagatcagatagagaacttataggtcccaacaatcaatatcttcccaaaattgtcgcagttttcgctgagattttatgtgcgggaaatgatctggcaactgaacaaactgtgagtcggatgattaatctattgaggcagctacaacagactttgccaccttcaacccttgcttcaacctggtcttccttgcagcctcagcagcagcttgcacttcagtccatcctctcatcctagttattttagattgtcaccttcagaagttgcacctctgttgtcatgtgatgtcattgttgctttttcagaagctgcattgtcaggtcaagttcattcctttagcaagacaggacttgtgaggtatggggttgtcgcagaggcagagcagtgttgcgttggttggatgggaaacagttttggtgtggaatgtgtatactatgttacagtcagaaggaattctgaaatgaacagggactccatcctgtctggatcatggggacggggcttgaccctgagtcatgcatcgcaaagatcgcatagcattcttttgtttatttttagttgtaacagttttgatgggtcgtttgtttctttggaaggtcggaaacagtttgtcatgtttaatttatttgtatatctgcatgctttttttccttttgcgttacccctcacctgctaatattctgatacaaaaaaggagtaacaaaatataacttttaggttgtttggattctcagaaaaagttgttacaaagtaatcttcat

SEQ ID NO: 5897 - DNA, 4459 bp, Cajanus cajan
accctcaattcccatggccaccgatcggaggcagagcgaggcccaagtggcccttatcctggggccggattccagccacctggaatccctaatctcgcacttgatgtcttcatccaacgaggaacgctcccaggcagagtccctcttcaacctctgcaaacagactcacccggagtccctcctcatgggcctcgcccacctcctacactcctcccctaatccagagactcgcaccatgtccgccatcctcctccgccgccacctcacgcgccaccacgacgccttcctctggcccctcctctccccctccgcccgctccacgctccactccctcctcctctcctccctccacaaagagcctctcaaatccatcgccaagaaactttgcgacactgtttccgaactagccgccgccatcctcccggaggacgccgccgcctggcccgacctcctcccgctcctctttcagtgggtaacatcccccgaggcgcggctgcaggaaatctcgctcctcgtcttcgcgcaattggcgcattacataggccaaaccctactccctcaattgtccactctccactcggttttcctccgctgcctccactcctccacgccctccgacgtccgcatcgccgccctcgccgccagcatcaacttcgtccagtgcctctctagtccttccgaccgggaccgcttccaggacctgctccctctcatgatgcagacgctcaccgaggcgctcaactccggccaggaggccgtcgcgcaggaggcgctcgagcttctcatcgagctcgccggcaccgagccgcggttcctccgccgccagattgcggacgtcgtcggcgccatgctgcaggtcgccgaggccgaggccttggaggaggggactcgccacttggctatcgaattcgtcgtgaccctcgccgaggccagggaacgtgcccctgggatgatgagaaagttgccgcagtttgtgaggaagctctttggcgtgttgatgaatttgttgctggatatcgaggatgatccggcgtggcatgctgcagtggatgaggatgaggatgcgggtgagacaagtaactatgggtttggacaggagtgtttggataggctttccatatcgttgggtggcaacactattgtgccggttgcttctgagttgctgccaactttcttggctgctcctgagtggcaaaagcaccatgctgcgctcattgcacttgcgcagattgcggagggttgttcaaaggtgatgataaagaatctggagcaggttttgtcaatgattttaaattcatttcacaatccccatcctcgagtgcgttgggcagctataaatgcagttgggcaattgtccacagatttggggccagacttgcaggttaaatttcaccacttagtgctgcctgcgttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgaccgctttagcatcagtggcagattcttctcaggtgcaatttcagaagtattatgatgctgtgatgccatacttaaaagctattctggtgaatgcaaatgataaatctaatcgtatgcttcgtgccaaagcaatggagtgcattagtttggtaggaatggctgttggaaaggataagttcagggaagatgccaaacaggtaatggatgtcttgatgtcactgcaacaatcccaactggatgctgatgatccaactgcaagttacatgttacaagcatgggcacggctttgcaagtgccttggacaggattttctcccatatatgggttttgtgatgcctcctttgctccagtctgcacaactaaagcctgatgtgaccattacatcagcagattctgatactgaatttgatgaagatgatgacagcattgaaacaatcacacttggggataaaaggataggcatcaagactagtgtcttggaggagaaggctactgcatgtaacatgctatgttgctatgctgatgagttgaaggaaggattttttccatggattgaccaggttgctttcacattggttcctcttcttaaattttactttcatgaagaagttaggaaggcagcagtttcagcaatgccggaactgttgtcctcagcaaaatcagctgttgagaagggacaatcacaaggtcgtgatgagacttatgtaaaacagttgtctgattatataataccaaatttggtggaggctttacacaaggagccagaagtagaaatttgtgctagcatgttggacgcattgaatgaatgcatacaggtctctggaccacatctagaagaaaagcaagtacggagcattgttgatgagattaaacaagtccttacagccagttcatcaagaaaacatgaaagagcagagagggctaaagaagaggacttcgatgctgaagaaagagaactactcaaggaagaaaatgagctagaagaggaactttttgatcaaattggtgattgcttggggactttgataaaaacattcagggcatctttcttgcctttctttgaggagttgtcctcatacctaacacctatgtttggaaaagataaaacctcagaggaaaggagaattgccatttgtatatttgatgatgttgctgagcactgtcgtgaagccgctcttaaatattatgattcttaccttccatttttacttgaagcctgcaatgatgaatatccagatgttcgacaggctgctgtttatggtgttggtgtttgtgctgagtttggtggatctgttttcaaaccccttgttgtagaggcactttcaaggttagatgctgtgataaggcatccaaatgcacaacattctgataacataatggcatatgacaatgccgtttcagctcttggaaaaatatgccagttccaccgtgatagcataaatgcaacacaggttgttcctgcctggctaaattgcttgcctataaaaggtgacgtaattgaggctaaggttgtgcatgaccaactctgttcaatggttgaaaggtcagatagagaacttataggtcccaacaatcaatatcttcccaaaattgttgcagtgtttgccgagattttgtgtgccggaaatgatctggcaactgaacaaacggtcagtcggatgattaatttattgaggcagcttcaacagactctgccaccttctacccttgcttcaacctggtcatccttgcagcctcagcaacagcttgcacttcagtccatcctatcatcctagtagttatgttggatgcgcgtctgtattgtcatagttgcctttgggaagcttctttgtcaggtcaacttggttctgttagcagctgcgtctggttcgtgtttcatgattgcggaatccatgcttcaggacttgtggctttgtcacacaggcagagcagtgttgagttggttggatgagaaacagttttggtgtggaatgtgtatactgtgttatggtcacagtgactcgatcctgtcttttggatgatggggacgaggcgtgaccgagtcatgcgtggctcgggaaaatcgcatagcattctttggtttatttggagttgtaacagttttggtgggtcttttttgggattcggaaacattttcatagtttaattaatttgtatatccgcatgtttgcgcttcccttccattatcacgtacattatgtttggatagggaaaatagagataagtagggtggatagagatgaaaaaataacttaatatttaggttgtggtttgagagaaaaaattaacgaagagaagggttatttaaaagtttatctttttcactttgattggataaaaaactctaaaaaatgtgttaaaaagcatgtgttcttgcatgaaatcattcattcatatggtaactaagtgaaaggagagaagaataaactcaattttttttttgaaaaaaaatgtcatctttatctccattttactgaagagtgatttagcagttatttaattatttgcttattttattattatgttattattgttattattcgcagttcgaaggcacaactggttttttttattctcttcatttcctatccttttttttattttttattttatactttcaatggagccaacttcaaacccacattcatttatggagattgcaaattaaggtaagtatatatgcatatttaaacatgtataaagattttgtgtggtatcttgtttgagttcgtaatttatgttttattttactatcatttatttttcatgtaatatataattatagttaactggtaatcgttattgtggcttgtttctgtcattttctcgacatcctaaattcatttttggatatttcaaaatgggaa

SEQ ID NO: 5898 - DNA, 4192 bp, Cicer arietinum
aagaaagtcgagggagccgcatcaccccgccattcaaataagaaacagaaaccctcgttgcgttttctctcattctttcttttcgactttcgagcgaggctcacccactcttccctccctttctttatatctctctctctctcttctctatccactccaataacactattcaactccgcaaccctttctctctcaatttcatcaatggcgaacgatccaaatcaaactcaaatggctctaattctaggacaggattcaactcacttggaatccctaatcacaaacctcatgtcctcctccaacgaccaacgttcccaagccgaaaacctcttcaacctctgcaaacaaacctaccctgattccttaatccttaaactctctcaacttcttcacacttcccctaaccaagaaacacgtaccatgtccaccatccttctccgccgtcacctcacgcgccaccatgatgaatcctttatttacccacacctttcaccttcaactcaatccaccctccgttccctcctcctctcgtctctccatcaagagccagtcaaatcaatcgctaaaaaactttgcgacactgtttccgaacttgcctccgctcttctctccgatgaccttgcttcctggcctgaccttcttccgcttctttttcagtgggttactgcatctgacactaggcttcaggaaatttctttacttgtgttcgctcaattggctcattatatcggtgaaaccctacttcctcaattgtccacccttcactctgttttcctccgctgcctcggtgcttccacctctgccgatgtccgtatcgctgcccttgccgctagtatcaacttcgttcagtgcctctccaatccctccgaccgcgacaggtttcaggatttgcttcccctcatgatgcagacattgactgaggcattgaattctggtcaggaggccactgcgcaggaggcacttgagcttctcattgagcttgctgggactgagccacggttcctgcgcaggcagattgttgatgttgttggtgccatgctgcagattgctgaggctgactctctagaagaagggactcgccatttggctattgagtttattgttacacttgctgaggcgagggagcgtgctcctgggatgatgaggaagctaccgcagtttgtgagtaagctgtttggtgtgctgatgaatttgctgctggatattgaggatgatcctgcttggcatggtgctgagactgaggatgaggatgctggtgagactagtaactatggatttggacaggaatgtttggataggctttcaattgctttgggtgggaacacgatagttccggttgcgtctgagttgttgccaacttacttggctgcacctgaatggcaaaagcaccatgctgcactcattgctcttgcacaaattgcagagggtagttcaaaggtgatgataaagaatttggagcatgtgttgtcaatggttttgaattcatttcatgatccacacccccgagtgcggtgggcagctataaatgcaattgggcaattgtccacagacttggggccagacttgcaggttaaatatcaccaattagtgcttccggcattagctggagccatggatgattttcaaaatcctcgagtacaggcacatgctgcttctgcagtgctaaatttcactgagaattgcgccccagataccctaacaccttatttggatgggattgtgagcaaacttcttgtactactgcagactggaaagcaaatggttcaagagggtgctttgacagctttagcatcagttgctgattcttcacaggagcaatttcaaaagtattatgatgctgtgatgccatacctaaaagctattttgatgaatgcaaatgataaatctaatcgaatgcttcgtgccaaagcaatggagtgtattagtttggtagggatggctgttggaaaggagaagttcaaggatgatgccaaacaggtcatggatgtcttgatgtcactacaacaatctcaactggatgctgatgatccaaccgcaagttacatgttacaagcatgggcacggctttgcaagtgcctcgggcaggattttctcccatacatgggttttgtcatgcctcccttgctccagtctgcacaacttaagcctgacgtgacaattacatcagcagattctgatgctgaatttgatgaagatgatgacagcattgaaaccatcactcttggggacaaaagaataggcattaagaccagtgtcctggaggagaaggctactgcatgcaacatgttatgttgttacgctgatgagttgaaggaaggattttttccttggattgaccaggttgctttcacattggtccctcttcttaaattttacttccatgaagaagttaggaaggctgcagtttcagctatgccagaactgctgtcttcagcaaaatcggccatagagaaggggcagtcacaaggccgtgatgcgtcttacctaaagcagttgactgattatataataccaaatttggtggaagcattacacaaggagccagaggtggaaatttctgcaggcatgctggacgcactgaatgaatgcatacaggtctcaggaccacatttagatgaaaaacaagtgaagagcattgttgatgagattaaaacagtaatcacggccagttcatccagaaaacaagaaagagctgagagagccaaagaagaggacttcgatgctgaagaaagggaactactcaaggaagaaaatgagcaagaagaagaactttttgatcaaattggggactgcttggggacgctgataaaaacattcagggcatcttttgtgcctttctttgatgagctttcgttgtacctaacacctatgtttggtaaagacaaaaccacagaggaaaggagaattgccatttgtatatttgatgatgttgctgagcactgccgcgaagcagctcttaaatattatgattcatatcttccattattgcttgaagcttgcaatgatgaatgttcagatgttcgacaggcagctgtttatggggtcggtgtttgtgctgagtttggtggatctgttttcaaaccccttgttggagaggcactttctaggttaaatgctgtgataacacatccaaatgcacgacatactgataatgtaatggcatatgacaatgctgtttcagctcttggaaaaatatgccagttccaccgtgatagcataaatgcagcacaggttgttcctgcctggctaagttgcttgcctctaaaaggtgatttaattgaggctaaggttgtgcatgacctactttgttcaatggttgaaagatcagatagagaacttataggtcaaaacaatcaatatcttccaaagattgttgcaatttttgccgagattttatgtgcgggaaatgatctggcaactgaacaaactgtgagtcggatggttaatttattgaggcaacttcaacagactttgccaccttctacccttgcttcaacctggtcatctttgcaccctcagcaacagcttgcacttcaatccatcctatcatcctagttattttggatttttgtgtcaattaccttcagaagatgcatgtctattgtcatgggatgtcatagttccctttgtgaagcctgctggttcacgtttcttgattgctgaaccatatttggcaatccaagtatccaccccatgacttctgaggtatggctttgttgtagagagatgttgagttggttagaatgaaaagcagttttggcatcaaatgcatatgtatatttaagtgttacatttaaaaggaattcttcgagtaggagtggacagcgtgattcgatcctgtgtgtggatgatggggtagatgtcttaccccgagagatgcattttttctacagaaccttgagtcatgcatggcatagtaaaccgcatagtattctttttttttttttttttgagggttgtaacagttttgacgagtcattttcttgaatgttggaaaccatttgtcattgaattctttatatatccgttggctatgtccttgctctttttctgcatttttttcacttggtgttttcaaagttcaaactaaactccataactcaggtcatttggggaggttttaaaatgataaacaagaggaatttttacatgcaacctcacaaaatttaccatctatgatataagaaaattt

SEQ ID NO: 5899 - DNA, 3802 bp, Fragaria vesca
tcctcccccctaaaatctttccgatggccgccgatccaactcagcagcagcagcagcagcagctggccgtgctcctgggccaggacccggctgagttcgaaaccctaatatcacatctgatgtcgtcgacgaacgagcagcggtccgaggccgagagggtgttcaacctgtgcaagcaggcccacccagacgccctggttctgaagctggtccatgtcctccaggccgcgccccgacccgactcccgcaccatgtccgtgatcctcctccgccgccagctcgactcgtccctctgggcccgcctctccccctccacccactcctccctcaagtccgctctcctctcctccctccactccgagtccacctccaaatccatgtccaagaagctctgcgacaccgtctccgagctcgcttcttctcttctccccgacaaccagtggccggacctcttgcctttcatgttccactgcgtctcctccgacaaccccaagctccaggagtcggctctcttcattttcgcccacctcgctcattacatcgcctcccaagccatgctcccccagctcaccaccctccactccgtcttctaccggtgcctctcctccgccgacgtccgaatcgccgccctcaccgcctctgtcaatttcatccagtgcctcacctccccctcccacagggacatgttccaggacctcttgcccttgatgatgcagactttgacagaggccttgaactccggtcaggaggccaccgcgcaggaggccctcgagttgcttatcgaactggccggcactgagccccggttcctgaggaggcagctggtggatgtggttggctccatgcttcagattgccgaggcatcctccctggaggaagggacccggcatttggccattgagtttgtcatcactctggccgaggccagggagagagcgcccgggatgatgaggaagctgcctcagtttattcataggttgtttgccatactcatgaccatgttgttggaccttgacgacgaccccgactggcacactgcagatactgagaatgaggatgctggtgagactagtaactacggctttggacaggagtgtttagacaggctttcaatttcagtgggtggcaataccattatacctgttgcttccgagctttttccgtcctacttggttgcccctgaatggcaaaagcaccatgccgtccacattgcccttgctcagattgccgagggctgctctaaggttatggtgcagaacctcgaacaggtggtgtcaacggtattgaattctttccaagatcctcacccacgtgtgcggtgggcagcaattaatgcagttgggcaattgtcaacggatttaggcccaaatttacaagagaagtatcaccagcgagtgctgcctgcattagctggagctatggatgacttccaaaatccacgagtacaggcccatgccgcttcagcagtactcaatttcagtgaaaactgcaccccagatattttggtaccgtacctggatggaattgtgagcaagcttcttgtacttctacagaatggaaagcagatggtccaggagggggctttaacagctttagcatcagttgctgattcgtcacaggagcaattccagaagtattatgatgctgtaatgccttacttgaaagccattttggttaatgcaaatgacaaagctaatcgtatgctacgtgcaaaatcaatggaatgtattagtttggttggaatggctgtcgggaaggataagtttagggatgatgcaaagcaggttatggaagtcttgatgtcattgcaaggatctgaaatggaggcagatgatcccacaacaagttatatgttacaagcatgggctagactttgcaaatgccttgggcaggattttctcccatacatgaatgttgtcatgccttctttgcttcagtctgctcaacttaagcctgatgtgacaatcacttctgcagattcagatggagaaattgatgaagatgatgatagcattgaaatgattactgttggggataagaggataggaatcaaaactagtgttctggaggaaaaagctacggcctgtaacatgctatgttgctatgctgatgagttgaaggaaggatttttcccttggattgatcaggttgctccaacattggttcctcttctaaaattttatttccatgaagaagttagaaaggcagctgtttcagcaatgccggagctcctacgttcagccaaattagcagtagagaagggccagtctcaaggccataatgagtcctacataaagcagttatctgattacataataccagcgctggttgaggcattgcacaaggaacctgaggttgaaatttgtgccagcattttagatgcattgaacgaatgtgtgcagagttctgggccactacttgatgaaaaccaagttagatgcatcgtggatgagatcaaacaagtgattacagcaatcacatctagaaaacaagagcgagcagaaagggccaaggcagaggactttgatgcagaagaaggggagcttctgaaggaggaaaatgaacaagaagaagagctttttgatctagttggtgattgtttgggaactttgataaagacattcaaggcttcttttttgcctttctttgacaagctttcctcttacataacaccaatgttgggtaaggataaaactgcagaagagaggagaattgccatctgcatatttgatgatattgcagagcattgccgtgaagctgctcgtaagtattatgatacttatgttcctttcctactggaagcttgcaatgatgaaagttcagatgttcgtcaggctgctgtttatggtgtcggtctttgtgcggagtatggtggatctgtgttcaaacctcttgttggtgaagctctttctaggttggatatggtgatcaggaaccccagtgcacaacactctgacaacatgatggcatatgataatgctgtttcagctcttgggaaaatatgccagttccaccgtgatagcatagatgcaccacagcttgtccctgcctggttaggttgtttacctataaaaggtgatttgattgaggccaaggttgtccatgaccagctgtgttcaatggttgaaagatcggatagagagcttttgggtcccaataatcaatatcttccgaaaatagttgcagtttttgctgaggttatatgtgcgggtaaagacttggcaactgagcaaacaactagtcgaatgattaatttattaaggcagcttcaacaaaccttaccgccctctacccttgcatcaacctggtcatccttgcaaccgcagcaacagctcgcattacaatttatgctctcatcataattcatttctggccttgtttttgtttacggaaattgctgcttctattggtgtggctgtttctgctcattatattttcttgcattggtggatggctgatttcatacctctagaaagctaatgcgtctgcattggtaaggttgttgctgtctggtctgtggttcagtagtgcattcattggttctgttttagtttttgataattaatttgggggtgtggtttgtcacaattgcctggttgctttgtctagttggcaaggattatgggaaaaaaaagaaaaggtacatggatggtcaaaattttggaatacagtgtgtatatattacagagttgcctattcatggcccaatacgctttccaatgctacagtagttgaaaagaatttttcaattgttgttttactatcctatgccaattgccagagttaaagatcattttgcatc

SEQ ID NO: 5900 - DNA, 4476 bp, Pinus taeda
tcttcttcgctgctgagccctgtattattattaaggacgacgactccttcgctctcctatcgcctgtcctcttgttttgttttgttttctccagctgcggcggcggcggcatcatctagcaatcaggccgagcattaattcggaattgggagagagatcgatccaatccaataagctacaatggatcaatccaagggcaccacgacaataactgcagaggtggaggcgcagataaacgccgtgatggggtcggaatcggcggcgtttgagtccctgataatgcacctcatgagcgctggcaatgagcagagaggccaggcggaggcgttgttcaacatctgcaaggagaagcacccagatgctctggccctgaagctcgttcatgtcctgcagtcatgcgggcaggtggaaatccgggccatggccgcgattctcctgaggaagcagatcacacgggacgagacatacatatggccacgattggcaccgcccacgcagaccgccatcaaggcccacctcctcgtctgcgtccagagggaggaggccaagaccatcgtcaagaagctctgcgacacggttgccgagcttgcggcttccatcatggaagagggccagtggccagagctcctgcccttcatgttccagtgcgtgagctccgattccccgcgtctcaaggagagcgcgttgctcatgttcgcgcagctctcgcagttcataggcgaccacctccaccctcatctctctaccctgcacaccgtgttccaccagtgtctctccccccctctccgtcggacgttcgaatcgcagccctcgcggccacgaccaacttcgtccagacgatcgagaccccgcaggaccgtgagcgattccaggacctaatccctgccatgatgcagacgctcaccgaggcactcaatacgaaccaggaggccacagcccaggaggctctcgagatgtttatcgagttggcgggcaccgagccacggttcctccgcaggcagatcgttaacgtggtggggagcatgctgcagatcgccgaggccgagactctggaagagggcactagacatctcgccatagagttcattattaccctcgcagaggctcgggagcgcgcccccggaatgatgcgcaagttccctcagttcattggtaggctttttgctattctcatgaaaatgcttctcgacatcgaggatgatcctgcctggcatgctgccaatactgaagacgaggatgccggtgaatcaagtaattacagtgttggtcaagagtgtttggaccgcttggccatttctctaggaggaaataccatcgtccccgttgcctcggagttgcttcctgcctatttggctgatcctgattggcgaaagcatcatgctgctctcattactcttgcccagatcgcagaaggctgtgccaaggtgatgctaaaaaaccttgaacaagttgtctctatggttctgaagtcattccaagatccacatcctcgtgtacgatgggcagccatcaatgccatcgggcaactgtcaactgatttaggcccggatttgcagcaacaatatcatcaacaagttttgcctgcacttgctggagctatggatgattttcagaatcctcgggttcaggcacatgcagcttcagcagtgctcaacttcagtgaaaattgtacgccagaaattttgacgccgtacttggatggtatagtgagcaagctacttgttcttttgcagaatggaaggcagatggtgcaggagggtgctttaacagctttagcatctgttgccgattcctcacaggagcactttcagaagtattatgatgcagttatgccttatctgaagtccatattaatgaatgccactgacaaatctaaccgtatgctgcgtgctaaatctatggaatgcattagcctggttggaatggccgtgggaaaagagaaattcagaaatgatgctaaagaggtgatggatgtgctgatgaccctgcaaggatctcagatggaggctgatgacccaaccataagctacatgttacaagcttgggcaagactttgcaagtgtttgggtctagatttccttccttacatgaatgtcgtgatgcctccacttcttcaatctgcccagttgaaaccagatgtgacaatcacttctgcagactcagataatgacattgatgattcagatgatgaaagtgtggagacaattacactcggggataaaaagattggtatcaagacaagcgttttggaggagaaggctacagcttgcaacatgctatgctgctatgctgatgagttaaaggagggcttctatccatggattgatcaggttgcacctacactagttcctcttctgaaattttacttccatgaagaagttcggaaggctgctgtttcagcaatgccggagcttttgcaatctgccaaattggctgttgagaagggaatggctcatgggcgggatcaaaactatgtcaagcagttgtctgattatatcatacctgcattggttgaagccttgcataaggaacctgaaactgaaatatgttcaagcatgttggatgcattgaatgaatgcatacagatatcaggtgtcttgcttgatcaaagccaagttaagtcaatagtggatgaacttaaacaagttatcacagcaagtgcaactagaaagagggagcggacggaaaggactacagcagaagattttgatgcagaggaaggggaaatacttcaagaggaaaatgaacaggaagaagaagtttttgatcaagttggtgaatgcataggaactctcattaagacattcaagtcctctttcttaccattctttgatgagctgtcatcttacataacacctatgttgggaaaagataaaacggcagaagagagacgaattgcaatatgcatttttgatgatgtagctgaacaatgtcaagcagctgctgtaaaatattatgacacatttctacctttcttactggaggcctgcaatgattctaatgcagatgtgcggcaggctgcagtttatggtattggtgtatgtgccgaatttggtggatctaaattcaaaactcttgttggtgaggcactttcgaggctgaattttgtcataagtcaaccaaatgcacgggaatctgataatgttatggcaactgataatgcaatttctgcattaggaaaaatctgccaatttcatcgcgatagcatagatgcaccacatgtggttccagcctggctaagttgcttgcctataaaaggtgatttaattgaagctaaaattgtccatgaacagttgtgttccatggttgagaggtctgatgcagagcttctgggtcctaacaatctatatctacctaaaattgtttctgtatttgcagaggttttgtgtgctggcaaagaccttgcgacggatcagactattgcgcggatggttaatctcttaagacagttgcagcaaacgctttccccatcagctcttgcttctacatggtcttccttgcaacctcagcaacaaatggcattgcagtcaattttgtcttcataaatgtattagtgccttgttgaaattatctgtgggcttgtagagatgcatgaatttctactattggttcattattggattaaggttgtttgactggactacttagttgggtgtcttattgttcattctttcatgtagtcattcatttctagatggttttctgtaaggcagttatgtattttttcaatgtgaagagtttttgcccatcgatccatgtggcccatggggtcaaatgggttttccataattttaattattgtattatagtctgctatttagcagagaaatgtagatgtctctgatgtgtggcgatgtcaaagtgcagtgtgaaagattttgcgaactcatgaatctgtatttttgtcatgtatctttagctggatacagaaagcgggttgaatgcaggaggaaaaatgacgttgtgaaatggcataagcttccttgtttatgccattgtagtgcacgggcactatttattcataagaattattcaaatccatttctgggcctatttttttcgtagtacttgattttgttataaaaagcaaggctcgatggcttgtttctattgtccattccccctgaaagttcaataatgtatcttcaaatgtaagtgaagatatttaattcgcctggcccttgggttttaggatataaatacgaaattatcggatcatattttgtgattgtaaattaatactattgctcatggttggaaatatcggatggttctttgggtttttttcattttacatttgtataacaataccctggattatttttctatttttgggcgggtttgccctcttttggaaacagatttcatctgttgattgttatggaaagaccctcctatgcaacacaaaacggtttgccggaacaccttaaagtcttttatttacaatttataccctgaaatcttttatttcaaatt

SEQ ID NO: 5901 - DNA, 3960 bp, Trigonella foenum-graecum
tcaattcaattcagtactcaacaatggcgttgaacgatccaaaccaaacccaaatggctctaattctaggtccagattcatctcacttcgaatccctaatcaaaaacctcatgtccaccatcaacgaccaacgctcccaagccgaaaatctcttcaatctctgcaaacaaacctaccccgattccctaattctcaaactctcccacctcctccatacttccctaaccccgaaacacgcaccatgtccaccatcctcctccgtcgtcacctcacgcgccaccacgacgattccttcatctacccacacctctccgtttcaactcaatccactctccgttccctcctcctccaatctctccatcaagagccaatcaaatccatcgtcaaaaagctatgcgacaccgtttctgaactcgcttccgctcttctctctgatgacttgtcttcctggcctgaccttcttccgcttctttttcagtgggttacttcgtctgaccctaggcttcaggagatttcgttgcttgtgtttgcgcaattggctcattatattggtgaaaccctacttcctcaattgtctactcttcattctgtttttcttcgttgtcttagtgctgctacttcctcttccgatgttcgcatcgccgcccttgctgctagtattaacttcgttcagtgtcttcctaattcctctgaccgcgataggtttcaggatttgctgcccctcatgatgcagacattgacggaggcattgaattcgggtcaggaggcgactgcgcaggaggcacttgagcttctcattgagcttgctgggactgagccacgtttccttcggaggcagattgttgacattgttggtgctatgctgcagattgcggaggctgagtcgttagaagaagggactcgccatttggctattgagtttgttgttacccttgctgaggcgagagagcgtgctcctgggatgatgaggaagttgccgcagtttgtgaagaaactgtttggtgtgttgatgaatttgttgctggatattgaggacgatcccgcttggcatgctgcgttgagcgaggaggatgatgctggtgagactagtaactatggatttggacaggaatgtttggatagactttcaattgctttgggcgggaacacgatagtgccagttgcgtctgagttgttgccgacttacttggctgcacctgaatggcaaaaacaccatgctgcgctcgttgctcttgcacaaattgcagagggttgttcgaaggtgatgacaaagaatctggagcatgtattgtcaatggttttgaattcatttcctgatccaaaccctcgggtgcggtgggcggctataaacgcaattgggcaactgtccacagatttggggccagacttgcaggataaatatcaccacttagtgcttccggcattagctggagccatggatgattttcaaaatcctcgagtacaggctcatgctgcttctgcagtgctaaatttcactgagaattgcaccccagatattctaataccgtatttggatgggattgtgagcaaacttcttgtactccttcagggtggaaagcagatggttcaggaaggtgctttgacagctttagcatcagtcgctgattcttcacaggagaaatttcagaagtattatgatgctgtgattccatacctaaaagctattttgttgaatgcaaatgataaatctaatcgtatgcttcgtgccaaagcaatggagtgtattagtttggtaggtatggctgttggaaaggaaaaattcagggatgatgccaagcaggttatggatgtcttgatgtcactccaacagtcgcaactggattctgatgatccaaccgcgagttacatgttacaagcgtgggctaggctttgcaagtgcctcgggcaggacttccttccatacatgggttttgtcatgcctccattgctccagtctgcacaacttaagcctgacgtgtcaattacatcagcagattctgatgccgaatttgatgaagatgatgacagcattgaaaccatcactctcggggataaaagaataggcattaagaccagtgtcttggaggagaaggctaccgcatgtaacatgttatgttgctatgctgatgagttgaaggaaggttttttccttggatcgaccaggttgcttccacgttggttcctcttcttaaattttacttccatgaagaagttaggaaggcagcagcttcagctatgccagaattgttgtcttcagcaaaatcggctatagagaaggggcagtcacaaggccgtgatgcaacatacctaaaacaattgtctgattatataattcctaatttggtggaagctttacacaaggagccagaggttgaaatttgtgcaagcatgttggacgcactgaatgaatgcatacaggtctcaggaccacatctagatgaaaagcaagtaaggggcattgttgatgagatcaaacaaatcatcacggccagttcatccagaaagcatgaaagagcagagagagccaaagaagaggactttgatgccgaagaaagagaactactcaaggaagaaaatgagcaagaagaagagctttttgatcaaattggtgattgcttggggacattgataaaaacatttagggcatcttttttgcctttctttgatgagctttcgtcatacctaacacctatgtttggtaaagacaaaacctcagaggaaaggaggattgccatttgtatattcgatgacgttgctgagcactgccgcgaagcagctcataaatattatggttcatttcttccattcttgcttgaagcttgcaatgatgaatgttcagatgttcgacaggcagctgtttatggtgttggtgtttgtgctgagtttggcggatctgttttcaaaccccttgttggagaggcactttcaaggttaaatgctgtgataacacatccaaatgcacagcattctgataatgtaatggcatacgataatgctgtttcagctcttggaaaaatatgccagttccaccgtgatagcataaatgcagcacaggttgttccggcatggctaagttgcttgcctataaaaggtgatttaattgaggccaaggttgttcatgacctactttgttcaatggttgaaagatcggataaagaacttataggccataacaatcaatatctttccaagattgttgcaatttttgccgagatattatgtgcgggaactgatctggcaactgaacaaactgtgagtcggatgattaatttattgaggcaacttcaacagactttgccgccttctacccttgcttcaacctggtcatcgttacaccctcagcaacaacttgcacttcagtccattctatcatcttagttattttggattcttgtgtccattaccgtcagaagatgcgtgtctattgtcatgggatgtcacagttgccctttgtgaagctactgtgtatggtcaagttagcattgtagtgccgttttcagaccaacagctgcacctgattagtgcttcttgattgctgaaccatatttggtagtccaagtatcaaccccatgacttgtgaagcatggatttgttgcaagagaggtgttgggtcggttagattgggaaacagttttggtgtcaattgtgtatgtatattgaagtgttatagttaaaaggaatttttgtgtcgaaggaatgaacattgtgcctcgatcctgtccgtgtgtggatgatgaggacaaggcatgttaccttgagtcatgcttgatacagtcaaccacatagcatttttttccttagggttgtaacagttttgacgagtcatttttcgtggatgtttgaaacaatttgtcatcgatttatttgtatatctggtggtttatgtccttgctcttttatcttgttttcacgcagtgtgtccaaccaaacttcaaaacccaagccatttggggatattcc

SEQ ID NO: 5902 - DNA, 4029 bp, Abies balsamea
taagctaaaaagttcacgagattttggcggcacttaacagagatttaagcctgtgggaggggtttgtaaaaaccctcttcgccgctgtgccctgtattattagggacgactccttcgctctcccttcgtctcttctcttttttgttttctccagtggcggcggcatcagacagcaagcaggcagagcattaatactgaattgcgagagaggtcgatccaatctaatagctacgatggatcaatccaagggcaccgtcacaataactgcagaggttgaggcacagataaacgccgtgttggggtcggaatcggcggcgttcgagtccctgataacgcatctcatgagcgccggaaacgagcagagaggccaagcggaggtgttgttcaacatctgcaaggagaagcaccccgatgcgctagccctgaagctggttcacgtcctgcagtcatgtgggcaggtcgaaatccgggccatggccgcgattctcctaaggaagcagatcacacgggatgagacatacatatggccacgattagcaccgcccacgcagaccgcaatcaaggcccacctcctcgtatgcgtccagagggaggaggccaagaccatcgtcaagaagctatgcgacaccgttgcggagctcgcggcctccatcatggaagagggccagtggccggagctcttgccgttcatgttccagtgcgtgagctccgattccccgcgcctcaaggagagcgcgttgctcatgttcgcgcagctctcgcagttcataggcgagcacctccacccgcatctctccactctccacaccgtgttccaccagtgcctgtccccgccctccccgtcagatgttcgaatcgcggccctcgcggccacgactaactttgtccagacgatcgagaccccgcaggaccgcgaacgtttccaggacctaatccccgccatgatgcagacgctcaacgaggctctcaacaggaacgaggaggccacggcccaggaggccctcgagatgttcatagagttggcgggcacagagccacggttcctccgccggcagatcattaacgtggtcggaagcatgctgcagatcgctgaggccgagagtttggaagagggcactcggcatcttgccatagagttcatcatcactctcgccgaggcccgggagcgtgccccaggaatgatgcgtaagttccctcagttcatcggtaggctttttgctattcttatgaaaatgcttctcgacatcgaggatgatcctgcctggcatgctgccaatactgaggacgaggatgcgggtgaatctagtaattacagtgttggtcaagagtgcttggatcgcttggctatttctctaggtggaaacaccatcgttcccgttgcctccgagttgcttcctgcttatttggctgatcctgattggcggaaacatcatgctgctctcattactctcgcccagattgcagaaggctgtgccaaggtgatgctaaaaaaccttgaacaagttgtctcgatggttttgaagtcattccaagatccacatcctcgtgtacgatgggcagccatcaatgccattgggcaactgtcaaccgatttgggcccagatttgcaacaacaatatcatcagcaagttttgcctgcacttgctggagctatggacgattttcagaatcctagagtgcaggcacatgcagcttcagcagtgctcaatttcagtgaaaattgtacacctgatattttgacaccatacttggatggtatagtgagcaagctacttggtcttttgcagaatggaaggcagatggtgcaggagggtgctctaacagctttagcatccgttgctgattcctctcaggagcactttcagaaatattatgatacagttatgccttatctgaagtctattttaatgaatgccactgacaaatccaaccgcatgctacgtgccaaatctatggaatgcattagcctagttggaatggctgtgggcaaagagaaattcagaaatgatgctaaagaggttatggaggtgctgatgagcctgcaaggatctcagatggaagctgacgacccaaccataagctacatgttacaagcatgggcaagactttgcaagtgtttgggacaagatttccttccttacatgaatgtggtgatgcctccactcctacaatctgctcagttgaagccagatgtgaccatcacttctgcagactcagataatgagatcgatgaatcagatgatgaaagtgtggagacaattactcttggggataaaaagattggtatcaagacaagtgttttggaggagaaggctacagcttgcaacatgttatgctgttatgctgatgagttaaaggagggcttctatccatggattgatcaggttgcacctacattggttcctcttctgaaattttacttccatgaagaagttcgaaaagctgctgtttcagcaatgccggagctcttgcaatctgccaaattggctgttgagaagggattggctcacggacgggatttaaactatgttaaacaattgtcagattatatcatacctgcattggttgaagctttgcataaggaacctgaaactgaaatatgttcaagcatgctagatgcattgaatgaatgcatacagatatcaggtgtcttgcttgatcaaaaccaagttaagtcaatagtggatgaacttaaacaagtaatcacagcaagtgcaactagaaagagggaacggacagaaaggactacagcagaagattttgatgccgaggaaggggaaatacttcaagaggaaaatgaacaggaagaagaagtttttgatcaagttggtgaatgcataggaactctcattaagacattcaagtcttcattcttaccattctttgatgagctatcatcttacatcacacctatgttggggaaagataaaacagcagaagagagacgaattgcaatatgcatttttgatgatgtagctgaacaatgtcaagcagctgctagtaaaatattatgacacatttctaccattcttactggaagcctgcaatgattctaatgcagatgtgcggcaggctgcagtttatggtattggtgtatgtgctgaatttggtggctctaaattcaaaactcttgttggtgaggcactttcgaggctgaattttgtcataagtcaaccaaatgcacgggaatctgataatgtaatggcaactgataatgcagtttctgcattaggaaaaatttgccaatttcatcgtgacagcatagatgcagcacatgttgttcctgcctggctaagttgcttgcctataaaaggtgatttaattgaagctaaaattgttcatgaacagttgtgttccatggttgagaggtctgatgcagagcttctgggtcttaacaatcaatatttacctaaaatcgtttctgtatttgcagaggttttatgtgctggcaaagaccttgcaacagacccgactattgcacggatggttaatctcttgagacagttgcaacaaacactttccccatcagcgcttgcttctacatggtcttccttgcaacctcagcagcaattggcattgcaatcaattttgtcttcataatatattggtgcctctgaaattatccatcggcttgtagagatgcatggatttctacttattggttcattactggattaatgttgtttaactggactacttagttgggtgtcttatggttcattcttttatgtagtcattcatttatagatggttttctgtaaggcagctatgtatttttcaatgtgaaagagttttgtccatcaatccatgtggcccatggcgtcaaatgggtcttccatagtcttagattattgtattatagtctgctatttagcagagcaatgtagatgtctggtatgtgtggcaatgtcaaagtgcagtgtgaaagattttgcaaactcatgaatccgttttttgtcttgatcgttagtcagatacagaaagtgggttaaatgcaagaggaaaaatgttgttgtgaaatggcagaag

SEQ ID NO: 5903 - DNA, 4447 bp, Pinus pinaster
taagagtggttggcctaaaaggttaacgagattttggcggcacttaacagagatttaagcctgcgggaggggtttgtaaaaaaccctcttcttcgctgctgagccctgtattattaaggacgacgactcctccgctctcctatcgcctcttgttttgttttgtttctccagctgcggcggcggcatcaatcagcaatcaggccgagcattaattgggaattgggagagagatcgatccaatccaataagactacaatggatcaatccaagggcaccacgacaataactgcagaggtggaggcgcagataaatgccgtgatggggtcggaatcggcggcgtttgagtccctgataatgcacctcatgagcgctggcaatgaacagaggggccaggcggaggcgttgttcaacatctgcaaggagaagcacccagatgctctggccctgaagcttgttcatgtcctgcaatcatgcgggcaggtggaaatccgggccatggcggcgattctcctaaggaagcagatcacacgggacgagacatacatatggccacgattggcaccgcccacgcagaccgccatcaaggcccacctcctcgtctgcgtccagagggaggaggccaagaccatcgtcaagaagctctgcgacacggttgccgagcttgcggcttccatcatggaagagggccagtggccagagctcttgcccttcatgttccagtgcgtgagctccgattccccgcgtctcaaggagagcgcgttgctcatgttcgcgcagctctcgcagttcataggcgaccacctccaccctcatctctctaccctgcacaccgtgttccaccagtgtctctccccccccctctccgtcggacgttcgaatcgcagccctcgcggccacgaccaacttcgtccagacgatcgagaccccgcaggaccgtgagcgattccaggacctaatccctgccatgatgcagacgctcacggaggcactcaatacgaaccaggaggccacagcccaggaggctctcgagatgtttatcgagttggcgggcaccgagccacggttcctccgcaggcagatcgttaacgtggtggggagcatgctgcagatcgccgaggcggagactctggaagagggtactagacatctcgccatagagttcattattaccctcgcagaggctcgggagcgcgcccccggaatgatgcgcaagttccctcagttcattggtaggctttttgctatctcatgaaaatgcttctcgacatcgaggatgatcctgcctggcatgctgccaatactgaagacgaggatgccggtgaatcaagtaattacagtgttggtcaagagtgtttggatcgcttggccatttctctaggaggaaataccatcgtccccgttgcctcggagttgcttcctgcctatttggctgatcccgattggcgaaaacatcatgctgctctcattactcttgcccagatcgcagaaggctgtgccaaggtgatgctaaaaaaccttgaacaagttgtctctatggttctgaagtcattccaagatccacatcctcgtgtacgatgggcagccatcaatgccatcgggcaactgtcaactgatttaggcccggatttgcagcaacaatatcatcaacaagttttgcctgcccttgctggagctatggatgattttcagaatcctcgggttcaggcacatgcagcttcagcagtgctcaacttcagtgaaaattgtacgcctgaaattttgacgccgtacttggatggtatagtgagcaagctacttgttcttttgcagaatggaaggcagatggtgcaggagggtgctttaacagctttagcatctgttgccgattcctcacaggagcactttcagaagtattatgatgcagttatgccttatctgaagtccatattaatgaatgccactgacaaatctaaccgtatgctgcgtgccaaatctatggaatgaacattagcctggttggaatggccgtgggaaaagagaaattcagaaatgatgctaaagaggtgatggatgtgctgatgaccctgcaaggatctcagatggaggctgatgacccaaccataagctacatgttacaagcatgggcaagactttgcaagtgtttgggactagatttccttccttacatgaatgttgtgatgcctccacttcttcaatctgcccagttgaaaccagatgtgacaatcacttctgcagactcagataatgacattgatgattcagatgatgaaagtgtggagacaattacactcggggataaaaagattggtatcaagacaagcgttttggaggagaaggctacagcttgcaacatgctatgctgctatgctgatgagttaaaggagggcttctatccatggattgatcaggttgcacctacactagttcctcttctgaaattttacttccatgaagaagttcggaaggctgccgtttcagcaatgccggagcttttgcaatctgccaagttggctgttgagaagggaatggctcatgggcgggatcaaaactatgtcaagcagttgtctgattatatcatacctgcattggttgaagccttgcataaggaacctgaaactgaaatatgttcaagcatgttggatgcattgaacgaatgcatacagatatcaggtgtcttgcttgatcaaagccaagttaagtcaatagtggatgaacttaaacaagttatcacagcaagtgcaactagaaagagggagcggacggaaaggactacagcagaagattttgatgcagaggaaggggaaatacttcaagaggaaaatgaacaggaagaagaagtttttgatcaagttggtgaatgcataggaactctcattaagacatttaagtcctctttcttaccattctttgatgagctgtcatcttacataacacctatgttgggtaaagataaaacggcagaagagagacgaattgcaatatgcatttttgatgatgtagctgaacaatgtcaagcagctgctgtaaaatattatgacacatttctacctttcttactggaggcctgcaatgattctaatgcagatgtgcggcaggctgcagtttatggtattggtgtatgtgccgaatttggtggatctaaattcaaaactcttgttggtgaggcactttcgaggctgaattttgtcataagtcaaccaaatgcacgggaatctgataatgttatggcaactgataatgcaatttctgcattaggaaaaatctgccaatttcatcgtgatagcatagatgcaccacatgtggttccagcctggctaagttgcttgcctataaaaggtgatttaattgaagctaaaattgtccatgaacagttgtgttccatggttgagaggtctgatgcagagcttctgggtcctaacaatctatatctacctaaaattgtttctgtatttgcagaggttttatgtgctggcaaagaccttgcaacggatcaaactattgcgcggatggttaatctcttaagacaattgcagcaaacgctttccccatcagctcttgcttctacatggtcttccttgcaacctcagcaacaaatggcattgcagtcaattttgtcttcataaatgtattagtgccttattgaaattatctttgggcttgtagagatgcatgactttctactattggttcattattggattaaggttgtttgactggactacttagttgggtgtcttcttgttcattctttcatgtagtcattcatttctagatggttttctgtaaggcagctatgtatttttcaatgtgaagagttttgcccatcgatccatgtggcccatggggtcaaatgggttttccatagttttaattattgtattatagcctgctatttagcagggaaatgtagatgtctctgatgtatggcgatgtcaaagtgcagtgtgaaagattttgtggactcatgaatctgtatttttgtcatgtatctttagctggatacagaaagcgggttgaatgcaggaggaaaaatgacgttgtgaaatggcataagcttccttgtttatgccattgtagtgcatgggcactatttattcgtaagaattattcaaatccatttctgggcctatttttttcgtagtacttggatttatttataaaagcaaggcttgatggcttgtttctattgtccattccccctgaaagttcaataatgtatcttcaaatgtaagtggagatatttaattcgcctggccattgggtttaggatataaatacgaaattatcggatcatattttgtgaatgtaaattaatactattgctcatggttggaatatcggatggttctttgggtttctttcattttacattctgtataacaataccttggattattttctatttctgggtcggtttaccattctttcggaagcagatttcatctgt

SEQ ID NO: 5904 - DNA, 3835 bp, Gossypium raimondii
gccttaaaattcgtatcttcttctttatttcttctttcctttcgttatattgggattggggaggcgccacaaatacaaaaaaccccaaataacaaaaacaaattctatctcctaaaaccctgaaactcgcccatggccaccgatcaaactcagctccaactcgctcaactcgcccacatcttgggccccgattcgactcacttcgaaaccctaatctcccacctcatgtcttcctccaacgaccaacgttcccaggccgagtcactcttccaccttgccaaacaaactcaccccgactctctctccctcgctctctcccgtgtcttatcctcatcccctcgccccgaactccgagccctctctgccgtcctcctccgtaaaatcctaactcccgccgctgattactcctttctctttcccctcctagctgaatccacacgcgccgccatcaaagcctcgcttttatcctccctccaaaccgaacaatcaaaagctaacgtaaaaaaactctgcgatacaatttccgaactcgcttcttccgtcgttgctactagaggctggccggaactattgccattcctcttccaatgtgtgaattctaagaatcccaacctcgaagaatctgctcttttgattttctctcgattagctcaaaacgtcggagaaacaacggaaaccctaatccctcatttaaacactctccattccgtcttcttcaattgtttatcaaatccgtcaagttgcgacgtacgaatcgcagctttaagcgcctcagtcagtttcattcaatgcatttcaaaccccaaagatcgggacgctttccaagatttgttgccgttgatgatgcagacgttgaccgaggcgttgaactctggattagaagccacagctcaagaggctttggaattgttaattgagttagccgggactgagccgaggtttctaaggaggcaaataatggaagtagtaggatcgatgttacaaattgctgaggcggagagtttagaagaaggaacacgccatttagccattgaatttataattacgttagcagaggcgagagagagggctccggggatgatgaggaagttaccacaattcataaggaggttattttgggtgttgatgaatctattggtggacattgaagatgaaccggattggtataatgcagagagtgaggatgaggatgctggggaaacaagtaattatggggttggtcaggagtgtttggatagattgtcgatttcattaggagggaatactgttgtaccagtggcttcagaattgtttccggtgtttttggctgcttcagagtggcagaaacgacatgctgctctcattgcacttgctcagattgctgagggttgttccaaggtgatgataagaaatctagaacaggtagtgtcaatggttttgaattcatttcacgatgcccatcctcgtgttcgatgggctgctattaatgccattgggcagttgtctacggacttgggcccagagttgcagactcaatatcatcagagagtgttgcctgcactagctggagccatggatgacttccagaatcctcgcgtgcaggcccatgctgcttcagcagtacttaatttcagtgaaaattgtaccccagacatcttaactccatacctggatgggattgtgagcaaacttcttgtactgcttcagaacgggaagcaaatggtccaggagggtgctttgacggctttggcatcagttgctgattcatctcaggagcaattccagaaatattatgatgctgtgatgccttacttgaaagctatcttggttaatgcaaatgataaatctaatcgtatgcttcgtgccaaagctatggagtgcattagtttggttggcatggctgttggaaaggaaaaatttagggatgatgctaaacaggttatggacgtcttgatgtcattgcaagtatctcaaatggaatcggatgatccaacaacgagctacatgttgcaggcttgggccaggctttgcaagtgccttggacaggattttcttccttacatgagtgttgttatgccccctctgcttcaatctgcgcagcttaagcctgatgtaacaatcacatctgctgattctgatgctaatgttgatgatgacgatgatgaaagcattgagactatcactcttggtgataaaaggatagggatcaaaacgagtgttttggaagaaaaagctacagcttgcaacatgttatgttgttatgctgatgagttgaaggaagggttcttcccatggattgatcaggttgctactactttagttccccttctaaaattttattttcatgaagaagttaggaaggcagctgtttcagccatgccggagctgttacgttctgctaaactagctgttgagaaagggcaagctcaaggtcgaaatggaacatatataaagcagttgacggattacataataccagctttggtggaggctttacacaaggagcctgaggtagaaatttgtgggagcatgttggattcattgaatgaatgcatagagatttgtggaccatttcttgatgagggccaaataaaatgcattgttgatgagattaaacaggtaatcacagctagctcagctagaaaacaagaaagagcagagagggccaaagctgaggactttgatgaagaagaaggtgaaatgcttaaggaggaaaatgagcaagaagaagaagttttcggtcaacttggtgatttgttgggaactttgatcaaaacattcaaggcatccttcttgcctttcttccaggagcttacatcttatataacccctatgtggggtaaggataaaacagccgaagaaaggagagttgctatctgtatatttgatgatattgctgagcactgtcgtgaggcagctcttaagtattatgacacatatcttcccttccttttggaggcatgcaatgatgaaagccctgatgttcgacaggcagctgcttttggggttggcttgtgtgctgagtttggcggatcggtgttcaaacctcttatccaagaggccctctccaggctgaatgctgttatcagacaccctaatgcattgcatttggacaatgtgatggcttatgacaatgctgtttctgctcttggaaaaatatgccaatttcatcgggatagtatagatgctgctcagattctcccagcttggttaagttgcttgccgataaaaggtgatctgattgaggccaagattgttcacgaacagctatgttctatggttgaaaggtcagatcaggaacttttagggcccaacaatcaatatcttcctaagatagtttctgtttttgcagaggttttatgtgctggtaaagatctggcaacagagcaaactgctagtagaatgataaatctgataaggcacttccagcaatcattacctgcatctacactggcatcaacctggtcatccttgcagccacagcagcagcttgctttgcaatcaattctatcatcctagttatggtgtcattgatgaggaaagcttctgattcctgtattcttagccttctacaatttaaaaaaaaaaaaatcaattatggattttatataatagaaggtaaaagaaaagtagaaagtggtgagggttttgttggtgagtaatgttttcacctatttatttattgttttgatagcatgttctataattttttttggcactgttttggccaatgcgtatggtggttgaaggttgaatatagcaaaattttggtataggaagtgcataataataatactacaagggacttgtaattggtccctttctctcaaattgttaatggtggtttcagcatcat

SEQ ID NO: 5905 - DNA, 4112 bp, Medicago truncatula
ccgccattcaaaaccaaaaacccttattttcagattttcgagcagcagagagagaatactcttctttcttccctccctctctctctctctctctctctgccctatccatcaaaacactctctctcaattcaattcaattcaattcacaacgatggcgttgaacgatcaaaatcaagcacaaatggctctaattctaggaccagattcaacccacttcgaatccctaatcacaaacctcatgtccaccatcaacgaccaacgttcccaagctgaaaatctcttcaatctctgcaaacaaacctatcccgattccttaatcctcaaactctcccatcttctccacacttcctctaaccccgaaacacgaaccatgtccaccatcctcctccgtcgtcatctcacgcgccaccacgacgactctttcatctacccacacctctccccttcaactcaatccactctccgttctctccttctctcatctctccatcaagaaccaatcaaatccatcgttaagaagctatgcgacaccgtttcggaactcgcttctgctcttctctctgatgacctgtcttcttggcctgacttgcttccgcttctttttcaatgggttacttccaatgatgctaggcttcaggagattgcgttgcttgtttttgcgcaattggcgcattatattggtgaaaccctacttcctcaattgtctactcttcattctgttttccttcgttgtctcagtgctgctacttcctcttcggatgttcgtatcgctgcccttgctgccagtatcaatttcgttcagtgtctctccaattcatccgaccgtgacaggtttcaggatttgctgcccctcatgatgcagacattgaccgaggcattgaattctggtcaagaggcaactgcacaggaggcacttgagcttctcattgagcttgctgggactgagccacgtttcctgcggaggcaaattgttgacattgttggcgccatgctgcagattgctgaggctgagtcgttagaagaagggactcgccatttggctattgagtttgtcgttacacttgctgaggctagagagcgtgctcctgggatgatgaggaagttaccgcagtttgtaaagaagttgtttggtgtgctaatgaatttgttgttggatattgaggatgatcctgcttggcatgctgcggtgagcgaggatgatgatgctggtgagactagtaactacggatttggtcaggaatgtttggatagactttcaattgctttgggcgggaacacgattgtgccagttgcgtctgaattgttgcctacttatttggctgcacctgaatggcaaaaacaccatgctgcactcgttgcacttgcacaaattgcagagggttgttcaaaggtgatgacaaagaacttggagcatgtattatcaatggttttgaattcatttcctgatccaaaccctcgggtgcggtgggcggctataaatgcaatcgggcaattgtccacagatttggggccagacttgcaggataaatatcaccacttagtgcttccggcattagctggagccatggatgattttcaaaatcctcgagtacaggctcatgctgcttctgcagtgctaaatttcactgagaattgcaccccggatattttggtaccttatttggatgggattgtgagcaaacttcttgtactccttcagagtggaaagcagatggttcaagagggtgctttgacagctttagcatcggtcgctgattcttcacaggagaaatttcagaagtattatgatgctgtgattccatacctaaaagcaattttgttgaatgcaaatgataaatctaatcgtatgcttcgtgccaaagcaatggagtgtattagtctggtaggtatggctgttggaaaagagaagttcagggacgatgccaaacaggttatggatgtcttgatgtcactgcaacaatctcaactggattctgatgatccaaccgcgagttacatgttacaagcgtgggctaggctttgcaagtgcctcgggcaggacttcctcccatacatggggtttgtcatgcctcccttgctccagtctgcacaacttaagcctgatgtgtcaattacatcagcagattctgacgctgaatttgatgaagatgatgacagcattgaaaccattactctcggggataaaagaataggcattaagaccagtgtcttggaggagaaggctacagcatgtaacatgttatgttgctacgctgacgagttgaaggaaggcttttttccttggattgaccaggttgcttccacattggttcctctccttaaattttacttccatgaagaagttaggaaggcagcagcttcagctatgccagaactgttgtcttcagcaaaatgggctatagagaaggggcagtcacaaggccgtgatgcaacttacctaaaacaattgtctgattatataattccaaatttggtggaagctttacacaaggagccagaggtcgaaatttgtgcaagcatgttgggcgcactgaatgaatgcatacaggtatcaggaccacatctagatgaaaagcaagtaaggagcattgtggatgagattaaacaagtcatcactgccagttcatccagaaagcatgaaagagcagagagagccaaagaagaggactttgatgctgaagaaagagaactactcaaggaagaaaatgagctagaagaagaactttttgatcaaattggcgattgcttggggactttgacaaaaacatttagggcgtcttttttgcctttctttgaagagctttcgtcatacctaatacctatgtttggtaaagacaaaacctcagaggaaaggagaatagccatttgtatatttgatgacattgctgagcactgccgcgaagcagctcataaatattatggttcgtttcttccattcttgcttgaagcttgcaatgatgagtgttcagatgttcgacaggcagctgtttatggggttggtgtttgtgccgagtttggtggatctgttttcaaaccccttgttggagaggcactttcaaggttaaatgctgtgataacacatccaaatgcacagcattctgataatgtaatggcatatgataatgctgtttcagctcttggaaaaatatgccagttccaccgtgatagcataaatgcagcacaggttgttccagcctggctaagttgcttgcctataaaaggtgatttaatcgaggctaaggttgtgcatgaccttctttgttcaatggttgaaagatcagataaagaacttataggtcataacaatcaatatctttccaagatcgttgcaatttttgccgagatattatgtgcggggactgatttagcaactgaacaaactgtgagtcggatgattaatttattgagacaacttcaacaaactttgccgccttctacccttgcttcaacctggtcatcgttgcaccctcaacaacaacttgcacttcagtccatcctatcatcctaattgttttggattcttgcgtccatttccttcagaagacgcgtgtctgttgtcatgggatgtcacagttgccctttgtaaagaagctgctgtgtctggtcaattttgttccttagcattgtagtgcttttcagaccaacagatgcacctggtttgtgtttcttgattgctgaaccatatttggtaatccaagtatcaactgcttgacttgtgtggcatggatttgttgctgggaggtgttgagttggttagattgagaaacagttttggtgtcgaatgtgtatgtatatttaagtgttatagttaaaaggaattttttgtgtcgaaggaatgggcattatgcctcgatcctgtacgtggatgaggcatgttacctttagtcatgcttgatacagtaaaccacatggtattcttttgttttttttagggttgtaacagttttgatgagtcattttccttggatgtctgaaacaatttgtcattgatttatttgtatatgtccgtgctctttttctggttttcatgcagtgttgtcaaaccaactcctaaacccaagccatttgcggatatttcaaaacgaaaaaacaaaaggatttttacatgcaaa

SEQ ID NO: 5906 - DNA, 4018 bp, Medicago truncatula
ccgccattcaaaaccaaaaacccttattttcagattttcgagcagcagagagagaatactcttctttcttccctccctctctctctctctctctctctgccctatccatcaaaacactctctctcaattcaattcaattcaattcacaacgatggcgttgaacgatcaaaatcaagcacaaatggctctaattctaggaccagattcaacccacttcgaatccctaatcacaaacctcatgtccaccatcaacgaccaacgttcccaagctgaaaatctcttcaatctctgcaaacaaacctatcccgattccttaatcctcaaactctcccatcttctccacacttcctctaaccccgaaacacgaaccatgtccaccatcctcctccgtcgtcatctcacgcgccaccacgacgactctttcatctacccacacctctccccttcaactcaatccactctccgttctctccttctctcatctctccatcaagaaccaatcaaatccatcgttaagaagctatgcgacaccgtttcggaactcgcttctgctcttctctctgatgacctgtcttcttggcctgacttgcttccgcttctttttcaatgggttacttccaatgatgctaggcttcaggagattgcgttgcttgtttttgcgcaattggcgcattatattggtgaaaccctacttcctcaattgtctactcttcattctgttttccttcgttgtctcagtgctgctacttcctcttcggatgttcgtatcgctgcccttgctgccagtatcaatttcgttcagtgtctctccaattcatccgaccgtgacaggtttcaggatttgctgcccctcatgatgcagacattgaccgaggcattgaattctggtcaagaggcaactgcacaggaggcacttgagcttctcattgagcttgctgggactgagccacgtttcctgcggaggcaaattgttgacattgttggcgccatgctgcagattgctgaggctgagtcgttagaagaagggactcgccatttggctattgagtttgtcgttacacttgctgaggctagagagcgtgctcctgggatgatgaggaagttaccgcagtttgtaaagaagttgtttggtgtgctaatgaatttgttgttggatattgaggatgatcctgcttggcatgctgcggtgagcgaggatgatgatgctggtgagactagtaactacggatttggtcaggaatgtttggatagactttcaattgctttgggcgggaacacgattgtgccagttgcgtctgaattgttgcctacttatttggctgcacctgaatggcaaaaacaccatgctgcactcgttgcacttgcacaaattgcagagggttgttcaaaggtgatgacaaagaacttggagcatgtattatcaatggttttgaattcatttcctgatccaaaccctcgggtgcggtgggcggctataaatgcaatcgggcaattgtccacagatttggggccagacttgcaggataaatatcaccacttagtgcttccggcattagctggagccatggatgattttcaaaatcctcgagtacaggctcatgctgcttctgcagtgctaaatttcactgagaattgcaccccggatattttggtaccttatttggatgggattgtgagcaaacttcttgtactccttcagagtggaaagcagatggttcaagagggtgctttgacagctttagcatcggtcgctgattcttcacaggagaaatttcagaagtattatgatgctgtgattccatacctaaaagcaattttgttgaatgcaaatgataaatctaatcgtatgcttcgtgccaaagcaatggagtgtattagtctggtaggtatggctgttggaaaagagaagttcagggacgatgccaaacaggttatggatgtcttgatgtcactgcaacaatctcaactggattctgatgatccaaccgcgagttacatgttacaagcgtgggctaggctttgcaagtgcctcgggcaggacttcctcccatacatggggtttgtcatgcctcccttgctccagtctgcacaacttaagcctgatgtgtcaattacatcagcagattctgacgctgaatttgatgaagatgatgacagcattgaaaccattactctcggggataaaagaataggcattaagaccagtgtcttggaggagaaggctacagcatgtaacatgttatgttgctacgctgacgagttgaaggaaggcttttttccttggattgaccaggttgcttccacattggttcctctccttaaattttacttccatgaagaagttaggaaggcagcagcttcagctatgccagaactgttgtcttcagcaaaatgggctatagagaaggggcagtcacaaggccgtgatgcaacttacctaaaacaattgtctgattatataattccaaatttggtggaagctttacacaaggagccagaggtcgaaatttgtgcaagcatgttgggcgcactgaatgaatgcatacaggtatcaggaccacatctagatgaaaagcaagtaaggagcattgtggatgagattaaacaagtcatcactgccagttcatccagaaagcatgaaagagcagagagagccaaagaagaggactttgatgctgaagaaagagaactactcaaggaagaaaatgagctagaagaagaactttttgatcaaattggcgattgcttggggactttgacaaaaacatttagggcgtcttttttgcctttctttgaagagctttcgtcatacctaatacctatgtttggtaaagacaaaacctcagaggaaaggagaatagccatttgtatatttgatgacattgctgagcactgccgcgaagcagctcataaatattatggttcgtttcttccattcttgcttgaagcttgcaatgatgagtgttcagatgttcgacaggcagctgtttatggggttggtgtttgtgccgagtttggtggatctgttttcaaaccccttgttggagaggcactttcaaggttaaatgctgtgataacacatccaaatgcacagcattctgataatgtaatggcatatgataatgctgtttcagctcttggaaaaatatgccagttccaccgtgatagcataaatgcagcacaggttgttccagcctggctaagttgcttgcctataaaaggtgatttaatcgaggctaaggttgtgcatgaccttctttgttcaatggttgaaagatcagataaagaacttataggtcataacaatcaatatctttccaagatcgttgcaatttttgccgagatattatgtgcggggactgatttagcaactgaacaaactgtgagtcggatgattaatttattgagacaacttcaacaaactttgccgccttctacccttgcttcaacctggtcatcgttgcaccctcaacaacaacttgcacttcagtccatcctatcatcctaattgttttggattcttgcgtccatttccttcagaagacgcgtgtctgttgtcatgggatgtcacagttgccctttgtaaagaagctgctgtgtctggtcaattttgttccttagcattgtagtgcttttcagaccaacagatgcacctggtttgtgtttcttgattgctgaaccatatttggtaatccaagtatcaactgcttgacttgtgtggcatggatttgttgctgggaggtgttgagttggttagattgagaaacagttttggtgtcgaatgtgtatgtatatttaagtgttatagttaaaaggaattttttgtgtcgaaggaatgggcattatgcctcgatcctgtacgtggatgaggcatgttacctttagtcatgcttgatacagtaaaccacatggtattcttttgttttttttagggttgtaacagttttgatgagtcattttccttggatgtctgaaacaatttgtcattgatttatttgtatatgtccgtgctcttttt

SEQ ID NO: 5907 - DNA, 3728 bp, Gossypium hirsutum
cctaaaaccctgaaactcgcccatggccaccgatcaaactcagctccaactcgctcaactcgcccacatcttgggcccgattcgactcacttcgaaaccctaatctcccacctcatgtcttcctccaacgaccaacgttcccaggccgagtcactcttccaccttgccaaacaaactcaccccgactctctctccctcgctctctcccgtgtcttatcctcatcccctcgccccgaactccgagccctctctgccgtcctcctccgtaaaatcctaactcccgccgctgattactcctttctctttcctctcctggctgaatccacacgcgccgccatcaaagcctcgcttttatcctccctccaaacagaacaatcaaaagctaacgtaaaaaaactctgcgatacaatttccgatctcgcttcttccgtcgttgctactagaggctggccggaactattgccattcctcttccaatgtgtgaattctaagaatcccaacctcgaagaatctgctcttttaattttctctcgattagctcaaaacgtcggagaaacaacggaaaccctaatccctcatttaaacactctccattcagtcttcttcaattgtttatcaaatccgtcaagttgcgacgtacgaatcgcagctttaagcgcctcagtcagtttcattcaatgtatttcaaaccccaaagatcgggacgctttccaagatttgttgccgttgatgatgcagacgttgaccgaggcgttgaactctggattagaagccacagctcaagaggctttggaattgttaattgagttagccgggactgagccgaggtttctaaggaggcaaataatggaagtagtaggatcgatgttacaaattgctgaggcggagagtttagaagaaggaacacgccatttagccattgaatttataattacgttagcagaggcgagagagagggctccggggatgatgaggaagttaccacaattcataaggaggttattttgggtgttgatgaatctattggtggacattgaagatgaaccggattggtataatgcagagagtgaggatgaggatgctggggaaacaagtaattatggggttggtcaggagtgtttggatagattgtcgatttcattaggagggaatactgttgtaccagtggcttcagaattgtttccggtgtttttggctgcttcagagtggcagaaacgacatgctgctctcattgcacttgctcagattgctgagggttgttccaaggtgatgataagaaatctagaacaggtagtgtcaatgattttgaattcatttcacgatgcccatcctcgtgttcgatgggctgctattaatgccattgggcagttgtctacggacttgggcccagagttgcagactcaatatcatcagagagtgttgcctgcactagctggagccatggatgacttccagaatcctcgcgtgcaggcccatgctgcttcagcagtacttaatttcagtgaaaattgtaccccagacatcttaactccatacctggatgggattgtgagcaaacttcttgtactgcttcagaacgggaagcaaatggtccaggagggtgctttgacggctttggcatcagttgctgattcatctcaggagcaattccagaaatattatgatgctgtgatgccttacttgaaagctatcttggttaatgcaaatgataaatctaatcgtatgcttcgtgccaaagctatggagtgcattagtttggttggcatggctgttggaaaggaaaaatttagggatgatgctaaacaggttatggacgtcttgatgtcattgcaagtatctcaaatggaatcagatgatccaacaacgagctacatgttgcaggcttgggccaggctttgcaagtgccttggacaggattttcttccttacatgagtgttgttatgccccctctgcttcaatctgcgcagcttaagcctgatgtaacaatcacatctgctgattctgatgctaatgttgatgatgacgatgatgaaagcattgagactatcactcttggtgatagaaggatagggatcaaaacgagtgttttggaagaaaaagctacagcttgcaacatgttatgttgttatgctgatgagttaaaggaagggttcttcccgtggattgatcaggttgctacgactttagttccccttctaaaattttattttcatgaagaagttaggaaggcagctgtttcagccatgccggagctgttacgttctgctaaactagctgttgagaaagggcaagctcaaggtcgaaatggaacatatataaagcagttgacggattacataataccagctttggtggaggctttacacaaggagcctgaggtagaaatttgtgggagcatgttggattcattgaatgaatgcatagagatttgtggaccatttcttgatgagggccaaataaaatgcattgttgatgagattaaacaggtaatcacagctagctcagctagaaaacaagaaagagcagagagggccaaagctgaggactttgatgaagaagaaggtgaaatgcttaaggaggaaaatgagcaagaagaagaagttttcggtcaacttggtgatttgttgggaactttgatcaaaacattcaaggcatccttcttgcctttcttccaggagcttacatcttatataacccctatgtggggtaaggataaaacagccgaagaaaggagagttgctatctgtatatttgatgatattgctgagcactgtcgtgaggcagctcttaagtattatgacacatatcttcccttccttttggaggcatgcaatgatgaaagccctgatgttcgacaggcagctgcttttggggttggcttgtgtgctgagtttggcggatcggtgttcaaacctcttatccaagaggccctctccaggctgaatgctgttatcagacaccctaatgcattgcatttggacaatgtgatggcttatgacaatgctgtttccgctcttggaaaaatatgccaatttcatcgggatagtatagatgctgctcagattctcccagcttggttaagttgcttgccgataaaaggtgatctgattgaggccaagattgttcacgaacagctatgttctatggttgaaaggtcagatcaggaacttttagggcccaacaatcaatatcttcctaagatagtttctgtttttgcagaggttttatgtgctggtaaagatctggcaacagagcaaactgctagtagaatgataaatctgataaggcacttccagcaatcattacctgcatctacactggcatcaacctggtcatccttgcagccacagcagcagcttgctttgcaatcaattctatcatcctagttatggtgtcattgatgaggaaagcttctgattcctgtattcttagccttctacaaattaaaaaaaaaaatcaattatggattttatataatagaaggtaaaagaaaagtagaaagtggtgagggttttgttggtgagtaatgttttcacctatttatttattgttttgatagcatgttctataattttttttggcactgttttggccaatgcgtatggtggttgaaggttgaatatagcaaaattttggtataggaagtgcataataataatacaagggacttgtaattggtcccttcctttctctacaaaaaaaaaaaaaaagaaaagtaccgactgcg

SEQ ID NO: 5908 - DNA, 4125 bp, Pseudotsuga menziesii
tgtgagtggttaggcttaaaagttaacgagattttggcggcacttaacagagatttaagcctgcgggaggagtttgtaaaaaccctcttcttcgccgttgagtcctgtgttatttgggtcgacgactccttcgcgctcccatatcatctcttctcttgattttgttatctccaccggcggcggcggcatcagccagcaaggaggctgagcattaattctgaattgagagagatcgatctagtccattagctagctacgatggatcaatccaagggcaccatcgcaataactgcagaggtggaggcgcagataaacgctgtgttggggtcggaatcagcggcgttcgaggccctgataacgcacctcatgagcgccggcaatgagcagagaggccaagcagaggcgttgtttaacatctgcaaggagaagcacccggatgcgctggccctgaagctcgttcatgtcctgcaatcatgcgggcaggtggaaatccgggccatggccgcgattctccttaggaagcagatcacacgggacgagacatacatatggccacgattgtcaccacccacgcagaccgccatcaaggcccacctcctcgtctgcgtccagagggaggaggccaagaccatcgtcaagaagctatgcgacaccgtagccgagctcgcagcctccatcatggaagaaggtcagtggccggagttattgcccttcatgttccagtgcgtgagctccgattccccgcgcctcaaggagagtgcgttgctcatgtttgcgcagctctcgcagttcataggcgagcatctccacccccatctctccaccctacacaccgtgttccatcagtgcctctccccggcttccccgtcagacgttcgaatcgcggccctcgcagccacgaccaacttcgtccagacgatcgagactccgcaggaccgcgagcgcttccaggacctaatccctgctatgatgcagacgctcacagaagccctcaacaggaacgaggaggcaacagcccaggaggccctcgagatgttcatcgagttagcgggcacagagccacgtttcctccgccggcagatcgttaacgtggtcggaagcatgctgcagatcgccgaggccgagtccctggaagagggcactcgacatctcgccatagagttcattattaccctcgcagaggcccgggagcgtgcccctggaatgatgcgcaagttccctcagtttatcggtaggctttttgctattcttatgaaaatgcttctcgacatcgaggatgatcctgcctggcatgctgccaataccgaggacgaggatgctggtgaatcaagtaattacagtgttggtcaagagtgcttggaccgtttggctatttctctaggtggaaacaccatcgtccccgttgcctccgagttgcttcctgcctttttggccgatcctgattggcggaaacatcatgctgctctcatcactcttgctcaaatcgcagaaggctgtgccaaggtgatgctaaaaaaccttgaacaagttgtctcgatggttctgaagtcattccaagatccacatcctcgtgtacgatgggcagccatcaatgccattgggcagctttcaactgatttgggcccggatttgcaacaacaataccatcagcaagttttgcctgcacttgctggagctatggatgattatcaaaatcctagagtgcaggcacatgctgcttcagcagtgctcaacttcagtgaaaattgtacacctgatattttgacaccatacttggatggtatagtgagcaagctgcttgttcttttgcagaatggaaggcagatggtgcaggagggttctttaacagctttagcatctgttgccgattcctctcaggagcactttcagaagtattacgatgcagtcatgccttatctgaagtccatattaatgaatgccactgacaaatccaaccgcatgctgcgtgccaaatctatggaatgcattagcctagttggaatggctgtgggaaaagagaaattcagaaacgatgctaaggaggtaatggaggtgctgatgagcctgcaaggatctcagatggaggctgacgacccaaccataagctacatgttacaagcgtgggcaagactttgcaagtgtttgggacaagatttccttccttacatgaatgtggtgatgcctccacttcttcaatctgcccagctgaaaccagatgtgaccatcacttctgcagactcagataatgatattgatgattcagatgatgaaagtgtggagacaattactcttggggataaaaaaattggtatcaagacaagtgttttggaggagaaggctacagcttgcaacatgctatgctgctatgctgatgaattaaaagagggcttctatccatggattgatcaggttgcaccgacactagttcctcttctgaaattttacttccatgaagaagttcgaaaagctgctgtttcagcaatgccggagcttttgcaatctgccaaattggctgtcgagaagggactggctcatggacgggatcagaactatgtgaagcaattgtcagattatatcatacctgcattggttgaggctttgcacaaggaacctgaaactgaaatatgttcaagcatgctggatgcattgaatgaatgcatacagatatcaggtgtcttgcttgatcaaaaccaagtaaagtctatagtggatgaacttaaacaagttatcacagcaagtgcaactagaaagagagaacggacagaacggacaacggcagaagattttgatgcagaggaaggggaaatacttcaagaggaaaatgaacaggaagaagaagtttttgatcaagttggtgaatgcataggaactctcattaagacattcaagtcctcattcttaccattctttgatgagctctcatcttatataacacctatgttggggaaagataaaacaacagaagagagacgaattgcaatatgcatttttgatgatgtagctgaacaatgtcaagcagctgctgtaaaatattatgacacatttctacctttcttgctggaagcctgcaatgattctaatgcagatgtgcggcaggctgcagtttatggtattggtgtatgtgctgaatttggtggatctaaattcaagactcttgttggtgaggcactttcaaggctgaattttgtcataagtcaaccaaatgcacgggactccgataatgtaatggcaactgataatgcaatttctgcattaggaaaaatctgccaatttcatcgcgacagcatagatgcaccgcatgttgttccagcctggctgagttgcttgcctataaaaggtgatttaattgaagctaaaattgttcatgaacagctgtgttccatggtggagaggtctgatatggagcttctgggtcctaacaatcaatatttacctaaaatcgtttctgtatttgcagaggttttatgtgctggcaaagaccttgcaacagagcagactattgcaaggatggtcaatctcttgagacagttgcagcaaactctttccccgtcagctcttgcttctacatggtcttccttgcaacctcagcagcaattggcactgcaatcaattttgtcttcataaatgtattattgccttgttgaatttatctgtgggcttgtagagatgcatgaattactattccttcattattggattaatgttgtttgactggactacttagtcgggtgtcttattgttcattctttcatgtagtcattcatttctagatggttttctgtaaggcagctatgcatttttcaatgtggagagttttgtccatcgatccatgtggcccatggcgtcaaatgggttttccgtagttttagattattgtattatagtctgctatttagcagaagaatgtagatgtctctggtatgtgtgacgatgtcaaagtgcagtgtgaaagattttgcgaactcatgaatctgtatttttgtctcgtatctttagctggataacagaaagcgggttgaatgcaggaggaaaaatgccgttgtgaaatggcatgagcttccttatttgaccagcattgtagtgcacgaggcactatatttattcaaaagaattttattaaaatcc

SEQ ID NO: 5909 - DNA, 4121 bp, Gossypium raimondii
gacaacttttggtttcgtttaaaacactcgcactcgctctcgcaaaccctgccttaaaattcgtatcttcttctttatttcttctttcctttcgttatattgggattggggaggcgccacaaatacaaaaaaccccaaataacaaaaacaaattatatcctcctaaaaccctgaaactcgcccatggccaccgatcaaactcagctccaactcgctcaactcgcccacatcttgggccccgattcgactcacttcgaaaccctaatctcccacctcatgtcttcctccaacgaccaacgttcccaggccgagtcactcttccaccttgccaaacaaactcaccccgactctctctccctcgctctctcccgtgtcttatcctcatcccctcgtcccgaactccgcgccctctccgccgtcctcctccgtaaaatcctaactcccgccgctgattactcctttctctttcccctcctagctgaatccacacgcgccgccatcaaagcctcgcttttatcctccctccaaaccgaacaatcaaaagctaacgtaaaaaaactctgcgatacaatttccgatctcgcttcttccgtcgttgctactagaggctggccggaactattgccattcctcttccaatgtgtgaattctaagaatcccaacctcgaagaatctgctcttttgattttctctcgattagctcaaaacgtcggagaaacaacggaaaccctaatccctcatttaaacactctccattccgtcttcttcaattgtttatcaaatccgtcaagttgcgacgtacgaatcgcagctttaagcgcctcagtcagtttcattcaatgcatttcaaaccccaaagatcgggacgctttccaagatttgttgccgttgatgatgcagacgttgaccgaggcgttgaactctggattagaagccacagctcaagaggctttggaattgttaattgagttagccgggactgagccgaggtttctaaggaggcaaataatggaagtagtaggatcgatgttacaaattgctgaggcggagagtttagaagaaggaacacgccatttagccattgaatttataattacgttagcagaggcgagagagagggctccggggatgatgaggaagttaccacaattcataaggaggttattttgggtgttgatgaatctattggtggacattgaagatgaaccggattggtataatgcagagagtgaggatgaggatgctggggaaacaagtaattatggggttggtcaggagtgtttagatagattgtcgatttcattaggagggaatactgttgtaccagtggcttcagaattgtttccggtgtttttggctgcttcagagtggcagaaacgacatgctgctctcattgcacttgctcagattgctgagggttgttccaaggtgatgataagaaatctagaacaggtagtgtcaatggttttgaattcatttcacgatgcccatcctcgtgttcgatgggctgctattaatgccattgggcagttgtctacggacttgggcccagagttgcagactcaatatcatcagagagtgttgcctgcactagctggagccatggatgacttccagaatcctcgcgtgcaggcccatgctgcttcagcagtacttaatttcagtgaaaattgtaccccagacatcttaactccatacctggatgggattgtgagcaaacttcttgtactgcttcagaacgggaagcaaatggtccaggagggtgctttgacggctttggcatcagttgctgattcatctcaggagcaattccagaaatattacgatgctgtgatgccttacttgaaagctatcttggttaatgcaaatgataaatctaatcgtatgcttcgtgccaaagctatggagtgcattagtttggttggcatggctgttggaaaggaaaaatttagggatgatgctaaacaggttatggacgtcttgatgtcattgcaagtatctcaaatggaatcggatgatccaacaacgagctacatgttgcaggcttgggccaggctttgcaagtgccttggacaggattttcttccttacatgagtgttgttatgccccctctgcttcaatctgcgcagcttaagcctgatgtaacaatcacagattctgatgctaatgttgatgatgacgatgatgaaagcattgagactatcactcttggtgataaaaggatagggatcaaaacgagtgttttggaagaaaaagctacagcttgcaacatgttatgttgttatgctgatgagttaaaggaagggttcttcccgtggattgatcaggttgctactactttagttccccttctaaaattttattttcatgaagaagttaggaaggcagctgtttctgccatgccggagctgttacgttctgctaaactagctgttgagaaagggcaagctcaaggtcgaaatggaacatatataaagcagttgacggattacataataccagctttggtggaggctttacacaaggagcctgaggtagaaatttgtgggagcatgttggattcattgaatgaatgcatagagatttgtggaccatttcttgatgagggccaaataagatgcattgttgatgagattaaacaggtaatcacagctagctcagctagaaaacaagaaagagcagagagggccaaagctgaggactttgatgaagaagaaggtgaaatgcttaaggaggaaaatgagcaagaagaagaagttttcggtcaacttggtgatttgttgggaactttgatcaaaacattcaaggcatccttcttgcctttcttccaggagcttacatcttatataacccctatgtggggtaaggataaaacagccgaagaaaggagagttgctatctgtatatttgatgatattgctgagcactgtcgtgaggcagctcttaagtattatgacacatatcttcccttccttttggaggcatgcaatgatgaaagccctgatgttcgacaggcagctgcttttggggttggcttgtgtgctgagtttggcggatcggtgttcaaacctcttatccaagaggccctctccaggcttaatgctgttatcagacaccctaatgcattgcatttggacaatgtgatggcttatgacaatgcggtttccgctcttggaaaaatatgccaatttcatcgggatagtatagatgctgctcagattctcccagcttggttaagttgcttgccgataaaaggtgatctgattgaggccaagattgttcacgaacagctatgttctatggttgaaaggtcagatcaggaacttttagggcccaacaatcaatatcttcctaagatagtttctgtttttgcagaggttttatgtgctggtaaagatctggcaacagagcaaactgctagtagaatgataaatctgataaggcacttccagcaatcattacctgcatctacactggcatcaacctggtcatccttgcagccacagcagcagcttgctttgcaatcaattctatcatcctagttatggtgtcattgatgaggaaagcttctgattcctgtattcttagccttctacaatttaaaaaaaaaaaaatcaattatggattttatataatagaaggtaaaagaaaagtagaaagtggtgagggttttgttggtgagtaatgttttcacctatttatttattgttttgatagcatgttctataattttttttggcactgttttggccaatgcgtatggtggttgaaggttgaatatagcaaaattttggtataggaagtgcataataataatactaaagggacttgtaattggtccctttctctcaaattgttaatggtggtttcagcatcattttcatcatcaagctaacattaaacgcattcctttagatttaagatttactacaacattgaataaacatgcagcaaattaacagttatctttttatgacacctaataattcaatgcatcgagaaaatctaaaaccagactttcaaaggataaacacacaaaactaaaataaacagcaacaaaagcaagaatttaatgaaggtttacaattcctgaagggaaacaaattacgtaacacaagaa

SEQ ID NO: 5910 - DNA, 726 bp, Vigna unguiculata
agtgtgagtgcttgcgagagtgagtgagagagtgatatggcgtgtctgagattcttacacgcagcactaccacaggctcagctcacactagggtttccttcgccacctcaatttctcaccattgctccacctctcaaattctctctctcctcttctaccttcaggtgcaaaacttttacgagattgaaagtgaatcagagggtgttgactgtgttcgcagcaaaccctaactctgtagatgggaaatcaaccaaagaaggatcagatgtaaatgaaagtagcaatgctggtcagggacctcctatccttactattttggctggattttttgtccttttcgtcgtttgttggagcatttggtccattatagcgtggctgataagtttgatagttactgcacctgctccgaaataaatttgatcataatgtttgtgtttgtattttaagccactgcattagtccttatgaatttgtcatagtttctttctacgcttttcgacttagtagtattttagtgctaaacatgataaagtgagccaaaagctggtaaagggaagaaaaagaattggtaactcctaatgctggttctaagtgggagagagcttatgttcaaatatttgtgtgactttggtatatattttgaagaactctgtagttgcttaatcttttgaatatgtctacatatattttggagaacagtagatccattgggtcagatattttgac

SEQ ID NO: 5911 - DNA, 1687 bp, Cajanus cajan
gaaaacacaagattgaactttttaacgaaaaactagaggcaggcaaaggttgccaaccactccatagctctcgtaaccctaaaactggttttgaagggctaaatattcattccagatcacataaaacaaacaagagtgtagcgagggagagtaatagcatcactgaactggtggtgtcgagggatggatgcgatacggaagcagctcgatgtgctgatgggagcaaaccgtaacggcgacgtccgcgaagtcaatcgcaagtactacgatcgcgatgtctgtcgcctctatctcgttggtctctgccctcacgagcttttccagttaacgaaaatggatatgggtccttgccctaaggtccactccttgcagctccgtaaagaatatgaggaggcgaaagcgaaagggactgataactatgatagggagttggaggatgttatagacaagcttattggcgagtgtgataggaaaattggcagggctctcaagcgtcttgaggatgaggatgcgaaagctgcaattgcgatttcggtctctgaagttactcagacacctgaggtgctggagttgtcgaagcaaatcaaggagaagttgaaagaagctgatcaatatgatcttgaaggcaagacagatctcaagattcgagctctagaggttgttgaggaacttagaactaagagagcagacaagcagtctatgcttcttttagatgcctttaacaaagatagggcatctttacctacacctctgccaaatccaccaccgctggcacccattcctgtagttgctcctgatcctcgaacacaggagatgataaatgaaaagctgaagaaggctgaggatctcggtgagcaaggaatggttgatgaggctcaaaaagcattggaagaggctgaagcacttaagaagcttccttccaggcaggagccagtgctggattcttcgaagtatacagctgcagatgtgcggattactgatcagaagcttcgtgtgtgcgacatttgtggagcatttttgagtgtttatgacagtgatcgtcgtttagctgatcattttggagggaaacttcatttagggtatatgcagattcgtgaaaagttagcagaacttcaagaagaaaggaacaagagtagaaagactgatcggcatgatgacaggagatcaaaagaacgtagtagggatcgagacagggagtcgagtaaggaccgtgaacgaggtgatagtcgtgaacgagggcgggactatgaccgtaggagcagagatcgtgataggcattatgatagagatcgtggatatgatcgagaccgagactcggatcgctcccgtacctatgactcaagaagtcgtcggaggtcacgttctagatcccgagagaggtctagagattatgatcgacacaggcgttatgatcgatactagcgatcgccatgtgaatcttatggatatgacaatgtctagactaggtgggtgttgaacctcatgttggacaaataattttgcaattccttccgtgttaaactatttctggaatgatggatgtaatttgagcttaggtgtagctatattatggtttgttgttgcttttccagattttaaatccaatttgtaatatgcctacttcgaagcagttcttgcaattgtgcttaacatgagagtagtttgattttaactaccattttcagtc

SEQ ID NO: 5912 - DNA, 1710 bp, Glycine max
ccaaacctgtcttaaccctaatactggttgacattacataatttcgagggtaaatattcattcactcaataacaacacaaacccaacccaaagataaaaacacaacacaagacactgaactcactggtgtgcaaccatggatgcgatacggaagcagctcgatgtgttgatgggagcgaaccgtaacggcgacgtccgtgaagtcaatcgcaagtactacgatcgcgacgtctgtcgcctctacctcgtcggtctctgccctcacgaactcttccagttaacgaaaatggatatgggcccctgccctaaggtccactccttgcagctccggaaagaatatgaggaggcgaaagcaaaggggaccgataattatgacagggagttggaggatgttatagacaagcttattggtgagtgtgacaggaaaatagggagggctctaaagcggctcgaggatgacgatgcgaaagctgcgattgcgatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcccacacctctgccaaatccaccacctttggcacctcttcctgtagttgctcctgatgctcgaacacaagagatgataaatgaaaagctgaagaaggctgaggatcttggtgagcaaggaatggttgatgaggctcaaaaagcactggaagaggctgaagcacttaagaagcttcctgccaggcaagagccagtgttggattcttcaaagtatacggcggcagatgtccggattactgatcagaagctacgtgtgtgcgacatttgtggagcatttttgagtgtttatgacagtgatcgccgtttagctgatcattttggaggcaaactacatttagggtatatgcagattcgcgagaagttagctgaacttcaagaagaaagaaacaagagccgaaagactgatcggcttgatgacaggagatcaaaagaacggagtagggatcgagacagggagtcgagtagggaccatgaacgtggtgatagtcgtgaacgagggcgagaccatgatcgtaggagcagagatcgtgataggcattatgatagagatcgtggatatgatcgcgaccgtgacagagactcagaccgcacccgctcctatgactcaagaagccgtcggaggtcacgctctagatcccaagagcgatctagagattatgatcgacataggcgtcatgatcgatactagcaattgccatgaatcttatgggtatgagaaaatgtctagtttaggtgggtgttgaacctcatgttggacaaataattttgcaatttcttctgtattgaaccgtttcttggatgatggatgtaactcaagctttaggtgtcagctaaactatggtttgatgttgctttgcagacattaaaaccaatttgtaatctgccttactttggagcagttcttgctatgtgcttaaaaatagtagtttgattggattgccatttacagtcctctcgtgcaaaataaatgaattaaaaataatgctcacgcatgtcacatttcgtatttaagtaact

SEQ ID NO: 5913 - DNA, 1611 bp, Glycine max
attcactcaataacaacacaaacccaacccaaagataaaaacacaacacaagacactgaactcactggtgtgcaaccatggatgcgatacggaagcagctcgatgtgttgatgggagcgaaccgtaacggcgacgtccgtgaagtcaatcgcaagtactacgatcgcgacgtctgtcgcctctacctcgtcggtctctgccctcacgaactcttccagttaacgaaaatggatatgggcccctgccctaaggtccactccttgcagctccggaaagaatatgaggaggcgaaagcaaaggggaccgataattatgacagggagttggaggatgttatagacaagcttattggtgagtgtgacaggaaaatagggagggctctaaagcggctcgaggatgacgatgcgaaagctgcgattgcgatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcccacacctctgccaaatccaccacctttggcacctcttcctgtagttgctcctgatgctcgaacacaagagatgataaatgaaaagctgaagaaggctgaggatcttggtgagcaaggaatggttgatgaggctcaaaaagcactggaagaggctgaagcacttaagaagcttcctgccaggcaagagccagtgttggattcttcaaagtatacggcggcagatgtccggattactgatcagaagctacgtgtgtgcgacatttgtggagcatttttgagtgtttatgacagtgatcgccgtttagctgatcattttggaggcaaactacatttagggtatatgcagattcgcgagaagttagctgaacttcaagaagaaagaaacaagagccgaaagactgatcggcttgatgacaggagatcaaaagaacggagtagggatcgagacagggagtcgagtagggaccatgaacgtggtgatagtcgtgaacgagggcgagaccatgatcgtaggagcagagatcgtgataggcattatgatagagatcgtggatatgatcgcgaccgtgacagagactcagaccgcacccgctcctatgactcaagaagccgtcggaggtcacgctctagatcccaagagcgatctagagattatgatcgacataggcgtcatgatcgatactagcaattgccatgaatcttatgggtatgagaaaatgtctagtttaggtgggtgttgaacctcatgttggacaaataattttgcaatttcttctgtattgaaccgtttcttggatgatggatgtaactcaagctttaggtgtcagctaaactatggtttgatgttgctttgcagacattaaaaccaatttgtaatctgccttactttggagcagttcttgctatgtgcttaaaaatagtagtttgattggattgccatttacagtcctctcgtgcaaaataaatgaattaaa

SEQ ID NO: 5914 - DNA, 1852 bp, Glycine max
agaggcaaagcaaatgtcaccgaccaccgaagctctcttaaccctaacactggttgacattgcatataataatagcagtgtttttagagggtaaatattcattgattcattgattccagatcctgaactcaacaacaacccaaagataaaaagcacaacacaagacactgaactcgcactcactgggttttcaaccatggatgcgatacggaagcagctcgatgtgttgatgggagccaaccgtaacggcgacgtccgtgaagtcaatcgcaagtactacgatcgcgacgtctgtcgtctctacctcgtcggtctctgccctcacgaactcttccagttaacgaaaatggatatgggcccttgccctaaggtccactccttgcagctccggaaagaatacgaggaggcgaaagcaaaggggaccgataattatgacagggagttggaggatgtaatagataagcttattggtgagtgtgataggaaaattggcagggctctaaagcggctcgaggacgacgatgcgaaagcggctattgcaatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcctacacctctgccaaatccaccacctttggcacctcttcctgtagttgctcctgatgctcgaacacaggagatgataaatgaaaagctgaagaaggctgaggatcttggtgagcaaggaatggttgatgaggctcaaaaagcattggaagaggctgaagcacttaagaagcttcctgccaggcaggagccagtgttggattcttcaaagtatacagctgtggatgtgcggattactgatcagaagctacgtgtgtgcgacatttgtggagcatttttgagtgtttatgacagtgatcgccgtttagctgatcattttggaggcaaacttcatttagggtatatgcagattcgtgagaagttagccgaacttcaagaagaaaggaacaagagccgaaagactgatcggcttgatgacaggagatcaaaagaacggagtagggatcgagacagggagtctagtagggaccgtgaacttggtgatagtcgtgaacgagggcgagaccatgatcgtaggagcagagatcatgataggcattatgatagagatcgtggatatgatcgagaccgtgacagagactcagaccgcacccgctcctatgactcaagaagtcgtcggaggtcacgctctagatcccgagagcgatctagagattatgatcgacataggcgtcatgatcgatactagcaattgccatgaatcttatgggtatgagaaaatgtctagtttaggtgggtgttgaacctcatgttggacaaataattttgcaatttcttctgtgttgaaccgtttctcggatgatggatgtaacttgagcttaggtgtcgctaaattatggtttgatgttgctttgcagacattaaatccaatttgtaatctgccttactttggagcagttcttgctattgtgcttaaaaatagtagtttgattggattgccatttacagtcctcgtgcaaaataaataaatatataaaatgctcacgcacttgtcacattcgtgttttaagtaacttaggaattactgataaaaaagtaacttaggaattgacttaaccaatcaattttgcttttaatatggttcaccctagaattcaac

SEQ ID NO: 5915 - DNA, 1721 bp, Glycine max
cgaagctctcttaaccctaacactggttgacattgcatataataatagcagtgtttttagagggtaaatattcattgattcattgattccagatcctgaactcaacaacaacccaaagataaaaagcacaacacaagacactgaactcgcactcactgggttttcaaccatggatgcgatacggaagcagctcgatgtgttgatgggagccaaccgtaacggcgacgtccgtgaagtcaatcgcaagtactacgatcgcgacgtctgtcgtctctacctcgtcggtctctgccctcacgaactcttccagttaacgaaaatggatatgggcccttgccctaaggtccactccttgcagctccggaaagaatacgaggaggcgaaagcaaaggggaccgataattatgacagggagttggaggatgtaatagataagcttattggtgagtgtgataggaaaattggcagggctctaaagcggctcgaggacgacgatgcgaaagcggctattgcaatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcctacacctctgccaaatccaccacctttggcacctcttcctgtagttgctcctgatgctcgaacacaggagatgataaatgaaaagctgaagaaggctgaggatcttggtgagcaaggaatggttgatgaggctcaaaaagcattggaagaggctgaagcacttaagaagcttcctgccaggcaggagccagtgttggattcttcaaagtatacagctgtggatgtgcggattactgatcagaagctacgtgtgtgcgacatttgtggagcatttttgagtgtttatgacagtgatcgccgtttagctgatcattttggaggcaaacttcatttagggtatatgcagattcgtgagaagttagccgaacttcaagaagaaaggaacaagagccgaaagactgatcggcttgatgacaggagatcaaaagaacggagtagggatcgagacagggagtctagtagggaccgtgaacttggtgatagtcgtgaacgagggcgagaccatgatcgtaggagcagagatcatgataggcattatgatagagatcgtggatatgatcgagaccgtgacagagactcagaccgcacccgctcctatgactcaagaagtcgtcggaggtcacgctctagatcccgagagcgatctagagattatgatcgacataggcgtcatgatcgatactagcaattgccatgaatcttatgggtatgagaaaatgtctagtttaggtgggtgttgaacctcatgttggacaaataattttgcaatttcttctgtgttgaaccgtttctcggatgatggatgtaacttgagcttaggtgtcgctaaattatggtttgatgttgctttgcagacattaaatccaatttgtaatctgccttactttggagcagttcttgctattgtgcttaaaaatagtagtttgattggattgccatttacagtcctcgtgcaaaataaataaatatataaaatgctcacgcacttgtca

SEQ ID NO: 5916 - DNA, 1659 bp, Arachis hypogaea
gggccgggagtgagtgagtgtgtgtgtaaaaaacagaaaaaggtagtaagaagcaaaataaatcccgtcgtcgaaatcctcccaatctgcatcaatagaaaccctaaccattgggtaggtgtttctcctgctcctcctcctcctcctcctccgaccaccaccatggatgccataaggaagcagctggacgtgttaatgggagcaaatcggaacggtgacgtcagagaggtcaaccgcaagtactacgatcgagacgtctgccgcctctacctcgtcggtctctgcccacacgaactcttccagctcaccaaaatggatatgggtccatgccccaaggttcactccttgcagcttcggaaagaatatgaggaagcaaaagcgaaagggacagataattatgacagggagttggaggatgttatagacaagctcattggtgaatgcgataggaagattggtagagctctgaagcgtcttgaggatgaagatgcaaaagcggcaattgcaatttcagtctctgaagttactcagactcctgaggtgctcgagttgtcaaaagaaatcaaggagaagttgaaagaagctgatcaatatgatcttgaaggcaagacagatctcaagattcgtgctttagaggttgtggaagaacttagaactaaaagagcagacaagcagtccatgctcctgttagatgcctttaacaaagacagggcatctttacctcaacctctgccaaatccacctcctttggctcccattcctgttgctgctcctgatcctcgaactcaagagatgataaatgagaagttgaagaaagccgaggaccttggcgagcaaggaaaggttgatgaggcgcaaaaagcattggaagaagccgaagcacttaagaagcttccggcaaggcaggagcctgtagtggataattcaaattcttcaaaatatacagctgctgatgtgcggattactgatcagaagctacgcgtgtgtgacatatgtggagcatttttgagtgtttatgacagtgatcgccgcttagctgatcattttggagggaaactccatttagggtatatgcagattcgagagaagttagcagaactccaggaggagaggaccaagagccggaagtcacttgatgacaggagatcaaaagaaaggagtagggatcgtgagccaagtagggaccgggatcgaggtgacagtcgtgaacgagggcgagactatgatcgtaggagtagagaccgcgataggcatcacgacagagatcgtggatatgatagagaacgtgacagagactatgatcgatcaagacgtcggaggtcccgctcaagatcacgagagagatccagggactatgatcgccacaggcgctatgatcggtactaggtatttgatgtggatcatttggattatgatataatattttagtagcctggtgtcggacaaaataattttgcaatttctgtgttgagaggattctccaatgatggatgtaacttgagctttaggtgtagctttatggttttgatggattgatgttggttcagagctattgagtccaccttgtaatttgcctacttggatcacttcatcgacatttgcactttttaaaatagttggtttattgtcttaacatttgttatccatccgaaatacgat

SEQ ID NO: 5917 - DNA, 1646 bp, Arachis hypogaea
cgggggagtgagtgtgtgtgtaaaaaaacagaaaaaggtagtaagaagcaaaataaatcccgtcgtcgaaatcctcccaatctgcatcaatagaaaccctaaccattgggtaggtgtttctcctgctccttctcctcctcctcctcccaccaccaccatggatgccataaggaagcagctggacgtgttaatgggagcaaatcggaacggtgacgtcagagaggtcaaccgcaagtactacgatcgagacgtctgccgcctctaccttgtcggtctctgcccacatgaactcttccagctcaccaaaatggatatgggtccatgccccaaggttcactccttgcagcttcggaaagaatatgaggaagcaaaagcgaaagggacagataattatgacagggagttggaggatgttatagacaagctcattggtgaatgcgataggaagattggtagagctctgaagcgtcttgaggatgaagatgcaaaagcggcaattgcaatttcagtttctgaagttactcagactcctgaggtgcttgagttgtcaaaagaaatcaaggagaagttaaaagaagctgatcaatatgatcttgaaggcaagacagatctcaagattcgtgctttagaggttgtggaagaacttagaactaaaagagcagacaagcagtccatgctcctgttagatgcctttaacaaagacagggcatctttacctcaacctctgccaaatccacctcctttggctcccattcctgttgctgctcctgatcctcgaactcaagagatgataaatgagaagttgaagaaagccgaggaccttggcgagcaaggaaaggttgatgaggcgcaaaaagcattggaagaagccgaagcacttaagaagcttccggcaaggcaggagcctgtagtggataattcaaattcttcaaaatatacagctgctgatgtgcggattactgatcagaagctacgcgtgtgtgacatatgtggagcatttttgagtgtttatgacagtgatcgccgcttagctgatcattttggagggaaactccatttagggtatatgcagattcgagagaagttagcagaactccaggaggagaggaccaagagccggaagtcacttgatgacaggagatcaaaagaaaggagtagggatcgtgagccaagtagggaccgggatcgaggtgacagtcgtgaacgagggcgagactatgatcgtaggagtagagaccgcgataggcatcacgacagagatcgtggatatgatagagaacgtgacagagactatgatcgatcaagacgtcggaggtcccgctcaagatcacgagagagatccagggactatgatcgccacaggcgctatgatcggtactaggtatttgatgtggatcatttggattatgatataatattttagtagcctggtgtcggacaaaataattttgcaatttgtgttgagaggattctccaatgatggatgtaacttgagctttaggtgtagctttatggttttgatggattgatgttggttcagagctattgagtccgccttgtaatttgcctacttggatcacttcatcgacatttgcactttttaaaatagttggtttattgtgttaacatttgttatccatccaaaa

SEQ ID NO: 5918 - DNA, 2207 bp, Prunus mume
aacaaacacaatccaaatcctcttttaataatttttttccccaaaactctccaaatccctaacgagccctaatctctttctcgctcagtgagccaactgaaatccaccactccaaagttgtagagacgactagagggggagtgatcagccatggacgcgctgaggaagcagctggaccagcttatgggggccaatcgaaacggcgacgtccgagaggtcaaccgcaaatattacgatcgcgaagtgtgtcgcctctacttggtcgggctctgcccccacgagcttttccagttaacgaaaatggatatgggtccctgccctaaggtccactcgttgcagctcagaaaagaatacgaagaagccaaagcaaaagggactgataactatgacagagacctggaggatgtcatagataggctcattgttgagtgtgataggaaaattgctagagctcttaagcgccttgaggatgatgatgcaaaggctgctattgcaatttctgtctctgaagttactcagacgccagaggtactcgagttgtcaaagcagatcaaggaaaagttgaaagaagttgatcaatttgatcttgaaggcaagacagatcttaagattcgggctatggagatagtagacgaactcagaggcaagagagcagataaacagtccatgcttcttttggatgctttcaataaggatagggcatccttacctcaacccctgccaaacccgccacctttggcacccttgcctgtagttgttcccgatgcccgaacacaggaaatgataaatgaaaagttgaagaaggcagaggaccttggtgagcaaggaatggttgatgaggcacaaaaagcgctggaagaggctgaagcactgaagaagctgcctgccagacaggagcctatcctggattcctctaagtacactgctgctgatgtgcgcattactgatcaaaagctacgtgtttgtgacatctgtggagcatttttgagtgtttatgacagtgaccgtcgtttagcggatcactttggcgggaagcttcatttaggctatatgcaaatccgtgagaagttagcagagctgcaggaagagagaaacaagattcgcaaggttgatcgggctgaggataggagatcaaaagagcgaagtaaggaacgcgacagggaatcaagtagggatagggaacgaggagatagccgcgaccgaggtagggatcatgatcgtaggagcagagatcgtgataggtattatgatcgagatcgcggatatgatcgcgagcgtgacagagattcagatcgctcccgcaattatgattcgagaagtcgccgtaggtcacgctcacgatcaagggagcgttccagggattatgatcgccacaggcgttatgatcggtactaggtcatccttgctatggagcatgtggcaaaagcataatttgtgttcttgtctaggtcagttttaaaactcgtgtaccaagatgattttatgtgtttctttttcgatattgtttcttttctggagttgagctgtttgacctgtgatggatgtaaggactgctgcttagtttttctcaacttcgtgtttaagaggtatgtttgagaggtatgttttactctgttttaagatggtatttgcattttgcttcatatttggatgtaatttttggccatcgaagagtggctgtcattgaagtagttacccttgctatcttgaaattcgacttcaatttaagatataaatcatttagtttaatccatcgatatggaatgaggtgggaaatggttctggtggctgaacctgaaccttaactcatcattagcatcaatccttgcgttgaagaggacaaaagctgttcaagaattttaggaagagggaagtttgtcgctgccaaagtaatcttgtgcagtatatgatttggtttcgtttatctcggtggtcgtgtgcatttggtgggactgctagttattgtgaggatttaaaatgattgctgtgagattgttgctctccatctgttttacgtgttatgtgcttgccggagtgagcggctaacgatgtgtggcccgtcttggagttaagaaaattcaattgaccccataatatatgtggtctcgcagaccccatgaggcaatgtaattgaccaacacatgtaactgtcaacattttttttcttgaatcaagagttctgcaattggtaattgtgtttatttttt

SEQ ID NO: 5919 - DNA, 1522 bp, Castanea mollissima
agaaaaagtcagaaagtttttagatttctagagagagaaagctttagagagagagatggatgcgataaggaagcaactcgatgtgttaatgggagcgaatcgaaacggcgacgttcgtgaggtgaatcgcaagtactatgatcgcgacgtttgtcgtctctatctcgtcggactttgccctcacgagctctttcagttaacgaaaatggatatgggtccttgcccaaaggttcactcattgcagctgagaaaagaatatgaagaagcaaaagcaaaagcgattgataactatgagagagacctggaggatgttatagataggctcattcttgagtgtgacaggaaaattactagagctcttagacgccttgaagctgaagatgcaaaggctgctattgcaatttctgtctctgaggttacacagacacctgaggtacttgagctatctaagcagatcaaggagaagttgaaagaagctgatcaatacgatcttgaaggcaaaacagatcttaagattcgagctttggaggtagtagaagaactgagaaccaaaagagcagacaaacagtccatgcttctcctggatgccttcaataaggatagggcatctttacctcaacccctgccaaacccacctcctttggcacccttgcctgtaattactcctgatcctcgtacacaagaaatgataaatgaaaagttgaagaaggctgaggatcttggtgagcagggtttggttgaagaggcacagaaggcattggaggaggctgaagcacttaagaagttacctgcccgacaggagcctgctctggattcctccaagtacactgctgctgatgtgcggattactgaccagaagttacgtgtttgtgacatttgtggagcatttttgagtgtttatgacagtgaccgccgtttagctgatcattttggggggaagcttcatttaggttatatgcagatccgtgagaagttagcagagcttcaggaagagaaagaaaagagccgaaaggttgatcggcatgatgacagaagatcaaaagagcgaagtagggacagagacagggaacctagcagggatcaggaacgtggagatagtcgtgatcagggaagggattatgatcgtaggagcagagatcgtgatagatatcatgatcgtgaacgtggatatgatcgggatcgtgacagagattccgatcggtcccgcagttatgattcaagaagccgccgccggtcacgctcacggtcaagggaacgttccagggattatgatcgccacaggcgttacgatcggtactagacggtcctcactgtggagcatgcggttgaaaatgtgtttgtctaggtcagtgttaaaactcatgtaggggaaagataatttttgtgtttctctaaatttttaggagagttgagctgtgaattctcctgtgatggacataatgacattatgcttaggttttttcaactttgtgtttgagaggtatgctcaacacttatatgacttgaattgaattgctactaa

SEQ ID NO: 5920 - DNA, 1883 bp, Quercus alba
actctcagtgagatagagagtttcagagcgaaagaaagagagaaagaaagtcagaaagtttttagatttctagagagagagagagatggatgcgataaggaagcaactcgatgtgttaatgggagcgaatcgaaacggcgacgttcgtgaggtgaatcgcaagtactatgatcgcgacgtttgtcgtctctatctcgtcggactttgccctcacgagctctttcagttaacgaaaatggatatgggtccttgcccaaaggttcactcattgcagctgagaaaagaatatgaagaagcaaaagcaaaagcgattgataactatgagagagacctggaggatgttatagataggctcattcttgagtgtgacaggaaaattactagagctcttagacgccttgaagctgaagatgcaaaggctgctattgcaatttctgtctctgaggttacacagacacctgaggtacttgagctatctaagcagatcaaggagaagttgaaagaagctgatcaatatgatcttgaaggcaaaacagatcttaagattcgagctttggaggtagtagaagaactgagaaccaaaagagcagacaaacagtccatgcttctcctggatgccttcaataaggatagggcatctttacctcaacccctgccaaacccaccacctttggctcccttgcctgtaattactcctgatcctcgtacacaagaaatgataaatgaaaagttgaagaaggctgaggatcttggtgagcagggtttggttgaagaggcacagaaggcattggaggaggctgaagcgcttaagaagttacctgcccgacaggagcctgctctggattcctccaagtacactgctgctgatgtgcggattactgatcagaagttacgtgtttgtgacatttgtggagcatttttgagtgtttatgacagtgaccgccgtttagctgatcattttggggggaagcttcatttaggttatatgcagatccgcgagaagttagcagagcttcaggaagagaaagaaaagagccgaaaggttgatcggcatgatgacagaagatcaaaagagcgaagtagggacagagacagggaacctagcagggatcaggaacgtggagatagtcgtgatcagggaagggattatgatcgtaggagcagagatcgtgatagatatcatgatcgtgaacgtggatatgatcgggatcgtgacagagattccgatcggtcccgcagttatgattcaagaagccgccgcaggtcacgctcacggtcaagggaacgttccagggattatgatcgccacaggcgttacgatcggtactagacggtcctcactgtggagcatgcgattgaaaatgtgtctgtctaggtcagtgttaaaactcatgtaggggaaagataattttttgtgtttctctctaaatttttaggagagttgagctgttaattctcctgtgatggacataatgacattatgcttaggttttttcaactttgtgtttgagaggtatgctcaacacttatttgacttgaattgaatttctactcatatttggctgtaagttaagtaattactgctgctgtagtgagatatggtttgttgtgtacacttttttaagtcggtcattttacttgaatagtcaggtgaaatgtgatgtgaatcatgttgggtaccaatccatattaaatagcaactcaggactaagatctttttgggacaaattgtcaataaaaaaaatttgatttcctcgttcagtttttgtgctgtttcattgtggtccgatagatgtatatgtaactcaaaactccgcaatgtttcttggagtaaaggtatctgtaatttggcatctgtaatgttattttctttcttgatcgac

SEQ ID NO: 5921 - DNA, 1619 bp, Prunus persica
aacaaacacaatccaaatcctcttttaatatttttttccccaaagctctccaaagccgtaacgaaccctaatctctttctcgctcagtgagccaactgaaatccaccactccaaagttgtagagacgactagagggggagtgatcagccatggacgcgctgaggaagcagctggaccagcttatgggggccaatcgaaacggcgacgtccgagaggtcaaccgcaaatattacgatcgcgaagtgtgtcgcctctacttggtcgggctctgcccccacgagcttttccagttaacgaaaatggatatgggtccctgccctaaggtccactcgttgcagctcagaaaagaatacgaagaagccaaagcaaaagggactgatgactatgacagagacctggaggatgtcatagataggctcattgttgagtgtgataggaaaattgctagagctcttaagcgccttgaggatgatgatgcaaaggctgctattgcaatttctgtctctgaagttactcagacgccagaggtactcgagttgtcaaagcagatcaaggaaaagttgaaagaagttgatcaatttgatcttgaaggcaagacagatcttaagattcgggctatggagatagtagacgaactcagaggcaagagagcagataaacagtccatgcttcttttggatgctttcaataaggatagggcatccttacctcaacccctgccaaacccgccacctttggcacccttgcctgtagttgttcccgatgcccgaacacaggaaatgataaatgaaaagttgaagaaggcagaggaccttggtgagcaaggaatggttgatgaggcacaaaaagcgctggaagaggctgaagcactgaagaagctgcctgccagacaggagcctatcctggattcctccaagtacactgctgctgatgtgcgcattactgatcaaaagctacgtgtttgtgacatctgtggagcatttttgagtgtttatgacagtgaccgtcgtttagcggatcactttggcgggaagcttcatttaggctatatgcaaatccgtgagaagttagcagagctgcaggaagagagaaacaagattcgcaaggttgatcggtctgaggataggagatcaaaagagcgaagtaaggaacgcgacagggaatcaagtagggatagggaacgaggagatagccgcgaccgaggtagggatcatgatcgtaggagcagagatcgtgataggtattatgatcgagatcgcggatatgatcgcgagcgtgacagagattcagatcgctcccgcaattatgattcgagaagtcgccgtagatcacgctcacgatcaagggagcgttccagggattatgatcgccacaggcgttatgatcggtactaggtcatccttgctatggagcatgtggcaaaagcataatttgtgttcttgtctaggtcagttttaaaactcgtgtaccaagatgattttatgtgtttctttttcgatattgtttctgttctggagttgagctgtttgacctgtgatggatgtaaggactgctgcttagtttttctcaacttcgtgtttaagaggtatgtttgagaggtatgttttactctgttttaa

SEQ ID NO: 5922 - DNA, 1504 bp, Theobroma cacao
gcgagagaaggaaaaagagacaaagaagagagtgttttagctcaaatattcccctttcactttccgagagaaagagaaggaggggaaatcgaccaaaagagaagaaaatggacgcaatgaggaaacagctcgatgtgcttatgggagctaatcgaaatggcgatgtaagggaagtaaatcgcaagtactacgatcgcgatgtttgccgtctctttttgtccggcctttgccctcacgagctcttccaattaacgaaaatggatatggggccatgcccaaaggtccactctttgcagctgaggaaagaatatgaagaagccaaggcaaaaggtgttgataactatgacagagaattggaagatgccattgatagactcattgttgagtgtgataggaaaattggcagagctctaaagcgtcttgaagatgaggatgccaaagctgctattgctatatcagtttctgatgttacacagacgcctgaagtacttgagctgtcaaagcaaataaaggagaaactgaaagaagctgatcaacatgatcttgaaggcaagacagatcttaagattcgagctctggaagaagtagaagaatttagaaccaaaagagcagacaagcagtccatgctgcttttggatgcattcaacaaagatagagcatcgctgcctcaacccctcccaaatccaccagcattggcacctctacctgtacctgcacctgatccccgtacgcaggagatgatcaatgagaagctaaagaaagcagaagatcttggtgagaaaggaatggtggatgaagcacaaaaagcattggaagaggctgaagcgcttaagaagctacctgccagacaagagcctgttctggattcctcgaagtacacagctgctgatgtccgcatcactgatcaaaagcttcgtgtttgtgacatttgtggagcatttttgagtgtttatgacagtgaccgacgtttagcagatcattttggaggcaaacttcatttaggctatatgcaaatccgggataaactagctgagcttcaggaagaaagaaacaagagccgcaaacttgatcggcatgatgacagaagatcaaaggaacaaagtaaggattgtgacagagaatctagtcgggatcatgaccgaggagatagccgtgaccgagggagggattatgatcgtaggagcagggaccgggacaggtattatgatcgagatcgtggacatgatcgggatcgtgagagagattacgagcgctcacgcagttatgattcaagaagtcgtcgcaggtcacgttctcggtctaaggaacgttctagggattatgatcgccacaggcgtgatcgatactagatggttgttgctatcaagtggatggatatgaaatcagtgttgtttagtttcttctattttgctggatgtatcaactgcttcgtttcttgactaaaatttttaagagattatgaggcagtcggtaactaggtcgaggtgtcctcgtagattcgtct

SEQ ID NO: 5923 - DNA, 1866 bp, Cicer arietinum
aaatcttggcaatgaagtgagacactcacctcattacttcgacaagttgaaaccctaactcgtcaactcagtataactgagtgtgtccgttgtgggtaaatcggagttccagatcgaaaagaaaagagaaggagaagtgagagagcaagtgcattagtgaaactgaagagaaggaagaaagtatggacgcgatacggaagcagctggacgtgttaatgggagccaatcgaaacggcgacgtccgcgaagttaaccgcaagtattacgatcgcgatgtttgtcgtctctatctcgtcggtctttgccctcacgaactcttccagctaacgaaaatggatatgggtccatgccctaaagttcactctttgcagctaagaaaagaatatgaggaagcgaaatccaaagggattgataattacgagagggagttggaggatgttatagacaagctaattggtgaatgtgataggaaaattggcagagctcttaagcgtcttgaggacgacgatgccaaagctgcaattgcaatttcagtctctgaagttactcagacgcctgaagtgcttgagttgtccaaagaaatcaaagaaaagttgaaagaagctgataaatacgatcttgaaggcttgtcagatatgaagattcgagctttggagattgtagaggaacttagaaccagaagagcagacaagcagtctacgcttcttttagatgcatttaacaaagatagggcatctctgcctcaacctctgccaaatccaccacctttagcaccccttcctgtagttactcctgatgctcgaacacaggagatgataaatgaaaagttaaagaaggctgaggatctgggtgaacaaggattgattgatgaggcacaaaaagcattggaagaggctgaagcacttaagaagcttccttccagacaagagccaacactggattcttcaaagtatacagctgcagatgtgcggattactgatcaaaagctacgtgtgtgcgacatttgtggagcatttttgagtgtttatgacagtgatcgccgtttagctgatcattttggagggaaacttcatttagggtatatgcaaattcgtgagaagttggcagaacttcaagaagaaagggccaacagccgtaagactgatcgtcttgatgacaggagatcaaaagaacggagtaaggatcgtgaaagggagccaagtagggaccgtgaacgtggcgagagccatgaaagagggcgagactatgatcgtaggagtagggatcgtgataggcaccatgatcgagaccgtggatatgatcgagaccgagacagagattcagaccgttcccgccactatgattcaagaagtcgtcggaggtctcgatctcgagagcgttctagagattatgatcgtcataggcgtcatgatcggtactagcagctgccaagaatcttatggatgtttaaagatgtctagtctaggtgggtgatgaacctcgtcttggacaattttttttttgggtagttttattgaactagttatccaatgatggatgtaacttgagcttaggtgttgctaaattgtggtttgatgtttgccctgcagtaattactaaatccaatttgtaatctgcctacatgtggagcagttctgcatttgtgctttaactgagcataaaaaaatttgtgcactttttttcacgttcacgcatgcctgtttaattatatgtttggaaaactaaagaatcttacccggccggcaacttgaaactccgattcttagtacatgtttggaaagttatgaaatcacggtatgaatgcacagtgaaatggaagcttcaattcatcgcatcaccacacgtttgatcaaatttatggcaatg

SEQ ID NO: 5924 - DNA, 1686 bp, Eucalyptus grandis
gatatctctccagagcttttctgcagcaacaaaaacctaatttctcccccccattccaaatctctctgcgttcgcttcgcttcgcgtggcccgagcacgagcagcgagagggagggagagagggagagggagagggtgagcggcggcagccatggatgcgatacggaagcagctggacgtgctgatgggggccaaccgcaacggcgacgtccgggaggtgaaccgcaagtactacgaccgcgacgtctgccgcatgtacctcgtcggcctctgcccccacgagctcttccagctcacgaaaatggacatggggccttgcccgaaggtccactcgctccagctccggaaagaatacgaagaagccaaaggaaaaggtgtagacaattatgaccgagacttggaggatgtcatcgatcgtctcattgttgagtgcgatcggaaaattgctagagccctcaagagactagaggaggatgatgcgaaggctgctattgcgatctctgtgtctgaggttacgcagacacccgagatacttgagttgtcgaagcagatcaaggagaagctaaaagaagctgaccaacatgatcttgaaggcaagacagatctcaagattcgagctttggagatcgtcgaagaactcagaactaaaagagctgataagcagtccatgcttcttttggatgcattcaataaagacagggcatctttaccgcaacctctgcccaacccaccacccttggcccccttgccagtagttgctcccgatcctcgcactcaagagatgataaatgagaagctgaaaaaagcagaggatcttggtgagcaaggtatggtggatgaagcacaaaaagcattggaagaggctgaagcccttaaaaagctgcatgccagacaggaacctgcacaggattctactaagtacactgctgcagatgtgcgaattactgaccagaagctacgtgtttgcgacatttgtggagcattcctcagtgtctatgacagtgaccgtcgtttagcggatcactttggcgggaagcttcatttgggttatatgcaaatccgtgataaattggcagagctacaggaagagagaaacaagatccgtaaggttgatcaccatgaggacagaagatcaaaagaaaggagtaaggatcgtgatagggaatcaagtaaggatcaagaacgagcggacagtcgtgatagagggagggattatgatcgcaggagtcgggatcgtgataggcaccatgagagagatcgtggatatgaaagggaacgtgaccgagatatagatcgtccccgcagctatgactccagaagtcgtcgcagatcacgatctaggtcgcaggaacgttctagggattatgaccgccacaggcgtcgtgaccgctactaatggattatggacatgaagatggaaatgatgtggtttcatcactaaactcctgtagggagagcttatctataactgtttgttccaaaaatgttctgacatgagctgtggtagtttcatatgaaagagtctgagtttctgcttaggaggtatagtttttggcttgctgtgtaccatgtattttgtacttaaatttgctggttgacctctgcattttcttatgtgaagtaccgttacctgagctttcatcctcaagttattttgcgcttctgagctttagacgaggggtctta

SEQ ID NO: 5925 - DNA, 1925 bp, Vitis vinifera
gccccaaaacactcgcagccctattagtttgggaatccagaaaccctaagatagagaaactcagtgttgagagagagtaaagaggaaaagagaaaagagatggatgcgataaggaagcaactggacgtgttgatgggggcgaatcgaaacggcgacgtccgggaggtgaataggaagtactacgaccgagatgtgtgtcgcctcttcttggtcggcctttgccctcacgagctcttccagttgacgaaaatggatatggggccatgtccgaaggtgcactccttgcagctaaggaaagaatatgaagaagccaaagcaaaaggtgtccataattatgacagggacttggaggatgttatagataggctcattgttgagtgtgatagaaaaattgctagagctcttaagcgtcttgaggatgaggatgctaaagctgctatagcaatttcagtctctgaggttactcagacacctgaggtgcttgagttgtcgaagcagattaaggagaagttgaaggaagctgatcaatttgatcttgaaggcaagactgatagcaagattcgagctctagaagtagtagaagaactcagaacgaaaagagcagacaagcagtctatgcttcttctggatgccttcaacaaggatagagcgtctttaccccaaccccttccaaacccgcccccattggcacccttgccagtacttgctcctgatcctcgtacacaggaaatgataaatgagaagctgaaaaaggcagaggatcttggcgagcaaggaatgatagacgaggcacagaaagcattggaagaggctgaagcacttaagaagctggcccctaggcaggagcctgttcttgattcttccaagtacactgctgctgatgtgcgcattactgatcagaagctacgcgtatgtgacatttgtggagcatttttgagcgtttatgatagtgaccgtcgcttagcagatcattttggaggaaagcttcatttgggctatatgcaaatccgtgaaaagctggcagagcttcaggaggagagaaacaagagccgcaaggttgatagacatgagaatgatagaagatcaaaggaacgaagccgggaccatgacagggaagcaagcaaggatcgagcagatagccgtgagcggggaagggaccatgatcgtaggagcagagatcgtgataggtaccatgatcgtgatcgtggacatgatcgggagcgtgacagagattctgaccgcccccgaaattatgattcaagaagtcgacgcaggtcacgctcacggtctggggaacgctccagggactatgatcgctccagggattatgatcgtcacaggcgttatgatcgatactagatctgggttggtgcagttgggcagatatgaaaaacttgtggggtttttttgtgcatgtcagacactagatgatcattggagttgagatgaggagtcttgcttagttcagagatggatgctcatgtaggaaggaaagatgttttacgcgctttgttttaaaaaacttaagtagattattgtagtgtctcctactatgggcgaagaagaagaatcaactgcattgtagatgttccaggcatatgtttgattgcgtagattttttatttatggctaaaatgatttaatgtgttttgacatttgattgttggggtaggaacacttcacttttaaggcttaagcatcacagacatgaactcaatcagaaatggatgtcacggcaaaatgattggggggaaatgtggctttgagatgctacgattttccaaggtgatgtgtgatctgccttccttcaccctgtttgtttcaatggaaaatggaatggttttgcataatgccagcttaggaatgcaatcttttcatttgtttggttggatgcgccgaagttgaggcttgcctgatttccttgg

SEQ ID NO: 5926 - DNA, 1744 bp, Vitis vinifera
cagaaaccctaagatagagaaactcagtgttgagagagagtaaagaggaaaagagaaaagagatggatgcgataaggaagcaactggacgtgttgatgggggcgaatcgaaacggcgacgtccgggaggtgaataggaagtactacgaccgagatgtgtgtcgcctcttcttggtcggcctttgccctcacgagctcttccagttgacgaaaatggatatggggccatgtccgaaggtgcactccttgcagctaaggaaagaatatgaagaagccaaagcaaaaggtgtccataattatgacagggacttggaggatgttatagataggctcattgttgagtgtgatagaaaaattgctagagctcttaagcgtcttgaggatgaggatgctaaagctgctatagcaatttcagtctctgaggttactcagacacctgaggtgcttgagttgtcgaagcagattaaggagaagttgaaggaagctgatcaatttgatcttgaaggcaagactgatagcaagattcgagctctagaagtagtagaagaactcagaacgaaaagagcagacaagcagtctatgcttcttctggatgccttcaacaaggatagagcgtctttaccccaaccccttccaaacccgcccccattggcacccttgccagtacttgctcctgatcctcgtacacaggaaatgataaatgagaagctgaaaaaggcagaggatcttggcgagcaaggaatgatagacgaggcacagaaagcattggaagaggctgaagcacttaagaagctggcccctaggcaggagcctgttcttgattcttccaagtacactgctgctgatgtgcgcattactgatcagaagctacgcgtatgtgacatttgtggagcatttttgagcgtttatgatagtgaccgtcgcttagcagatcattttggaggaaagcttcatttgggctatatgcaaatccgtgaaaagctggcagagcttcaggaggagagaaacaagagccgcaaggttgatagacatgagaatgatagaagatcaaaggaacgaagccgggaccgtgacagggaagcaagcaaggatcgagcagatagccgtgagcggggaagggaccatgatcgtaggagcagagatcgtgataggtaccatgatcgtgatcgtggacatgatcgggagcgtgacagagattctgaccgcccccgaaattatgattcaagaagtcgacgcaggtcacgctcacggtctggggaacgctccagggactatgatcgctccagggattatgatcgtcacaggcgttatgatcgatactagatctgggttggtgcagttgggcagatatgaaaaacttgtggggtttttttgtgtatgtcagacactagatgatcattggagttgagatgaggagtcttgcttagttcagagatggatgctcatgtaggaggaaagatgttttacgcgctttgttttaaaaacttaagtagattattgtagtgtctcctactatgggcgaagaagaagaatcaactgcattgtagatgttccaggcatatgtttgattgcgtagattttttatttatggctaaaatgatttaatgtgttttgacatttgattgttggggtaggaacacttcacttttaaggcttaagcatcacagacatgaactcaatcagaaatggatgtcacggcaaaatgattggggaaatgtggctttgagatgctacgattttccaag

SEQ ID NO: 5927 - DNA, 1292 bp, Fagus grandifolia
catggatgcgataaggaagcagctggacgtgctgatgggagcgaatcgaaacggcgacgttcgggaggtgaaccgcaagtactacgatcgcgacgtttgccgtctctatctcgtcggcctttgccctcacgagctcttccaattaacgaaaatggatatgggtccctgcccaaaggttcattcattgcagctgaggaaagaatatgaagaagcaaaagcaaaagcggtagataactatgacagagacctggaggatgttatagataggctcattcttgagtgtgataggaaaattactagagctcttaggcgccttgaggctgacgatgcaaaggctgctattgcaatttctgtctctgaggttacacagactcctgaggtacttgagctatccaagcagatcaaggagaagttgaaagaagctgatcagtatgatcttgaaggcaaaacagatcttaagattcgagctttggaggtagtagaagaactgagaaccaaaagagcagacaaacagtccatgcttctcctagatgccttcaataaggatagggcatctttacctcaacccctgccaaacccaccacctttggcacccttgcctgtaattactcctgatcctcgtacacaagaaatgataaatgaaaagttgaagaaggcagaggatcttggtgagcagggtttggttgaagaggcacagaaggcattggaggaggctgaagcacttaagaagctacctgcccgacaggagcctgctctggattcctccaagtacactgctgctgatgtgcgcattactgatcagaagttacgtgtttgtgacatttgtggagcatttttaagtgtttatgacagtgaccgccgtttagctgatcattttggagggaagcttcatttaggttatatgcaaatccgtgaaaagttagctgagcttcaggaagacaaagaaaagagccgaaaggttgatcggtatgatgatagaagatcaaaagagcgaagtagggatggagacagggaacctagcaaggatccggaacgtggagatagccgtgatcaggtaagggattatgatcgtaggagcagagaccgtgatagatatcatgatcgtgaacgtggatatgatcgggatcgtgacagagattcagatcgcacccgcagttatgattcaagaagccgccgcaggtcacgctcacggtcaaaggaacgggagcgttctagggatcatgatcgccacaggcgttacgatcggtactagacagtctcgctatggagcatatgaatttgaaaatgtgttt

SEQ ID NO: 5928 - DNA, 2104 bp, Citrus clementina
tattttactctcaattttacacttaatcccccaaaattcttcgtggctcttgggtcttgtctattaactccaaaatctcgaaagctcacaaaccctagttctgagtctcgagtgctcgactctcattctgacaaaatggacgcaatgaggaagcaactagacgtcctgatgggagccaatcgaaacggcgacgtacgagaagttaatcgcaagtactacgatcgcgatgtttgccgtctctacttggccggactttgccctcacgagctcttccaattaacgaaaatggatatggggccatgtccgaaggttcattctttgcagttgcgaaaagaatatgaagaagccaaggcaaaaggcgttgataattatgacagagaattagaagatgctattgatagacttattgttgagtgtgataggaaaattggtagagctcttaaacgtcttgaagatgacgatgcaaaggctgctattgctatatcagtctcggaggtgactcagactccagaggttcttgagttgtcaaaacagatcaaagaaaagttgaaagaagctgatcaatatgattatgaaggcaagactgatcttaagattcgagctttggaggtggtagaagaactcagaacaaaaagagctgataaacagtccatgctcctcttggatgctttcaataaagatagagcatcgttgcctcaaccccttccaaacccaccaccattggcacctttgccaattcctgcaccagatgctcgtactcaggaaatgataaatgaaaaattgaagaaggcggaggatcttggtgagcaaggaatggtagatgaagcacaaaaagcattggaagaggctgaagcacttaagaagctgcctgccagacaagaacctacactagattcctccaaatacactgctgcagatgtgcgcattactgatcagaagctacgtgtgtgtgacatctgtggagcttttttaagtgtttatgacagtgatcgtcgcttagcagatcattttggagggaagcttcatctaggctacatgcagatccgtgataaattagcagagcttcaggaggagagaaacaagaaacacaaagatcgctgtgatgatagaaggtcgaaagaacgaagtaaggatcaggacagagaaccaagcagggatcgtgagaaggaagcaagtcgggatcgtgatcgaggggatagtcgtgaccgcgggagggattatgatcgtagtagccgagatcgtgataggtactatgatcgagatcgcagatatgatcgcgagcgtgatagggattctgatcgccaccgaagttatgattcaagaagtcaccgcaggtcacgctcgcggtcaaaggaacgttcaagagattatgatcgccacaggcgtcatgatcggtactagaaggccaagtttgagaacatacaatcagaaatgtgttcttgtttaggtcagtgaacttatgtaggtgaagtatgttcttgtgtgttttttctgattccttagtggagttcagcagttctactgttatggtgacgtaacaactgcttcgaaggttttgttgaattgcgtttatgaggtatgtgctacaatgttttggcataatatttatggcttagtgttacactaaatttcaagaatatacatcatgatgaaggtggatagagttaagattagctctgacatgattaaattcatgaaacttgaatcccaccctacagaaggagtttaatttttcttgtgaattttgggatgaatgctacatgcttccgatggtttatgttgcaagagtgcaagtcatgaggcaagattgcatggttatttggaaatgtttctgtaaatagaaaacaaacaaaaaataaaaaaaaataaaaaaaaggttacatataaactgaacaatttaccgtgggagaggaggtatccattaaaagattattcaaccatctggcttggacaaattgttggaagttgttatgcaacaacactaggattttttagtcattaacagaatgcattgttacagcttcaagtagttcagcgtcgatatgtctcccattaaaattccatcttgtttaagaaaagaaagaaaggagaactgccggagggg

SEQ ID NO: 5929 - DNA, 1671 bp, Medicago truncatula
caccctagtagttgaacaagatctaaccctaaactcataaactcaacaaacacaagttccatcgagttcagttctgttccagatcgaaaacaatggatgccatacggaagcaactggacgttctcatgggagccaatcgtaacggcgacgtccgtgaagttaaccgcaagtattacgatcgcgatgtttgccgtctttatctcgtcggtctttgcccccacgaactctttcaattaacgaaaatggatatgggtccttgccctaaggttcactcattgcagctcagaaaagaatacgaggaagccaaatccaaaggcacagatagttacgaaagagagttggaggatgttatagataagcttattggtgaatgtgataggaaaattggtagagctcttaagcgtcttgaggatgatgatgccaaagccgcaattgcaatttccgtatccgaagttactcagacacctgaaataattgagttgtccaaagaaatcagagaaaagttgaaagaagctgataaatttgatcttgaaggcttgtcggatatgaagattcgagctttggagattgtagaggaacttcgaatcaaaagagcagacaaacagtctacacttcttttagatgcatttaacaaagatagggcatctttacctcaacctctgccaaatccaccaccgctagcaccccttcctgtagttactcctgatgctcgaacacaagagatgataaatgaaaagttgaagaaggctgaggatcttggtgagcaaggactgattgatgaggcacagaaagcattggaagaggctgaagcacttaagaagcttccttccaggcaggagccaccattggattcttcgaagtatacggctgctgatgtgcggattactgatcagaagctacgtgtgtgcgacatttgtggagcatttttgagtgtttatgacagtgatcgtcgattagctgatcattttggagggaaacttcatttaggctatatgcaaattcgtgagaagttggccgaacttcaagaagaaagaaacaagagccgtaagattgatcgtcttgatgacaggagatcaaaagaacggagtagggatcgtgacagggagcctagtagggaccgtgaacgtggtgagagccatgagcgagggcgagacaatgatcgtaggagcagagatcgtgacaacaggcaccatgatagagaccgtggatatgatcgagatcgtgatagagactcatcccgctacgattcaagaagtcgccggaggtcacgatctcgagagcgttctagagattatgatcgtcacaggcgtcatgatcggtactagtggctgccataaatcttctggatgtgaaaagatgtgtagtctaggtgggtgttgaaccttgtcttggacaaataattttgcattgtattgaacaatatccaatgatggatgtaacttgagcttaggcgttgctaaattatggttggatgttgctttgcgggtagttaaatctaatttgtaatatgattacttggagaagttttgcaattgtactttaaaatgtgagtagttttgttgaacatttaacctgttgcccataaaaacaaaattgtgcattcttaacatttacatgtgccctatcaagcaactaagaaattaattgaactattcaccttgctgtggtgat

SEQ ID NO: 5930 - DNA, 1514 bp, Medicago truncatula
cataaactcaacaaacacaagttccatcgagttcagttctgttccagatcgaaaacaatggatgccatacggaagcaactggacgttctcatgggagccaatcgtaacggcgacgtccgtgaagttaaccgcaagtattacgatcgcgatgtttgccgtctttatctcgtcggtctttgcccccacgaactctttcaattaacgaaaatggatatgggtccttgccctaaggttcactcattgcagctcagaaaagaatacgaggaagccaaatccaaaggcacagatagttacgaaagagagttggaggatgttatagataagcttattggtgaatgtgataggaaaattggtagagctcttaagcgtcttgaggatgatgatgccaaagccgcaattgcaatttccgtatccgaagttactcagacacctgaaataattgagttgtccaaagaaatcagagaaaagttgaaagaagctgataaatttgatcttgaaggcttgtcggatatgaagattcgagctttggagattgtagaggaacttcgaatcaaaagagcagacaaacagtctacacttcttttagatgcatttaacaaagatagggcatctttacctcaacctctgccaaatccaccaccgctagcaccccttcctgtagttactcctgatgctcgaacacaagagatgataaatgaaaagttgaagaaggctgaggatcttggtgagcaaggactgattgatgaggcacagaaagcattggaagaggctgaagcacttaagaagcttccttccaggcaggagccaccattggattcttcgaagtatacggctgctgatgtgcggattactgatcagaagctacgtgtgtgcgacatttgtggagcatttttgagtgtttatgacagtgatcgtcgattagctgatcattttggagggaaacttcatttaggctatatgcaaattcgtgagaagttggccgaacttcaagaagaaagaaacaagagccgtaagattgatcgtcttgatgacaggagatcaaaagaacggagtagggatcgtgacagggagcctagtagggaccgtgaacgtggtgagagccatgagcgagggcgagacaatgatcgtaggagcagagatcgtgacaacaggcaccatgatagagaccgtggatatgatcgagatcgtgatagagactcatcccgctacgattcaagaagtcgccggaggtcacgatctcgagagcgttctagagattatgatcgtcacaggcgtcatgatcggtactagtggctgccataaatcttctggatgtgaaaagatgtgtagtctaggtgggtgttgaaccttgtcttggacaaataattttgcattgtattgaacaatatccaatgatggatgtaacttgagcttaggcgttgctaaattatggttggatgttgctttgcgggtagttaaatctaatttgtaatatgattacttggagaagttttgcaattgtactttaaaatgtg

SEQ ID NO: 5931 - DNA, 1747 bp, Trigonella foenum-graecum
gacaagactaatgagtcccacacttacctcaccccactacctgaacaagatctaaccctaactcatcaaagcaacacaactcaacttgtttgagcgtaaatcaagttcgaggttgagttccagatcgaaaacaatacaaaagaagaagtgagagagcaacaacactgaaatcgaaagagaagaagaaagcatggatgctatacggaagcaactggacgttcttatgggagccaatcgtaacggcgacgtccgtgaagttaaccgcaagtattacgatcgcgatgtctgccgtctttacctcgtcggtctttgccctcacgaactttttcaattaacgaaaatggatatgggtccttgccctaaggttcattcattgcagctcagaaaagaatatgaggaagcgaaaggcaaagggattgataattatgaaagggagttggaggatgttatagataagcttattggtgaatgtgatagaaaaattgggagagctcttaagcgccttgaggatgatgatgccaaagccgcaattgcaatttcggtatccgaagttactcagacacctgaagtgcttgagttggctaaagaaatcaaagaaaagttgaaagaagctgataaatttgatcttgaaggcttgtcagatatgaagattcgtgctttggagattgtagaggaacttagaatcaaaagagcagacaaacagtctacacttcttttagatgcatttaacaaagatagggcagctttacctcaacctctgccaaatccaccacctttggcaccccttcccatagttactcctgatgctcgaacgcaggagctgataaatgaaaagttgaagaaggctgaggatcttggtgagcaaggattgattgatgaggcacaaaaagcattggaagaggctgaagcacttaagaagcttccttccaggcaggagccagcgctggattcttcgaagtacacagctgctgatgtgcggattactgatcagaagctacgtgtgtgcgacatttgtggagcatttttgagtgtttatgacagtgatcgtcgattagctgatcattttggaggaaaacttcatttagggtatatgcaaattcgtgagaagttggccgaacttcaagaagaaagaaacaagagccgtaagattgagcgtcttgatgacaggagatcaaaagaacggagtagggatcatgacagggagccgagtagggaccgtgaacgtggtgaaagccatgagcgagggcgagacaatgatcgtaggagcagagatcgtgataggcaccatgatagagaccgtggatatgatcgagatcgggacagagactcatcccgctacgattcaagaagtcgccggaggtcacgatctcgagagcgttctagagattatgatcgtcacaggcgtcatgatcggtactagcagctgccataaatcttctggatgtgaaaagatgtgtagtctaggtgggtgttgaaccttgtcttggacaaataattttgcattttattgaacaatatccgatgatggatgtaacttgagcttaggtgttactagattatagtttgatgttgctttgcggtagttaaatataatttgtgatgtgcctacttggagaagttctgcaattgtactttaaaatgttagttttgtttttgctgtcatcgatttagttgcccataaaaacaaaattgtgcactctttgcatttacttgtgccctatcaagtaactaagaaattaatttaacc

SEQ ID NO: 5932 - DNA, 1935 bp, Gossypium hirsutum
aaggccgaaattctcgatccctagcgaaaaccaaaccctagaaaaagtctcccttgccttgccttgccttaactctttcacagaaaaagaagtgttggaggttaaatattgattcccctttcactttgcaagagaaaggagaagacaacacctaaaaaggaaaaaaagcaccaaaatggacgctatgaggaaacagctcgatgtgctgatgggtgccaatcgaaatggcgatgtacgtgaagtgaatcgcaaatactacgatcgcgatgtttgccgtctctttttgtctggtctttgccctcacgagctcttccaattaacgaaaatggatatgggaccatgcccaaaggtccactctttacagctgaggaaagaatatgaagaagccaagtcaaaaggtgttgataattatgacagagaattagaagatgccattgatagactcattgtcgagtgtgataggaaaattggcagagctctacggcgtcttgaagatgaggatgccaaagctgctattgctatatcagtttctgaggttacacagacacctgaaattcttgagctgtcgaagcagataaaggagaaactgaaagaagctgatcaacatgatcttgaaggcaagacagatcttaagattcgagcactggaagaagtagaagagcttagaactacaagagcagacaagcagtcaatattacttttggatgcattcaataaagatagagcatcgctgcctcaacccctgccaaatccaccgccattggcacctttgcctgtagctgcacctgatcctcatatccaggagatgataaacgagaagctaaagaaagcagaagatcttggtgagaagggaatggtggatgaagcacaaaaagctctggaagaggctgaagctcttaagaagctgcctgctagacaggagcctgttctggactcctcaaagtacacagccgctgatgtccgcattactgatcaaaagcttcgtgtttgtgacatttgtggagcatttttaagtgtttatgatagtgaccggcgtttagctgatcattttggaggcaagcttcatttaggttacatgcaaatccgtgataaactagcagagcttcaggaagagagaaacaagagccgcaaacttgatcgatatgatgacagaagatcaaaggaacggagtagggatcgtgaaagagagcccagtcgggatcgtgatcgaggagagagccgtgatcgagggagggatcatgatcgtaggagcagggatcaggataggtatcatgaacgagatcgtggatatgatcgggaccgtgagagagattatgaacgctcacgcagttatgattcaagaagtcgtcgtaggtcacgttctcggtctagggaacattctagggattatgatcggcacaggcgtgatcgctactaggatggatgatggttgcagtcaaagtggatggataatgaaatgatgttcttgtttaggtcggtgattaaatcatgtaggattgttgtgatggttttatgcaaagtaggattcatcaacatgtgcttttgggggtggagtttggcagttttctggtgttttttgctggatgtattgactttgacttgactgcttcaaagatttctctgttgcttaaatatctggagaggtacgttttagtgttttaacaacatttatttctcactaatcatccgctgcagtgacatctccaagtgatcaattactgagcaatgctattaacaacaccctccttttctcccacgatattaaatgatatttttggaaattagctgccagccctaatccctaaaaacacttctctaggactggattttaaaggatcgtttttctttctttgatggaatggtattagcagccagcactttacaataacctttactacactggaatatgtgatcatttgtcggtgacgaaaccta

SEQ ID NO: 5933 - DNA, 2096 bp, Citrus sinensis
tattttactctcaattttacacttaatcccccaaaattcttcgtcgctcttgggtcttgtctattaactccaaaatctcgaaagctcacaaaccctagttctgagtctcgagtgctcgactctcattctgacaaaatggacgcaatgaggaagcaactagacgtcctgatgggagccaatcgaaacggcgacgtacgagaagttaatcgcaagtactacgatcgcgatgtttgccgtctctacttggccggactttgccctcacgagctcttccaattaacgaaaatggatatggggccatgtccgaaggttcattctttgcagttgcgaaaagaatatgaagaagccaaggcaaaaggcgttgataattatgacagagaattagaagatgctattgatagacttattgttgagtgtgataggaaaattggtagagctcttaaacgtcttgaagatgacgatgcaaaggctgctatcgctatatcagtctcggaggtgactcagactccagaggttcttgagttgtcaaaacagatcaaagaaaagttgaaagaaactgatcaatatgattatgaaggcaagactgatcttaagattcgagctttggaggtggtagaagaactcagaacaaaaagagctgataaacagtccatgctcctcttggatgctttcaataaagatagagcatcgttgcctcaaccccttccaaacccaccaccattggcacctttgccaattcctgcaccagatgctcgtactcaggaaatgataaatgaaaaattgaagaaggcggaggatcttggtgagcaaggaatggtagatgaagcacaaaaagcattggaagaggctgaagcacttaagaagctgcctgccagacaagaacctacactagattcctccaaatacactgctgcagatgtgcgcattactgatcagaagctacgtgtgtgtgacatctgtggagcttttttaagtgtttatgacagtgatcgtcgcttagcagatcattttggagggaagcttcatctaggctacatgcagatccgtgataaattagcagagcttcaggaggagagaaacaagaaacacaaagatcgctgtgatgatagaaggtcgaaagaacgaagtaaggatcaggacagagaaccaagcagggatcgtgagaaggaagcaagtcgggatcgtgatcgaggggatagtcgtgaccgcgggagggattatgatcgtagtagccgagatcgtgataggtactatgatcgagatcgcagatatgatcgcgagcgtgatagggattctgatcgccaccgaagttatgattcaagaagtcaccgcaggtcacgctctcggtcaaaggaacgttcaagagattatgatcgccacaggcgtcatgatcggtactagaaggccaagtttgagaacatacaatcagaaatgtgttcttgtttaggtcagtgaacttatgtaggtgaagtatgttcttgtgtgttttttctgattccttagtggagttcagcagttctactgttatggtgacgtaacaactgcttcgaaggttttgttgaattgcgtttatgaggtatgtgctacaatgttttggcataatatttatggcttagtgttacactaaatttcaagaatatacatcatgatgaaggtggatagagttaagattcgctctgacatgattaaattcatgaaacttgaatcccaccctacagaaggagtttaatttttcttgtgaattttgggatgaatgctacatgcttctgatggtttatgttgcaagagtgcaagtcatgaggcaagagtgcatggttatttggaaatgtttctgtaaatagaaaacaaacaaaaaaataaaaaaaaggttgcatataaactgaacaatttaccgtgggagaggaggtatccattaaaagattattcaaccatctggcttggacaaattgttggaagttgttatgcaacaacactaggattttttagtcattaacagaatgcattgttacagcttcaagtagttcagcgtcgatatgtctcccattaaaattccatcttgtttaagaaaagaaagaaagggagaactgctggagggg

SEQ ID NO: 5934 - DNA, 2054 bp, Gossypium raimondii
gaaaagaaaaataaaaacaatgagttcacccctggcttagaaaaaacctaataaatcaaaattgtcataagagcccccggaaggccgaaattctcgatccctagcgaaaaccaaaccctagaaaaagtctcccttgccttgccttaactctttcacagaaaaagaagtgttggaggttaaatattgattcccctttcactttgcaagagaaaggagaagacaacacctaaaaaggaaaaaaaacaccaaaatggacgctatgaggaaacagctcgatgtgctgatgggtgccaatcgaaatggcgacgtacgtgaagtgaatcgcaagtactacgatcgcgatgtttgccgtctctttttgtccggtctttgccctcacgagctcttccaattaacgaaaatggatatgggaccatgcccaaaggtccactctttacagctgaggaaagaatatgaagaagccaagtcaaaaggtgttgataattatgacagagaattagaagatgccattgatagactcattgtcgagtgtgataggaaaattggcagagctctacggcgtcttgaagatgaggatgccaaagctgctattgcaatatcagtttctgaggttacacagacacctgaaattcttgagctgtcgaagcagataaaggagaaactgaaagaagctgatcaacatgatcttgaaggcaagacagatcttaagattcgagcactggaagaagtagaagagcttagaactacaagagcagacaagcagtcaatattacttttggatgcattcaataaagatagagcatcgctgcctcaacccctgccaaatccaccgccattggcacctttgcctgtagctgcacctgatcctcatatccaggagatgataaacgagaagctaaagaaagcagaagatcttggtgagaagggaatggtggatgaagcacaaaaagctctggaagaggctgaagctcttaagaagctgcctgctagacaggagcctgttctggactcctcaaagtacacagccgctgatgtccgcattactgatcaaaagcttcgtgtttgtgacatttgtggagcatttttaagtgtttatgatagtgaccggcgtttagctgatcattttggaggcaagcttcatttaggttacatgcaaatccgtgataaactagcagagcttcaggaagagagaaacaagagccgcaaacttgatcgatatgatgacagaagatcaaaggaacggagtagggatcgtgaaagagagcccagtcgggatcgtgatcgaggagagagctgtgatcgagggagggatcatgatcgtaggagcagggatcaggacaggtatcatgaacgagatcgtggatatgatcgggaccgggagagagattatgagcgctcacgcagttatgattcaagaagtcgtcgtaggtcacgttctcggtctagggaacattctagggattatgatcggcacaggcgtgatcgctactaggatggatgatggttgcaatcaaagtggatggataatgaaatgatgttcttgtttaggtcggtgatgaaatcatgtaggattgttgtgttggttttatgcaaagtaggattcatttgggggtggagtttggcagttttctggtgttttttgctggatgtattgactttgacttgactgcttcaaagatttctctgttgcttaaatatctgggagaggtacgttttagtgttttaacaacatatttatttctcactaatcatccgctgcagtgacatctccaagtgatcaattactgagcaatgctattaacaacaccctccttttctcccacgatattaaatgatatttttggaaattagctgccagccctaatccctaaaaacacttctctaggactggattttaaaggatcgtttttctttctttgatggaatggtattagcagccagcactttacaataacctttactacactggaatatgtgatcatttgtcggtgacgaaacctatttaaaattttatggtttttcttcttaaaaaagaattttaacgttgtaggtga

SEQ ID NO: 5935 - DNA, 2303 bp, Gossypium raimondii
aaagatataaatattaaaggataaatttatgattatgcctttagaaaaaataaaagaatagttttagtagctagttaaacatttttgatggatgatataaatttagaatggactaaattaaagtaagaacaaaattatatggcaaattatgaaaaaaagtgaaaagaaaaataaaaacaatgagttcacccctggcttagaaaaaacctaataaatcaaaattgttataagagcccccggaaggccgaaattctcgatccctagcgaaaaccaaaccctagaaaaagtctcccttgccttgccttgcctctttcacagaaaaagaagtgttggaggttaaatattgattcccctttcactttgcaagagaaaggagaagacaacacctaaaaaggaaaaaaaacaccacaatggacgctatgaggaaacagctcgatgtgctgatgggtgccaatcgaaatggcgacgtacgtgaagtgaatcgcaagtactacgatcgcgatgtttgccgtctctttttgtccggtctttgccctcacgagctcttccaattaacgaaaatggatatgggaccatgcccaaaggtccactctttacagctgaggaaagaatatgaagaagccaagtcaaaaggtgttgataattatgacagagaattagaagatgccattgatagactcattgtcgagtgtgataggaaaattggcagagctctacggcgtcttgaagatgaggatgccaaagctgctattgcaatatcagtttctgaggttacacagacacctgaaattcttgagctgtcgaagcagataaaggagaaactgaaagaagctgatcaacatgatcttgaaggcaagacagatcttaagattcgagcactggaagaagtagaagagcttagaactacaagagcagacaagcagtcaatattacttttggatgcattcaataaagatagagcatcgctgcctcaacccctgccaaatccaccgccattggcacctttgcctgtagctgcacctgatcctcatatccaggagatgataaacgagaagctaaagaaagcagaagatcttggtgagaagggaatggtggatgaagcacaaaaagctctggaagaggctgaagctcttaagaagctgcctgctagacaggagcctgttctggactcctcaaagtacacagctgctgatgtccgcattactgatcaaaagcttcgtgtttgtgacatttgtggagcatttttaagtgtttatgatagtgaccggcgtttagctgatcattttggaggcaagcttcatctaggttacatgcaaatccgtgataaactagcagagcttcaggaagagagaaacaagagccgcaaacttgatcgatatgatgacagaagatcaaaggaacggagtagggatcgtgaaagagagcccagtcgggatcgtgatcgaggagagagctgtgatcgagggagggatcatgatcgtaggagcagggatcaggacaggtatcatgaacgagatcgtggatatgatcgggaccgggagagagattatgagcgctcacgcagttatgattcaagaagtcgtcgtaggtcacgttctcggtctagggaacattctagggattatgatcggcacaggcgtgatcgctactaggatggatgatggttgcagtcaaagtggatggataatgaaatgatgttcttgtttaggtcggtgattaaatcatgtaggattgttgtgatggttttatgcaaagtaggattcatcaacatgtgcttttgggggtggagtttggcagttttctggtgttttttgctggatgtattgactttgacttgactgcttcaaagatttctctgttgcttaaatatctgggagaggtacgttttagtgttttaacatatttattcctcactaatcatccgctgcagtgacatctccctaaaaacacttctttaggactggattttaaaggatcgtttttctttctttgatggaatggtattagcagccaccacttaacaataacctttactacactggaatatgtgatcatttgtcggtgacgaaacctatttaaaattttatggtttttcttcttaaaaaagaattttaacgttgtaggtgatttcctgcactaaaaaggattctcttatgggtaaattattaaaatagtttttgtttatttcaagttgcattttaatcatttatgttttaattacttgtgttatttgtcgttaatagtgtaacggtaagctgacgtaacattaaatcattattttaaacaaacttttaagttaatta

SEQ ID NO: 5936 - DNA, 1717 bp, Lupinus angustifolius
ctaggtattgatttcataattttcttagatcactcgtgtgagtaagaaacccaaaagagagagaaggagaatcgaaaaccctaacaatggatgccataaggaagcaattggacgtgttaatgggcgcaaataggaacggtgacgttagagaagtcaatcggaaatactatgatcgtgatgtttgtcgtctctacctcgttggtctttgtcctcatgaactctttcaactcaccaaaatggacatgggtgcttgccctaaggttcactccttgcagttaaggaaagaatacgtggaagcaaaagcaaaaggggtcgataattatgacagggagttggaggatgttatagacaggctcatcgccgagtgcgaaaggaaaattggcagagctctgaagcgccttgaggatgacgatgccaaagctgcaatcgcaatatcggtgactgaagttactcagactcccgaggtgcttgagttgtcaaaggaaatcaaagagaagttgaaagaagctgatcaatatgatcttgaaggcaacacagatctcaagatccgagctatggaaattgtagaggaacttaggactaagagagctgacaatcaggctacacttcttcttgatgccttcaacaaagatagagcatctttacctcaacctcttccaaatccacctccattggcaccctttccagtagttcctcgtgatcctcgaacacaggagatgataaatgaaaagttcaagaaggctgaagaacttggtgaacaaggaatggttgatgaggcacaaaaagcattggaagaggctgaagcacttaagaagctccctccaaggcaggagccaccgttggatccttctaagtacacagctgcagatgttcggattactgatcagaagctacgtgtgtgcgacatttgtggggcatttttgagtgtttatgacagtgatcgccgcttagctgaccattttggagggaaacttcatttaggatatatgcagatccgtgagaagttagcagaactccaagaagaaaggaacaagagccgaaagattgattggcaggatgataagaaatcaaaagaactgagtagggatcgtgacagggagtcaagtaaggaccgtgaaggtggcgagactcgtgaacgaggcagagactatgatcataggagcagggatcgtgataggcataatggtagagaccgtggttatgatcgagatcgtgacagggactctgatcgctccagacactatgactcaagaagtcgccggaggtcccgctcacgatctcgagagcgttctagagactatgatcgtcataggcgtcatgatcgatactagtgattgctgtggatcttatggatatgataagatatttgatgcaggtgggtgataatgaacttcatgttggaccaataattttgctatttcttgtgttaaactgtttctccaatgttagatgtaacttgagtttaggtgttgctaaattgtgtttcatcttgctttgagttacttgattaaacttgtaatctgggtcatggatcagttcctgcgtttgtgcttaaaaatacttgttattacatttaccattggaacatattatagagaattgtgtgcgcatggatgctggtggtaattgataggggtgttgtattgttcaagacttgtttcattttatgaattcgctataattggaattatattatgataaaattcgattatagtaa

SEQ ID NO: 5937 - DNA, 2487 bp, Cannabis sativa
ttttttcataataaacatacccatgaaaaatgaaaacttgaggacttatgtgacatgttttggaaagataagggactataataataaacgtcttaagtgcgtttcaaaacaaatatatatcagaaacagaaggggaaaaaatcgtgtgattagtgctttatcgattcgaagcttcatattttattgattaattctccgaaaaattgcgagccaagccaagccctaatcgggaaaactcttccaactcagggagagagtgagagaaagaagccatggacgccctgaggaagcagctcgaccagttgatgggggcaaaccgaaacggcgacgttcgagaggtcagtcgcaagtattacgatcgcgatgtttgccgtctctacttggtcggcctttgtcctcacgagcttttccaattaacgaaaatggacatgggaccatgccctaaggtgcactctttgcagcttaggaaggaatatgaagaagccaaagcgaaagggactgacaactatgacagagatctcgaggatgttattgataggctcattgttgagtgtgatagaaagattgctagagctcttaagcgtcttgaggatgatgatgcaaaggctgctattgcaatttctgtttctgatgttactcagacaccagagataattgagttgtcgaagcagatcaaagagaaattgaaggaggctgatcaatatgatcttgaaggcaagacagatcttaagattcgagctctagaggtgatagaagaactcagaacccaacgagcagacaaacagtccatgcttcttttggatgccttcaacaaagatagggcatctttacctcaacccttgccaaatcctccacctttggcacctttgcctgtagctgcgcttgatcctcgtacacaggaaatgattaatgaaaaactaaagaaggcagaagatcttggtgagcaagggatggttgatgaagcacaaaaagcattggaagaggctgaagccctaaaaaagctgcctgccaggcaggagccagttcttgattccactaagtacactgcggatgatgttcgcattactgatcaaaagctaagggtatgtgacatatgtggagcattcttaagtgtttatgacagtgaccgacgattagctgaccattttggggggaagcttcatttaggctatatgcaaatccgcgagaagttagcagagcttcaggaagagagaaacaaagttcgcaaggttgatcgatatgatgataggaggtcaaaagagcgaagtagggagattgaaagggagtctagtagggatagagaaagagcaggtagccgtgatcgaagagattatgatcgcaagagcagagatcgtgatagacatcatgatcgtgatcgtggatatgatcgtgaacgtgagagagattcagatcgctcccgcagttatgattccagaagtcgtcgtgaccgctctagatcacgggagcgttcaagggactatgatcgccacagcaggcgttatgatcggtactagacaaattcttatgcagagaagaagggctacgagggggtggaaatttgatctttttctaggtcagtgttgaaactaatgtaggaaaaaataacagtttgtgtttcttcctaaatttttatctatttatctggagttgagctgtttctcctgtggaggacgtaaggaatgctgcttaggttttctcaacttcgttgttagagactaagaggtatgtttgagaggtatgttttattctgttttaagtcattgccattagcttctttatttataatctatggctgaaagtttagtttgtttgcttacaaactcctatctgtggggtaatttggcttctaatttatgaagttgagttgaaaaattgacatggaatgtcttgaggggtaggtaaggaggatggaacatctactggttttaaagtttgtttcttttttttttacttacaaattggcaaagcatggaatccggtaaaattattcaatatccaattgcttttgtatatacaatgacatttgctcatttgagagatactagacttcaaaaacatttgctcattttttgtttttttgttcttccatggggttggggatttaagccttgaacttcgacaatgaaggtagggctgggttgtgaatgatcacgtttgcgcagtcatttaaaatgcattaaataacgaagtctctagtgaccttgaaataaggtgaaatcgaacattaacaagcaagaatggctactcgtatatcctaattttcgaaagtactctccataagcattttgaatattttaaatgcgcttacttcgataatgaagatcgaacaatcagaagatgaaaaagcattgtttcttgttcttaccagaaatatttattcaacgaatttcacaagtaggtattggtttcatctgtaactaacaatctagtggcgccttccaacaataaatcaaccggcctagttactattaggccactgctagcagc

SEQ ID NO: 5938 - DNA, 2761 bp, Ricinus communis
tacctggctgccatggttccaagttttgaggcgagcggaaaaggtaccggcggggacaaaatcggaatcaccaaaagcgtgttcgagcgtgaattggatcttcgaatccaaatccggatcggaaaacttacgtcgagtagttgtaggagtaggtgatgatctggtggtgtatgtagaatcagaagaagaacgcggttgagatgatgctcttccgatgccaacaaactcttcgtcgtctactagaagctcatctgattgaaaagcagttaaagatgcagttaaagatgcagttaaaaagcaaacagtgagcaccaaagcaatcaattgtttcatcatcgtcactgtgctcttcctcttcgctagaccaccacaccagagtttgttttgaggctggcttttgaccctttttgctatttgggccctgtttaagatattttgctaattgggtcttccattcttaatttatttgttctttttgttactgaggaaggcacctgaagaaataatagcaatacaaagggtacgcagagagagggagaattctattgaaagatggacgcgatgaggaaacagctggatgtgctcatgggagccaatcgaaacggcgacgtaagagaggtgaatcgtaaatattacgatcgtgatgtgtgtcgcatgtacctggttggcctttgccctcatgagctcttccaactaacgaaaatggatatggggccatgtcctaaagtccattcgctgcagctgaggaaagaatatgaagaggcaagggccaaaggtactgataactatgatagagagttggaggatgtaatagatcggcttattgtggagtgtgataagaaaatcagtcgagctcttaagcgtcttgaggctgaggatgcaaaggctgctattgcaatatcagtttctgaggttacacagaatccagagataattgagctgtcaaagcagattaaggagaagttgaaagaagctgataaacatgatcttgaaggcaagacagactttaagattcaggctttggaggaggtggaaaaactcagaacagaaagagcagagaagcagtctgcgctacttttggaagccttcaacaaagatagggcatctttacctcaaccattgccaaacccaccaccattggcacccttgcctgtacctgctcctgatcctcgtacccaggaaatgataaatgagaagctgaagaaagcggaggatcttggcgagcaaggaatggtagatgaggctcaaaaagcattggaagaagctgaggcactgaagaagctgcctgccaggcaagatcctgcactggattcctccaaatatactgctgctgacgtgcgcattactgatcagaagttgcgtgtttgtgatatctgtggagcatttttgagcgtatatgacagtgatcgacgtttagcagatcattttggagggaagcttcatttaggctatatgcaaatccgtgagaaactaacagagcttcaggaggagagaaacaagctccgaagaggtgatcggcatgatgatcgaagatcaaaagagagaagtaaagaccatgacagagaatcatccagggatcgagaccgagcgggaagccgcgaccaggagagggattatgatcgtaggagtagagatcgtgacaggcattatgatagagatcgtgcatatgaacgggagcgtgatagagattcagatcgttctcgtagttatgattcaagaagccgccacaggtcgcgctctcgatctagagaacgtgctagggactatgatcggcacaggcgctacgatcgttactaagggctcttgctgttgagcattttggtatgagaactcgtgtttctttttgcctagtttaatgaacttgtggattgaagaatgatgttatgtgtttcttctgatatttttagtggagtttgatagtactattatggtgggcataccaactacgccataaattttcttgacttgtatgtttaagaggtacgctttgcactttttatataaataccatgtcctgctaatctttaaacttggctcagttctaatactcctaaactggaagttactgatcttgtgcaaattgaattggggcacatggtatatagatgactatgttgccattggatataatttgcttttgcattttgttttgaagaaaaggggagagaaaatgaaaagcaatctcttcttcttaccacttgaattaggagccaggtcatttgtgttcaattgtaagtaggacctcagcctttttctttggagataaaagaaaagaaaaagttctggacttgggaaacctgccaaccttttatttaacaattatttccaaagttttcttttaaaaggggaaacaggtaaatcattttgtttttcttttcccctccccccctgcggcacacatcttgtcttatatcttcaagtagctgtgggttacaagctcagccagctagttattctttcggatgtctaactactttctggagtgcggcctaaaagagtattgatagtagcaacaacttatgggtactttctttgccgattgttgttttgaggtgtgaaattgttccttatcaagagaacttgtcccatatgctatcccggctttgggggcatggaagtgtttttgctgattttgtatgtaatgcaactgttcaatgatatattgaagttggagaaactcatttgaaccctatattttcttgaaataaaattctcaaatggtttttgagcaaaaactagccactattggaatgaaattacc

SEQ ID NO: 5939 - DNA, 2531 bp, Cannabis sativa
agggactataataataaacgtcttaagggcgtttcaaaacaaatatatatcagaaacagaaggggaaaaaatcgtgtgattagtgctttatcgattcgaagcttcatattttattgattaattctccgaaaaattgcgagccaagccaagccctaatcgggaaaactcttccaactcagggagagagtgagagaaagaagccatggacgccctgaggaagcagctcgaccagttgatgggggcaaaccgaaacggcgacgttcgagaggtcagtcgcaagtattacgatcgcgatgtttgccgtctctacttggtcggcctttgtcctcacgagcttttccaattaacgaaaatggacatgggaccatgccctaaggtgcactctttgcagcttaggaaggaatatgaagaagccaaagcgaaagggactgacaactatgacagagatctcgaggatgttattgataggctcattgttgagtgtgatagaaagattgctagagctcttaagcgtcttgaggatgatgatgcaaaggctgctattgcaatttctgtttctgatgttactcagacaccagagataattgagttgtcgaagcagatcaaagagaaattgaaggaggctgatcaatatgatcttgaaggcaagacagatcttaagattcgagctctagaggtgatagaagaactcagaacccaacgagcagacaaacagtccatgcttcttttggatgccttcaacaaagatagggcatctttacctcaacccttgccaaatcctccacctttggcacctttgcctgtagctgcgcttgatcctcgtacacaggaaatgattaatgaaaaactaaagaaggcagaagatcttggtgagcaagggatggttgatgaagcacaaaaagcattggaagaggctgaagcccttaaaaagctgcctgccaggcaggagccagttcttgattccactaagtacactgcggctgatgttcgcattactgatcaaaagctaagggtatgtgacatatgtggagcattcttaagtgtttatgacagtgaccgacgattagctgaccattttggggggaagcttcatttaggctatatgcaaatccgagagaagttagcagagcttcaggaagagagaaacaaagttcgcaaggttgatcgatatgatgataggaggtcaaaagagcgaagtagggagattgaaagggagtctagtagggatagagaaagagcaggtagccgtgatcgaagagattatgatcgcaagagcagagatcgtgatagacatcatgatcgtgatcgtggatatgatcgtgaacgtgagagagattcagatcgctcccgcagttatgattccagaagtcgtcgtgaccgctctagatcacgggagcgttcaagggactatgatcgccacaggtactggcttcaaattttccctatcaagttcccactatttcaaatggtcttatttttggctggtcatctgaaattaagtaattctatttcagcaggcgttatgatcggtactagacaaattcttatgcagagaagaagggctacgagggggggtggaaatttgatctttttctaggtcagtgttgaaactaatgtaggaaaaaataacagtttgtgtttcttcctaaatttttatctatttatctggagttgagctgtttctcctgtggaggacgtaaggaatgctgcttaggttttctcaacttcgttgttagagactaagaggtatgtttgagaggtatgttttactctgttttaagtcattgccattagcttctttatttataatctatggctgcaagtttagtttgtttgcttacaaactcctatctgtggggtaatttggcttctaatttatgaagttgcgttgaaaaaattgacatggaatgtcttgtggggtaggtaaggaggatggaacatctactggttttaaagtttgtttcttttttacttacaaattggcaaagcatggaatccggtaaaattattcaatatgcaattgcctttgtatatacaatgacatttgctcatttgagagatactagtgttcaaaaacatttgctcatttttgttttttgttcttccattgggttggggatttaagccttgaacttcgacaatgaaggtcgggcggggttgtgaatgatcacatttgcgcagtcattttataatagtcgggagttagaaccgaaaaatgcattaaataacgaagtctctaatgaccttgaaataaggtgaaatcgaacattaacaagcaagaatggctactcgtatatcctaattttctaaagtactctccataagcattttggatattttaaatgcgcttactgcgataatgaagaccgaacaatcagaagatgaaaaagcattgtttcttgttcttaccagaaatatttgctcaacgaatttcacaagtaggtattggtttcctctgtaactaacaatccagtggcgccttccaacaataaatcaaccggcctagtaactattaggccacttttagcagc

SEQ ID NO: 5940 - DNA, 1913 bp, Gossypium hirsutum
aagaatcggccgagacatgagtcacccctggcttagaaaaaactaatatcaaatagtcataagagcccccggaaggccgaaattctcgatccctagcgaaaaccaaaccctagaaaaagtctcctttggccttgccttgcctctttcacagaaaaagaagtgttggaggttaaatattgattcccctttcactttgcaagagaaaggagaagacaacacctgaaaggaaaaaaaaaaacaacaccacaatggacgctatgaggaaacagctcgatgtgctgatgggtgccaatcgaaatggcgacgtacgtgaagtgaatcgcaagtactacgatcgcgatgtttgccgtctctttttgtccggtctttgccctcacgagctcttccaattaacgaaaatggatatgggaccatgcccaaaggtccactctttacagctgaggaaagaatatgaagaagccaagtcaaaaggtgttgataattatgacagagaattagaagatgccattgaaagactcattgtcgagtgtgataggaaaattggcagagctctacggcgtcttgaagatgaggatgccaaagctgctattgcaatatcagtttctgaggttacacagacacctgaaattcttgagctgtcgaagcagataaaggagaaactgaaagaaactgatcaacatgatcttgaaggcaagacagatcttaagattcgagcactggaagaagtagaagagcttagaactacaagagcagacaagcagtcaatattacttttggatgcattcaataaagatagagcatcgctgcctcaacccctgccaaatccaccaccattggcacctttgcctgtagctgcacctgatcctcatatccaggagatgataaacgagaagctaaagaaagcagaagatcttggtgagaagggaatggtggatgaagcacaaaaagctctggaagaggctgaagctcttaagaagctgcctgctagacaggagcctgttctggactcctcaaagtacacagctgctgatgtccgcattactgatcaaaagcttcgtgtttgtgacatttgtggagcatttttaagtgtttatgatagtgaccggcgtttagctgatcattttggaggcaagcttcatttaggttacatgcaaatccgtgataaactagcagagcttcaggaagagagaaacaagagccgcaaacttgatcgatatgatgacagaagatcaaaggaacggagtagggatcgtgaaagagagcccagtcgggatcgtgatcgaggagagagctgtgatcgagggagggatcatgatcgtaggagcagggatcaggacaggtatcatgaacgagatcgtggatatgatcgggaccgggagagagattatgagcgctcacgcagttatgattcaagaagtcgtcgtaggtcacgttctcggtctagggaacattctagggattatgatcggcacaggcgtgatcgctactaggatggatgatggttgcaatcaaagtggatggataatgaaatgatgttcttgtttaggtcggtgattaaatcatgtaggattgttgtgatggttttatgcaaagtaggattcatcaacatgtgcttttgggggtggagtttggcagttttctggtgttttttgctggatgtattgactttgacttgactgcttcaaagatatctctgttgcttaaatatctgggagaggtacgttttagtgttttaacatatttattcctcactaatcatccgctgcagtgacatctccctaaaaacacttctttaggactggattttaaaggatcgtttttctttctttgatggaatggtattagcagccaccacttaacaatataacctttactacactggaatatgtgattatttgtcgatgacgaaacct

SEQ ID NO: 5941 - DNA, 1974 bp, Fragaria vesca
atcaaatccaaatctcccaaatccaaaacaaaccctaaaatctggaggagtagagagagggagcgatggacgcgctgaggaagcagctggaccagctcatgggggcgaatcggaacggcgacgttcgggaggtgaatcgcaaatattacgatcgcgatgtgtgtcgcctctacctggtcggactctgcccccacgagcttttccaattaacgaaaatggatatgggaccctgccccaaggttcactctctgcaactcagagaagaatacaaagaagctaggaagcaagggaccgataactatgacagagacctggaggatgtcatagataggctcattgttgaatgtgatcggaaaatttctagagcccttaagcgccttgaggatgatgatgcgaaagccgccattgcaatttctgtctccgaggttactcagacaccggagatacttgagttgtcaaagcagatcaaagagaagcttgaagaagctgatagattcgatcttgaagggaagacagatcttaagattcgagctctggagatattagaagatctcaggggaaagagagcagacaaacagtcaacgcttcttttggatgctttcaataaggatagggcagctttacctcaacccctgccaaatccaccacctttggctccgttgcctgtagttgttcctgacgctcgtacacaggaaatgataaatgaaaagttgaagaaggcagaggaccttggtgagcaaggaatggttgatgaggcgcaaaaagcgttggaagaggccgaagcactgaaaaagttgcctcccaggcaggagcctgtcctggattcctccaagtatactgctgctgatgtgcgaattacggatcaaaagctgcgtgtctgtgacatctgtggagcatttcttagtgtttatgacagtgatcgtcgtttagctgatcatttcggtgggaaacttcatttaggctatatgcaaatccgtgagaagttagcagagctgcaggcagagaaaaacaagattcgcaaggttgatcggtatgatgaaagaagatcaaaagagagaagcaaggaacgtgatagagaacctagtagggacagagaacgcggcgatagccgcgaccgagggagggatcttgatcgtaggagcagagatcgagataggcactatgaccgtgatcgtggagagcgtgacagagattcaaaccgctcccgcaattatgattcaagaagtcaccgtaggtcacgctctcggtcacgggaacgttccaaggattatgatcgccacaggcgttacgaccgatactagttcttgatttgaagtatgtggaaagaggatattttgtattcctgtctaggtcagttttaaaacttatgtaccaagatggtttaatgtttcttcccaagttctttgtttcgagttgagcttctcctctgatggatgtaaggactgcttagtttttctcaacttcgtatttaagaggtatgcatgagaggtatgttttattgtcttgatatatctttattcacattttcttgatatttgactgatccttggccaacaaatagagatgtaaatcttaagaaatcactcccttgttgagattcaacgccgtgttaaagacatatgttggtcagctacttacattcagttgccattgtttagtctgatcaatacatgtagtgtttggaaagggtgatgggatgaacctaatttttcaagaaatcatccagaactctttacaaagatggaaggtaaaaataagattgccttggtgctatgtgatccggatctgttctatcaatcatcttctgagttgtagttgtgaggttttgatattatgctgtgaaacaattattgtctgaattgtaatgtgcttgctttagaaagttcaattggcccattttaatatttttaaaacaatctcaagtttctgaatcaaagagcaagtcatttggttcttagctcttttaatgtcaac

SEQ ID NO: 5942 - DNA, 1650 bp, Catharanthus roseus
ttgctctggagacttcgataattgaaagagacaaacctttttaacagcgatagagagagaagagatattaagattgagggcgttgttgaagtcttgttcaacaatggatgcgataaggaagcaactggacgtgttaatgggggccaatcgaaatggggacgttagggaggtggatcgcaagtactatgatcgtgatgtctgccgtctcttcctctccggtctttgccctcacgaactcttccagctcactaaaatggatatggggccttgcccgaaggtgcactcgttgcagctccggaaagaatatgaggaatcaaagacaaaaggtacggacaactatgatagggacctggaggatgtcatagataggctgattgtcgagtgtgataggaaaattgcaagagctcttaagagattagatgatgaagatgctaaggcagccattgccatctcggtatctgaagttacccagacaccagaggtccaagagttatcaaaagaaataaaagagaagctgaaagaagcggatatttatgatcttgaagggaagacagacatgaagattcgtgcccttgaagtggtggaagagctcagaactaaaagagctgacaagcagtctatgcttcttttggatgcattcaacaaagatcgagcttcactacctcagcccctgacaaatgctccacaatcggcaccccttcctgcaactgcacctgatcctcatgtgcaggaaatgataaatgaaaaactcaagaaggccgaggatctcggtgagcaagggatggttgatgaggcacagaagttactggaagaggcagaggcacttaagaagctacctgcacgtcaggaacctgtactggattcctcctccaagtacactgccgcggatgtacgaattactgatcagaagctccgtgtatgtgacatttgtggagcatttttgagtgtttacgatagtgatcgtcgtttagcagatcattttgggggcaagcttcatttaggctatatgcaaatccgtgaaaagttagctgagcttcaggaagagagaaacaagaagcggaaagcattagaggaagagagaagatcaaaggagcgaagaagccgagaccgtgaatcaagcagggatagggatcgtggtgatagtcgtgaacgaggaagggatcatgaccgtaggagcagggatcgtgatcgtgatcgtggctatgaccgggatcgggaaagggagagagatggagatcgctcccgtagctataattcaaggagtcatcggaggtcaaggtcacgctcacgagaacgttctcgggattatgatcgccacaggcgctcagatcgttactagctgggcattgctgtaaccaggaagaggtggagagcagtcttttgcaggttaatgcatgaaaaagtctgtaggagtcttaaagatgttgctattttggagttttgggatttgagagattgttcctgtatttgcttaatagtggtgggataaactactatgcccaagtcttggtggaactaactcagtgctctattttttctatgttttgaatctgcagaaattcaactatggcttctcaattctgtcttgtatttgatttcaactaaatgggcagcggaggacataaaaagtaaattacaatgttggcatgc

SEQ ID NO: 5943 - DNA, 1701 bp, Cucumis melo
atagcttcgctttagagagtagagacaggacacccttcggtgagaaggtttcctagacagagatagagagacacctccggagagtcagccatggatgcttttagaaggcaactggaccagctaatgggtgcgaatcgaaatggtgacgtccaggaagttagtcgcaagtactacgaccgcgatgtgtgccgcatgttcttagttgggctttgtccccatgagctcttccaactcacgaaaatggatatgggtccatgtccgaagatccattccttgcaactcaggaaagaatatgaagaaggaaaggctaaagggattcataactatgaccgagacttggaggatgttatagatcgtctcattattgaatgtgatagaaaaattgctagagccttaaagcgacttgaggaggaagatgcaaaggcagctattgcaatttctgtctctgaagtaacccagatacccgaggtactcgagttgtcaaaagaaattaaagagaaattgaaagaagccgaccaatatgatcttgagggcaaaactgatcttaaaattcgggttttggaggttgtagaagaattgaggaccagacgagctgacaaacagtccatgcttcttttagatgctttcaacaaagatagggcatctttgcctcaacctctgccaaacccaccacctttggctcctctacctgttgtagctcctgatcctcgtacgcaggagatgataaatgagaagttgaaaaaggccgaggaactaggtgagcaaggaatgattgacgaggctcaaaaagccctggaggaagctgaagcactcaagaagttgcctgctaggcaggagccagtggtggattcatccaaatatacagctgctgatgttcgaattacggatcaaaagctgcgggtatgtgacatctgcggggcatttttaagtgtttatgacagtgatcgtcgtttggcagatcattttggaggaaaacttcatctcggctacatgcaaatacgtgaaaagttagcagagcttcaggaagaaagaaacaaaagccgcaaggttgatcgacacgatgatcgacgatcaaaggagcgtagtagagagcctgatagagaacctagtagagaccgtgaccgtggtgatagtcgtgaccgtggaagggataatgaccgtaggagcagggatcgtgataggtatcacgatcgggatcgttatgatcgagagcgcaacagagacccagatcgctcttatgattctagaagtcgtcgccgttcacgctcacgatcaacagaccgtgaacgtgcaagggactatgatcgccacaagcgccgtgaccggtactgaatagttgtggatctaacggacgtgaaagtacaggttcatgccctgtttttcttcctctattttgaatgcagttggctgtatcttctctaatgattttataatgaccgccagaaggttatgttgacagtacttatgagaggtatggttgtactgattactggaattttatatgtagctggtagtagagtagtttctttgaggttttcttttcacatataaactaaggtcatgggatacatcaatttttcatatgatcattttgaagacttcataacaggatgtaagttggtaagatttgacatataatcatctgtttcatgtattaagaacctataggcaggcctgataaatgatatctttcaaatttat

SEQ ID NO: 5944 - DNA, 1775 bp, Citrullus lanatus
ccaaccctagttttgtatttgcatccgatagcctcgctctagagcagagacaccctttggtgagaaggtttcctagagagagagagggggagagagctccggagagacagccatggatgcttttagaaggcaactggaccagctaatgggtgccaatcgaaatggcgacgtgcaggaagttagccgcaagtactacgaccgcgatgtctgccgcatgttcttagttgggctttgtccccatgagctcttccaactaacgaaaatggatatgggtccatgtccgaagatccactccttgcaacttaggaaagaatatgaagaaggaaagactaaagggattcataactatgaccgggacttggaggatgttattgatcgtctcattatcgagtgtgatagaaaaattgctagagccttgaagcgacttgaggaggaagatgcaaaggcagctattgcaatttctgtctctgaagtcacccagatacctgaggtacttgagttatcaaaagaaattaaagagaagttgaaagaagctgaccaatatgatctggagggcaaaacagatctcaaaattcgagttttggaggttgtagaagaattgaggaccaaacgtgctgacaaacagtccatgcttcttttagatgctttcaacaaagatagggcatctttgcctcaacctcttccgaacccaccacctctggctcctctccctgttgtcgctcctgaccctcgtacacaagagttgataaatgagaagttgaaaaaggccgaggaacttggtgagcaaggaatgattgacgaggctcaaaaagcactggaggaagctgaagcacttaagaagctgcctgctaggcaggagccagtgatggattcatccaagtatacagctgctgatgtgcgaattacggatcaaaagctgcgtgtgtgtgacatctgcggggcatttttaagcgtttatgacagtgatcgtcgtttggcagatcattttggtggaaaacttcatctcggctacatgcaaatacgtgaaaagttagcagagcttcaggaagaaagaaacaaaagccgcaaggttgatcgtcatgatgatcgacgatcaaaggagcgtagtagagaacctgatagagaacctagtagagatcgtgaccgtggtgatagtcgtgatcgtggaagggataatgatcgtaggagcagggatcgtgataggtatcatgatcgggatcgttatgatcgagagcgcaacagagacccagatcgctcttatgattctagaagtcgtcgccgttcacgctcacgatcaacagaccgtgaacgtgcaagggactatgatcgccacaagcgccgtgaccgatactaaacagttgtggatccaatggaagtgaaaatacaggttcacatcctgtgtttcttcctctattttgagtgcagttggctgtatcttctctaatgattttataatgactgccagaaggttatgttgacaatgcttttgagaggtatggttgtactgattactggaattttatatgtagctgttagtagagtagttccttgaggtcttcttttgaaatataaactaaggttatgatgggatacatcaatttttcatacgatcattttggagacttcatcacaggatgtaagttggtaatatttgacctataactattgaccaatcaccgtttcatgtattaagaaccaataggcaggcctgatgaacgattcttttcttctttactgttctcccttttccattcatgtttatctgcagtaaatgt

SEQ ID NO: 5945 - DNA, 1450 bp, Malus domestica
aaacgcactccaaatccaccttagtatttttttccccaaaccctccaaatccgcaacagacgagccctaaattctctctctgagcaaacccaaaacgccaactgaaaagtcaccaattccaaagccgtagaggacgacgactggagagggattgtgagcggccatggacgcgctgaggaagcagctcgaccagctcatgggggccaaccgaaacggcgacgttcgggaggtcaaccgcaagtattacgatcgcgatgtgtgtcgcctctacttggtcggcctctgcccccacgagctttttcagttaacgaaaatggatatgggtccgtgccctaatgtccactctttgcaactcagaaaagaatacgaggaagcgaaagcgaaagggactgataactatgacagagacctggaggatgtcatagataggctcattgttgagtgtgataggaaaattactagagctcttaagcgcctcgaggatgatgatgccaaggctgctattgccatctctgtctctgaagttactcagacaccagagatacttgagttgtcaaagcagatcaaggagaagttgaaagaagttgatcaatatgatcttgaaggcaagacagatcttaagattcgggctttggagatagtagaagaactcagaggcattagagcagataaacagtccacgttacttttggatgctttcaataaggaccgggcagctttacctcaacccctgccaaacccacctcctttggcacccttgcctgtagttgttcctgatgcaagaacacaggaaatgataaatgaaaagttgaagaaggcagaggaccttggtgagcaaggtatggttgatgaagcacaaaaggcattggaagaggctgaagcgctgaagaagctgcctgccagacaagagcctatcgtggattcctccaagtacactgctgctgatgttcgtattactgatcaaaagctacgcgtttgtgacatctgtggagcatttttgagtgtttatgacagtgaccgtcgtttagctgatcactttggcgggaagcttcatttaggctatatacaaatccgtgagaagttagcagagctgcaggaagagaaaaacaagagtcgtaaggttgataggtctgatgataggagatcaaaggagcgaagtatggaatgtgacagggaatcaagtagggatagagaacgtggagctagccgggaccgaggtagggattatgatcgtaggagcagagatcgcgataggtactatgatcgagatcgtggatatgatcgcgatcgtgatagagattcagatcgctcccacaattatgattcaagaagtcgccgtaggtcacgctcacgatcgagggaacgttccagggattatgatcgccacaggtgcgtgctcttccgtggtggccgatttttagtgagttctatttatttcacatgcaattag

SEQ ID NO: 5946 - DNA, 1633 bp, Cucurbita pepo
ccagccctaattttgtatttgactccgacatcctcgctctggagccgagacaccctttgttgagaaggttttctacgcagagagagctacggagagatagccatggatgcttttagaaagcaactcgaccagctaatgggcgcgaatcgaaatggcgacgtgcaggaagttagccgcaagtactacgaccgcgatgtgtgccgcatgttcttagttggcctttgtccccatgaactcttccaactcacgaaaatggatatgggtccatgcccgaagatccactccttgcaacttaggaaagaatatgaagaagcaaagactaaaggggttcataactacgacagagacttggaggatgttatagatcgtctcattattgagtgtgataggaaaattgctagagccttgaagcgacttgaggaggaagatgcaaaagcagctattgcaatttctgtctctgaagtcacccagatacctgaggttcttgagttatcaaagcaaattaaagagaagttgaaagaagccgaccaatatgatcttgagggcaagacagatcttaaaattcgagttttggaggttgtagaagagttgaggacattacgagctgacaaacagtcgatgcttcttttagacgcttttaacaaagatagggcatctttacctcaaccaatgccaaacccaccgcctctggctcctttgcctgttgtagctcctgatcctcgtacacaggagatgataaatgagaagttgaagaaggctgaggaactgggtgagcaaggaatgattgacgaggctcaaaaagcattggaggaagctgaagcactcaagaagctaccagctaggcaggagccagtgatggattcttccaaatatactgctgctgatgtgcgaattacggatcaaaagctgcgtgtgtgtgacatttgtggagcatttttaagcgtttatgacagtgatcgtcgtttggcagatcattttggaggaaagcttcatcttggctatatgcaaatccgtgaaaagctagcagagcttcaggaagaaagaaacaaaagccgcaagattgatcgacatgatgatcaacgatcgaaggagcgaagtagagaacctgatagagaaccaagtagggatcgtgaccgtgaccgtgaccgtgctgatagtcgtgaccgtggaagagataatgatcgtaggagcagggatcgtgatagatataatgatcgggatcgttatgaccgagaccgcaacagggacccagatcgctcttatgattctagaagtcgtcgccattcacgctcacgatcaacagaccgtgaacgttcaagggactatgatcgtcacaagcgacgtgaccggtactagtactaaacagatcttacgaatgggtccaatggaagtgaaggtacaggtttatgtcctgtgtttcttcctatattttgagtgcagttggctgtatcttctctaatgattttataatgaccaccacaaggttatgttgactgtacttttgagaggtatggttgtactgattactggaattttatatgtagctgttagtggagtagtttccttgcaatcttttttgacatatagactaaggttgtgggatacatcaattttttatattgatcattttgga

SEQ ID NO: 5947 - DNA, 1531 bp, Tabernaemontana elegans
accacgctccgactcccaaatcgaacaaaaaccctaacccacagctgtgctctggagacttagataatccaaagaaacgaacccttcaacagcgacaaagagagaagagagatagagattgagtgtgtcgtagaagtcttgttcaacaatggatgcgataaggaagcaactggatgtgttaatgggggccaatcggaatggggacgttagggaggttgatcgtaagtacttcgatcgtgatgtctgtcgtctcttcctctctggcctctgccctcacgaactcttccaactcactaaaatggatatggggccttgcccgaaggtgcactcattgcaactcaggaaagaatatgaggaagcaaaggcaaaaggtgttgacaactatgacagagacttggaggatgtcatagataggctaattattgagtgtgataggaaaattgctagagctcttaaaaggcttgatgatgaagatgctaaggcagccattgctatctcagtatcagaagttacccagacgccagagatccaagagttgtcgaaagaaataaaggagaagcttaaagaagccgatatccatgatcttgaaggcaagacggatatgaagattcgagcccttgaagtggtggaagatctgagaactaagagagctgacaagcagtctatgcttcttttggatgcattcaacaaagatcgagcttcactacctcagcccctaacaaacactccacaattggctcccttgcctgcaactgcacctgatcctcgtgtacaggaaatgataaatgagaaactaaagaaggctgaggatcttggtgagcaagggatggttgatgaggcacagaagttattggaagaggcagaggcacttaaaaagttacctgcacgtcaggaacctgctcaggatacctcctccaagtacacggctgcagatgtacgcattactgatcagaagcttcgtgtctgtgacatctgtggagcatttttgagcgtttatgacagtgatcgtcgtttagcagatcattttggaggaaagcttcacttaggctatatgcaaattcgtgaaaagttatctgagcttcaggaagagagaaacaagaagcggaaagcatatgaagaagagagaagatcaaaggaacgaagaagccgggaccgtgagtcaagtagagacaaggatcgtggtaatagtcgtgaacaagcaagggatcatgaccgtaggagcagggatcgtgatcgtcactatgatcgtgatcgtggctatgatcgggagcgggagcgggagagagatagggatagagatcgttctcgtagctatgattcaaggagtcgtcggaggtcaaggtcgcggtcacaggaacgttctcgagattatgatcgccacaggtctgaccgatactagctgaccattgctggaagggagaggtgaagaaatattcttgcttttgtcaatgctcaaaggactgtaggaatcttgaaggtggttgctttattaaatgtttatggatcgtccgaaatggttcctgtatttgct

SEQ ID NO: 5948 - DNA, 1566 bp, Panax ginseng
gaagagagatggatgcacttagaaaacagctggacgtgttgatgggagctaacagaaatggcgacgtgagagaagtgaatcgaaagtattacgatcgtgatgtttgtcgtctcttcttagttggcctttgccctcacgaactcttccaactcactaaaatggatatgggaccttgcccaaaggtgcactcgctacagttgaggaaagaatatgaagagtccaaagtaaaaggtcaagacaattatgatagggagttggaagatgtcattgacaggcttattgttgagtgtgatagaaaaattgctagggctcttaaacgtcttactgatgaggatgctaaagcggctattgcaatatccgtttctgaagttaccatgacacctgatattcttgagttgtcaaaggagataaaggagaagctaaaagaagttgatcaacatgatctagaaggcaaaacggatatgaagatccgagctttggaagtgttggaagaactcagaactaaaagagcagacaaacagtctatgcttcttttggatgccttcaacaaagatcgagcttctttacctcagccccttccaaaccctccaccattggcaccattcctgtggttgttcctgatgctcgcacacaggagatgataaatgagaaactgaagaaagccgaagatcttggtgagcaaggtatggtcgatgaggctcaaaaagcattggaagaagctgaagaaatcaagaagttgcctggcatccgtcaagaacctgttctggattcctcaaagtacactgctgctgatgtgcgcattactgatcagaagttgcgtgtctgtgacatttgtggagcatttttgagcgtttatgacagtgatcgtcgattggcagatcattttggaggaaagcttcacctaggctatatgcaaatccgtgaaaagttagcggatattaaggatgagagagacaataaaaggaaggcctctgaagaactgagaagatcaaaagagcaaagcagggatcatgatagagaaggaagtagggatcgaggaggaagccgtgaacggcaaagggaccatgatcgcaggagcagagatcgtgacaggcataatgaccgagatcgtgggtatgatcgagaacgtgacagagagagagaccagtcacgcagctatgattcaaggagtcgtcggagatcacgttcacgatcaagggagcgtgctagggactacgatcgccacagcaggtgctatgatcgatactagctgacaaatatttattgaatgattaaatctggaaatttgtcttctggtacgtattaatgcccctagagatttatgttcggagaaaaaatgatggcttctttaatttgttgtacttccgctacagaatagtaatggtagaaagaacagtttcgtactatcatgtttctgcagaagatccacattttcatgcattggttgtttcaactccatggcgtttcgattgtaaggaaatttgtggattttttttcttgttttgagttgtcgctttgaacagcaggcctaattcaatggaatttgttcggcttttgaacctgaaa

SEQ ID NO: 5949 - DNA, 1684 bp, Panax ginseng
aatatttcgccaactttggcaaaggaccaaaagaagattttcctcttccgagcctaaaacctaacgatctattgtttcccccctaaaaatcctttccattagcaaaacctaaaccctagggaagagagatggatgcacttagaaaacagctggacgtgttgatgggagcgaacagaaatggcgacgtgagagaagtgaatcgaaagtattacgatcgtgatgtttgtcgtctcttcttagttggcctttgccctcacgaactcttccaactcactaaaatggatatgggaccttgcccaaaggtgcactcgctgcagttgaggaaagaatatgaagagtccaaagtaaaaggtcaagacaattatgatagggagttggaagatgtcattgacaggcttattgttgagtgtgatagaaaaattgctagggctcttaaacgtcttactgatgaggatgctaaagcggctattgcaatatccgtttctgaagttaccatgacacctgagattcttgagttgtcaaaggagataaaggagaagctaaaagaagttgatcaacatgatctagaaggcaaaacggatatgaagatccgagctttggaagtgttggaagaactcagaactaaaagagcagacaaacagtctatgcttcttttggatgccttcaacaaagatcgagcttctttacctcagccccttccaaaccctccaccattggcacccttgcctgtagttgttcctgatgctcgcacacaggagatgataaatgagaagctaaagaaagccgaagatcttggggaacaaggtatggtcgatgaggctcagaaagcattggaagaagctgaagcactcaagaagttacctgttcttcggcaagaacctgttctggattcctccaagtacactgccgctgatgtgcgtattactgatcagaagttgcgtgtctgtgacatttgtggagcatttttgagcgtttatgacagcgaccgtcgtttggcagaccattttggaggaaaacttcatctgggctatatgcaaattcgcgaaaagctagctgatcttaaggatgagagagacaataagaggaaggcctctgaagaactgataagatcaaaagagcgtagcagggaccatgatagggaaggtagtagggatcgagatcgaggaggaagccgtgaacgggcaagggatcatgatcgtaggagcaaagatcgagatcgtggttatgatcgagatcgtgaaagagagggagaccggtaccgcagctatgattcaaggagtcgccagagatcacggtcaagggagcgtgccaggggctatgatcgccatagcaggagatatgatcgacactagctgacatttgcagttgaatggatggatctggaaatttgtcttctggtatttatcaatgtgtggggcttatgtttggagagagattatgactgctttaagttcactagtggatatttagataattcttctgtaatggtagagaaaaatagcttcttagtatcatgttttatatccacatttacgtgctttagtttgaatttcatggtgtagattctaaggaaaatttgctagtattttgtgctttcaattgctctgaatacaaaacctaatccatcgatatttaatagtgaatttctgatgcttttaatccgaggactgttaaccggcttaaa

SEQ ID NO: 5950 - DNA, 1474 bp, Trifolium pratense
  misc_feature (1121)..(1121): n is a, c, g, or t
  misc_feature (1283)..(1283): n is a, c, g, or t
acggaagcagctcgccgttctcatgggtgccaatcgcaacggcgacgtccgtgaagttaaccgcaagtattacgatcgcgatgtctgccgtctctacctcgtcggtctttgccctcacgaactcttccagttaacgaaaatggatatgggaccatgccctaaggttcactcattgcagctaagaaaagaatatgaggaagcgaaatcaaaagggattgataattacgagagggagttggaggatgttatagataagcttattggtgagtgtgataggaaaattggtagagcgcttaagcggcttgaggatgatgatgccaaagccgcaattgcaatttccgtttctgaagttactcagacacctgaagtgcttgagttggctaaagaaatcaaagaaaagttgaaagaagctgataaatatgatcttgaaggcttgtcagatatgaggattcgagctttggagattgtagaggaacttagaatcaaaagagcagacaaacagtctacgcttcttttagatgcatttaataaagatagggcatctttacctcaacctctgccaaatccaccaccgttagcacctcttcccgtagttactcccgatgctcgaacacaggagatgataaatgaaaagttgaagaaggctgaggatcttggtgagcaaggattgattgatgaggcacagaaagcattggaagaggctgaagcacttaagaagcttccttccaggcaggagccagcactggattcttcgaagtatacagctgctgatgtgcggattactgatcagaagctacgtgtgtgcgacatttgtggtgcatttttgagtgtttatgacagcaggctcttgtgccagttttacgagggataacttttgcagctaaagaattgatcgtcgattagctgatcattttggagggaaacttcatttagggtatatgcaaattcgtgagaagttggcagaacttcaagaagaaaggaacaagagccgtaagattgatcgtcttgatgacaggagatcaaaagaacggagtagggatcgtgacagggagccaagtagggactgtgaacgtggtgagagccatgagcgagggcgagacattgatcgtaggagcagagancgtgataggcaccatgatagagaccgtggatatgatcgagaccgggacagagactcatcccgctcatacgattcaagaagtcgtcggaggtcacgatctcgagagcattctagagattatgatcgtcataggcgccatgatcggtactagcagctgcaatanattttatggatgtgataagatgtgtattctaggtggacctggaaccttgtcttggacaaataattttgcattgtattgaacaatattcaatgatggatgtaacttgagcataggtgttgctaaattatggtttgatgttgctttgtagtagttaaatctaatttgtaatctggctacttgaagcagttctg

SEQ ID NO: 5951 - DNA, 1543 bp, Cirsium arvense
gcgttgctccgaaaatttccagaaaccaacaccaaaacctaaccactgcgtctttgggcggagaagggaaggattttgttgagatggatgcaataaggaagcagctagatgtattgatgggagcaaatcggaatggagatgtcagagaagtcaatcgcaagtactacgatcgtgatgtctgtcgtctcttcttagtcggtctttgccctcacgagctcttccaactcacaaaaatggatatgggaccatgcccgaaggtgcactcatttcagctgaggaaagaataccaagaagccaagtcaaaaggtcaagataactatgacagggaattggaggatgttatagacaggctcattgttgaatgtgacaggaaaattgctcgagctcttaaacgtcttagtgaggaggatgctaaagcagctattgctatctctgtgtcggaggttactcagacacctgagattcttgagctgtccaagcagataaaagagaagctgaaagaagctgatcaacatgacctggaagggaaagcagatatgaagattcgagctttggagatggttgaagaactcagaacacaaagagcagacaaacagtcaatgcttttattggacgcattcaacaaagatcgagcttctttacctcaaccacttgcaaatcctcctccattggcaccattgcctttggctactcctgatgctcgcactcaggagttgattaacgagaagctgaaaaaagcagaagatcttggcgagcaaggaatggtggatgaagcacaaaaagcgctcgaagaggctgaagcacttaaaaagctttcaatgcagttgcctcctcgtcaggaaccagttacagactcctctaagtatactgcagcagatgtccgagttactgatcagaagttacgtgtttgtgacatatgtggagcgttcttaagtgtttatgacagtgaccgccgcttagcggatcattttggaggaaagctccaccttggatatatgcaaatccgggagaagttagctgatcttcaggatgagagaaacaataaaaggaagcctattgaagatgaccgaagatcaaaaagaaagaagcagggatattgagcgggaaggaagcagagatcaggatcgaggcagtagccgtgaccgtgcaagggatcatgatcgtaggagtagagaccgtgataggcatcatgatcgtggtcgtggttatgaccgttatgatcgcgatagagaacgagatcgttctcgtagctatgattccaggagtcgccatagatcacgatctcactcaagggagcgtccaagggattatgaccgtcaaaggcgctatgatcgatactagccatgaagcggatgaaagaaggtttcttcttcttcttttctgggaacatttgttttctttttgggttgatgctttctttaactcgtgggatctaatttgatattactagaagaaaaccgctctttgtatttgtttttcttatatctggattaccgtttttatgtttgttttctagagcagctctattgtatagtagtgttgc

SEQ ID NO: 5952 - DNA, 1851 bp, Aristolochia fimbriata
tattaacgtttccttacaccgacgggagtcagtgctacgttgtccattaacctgctctttcttccccaagttttaaagttttttctcttctttctcgaagactagaactgtctggtatctccgttcttggttcggcttcagcttaatgcatgcctaaaaaaagttcaggcttcaacaatcggaaccgctcctcgagaataggcccttccgatactcttcttctccagtggtcagtcactgggaggagaaaaaccctaaccctagggacggactagttatttttcttttttttaaaggggcaataacctcgtttgtgagccagaccttgggcgacaatggatgccatgagaaagcagctggacgttctcatgggagcgaacagaaatggagacgttagggaggtcaatcgaaagtattacgaccgagacgtctgccgtctcttcttggtcggcctgtgccctcatgagctttttcagttgacgaaaatggatatgggtccatgtccaaaagtgcattcgttacagctaaggaaggaatatgaagaagccaaagcaaaaggagttcataattatgatagggagcttgaggatgtcattgataagctgataattgagtgtgatcgcaaaattcagagagctctcaaacgtctggaagatgaggatgctaaagcagctattgctatatctgtttctgaggttactcagtctcctgaagtgcttgagctgtcaaagcaaattaaggaaaaattgaaagaagctgatgcttttgatctggaaggtaagactgataataaaatccgtgctctggaagttgtggaagaacttagagcaagaagagcagacaagcagtccatgctgcttctagatgccttcaacaaagacagagcttccttacctcagccactgcctaatcctccaccattggctcctttgcctgttcttgctccgcctgatgctcgcacccaggagatgataaaagaaaagctaaaaaatgcagaggatcttggtgagcaaggattagttgatgaggcacagaaagcacttgaagaggcagaagctctgaaaaagctggctcaaagacaggaacctgtacttgatggttccaagtatactccagtcgatgtgcgcattacagatcagaaactgcgtgtttgtgatatttgtggagcattcttgagtgtatatgacagtgaccgacgtttagctgatcattttggagggaaacttcatctgggatatatgcaaattcgcgaaaaattagctgaacttcaggaggaaaggaataagagtcggaaacaagctgaagaggaaaggaggtcaaaagagcgtagtcgggaacgtgaaaggggtgctagcagggacagagagcgagatagagaagatcatggtacacgagagaaaccccgtgattataaccgtcgaagcagagactatgatcgctcttatgatcgcgatcgtggatatgatcgagatagagagaaagatcgatctcgaagttatgattcaagaagccacagaagatctcgctcccgatcaagggaatgttcaagggattatgatcgcaataggcgtcatgatcgatatgatcgacactagagcaatggcatctggatgaggtggattagaatttaggatcggtactcttaaatatttccctgagtgtttttaattgttttgttgcagctgggtgttgtgttgacaaagcccatgcttggaaacagttggtgggacatcaatccttttttcactggatgtaggttacagtgatattttgctgcgtatgtatgatagcagaagcaaatggcattatgtcaaacgcaacattgagtacccttgtactgttgtgcaagta

SEQ ID NO: 5953 - DNA, 1625 bp, Euphorbia peplus
gttagagtggtggagcaaaatcttgtgaaaggtatctcgtttttacccccaaatcaaaaccctaatccctcctcctgagtcgatcagatcagacatcgagagggtaagggatggacgcgatgaggaagcagcttgatgtgctgatgggagccaatcggaacggcgatgtgagagaagttaatcgaaagtattacgatcgtgatgtttgtcgcatgtacttggtcggcctttgccctcacgaactcttccaattgacgaaaatggatatgggtccatgtccaaaggttcattccctgcagctcagaaaagagtatgaaggggccagggctaaaggtactgataactatgatagagagcttgaggatgtcattgaccgcctcattgttgagtgtgataagaaaatcagtagagctcttaagcgtcttgaggctgatgatgccaaggctgctattgcaatttctgtttctgaggttacacagaatccagagataattgagttgtcaaagcagatcaaggaaaagctaaaagaagctgatagacatgatcttgaaggcaagacagattataagattcaaactcttgaagaggtggagaaaatgagaagtgaaagagcagagaagcagtctgcactactgttggaagccttcaacaaagatagggcatctttgcctcaaccactgccaaatccaccacctttggcacctttgcctgtgcatactcctgatccacgtacccaggaaatgataaatgagaaactgaagaaggctgaggacctaggtgagcaaggaatggtagatgaggctcagaaagcactggaagaggcggaggcacttaagaagctgcctgccaggccagatcctgctttggattcctccaagtataccgcagctgatgtgcgcattactgatcagaagttgcgtgtttgtgacatctgtggagcatttttgagtgtatatgacagtgatcgacgtttagcagatcattttggagggaagcttcacctgggctatatgcaaatccgcgaaaagctagctgagcttcaggaagagagaaacaagccccgcagagctgatcggcccgatgatcaaagaccaaaagagcgaagtagggaacgtgaaagagaaccaagcaaggatcgagatcgagcagatagccgtgacagggagagggatcatgataggaggagcagagatcgtggtgataggcatcatgatcgggaccgtggatatgatcgagaacgcgagagagattcagatcgctcacgcggttatgattcaaggagtcgccacaggtcacgctctcggtctagagaacgttcaagagattatgaccgccataggcgctatgatcggtactaggactactgtggttttagtattttcggatgaaaatttgtggttttttgccccgttagatgaatgaagtttgtggagtagaggttgaccatatgctttggtgttttcagcagagtttgactagatatgatctactatcgtaacttgtatgttcatagttagtgctgcaatttgtactgctatttttttaatatttatttcatgtttggttctatacttcaccaaaatttaattttgtgttaaaaacgcccagtttccagtgcctttgta

SEQ ID NO: 5954 - DNA, 1533 bp, Nicotiana tabacum
  misc_feature (1360)..(1360): n is a, c, g, or t
  misc_feature (1384)..(1384): n is a, c, g, or t
ggccattacggccggggaaggaggaagactgaagaaaaaaacccttccatagactgagcaactcaagcctgaacagcggcgaatttcaagcgttcatcatcaatggacgccataaggaaacaactggatgtgttaatgggagccaaccgaaacggcgacgtaacggaggtcgatcgcaagtactacgaccgtgaagtttgccgtctcttcctctccggtctttgcccccacgagctcttccaactcactaaaatggatatggggccatgccctaaggtgcactctttgcagctgagaaaagaatatgtcgaagcaaaagaaaagggtcaggataactatgacagggacttggaggatgcaattgataggctgattgttgagtgtgacaggaaaataactagagcacttaaacggcttgacgaggaggatgccaaagctgctattgccatatcagtatctgaagttactctgacaccggagattgatgagttgtcaaagcaaatcaaggagaagttgaaagaagctgatgtatatgatcttgaaggcaagacagatatgaaaattcgagctctggaagaggttgaagaactcagaactaagagagcagacaaacagtcaatgctccttttggatgcatttaacaaagatcgagcatctttacctcagccacttcagaacggtccacagttagcacccttgcctgcagctgctccagatcctcgcatacaagaaatgataaatgagaagctgaagaaagcagaagatcttggtgagcaaggaatggttgatgaagctcagaaagcattggaagaggcggaagctcttaagaagctgcctgtgaggcaagaccctggtcaggattcctcaaagtacactgcagttgatgtgcggattactgatcaaaagctccgtgtgtgcgacatctgtggagcctttttaagtgtttatgacagtgaccgtcgcttagctgatcattttggaggaaagcttcatttgggttatatgcaaatccgtgagaaattagctgaacttcaggaagaaagaaacaagaagcggaaggccatagaagaagataggagatctaaagaaagaaaaagcagggaacgtgatagagaatcaagcagggacagagttgatagccgcgaagcagggagagatcacgatcgcaggagtaaagatcgcagctatgatcgtgagcgtgacagaaatagagaccgctctcgcaactatgattcaagaagtcataggcgatcacgttcacggtcaagagaacggtctagggattatgatcgccacagacgatatgatcgttactaggtgaaagctgctgtggcatggagagctggaaaagttgtgtcgngacttgttggatgtttggtacttngtagtatccaggagacgatgccatatgtattgctgtctttatttggtcagtttttgattctgcagtgttaggtgaaatttgagattgaccttcaaaattacatgtgcgttttatgcaccagctaaattttatgacaatgcaaggttttg

SEQ ID NO: 5955 - DNA, 1453 bp, Centaurea maculosa
aagaagaaggagtttgctctccgatggatgccataaggaagcagctcgatgtgttaatgggagctaatcggaatggtgacgtcagagaagtcaatcgcaagtactacgatcgtgatgtttgccgtctcttcttagtcggcctttgccctcacgagctcttccaactcactaaaatggacatggggccatgcccgaaggtgcactcatttcagctgaggaaagaataccaagaggccaaggcaaaaggtcaagataactatgatagggaattggaggatgttatagacaggctcatcgttgaatgtgacagaaaaattgctagagctcttaaacgtctcagtgaggaggatgctaaggcagctattgctatctctgtgtcggaggttactcagacacctgaaattcttgagctgtccaagcagataaaggagaagctgaaagaagccgatcaatatgatcttgaagggaaagcagatatgaagattcgagctttggagacggttgaagaactcagaacacaaagagcagacaaacagtctatgcttttattagacgcattcaacaaagatcgagcttcgttacctcaaccgctggcaaatcctcctccattggcaccattgcctttggctactccagatgctcgcactcaggaattgattaacgagaagctgaagaaagcagaagatcttggcgagcaaggaatggttgatgaagcacaaaaagcgctcgaagaggccgaagctcttaaaaagctttcgatgcagttgcctcctcgtcaggaaccagttacagactcttctaagtatactgctgcagatgtgcgagttactgatcagaagttacgtgtttgcgacatatgtggagcattcttgagtgtttatgacagtgaccgccgattagcggatcattttggaggaaagctccaccttggctatatgcaaatccgggagaagttagctgatcttcaggaagagagaaacaataaacggaagcctgttgaagatgacagaagatcgaaagaacgaagcagggatcctgagcgtgaaggtagcagagatcgtgatcgcgcaagtagccgtgaccgtgcaagggatcatgatcgtaggagtagagaccgtgataggcatcacgaccgcggtcgtgggtatgaccgttatgatcgtgatagagaaagagaaagagaccgttctcgtagctatgattcaaggagtcgacacagatcgcgatcgcactcaagggaacgtcccagggattatgatcgtcaaaggcgctacgaccgatactagccgtgaagcggatgaaggaaggtttcttcttcttttctgggaacatctgctttctttttcttggtttgaactagcgaatctaatttgatactagaagaaacacctctgctctttgtatttgttttcttatcgagattttaccttttcttatgtttgtttttctagag

SEQ ID NO: 5956 - DNA, 1696 bp, Centaurea maculosa
  misc_feature (32)..(32): n is a, c, g, or t
  misc_feature (58)..(58): n is a, c, g, or t
  misc_feature (436)..(436): n is a, c, g, or t
  misc_feature (442)..(442): n is a, c, g, or t
  misc_feature (619)..(619): n is a, c, g, or t
  misc_feature (658)..(658): n is a, c, g, or t
  misc_feature (906)..(906): n is a, c, g, or t
gggggcgtttgtttgaaattttccccgaaacnaacacaccaaaaccctaaccactgcntcctagggcggagaaggaagggaagaagaaggagtttgctctcccatggatgccataaggaagcagctcgatgtgttaatgggagctaatcggaatggtgacgtcagagaagtcaatcgcaagtactacgatcgtgatgtttgccgtctcttcttagtcggcctttgccctcacgaactcttccaactcactaaaatggacatgggaccatgcccgaaggtgcactcatttcagctgaggaaagaataccaagaggccaaggcaaaaggtcaagataactatgatagggaattggaggatgttatagacaggctcatcgttgaatgtgacagaaaaattgctagagctcttaaacgtctcagtgaggaggatgctaangcagcnattgctatctctgtgtcggaggttactcagacacctgaaattcttgagctgtccaagcagataaaggagaagctgaaagaagccgatcaatatgatcttgaagggaaagcagatatgaagattcgagctttggagacggttgaagaactcagaacacaaagagcagacaaacagtcnatgcttttattagacgcattcaacaaagatcgagcttcnttacctcaaccgctggcaaatcctcctccattggcaccattgcctttggctactccagatgctcgcactcaggagttgattaacgagaagctgaagaaagcagaagatcttggcgagcaaggaatggttgatgaagcacaaaaagcgctcgaagaggccgaagctcttaaaaagctttcgatgcagttgcctcctcgtcaggaaccagttacagactcttctaagtatactgctgcagatgtgcgagntactgatcagaagttacgtgtttgcgacatatgtggagcattcttgagtgtttatgacagtgaccgccgattagcggatcattttggaggaaagctccaccttggctatatgcaaatacgggagaagttagctgatcttcaggaagagagaaacaataaacggaagcctgttgaagatgacagaagatcgaaagaacgaagcagggatcctgagcgtgaaggtagcagagatcgtgatcgcgcaagtagccgtgaccgtgcaagggatcatgatcgtaggagtagagaccgtgataggcatcacgaccgcggtcgtgggtatgaccgttatgatcgtgatagagaaagagaaagagaccgttctcgtagctatgattcaaggagtcgacacagatcgcgatcgcactcaagggaacgtcccagggattatgatcgtcaaaggcgctacgaccgatactagccgtgaagcggatgaaggaaggtttcttcttcttttctgggaacatttgctttcttttttcggtttgaactagcgaatctaatttgatactagaagaaacacctctgctctttgtatttgtttttcttatcgagattttacccttttttttatgtttgtttttctagagcagctctatgtatagtagtgttgcccatcttcttcaccatgttcatagatttttaagtgctggattgtggcacccaaaatttactatcgtcttaatcgctgtaagtctacgcttttcttgacggatttctggtttcgattgtcaaattattttgacatcta

SEQ ID NO: 5957 - DNA, 1666 bp, Cirsium arvense
ccaaccactgcgtcctttgggcggagaagaagaaagaagaaggagtttgctctccgatggatgccataaggaagcagctcgatgtgttaatgggagctaatcggaatggtgacgtcagagaagtcaatcgcaagtactacgatcgtgatgtttgccgtctcttcttagtcggcctttgccctcacgaactcttccaactcactaaaatggacatggggccatgcccgaaggtgcactcatttcagctgaggaaagaataccaagaggccaaggcaaaaggtcaagataactatgatagggaactggaggatgttatagacaggctcattgttgaatgtgacagaaaaattgctagagctcttaaacgtctcagtgaggaggatgctaaggcagctattgctatctctgtgtcggaggttactcagacacctgaaattcttgagctgtccaagcagataaaggagaagctgaaagaagccgatcaatatgatcttgaagggaaagcagatatgaagattcgagctttggagacggttgaagaactcagaacacaaagagcagacaaacagtctatgcttttattagacgcattcaacaaagatcgagcttcgttacctcaaccgctggcaaatcctcctccattggcaccattgcctttggctactccagatgctcgcactcaggagttgattaacgagaagctgaagaaagcagaagatcttggcgagcaaggaatggttgatgaagcacaaaaagcgctcgaagaggccgaagctcttaaaaagctttcgatgcagttgcctcctcgtcaggaaccagttacagactcttctaagtatactgctgcagatgtgcgagttactgatcagaagttacgtgtttgcgacatatgtggagcattcttgagtgtttatgacagtgaccgccgattagcggatcattttggaggaaagctccaccttggctatatgcaaatccgggagaagttagctgatcttcaggaagagagaaataataaacggaagcctattgaagatgacagaagatcgaaagaacgaagcagggatcctgagcgtgaaggtagcagagatcgtgatcgcgcaagtagccgtgaccgtgcaagggatcatgatcgtaggagtagagaccgtgataggcatcacgaccgcggtcgtgggtatgaccgttatgatcgtgatagagaaagagaaagagaccgttctcgtagctatgattcaaggagtcgacacagatcgcgatcgcactcaagggaacgtcccagggattatgatcgtcaaaggcgctacgaccgatactagccgtgaagcggatgaaggaaggtttcttcttcttttctgggaacatctgctttctttttctggtttgaactagcgaatctaatttgatactagaagaaacacctctgctctttgtatttgttttcttatcgagattttaccttttcttatgtttgtttttctagagcagctctatgtatagtagtgttgcccatcttcttcaccatgttcagagcttttaagtgctggattgtggcacccaaaatttactatcgtcttaatcgctgtaagtctacgcttttcttgacggatttctggtttcgattgtcaaattatttgaacatcaaaaagaaaaagtaccgactgcg

SEQ ID NO: 5958 - DNA, 1219 bp, Panax ginseng
ggacgtgttgatgggagcgaacagaaatggcgacgtgagagaagtgaatcgaaagtattacgatcgtgatgtttgtcgtctcttcttagttggcctttgccctcacgaactcttccaactcactaaaatggatatgggaccttgcccaaaggtgcactcgctgcagttgaggaaagaatatgaagagtccaaagtaaaaggtcaagacaattatgatagggagttggaagatgtcattgacaggcttattgttgagtgtgatagaaaaattgctagggctcttaaacgtcttactgatgaggatgctaaagcggctattgcaatatccgtttctgaagttaccatgacacctgatattcttgagttgtcaaaggagataaaggagaagctaaaagaagttgatcaacatgatctagaaggcaaaatggatatgaagatccgagctttggaagtgttggaagaactcagaactaaaagagcagacaaacagtctatgcttcttttggatgccttcaacaaagatcgagcttctttacctcagccccttccaaacccaccaccattggcacccttgcctgtagttgttcctgatgctcgcacacaggagatgataaatgagaagctgaagaaagccgaagatcttggggaacaaggtatggttgatgaggctcagaaagcattggaagaagctgaagcactcaagaagttacctgttcttcggcaagaacctgttctggattcctccaagtacactgccgctgatgtgcgtattactgatcagaagttgcgtgtctgtgacatttgtggagcatttttgagcgtttatgacagcgaccgtcgtttggcagaccattttggaggaaaacttcatctgggctatatgcaaattcgcgaaaagctagctgatcttaaggatgagagagacaataagaggaaggcctctgaagaactgataagatcaaaagagcgtagcagggaccatgatagggaaggtagtagggatcgagatcgaggaggaagccgtgaacgggcaagggatcatgatcgtaggagcaaagatcgagatcgtggttatgatcgagatcgtgaaagagagggagaccggtcccgcagctatgattcaaggagtcgtcggagatcacgttcacggtcaagggagcgtgctaggggctatgatcgccatagcaggagatatgatcgatactagctgacatttgca

SEQ ID NO: 5959 - DNA, 1685 bp, Euonymus alatus
aagtcgtcaaatctgctcttaaccaacccagcccagtaaaagaagcaaaccctaggagtctagaactagaaatacattctctctctgcgactgtagagactgagctcggaacgggacgggagagtaagctctagacagaaagagcagagatggacgcgatgaggaagcagctcgatgttcttatgggggcaaaccgcaacggggatgtacgggaggtgaatcgcaagtactacgatcgggacgtatgtcgtctttacttggctggcctctgccctcacgagctttttcagttaacgaaaatggatatgggtccatgccctaaagttcattccttgcagctgagaaaggaatatgaagaagccagggcaaagggtcttgacaactatgacagggatttggaggatgttattgatagacttattgttgagtgtgttaagaaaattggtagagctcttaagcgtctcgaggatgacgatgcaaaagctgcaattgcaatttcagtttctgaggttactcagactcctgaggttcttgaattatccaagcagatcaaggagaaattaaaacaagctgatcagtatgaccttgaaggcaagatggatcttaaggttcgagctctggaaattatagatgaacttagaaccaaaagggcagacaaacagtctatactccttttggatgccttcaataaagatagggcatctttgcctcaaccattggcaaacgcgccacagttggcaccattgccagtacctgctcctgatgctcatacccaggaaatgataaatgagaagctgaagaaggctgaggatctcggtgagaaggggatggtagatgaggctcagaaagcattggaagaggcagaggcgcttaagaagctaccctccaggcaggaacctcctctggattcctctaagtatactgctgctgatgttcgcattactgatcaaaagctgcgggtttgtgacatatgtggagcgtttttgagtgtttatgacagtgatcgccgtttagcagatcattttggagggaagcttcatttagggtacattcaaattcgtgaaaaactttctgagcttcaggaagagcgaaacaagagccgcaaagttgatcagcatgatgatagaagatcaaaggagagaagtagagaacgtgagagcgaaccaagtaaggatcgcgatcgaggagatagtcgtgaccgggtgagagataatgatcgcaagagtagagatcgtgacaggcgttatgatcatgacagagattatgagcggcctcgaaattacgattcaagaagtcgtcgcaggtcacgctcccggtctagggaacgctcaagagattatgatcgccacaggcgctatgatcgtcatcactagatggggactgttgaagttgaacagatgggcaaaaagaaaaatgtttttattcaggtcagtgaagacagtcgtgggatggtagtttttaaatattggctttggagtttggtgcctgtataacctgattatggataatttttcaactgatgtgtaggttggtttttcttgagttgtatgtttggcaggtatgctttttaaattcaacacactgaatgatgtatcttatcatatgtagttgtgcacatttctgagagagatggactaatcctttggaccaagtttggtagttttctaaataaacgcagttgaaat

SEQ ID NO: 5960 - DNA, 1916 bp, Lactuca sativa
gatggggctctgccttggttcagatttctcctgaaaaccaaaccaccaaaaccctaagcactgcgtgcttgaaattccttcagatggatgcaataagaaagcagctagatgtgctgatgggggcaaatcggaatggagatgttagagaagtcaatcggaagtactacgatcgtgatgtctgccgtcttttcttggtcggcctttgccctcatgaactctttcaactcactaaaatggacatgggaccatgcccgaaggtgcactcatttcagctaaggaaagaataccaagaagctaaggcaaaaggtcaagataattatgatagagaattggaggatgttatagacagactcattgttgaatgtgacagaaaaattgccagagctcttaaacgtcttagtgaagaggatgctaaagcagctattgctatttctgtgtcagaggttacacagacacctgagatttttgagttgtcaaagcaaataaaggagaagctaaaagaagctgatcaaaatgatctggaaggaaaagcagatatgaagattcgagctcttgagatggttgaagaacttagaactcaaagagcagataaacagtcaatgctattattagatgcattcaacaaagatcgagcttctttacctcaacctcttccaaatcctccaccattagcaccattgcctgttgctactcctgatgccagaacccaagaattaatcaatgaaaagctgaaaaaagcagaagatcttggtgagcaaggaatggttgatgaagcacaaaaagcactggaagaagcagaagcactcaaaaagctttcaatgcatttacctcctcgtcaagaacctgttacagactcctctaagtatactgctgcagatgtgcgagttactgatcagaagttacgtgtatgtgacatatgtggagcgtttttaagtgtttatgacagtgatcgccgcctagcagatcattttggtggaaagctccaccttggctacatgcaaatccgtgaaaagttagctgatcttcaggaagagagaaacaataaaaggaaggcgcctgaagaagatagaagatcaaaagaacgaatcagggaagtggagcgggaaggaagcagagatagagatcgtgaccgagcaggtagcagagagcgtgcacgggaccacgatcgaaggagccgcgaccgccataataatgaccgtgaccgtgaacgtgatcgtgggtatgaccgtgatcggtcccgtagctatgactcgaggagtcgacatagatccaggtcacgctcaagggaacgcgctcgggattatgatcgtcaaaggcgttatgatcgacactagccatgaagtaaagcagatgagaaagaaggtttctttatattggttggtggtgttttaacctcaaatcaaatttacaagtgcttctaatttggtactaaaaaaagagacttcaatttgtatttgtttttgtttttggatttccttattatgtttcctagcgcagcagctctatgtatattagtgttgcatatttggagttataagcgggggattgattgtggcataacccaaaattcctaaacctttgtattcctgtaactttagtttatgctccagagttacttttcatgggttgttgttttgaacatcactttgatggagtaggagtgtaggacaattacaaaatggtctttcaacttatacaagaattgcaaaatggaaacatcactttcccctgttaaaatctgataacgctgaaaggacagattagtaagtttgatgctgtcagtcttatcaaacgccacacacattcgataaaattttgttgattcatctccaataattttcttttgtgtgccaaatgctaaacttatgtgtgacttgtctgcaatgtgaaatctcaaatttttacgagttgtggcg

SEQ ID NO: 5961 - DNA, 1567 bp, Nicotiana benthamiana
ccaatttgcgaaaccctacaaaacaagcgcactggagaactgaaaagcttccaaataggaagactgaaggaaaaaaccctttccatagacggagcaactcaagcctgaatagcggcgaatttcaagcgttcatcatcaatggacgccataaggaagcaactggatgtgttaatgggagccaaccgaaacggcgatgtaacggaggtcgatcgcaagtactacgaccgtgaagtttgccgtctctttctctccggtctctgccctcacgaactcttccaactcactaaaatggatatggggccatgccctaaggtgcactctttgcagctgagaaaagaatatgtcgaagcaaaagaaaagggtcaggataactatgacagggacttggaggatgcaattgataggctgattgttgagtgtgacaggaaaataactagagcccttaaacggcttgacgaggaggatgccaaagctgctattgccatatcagtatctgaagttactctgacaccggagattgatgagttgtcaaagcaaatcaaggagaagttgaaagaagctgatgtatatgaccttgaaggcaagacagatatgaaaattcgagctctggaagaggttgaagaactcagaactaagagagcagacaaacagtcaatgctccttttggatgcatttaacaaagatcgagcatctttaccacagccacttcagaatggtccacagttagcacccttgcctgcagctgctccagatcctcgcatacaagaaatgataaatgagaagctgaagaaagcagaagatctaggtgagcaaggaatggttgatgaagctcagaaagcattggaagaggcggaaactcttaagaagctgcctgtgaggcaagaccctggtcaagattcctcaaagtacactgcagttgatgtgcggattactgatcaaaagctccgtgtgtgcgacatctgtggagcttttttaagtgtttatgacagtgaccgccgcttagctgatcattttggaggaaagcttcatttgggttatatgcaaatccgtgagaaattagctgaacttcaggaagaaagaaacaagaagcggaaggccatagaagaagatagcagatctaaagaaagaaaaagcagggaacgtgatagagaatcaagcagggacagagttgatagccgcgaagcagggagagatcacgatcgcaggagtaaagatcgcagctatgatcgtgagcgtgacagaaatagagattggtctcgcaactatgattcaagaagccataggagatcacgttcacggtcaagagaacggtcaagggattatgaccgccacaggcgatatgatcgctactaggtgaaagctgctgtggcatggagagctggaaaggttgtgccgcgactttttggatgtttggtactttgtagtatccaggagacgatgccatatgtattgctgtctttatttggtcagttttggattctgcagtgttaggtgaaatttgagattgaccttcaacattacatgtgcgttttatgcatcagctaaattttatggcaacgcaaggttt

SEQ ID NO: 5962 - DNA, 1929 bp, Populus trichocarpa
tctagagacaaaatcacataatataccaaaaagcagcagcagtaatttaaccaaggatagataagtaagaaatcaaacccaagccctagaggtcccgagtctctccctcgatctcaacaaacacagggagagaagaagcagtgcttgctgctttgtttgtttgtctgtctcagtggagattggagaaaccagagatggatgcgatgaggaaacagctggatgtgctcatgggagcaaatcgaaacggcgacgtaagagaggtcaatcgcaagtactacgatcgtgatgtttgtcgcttgtacttggttggcctttgccctcacgagcttttccaactaacgaaaatggatatgggaccatgcccgaaagtccattcactgcagctgaggaaagaatatgaagaatcgacggggaaaggtgttgataactatgagatagagttagagaatgttatcgataagctcattgtcgaatgcgataagaaaatcggtagagcacttaagcgtcttgaagatgaagacgccaaggctgctattgcgatttcagtcactgaggttacacagaatgctgaggtaagtgagttatcgaagctgattaaagagaagctgaaagaagttgacaaatatgatctcgaaggcaaaacagattttaaaattcaagttttggaagaagtggaaaaacttagaactgaaagagcagagaagcagtctgcactgcttttggaggccttcaataaagacagggcttctttacctcaacccatgctgacccccccaccaccaccaccacccatgccattacctactcctgatcctcgcacccaagagatgataaatgagaagctgaagaaagctgaggatcttggtgagcaaggaatggtagatgaagctcaaaaagcattggaagaggctgaagcacttaagaagcttcctgccaggcaggaaccttctgcagattcctccaagtatactgctgctgatgtgcgcattactgatcagaagctacgtgtttgtgacatttgtggagcttttctaagcgtatatgacagtgaccgacgtcttgcagatcattttggagggaagcttcatttaggctatatgcaaattcgtgagaaactcactgagcttcaggaaaacaagcaacgcaaggttgaccggcacgatgatcagagatcgagagaacgaagtagagatcgcgatagagaaccaagcagggatcgagatcggggagatagccgtgaccgggggagagagtatgatcgaaaaagcagagaccgtgacaggtataatgaccgggatcgtggatatgatcgtgaacgtgacagaggttcagagcgctcccgcaattatgattcaagaagtcgtcgcaggtcacgttctcggtctagggaacattctagggattatgatcaccacaggcgctttgatcggtactaagattgtgttgctgagcagttggctatggaaacttgtgtttgttgcctaggtcagtaaacttgtggttttgaagtttatgtatgattttctctgtctttctgatacttttagtggagttcgacagttatctcctaatatcgtggataccaactacttcgtagattttcttgacttctatttttaagaggtatgagttgaactgttttccaagtttttatgtttctagttatgcatatgctacatgaatttcaaagctgctccctcttcattattgtcattgatccgtaatcaaattggtcatctacgtcaattggctcaccattttagctttatatttgttcatgtatggattattacttggagagaaggttcagtatgaatgtgcgttgtgtgcaatctcaaaagtacatcgttgttgtgtgaatatataatccttcgatttcgttcaacagtgaatataactgtccttgggggtgatgcatgttctatctcc

SEQ ID NO: 5963 - DNA, 1662 bp, Elaeis guineensis
ctcgtttgcctctcttatcggtctctttgttaatctcctcccctctttctactgagcgaccgtcggaaaaaccctaaccctagggatggacgcgatcaggaagcagctcgacgtcctcatgggggctaaccgaaacggcgacgttatggaggtgaaacgcaagtactacgaccgcgacgtctgccgtctctacttggctggcctttgcccccacgacctcttccagctcacgaaaatggatatgggtccttgtccaaaggtgcattctctacagctgaggaaagagtatgaagaagccaaagcaaagggaattcataattttgatagagaactggaggatatgatagaaaggctaattgtcgaatgtgaaaggaaaatccagagagcccttaagcgtctagaggaagaggatgccaaagcagctattgcaatatccgtatcagaagttacccagacacctgaggtcatggagttgtcaaagcaaatcaaggagaaattgaaagaagctgatgcttttgatttggaaggaaaaactgacagtaaaattcgggctctggaggaggttgaagagcttagaacaaaaagagctgataagcagtctatgctgcttctggatgccttcaacaaagaccgggcttcattgccacaaccacttcagaatccctctcaattatcttcaacacccgcacctattcctccagatccccgaacacaagaaatgataaatgaaaaacttagaaaggcagaagagcttggtgagaagggaatggtagatgaagctcagaaagctttggaagaggcagaagctctgaaaaagttgggtgcacgccaggagccagtcttagattcttcaaagtatactgctgcagatgtgcgaattactgatcagaagttacgtgtatgtgacatatgtggagcattcttgagtgtctatgatagtgatcgtcgtttggctgatcattttggaggaaagcttcacttgggctatatgcaaattcgtgagaagatagcagaacttcaggaagagagaaataagaggcgaaagtcggagcgaactgaatatgatagcaggtcaagagaacgaagtcaggaccgtgatagagcagcaagtagggatcgggacagagatagagaggaccgaggtgatagtcgtgacaggggaagggattatgatcgtagaagcagagactatgatcgccattatgatagagatcgaggatatgatcgcgaccgagagagagaatcagatcgatctcgcagttatgattcaaggagccggcgaaggtcacgttctcgttcaaaggaacgctctagagattatgatcggcacaggcgtcatgatcgatacgaccgatactgaacttttatttcaggatggaagatatgaagtgttgaggtctgtgtgcttaagctctatggctggtgtcacagtgtggtttcgtgcctgtggattcagttcacctgaatacagagtccttttatctggatttccctggtggttgattccagcacttgtgaaggaatttataagcctgtctaatagaatgaaaaccttgttaggtcgtttaactgcttttggaagtactcttgtgaaacgtaaaagatagatgctactctgttggaaaaaatgcgttgactggtaggttgtgtttggttgctttc

SEQ ID NO: 5964 - DNA, 1599 bp, Elaeis guineensis
gaccacctggaaaaccctaaccctagagatggacgcgatcagaaagcagcttgacgtcctcatgggggccaaccggaacggcgacgtcagggaggtgaatcgcaagtactacgatcgcgacgtctgccgcctcttcttggccggcctttgcccccacgacctcttccagctcacgaaaatggacatgggtccttgtccaaaggtgcactctttacagctgaggaaagaatatgaagaagccaaagcaaagggaattcataattttgatagagaactggaggatttgatagaaaggctgattgttgaatgcgaaaggaaaatccaaagagcccttaagcgcctggaggatgaggatgccaaagctgctattgcaatatctgtatcagaggttacccagacagctgaggtcatggagttgtcaaagcaaatcaaggagaaattgaaagaagttgatgcttttgatttggagggaaaaacggacagtaaaatccgggctctggaggagcttgaagagcttaggacaaaaagagctgataagcaggcgatgcttcttcttgatgccttcaataaagaccgagcttccttgccccaaccacttcagaatcttcctcaatcgtcatcgacgccagtacttgttcctccagatccccgaacacaagaaatgataaatgaaaaacttaagaaggcagaagaactgggtgagaagggaatggtagatgaagctcagaaagctttggaagaggcagaagctcttaaaaagttgggtgcacgccaggagccaggcttagattcttcaaagtatactgctgcagatgtgcgaattactgatcagaagttgcgtgtatgtgacatatgtggtgcatttttgagtgtctatgacagtgatcgtcgtttggctgatcattttggaggaaagcttcatttgggttatatgcaaattcgtgagaagttagcagaactgcaggaagagagaaataagaggcgaaagttggaccgctctgaatatgatagaaggtcaagagaacgaagtcaggactgtgacagggcagcaagtagggatcgagatagagatagagatgaccgaggtgataatcgtgacaggggaagggactatgatcgtaggagcagagactatgatcgtcattatgatagagatcgaggatatgatcgcgaacgagatagagaatcggatcgatctcgcagtcatgattcaaggagccgacgaaggtcacgttctcattcaagggaacgctctagagattatgatcggcacaggcatcatgaccgatatgatcgatactgacgttttatttcaggatggaagacatgaaacagatatgagacagaggtctctatgctaaagttatggctgttgtcgcacgtgtagtttcatgtctgacaattcagttcacctgaaacaaagtccttttctgtggatttcctgggtgggtggttccagtacttggtgaaggatgatgcctaattagtagatgagaatcttgtgtagtttaactaattttaaaaatactatcctatggaacttaaaagattgatgctacttttggaaaaatgctgtggacagactctgtttcggttgcc

SEQ ID NO: 5965 - DNA, 1775 bp, Solanum lycopersicum
gttttttaattaatttaaagttgataaatttaaaatgaaaattaaaaaggaccaatttggcaaaccctataaaaaacgctgtgagaagtgaaaaagcttcaaaagagttgagaggaaaaaaacccttacacagatagagagcaaacctaagcttgaactcagcagcgaattttaagcgttcatcgtcaatggacgccattaggaagcaactggatgtgttaatgggagctaaccggaacggcgatgtgacggaggttgatcggaagtactacgaccgtgaagtttgccgtctttatctctccggtctctgccctcacgaactctttcagctcactaaaatggatatgggggcatgccctaaggtgcattcgttgcctctaagaaaagaatatgaagaagcaaaggcaaaaggtcaggataactatgacagggacttggaggatttaatagacaggctgattgttgagtgtgacaggaaaataactagagcccttaaaaggcttgatgaggaggatgccaaagctgctattgccatatcagtatctgaagttaccctgactccggagattgatgagttgtcaaagcaaattaaagagaagctgaaagaagctgacatacatgatcttgaaggtaagacagatatgaaaattcgagctttggaagaagttgaagaacttcgaactaagagagcagacaaacagtcaatgcttcttttggatgcattcaacaaggatcgagcatctttgccgcagccacttcagaatgctccacagttggcacccttgcctgcatctactccagatcctcgcatacaggaaatgataaatgagaaactgaagaaagcagaagatcttggtgaacaaggaatggttgatgaagctcagaaagcattggaagaggcggaagctcttaagaagctacctgtgaggcaagaacctgttcaggattcctcaaagtacactgcagttgatgtgcggattactgatcagaagctccgtgtatgcgatatttgtggagctttcttaagtgtttatgacagtgatcgtcgcttagctgatcattttggaggaaagcttcatttgggatatatgcaaatccgggagaaattagctgaacttcaggaagaaagaaacaagaagcgcaaggcaatagaagaagataggagatctaaagaaaggaaaagcagggaacgcgagagagaatcaagcagggatagagttgataaccgtgatcatgatcgcaggagtaaagatcgcagctatgatcgtgagcgtgacagaaacagagaccgctctcggaactatgattcaaggagtcacaggagatcacgttcacggtcaagagaaaggtcaagggattatgatcgccacaggcgtcacgatcgctactaggtgaaagttgctgtggcatgaggagttgaaatcttgtgtcttaacttggtggatgtttggtacttggtagtatctaggagctgatgtcatatatatatactgctgtttttatttggtcgtttttggattatgaattggttaggggggtgaagtttggtatttgattatcaaaatgacatttttttattgtaccagcctttgagatttctcctcttgtggagacaataacccatttaaaaattcttaggcttgttttcgccatcatgggtgatttgtttgtggaagattggtgtcgttgatttgtaagttttaatgctcgatttgttagacatttcaaatgagagttaactctcttttttaaaagaaattggttcatgaagttaa

SEQ ID NO: 5966 - DNA, 1676 bp, Solanum lycopersicum
ttcaaaagagttgagaggaaaaaaacccttacatagatagagagcaaacctaagcttgaactcagcagcgaattttaagcgttcatcgtcaatggacgccataaggaagcaactggatgtgttaatgggagctaaccggaacggcgatgtgacggaggttgatcggaagtactacgaccgtgaagtttgccgtctttatctctccggtctctgccctcacgaactctttcagctcactaaaatggatatgggggcatgccctaaggtgcattcgttgcctctaagaaaagaatatgaagaagcaaaggcaaaaggtcaggataactatgacagggacttggaggatttaatagacaggctgattgttgagtgtgacaggaaaataactagagcccttaaaaggcttgatgaggaggatgccaaagctgctattgccatatcagtatctgaagttaccctgactccggagattgatgagttgtcaaagcaaattaaagagaagctgaaagaagctgacatacatgatcttgaaggtaagacagatatgaaaattcgagctttggaagaagttgaagaacttcgaactaagagagcagacaaacagtcaatgcttcttttggatgcattcaacaaggatcgagcatctttgccgcagccacttcagaatgctccacagttggcacccttgcctgcatctactccagatcctcgcatacaggaaatgataaatgagaaactgaagaaagcagaagatcttggtgaacaaggaatggttgatgaagctcagaaagcattggaagaggcggaagctcttaagaagctacctgtgaggcaagaacctgttcaggattcctcaaagtacactgcagttgatgtgcggattactgatcagaagctccgtgtatgcgatatttgtggagctttcttaagtgtttatgacagtgatcgtcgcttagctgatcattttggaggaaagcttcatttgggatatatgcaaatccgggagaaattagctgaacttcaggaagaaagaaacaagaagcgcaaggcaatagaagaagataggagatctaaagaaaggaaaagcagggaacgcgagagagaatcaagcagggatagagttgataaccgtgatcatgatcgcaggagtaaagatcgcagctatgatcgtgagcgtgacagaaacagagaccgctctcggaactatgattcaaggagtcacaggagatcacgttcacggtcaagagaaaggtcaagggattatgatcgccacaggcgtcacgatcgctactaggtgaaagttgctgtggcatgaggagttgaaatcttgtgtcttaacttggtggatgtttggtacttggtagtatctaggagctgatgtcatatatatatactgctgtttttatttggtcgtttttggattatgaattggttaggggggtgaagtttggtatttgattatcaaaatgacatttttttattgtaccagcctttgagatttctcctcttgtggagacaataacccatttaaaaattcttaggcttgttttcgccatcatgggtgatttgtttgtggaagattggtgtcgttgatttgtaagttttaatgctcgatttgttagacatttcaaatgagagttaactctcttttttaaaagaaattggttcatgaagtt

SEQ ID NO: 5967 - DNA, 1564 bp, Chenopodium quinoa
ctggaagagagagaaaatggatgcgattcggaagcaattagatgtgttaatgggtgctaatcgtaatggagatgttactgaagttaatcgcaagtatttcgatcgagatgtttgccgtctctttttgtctggtctttgtcctcacgaacttttccagttaacgaaaatggatatggggccatgtccaaaggtgcattcgttgcaattacggaaagaatatgaagatgcaaaggccaagggtgttgataactacgacagggatttagaggatgtcatagacaggctcattgtagaatgtgacagaaaaattactagagctctcaagcgtcttgcagatgaggatgctaaagctgctattgcaatttctgtgtctgatgttacccagacagaagagatcatagagttgtccaagcagatcaaagagaagttgaaagaagctgaccagtcggatcttgaaggcaaaacagatcttaaaattcgagctttggaagaagttgaagaattaaggacgtcaagagctgataaacagtccatgcttcttttggatgctttcaacaaagacagagcctctctaccacagccgcttcccaatcctcctccattggctcctttacctatgcttgctcctgatgctcgtactcaagaattgataaacgagaaactgaagaaagcagaggatctaggtgagcaagggatggttgacgaagcacagaaagcattagaagaagctgaagcattaaagaggcttgcgccaaggccggacccctcagcagatccagcaaagtatactgccgctgatgttcgcattactgatcagaagctacgtgtctgtgatatttgtggagcattcttgagtgtttatgatagtgatcgtcgtttagcagatcattttgggggaaagcttcatttgggatacatgcaaattcgtgagaaattagctgagcttcaggaagaaaagaacaagaagcgcaaggttcatgaagaagatagaaggtccagagagcgcagccgtgaagtagaacgtgcacccagtaaggacagggaaagaggtgatagtcagcaaagggattatgaccggagaagcagggaccgtgataggcacagtgacagggatcgtggttatgaccgtgaacgtgaaagagatagggagcgatcccgcagtcatgattcaagaagtcgccgaaggtctcgttcacggtccagagaacgttccagggattacggccgtgactatgatcgtagcaggcgtcatgaccgagatcgatactagagcttcatgcactgcattctcatcatgaacaagtttactcttgctgcgtacaactatgttgtttttctttccatcttttttctttgagacaaagtactcgggagtattcaggttgtggactttgcgtgtctttctcaggatggtttgtcgaaagaatgagatgcttcttttgttaatcttagtaagagtacggtaattttcccgtgtaatagcttaggatgtatgaaaagaaaatcttggttatgtttagatgggatactctgcttaacctctcctttgtgacttatttttcat

SEQ ID NO: 5968 - DNA, 1443 bp, Flaveria ramosissima
tctccgatagacccaaacattccacgcaccaccggccggaccctcggttcaccgctcaccttaacctaactcatacacacatcgcccgcttgggttccaaatcccccaacgataaccgaacatcaaaacctaaccaccggagaagacaaccattccgtacaaatggatgcaatacgaaagcagttagatgtgttaatgggagccaatcgtaacggcgacgtcacagaagtcaatcgtaagtactacgatcgtgatgtctgtcgtctgttcttagtcggcctttgtccgcacgaactgtttcaactcactaaaatggacatgggaccatgcccgaagatccactcgtttcagctgaggaaagaataccaagaagcaaagtcaaaaggtgaagataattatgatagagaattggaggatgttatagacagactcattgttgaatgtgaccgaaaaattgcaagagctcttaaacgtcttagtgaggaggatgctaaggcagctattgctatctctgtgtcagaagttacccagacacctgagattcttgagttgtcaaagcagataaaggagaagctgaaagaagctgatcaatatgaccttgaaggaaaagcagatatgaaaattcgaactctagagatgattgaagaactcagaactcaaagagcagacaaacagtcaatgcttttattagatgcatttaacaaagatcgagcttctttaccttcacctcttccgaaccctccaccattggcgcccttgcctgtgcctaatcctgatgctcgcactcaagagttgattaacgagaagctgaagaaagcagaagatcttggcgagcaagggatgttggacgaagcacaaaaagcacttgaagaggctgaagcacttaaaaagctttcaatacacttgcctcctcgtccagaacctgttacagactcctctaagtatactgctgcagatgtgcgagttactgatcagaagttacgtgtctgtgacatttgtggagcctttttaagtgtttacgacagtgaccgccgcctagcggatcattttggaggaaagcttcaccttggctatatgcaaatccgtgagaagttggctgatcttttggaagagagaaataatagaaggaaggctccagaagatgacagaagatccaaagaacgcagcaaggatcttgaacgagagggtagtagagaccgggaccgagccagtagccgtgaccgtgaccgtacacgtgatagtgaccgtaggagccgagaccgtgataggcatcatgaccgtggtcgtggttatgaccgctatgaccgagatagagaaagagatcgtgattcaaggagccggcatagatcacggtcgcggtcaagggaccgtgtcagggattatgatcgaccaaggcgttatgaccggtactaatgatcaagcatatgaaataaggttttattt

SEQ ID NO: 5969 - DNA, 1431 bp, Helianthus annuus
gagatccattttataaccttgattacatttcgaagttcggccaacgaactcaagacttccacaccaaataacaaatccagcaagatctacctttttagttgatttaccgtcttcaaattcccccaaaaacagaacaccaaaaccctaagcattgcgagagggtgttgagatggatgcaatccgaaagcagctggatgtgttgatgggagccaatcggaacggagacgttaccgaagtcaatcggaagtactacgatcgtgacgtctgtcgtctcttcttggtcggcctttgcccgcatgaactctttcaacttactaaaatggacatgggaccatgcccaaaggtgcactcatttcagctgaggaaagaataccaagaagccaaggcaaaaggtcaagataattatgaaagggaattggaggatgttatagacagactcattgttgaatgcgacagaaaaattgcaagagctcttaaacggcttagtgaggaggatgctaaagcagctattgctatctctgtgtcagaagttactcagacacctgagattcttgagttgtcaaagcagataaaggagaaactgaaagaagctgatcagtatgacctggaaggaaaagtagatatgaagattcgagctatggagatggttgaagaactcagaactcaaagagcagacaaacagtcaatgcttttattagatgcgtttaacaaagatcgagcttctttaccacaacctcttccaaatcctccaccattggcaccattgcccgtggctaatcctgatgcccgcactcaggagttgattaatgagaagctgaaaaaagcagaagatcttggtgagcaaggaatgttggatgaagcacaaaaagcactggaagaggctgaagcgcttaaaaagctttcaatgcactttcctcctcgtcaggaacctgtaacagactcctctaagtatactgctgcagatgtgcgagttactgatcagaagttgcgtgtttgtgacatttgtggagccttcttaagtgtttatgacagtgaccgtcgcttagctgatcattttggtggaaagctacaccttggctatatgcaaatccgtgagaagttagctgatcttctggaagagagaaccaataaaaggaaggttccggaagatgacagaagatcgaaagaacgaagcaaagatcttgaaagggaaggtagcagagaccgggtccgagctagtagccgtgaccgtgatcgtgtgcgcgatagtgaccgtaggagccgagaccgtgataggcatcaggatcgtgatcgtggttatgatcgctatgaccgtgatagagaaagggaccgtgattcaaggagccggcataggtcgcgatcaagggaccgtgttagggattatgatcgaccaaggcgttatgaccggtactagcaatgaagtggataaaa

SEQ ID NO: 5970 - DNA, 1263 bp, Ambrosia trifida
agatggatgcaatcagaaagcagctggatgtgttgatgggagcgaatcgtaacggagacgtgacggaagtgaatcgaaagtactacgaccgtgacgtctgccgtctgttcttggtcggcctttgcccgcatgaactctttcaactcaccaaaatggacatgggaccatgcccaaaggtgcactcatttcagctgaggaaagaataccaagaagcgaagtcaaaaggtcaagacaattatgacagggaattggaggatgtcatagacagactcattgttgaatgtgacagaaaaattgcaagagctcttaagcgtcttagtgacgaggatgctaaagcagctattgctatctctgtgtcagaggttactcagacgcctgagattcatgaattgtcgaagcagataaaggagaagctgaaagaagctgatcaatatgacctggaaggaaaagtagatatgaagattcgagctatggaagtggttgaagaactcagaactcaaagagcagacaaacagtcaatgcttttactagatgcgtttaacaaagatcgagcttctttaccacaacctcttccaaatcctccaccattggcaccgttgcctgtggctactcctgatgctcgcactcaggagttgattaatgagaagctgaaaaaagcagaagatcttggtgagcaaggaatgttggatgaagcacaaaaagcactggaagaggctgaagcactcaaaaagctttcagttcacttgcctcctcgtcaggaacctgttacagactcctctaagtatactgctgcagatgtgcgagttactgatcagaagttacgtgtctgtgacatttgtggagtcttttttaagtgtttacgacagtgaccgccgcttagcggatcattttggaggaaagcttcaccttggctatatgcaaatccgtgagaagttggctgatcttttggaagagagaaccaataaaaggaaggctccggaagatgacagaagatcaaaagaacgaagcaaggatcctgaacgagagggtagccgagaccgggccggtagccgtgatcgtgaccgtacacgtgatggtgaccgtaggagccgagatcgtgataggcatcatgaccgtggtcgtggctatgaccacagtcatagagatagagaccgtgattcaaggagccgtcatagatcacggtcacggtcgagggaccgtgttagggattatgatcgaccaaggcgttatgaccggtactagcaataaagcaggtcgaaggtt

SEQ ID NO: 5971 - DNA, 1444 bp, Flaveria ramosissima
aagagtagtgtttttatatgattatgctagtcgattgagttgttgcctaggttgagaaacggaacacgaaaccctaacccttgcattctggcgaggtgaaggcaagaaattcgtggagatggatgcaatcagaaagcagcttgatgtgttgatgggggccaatcgcaacggcgacgtcacagaagtcaatcggaagtactacgatcgtgacgtctgtcgtctcttcttagtcggcctttgcccccatgaactctttcaactcactaaaatggacatgggaccctgcccaaaggtgcactcatatcagctaaggaaagaataccaagaagcaaagtcaaaaggtcaagataattatgacagggaattagaggatgtcatagacagacttattgttgaatgtgacagaaaaattgcaagagctctcaaacgtcttagcgaggaggatgctaaagcagctattgctatctctgtgtcagaagttactcagacgcctgagattcttgagttgtcaaagcagataaaggaaaagctgaaagaagctgatcaatatgcactcgaaggaaaagcagatatgaagattcaagctttggagatggttgaagaactcagaactcaaagagctgacaaacagtcaatgcttttgttagatgcatttaacaaagatcgagcttctttacctcaacctcttccaaatcctccaccattggcaccattgcccgtggctaatcctgatgctcgcactcaggagctgattaacgagaagctaaaaaaagcagaagatcttggtgagcaaggaatgttggatgaagcacagaaagcactggaagaggctgaagcacttaaaaagctctcaatgcagttacttcctcgtcaggaacctgtaacagactcctctaaatttactgctgcagatgtgcgagttactgatcagaagttgcgtgtttgtgacatttgtggagcctttttaagtgtttatgacagtgatcgtcgtttagcggatcattttggtggaaagctccaccttggttatatgcaaattcgtgagaagttagctgatcttctggaagaaagaacaaataaaaggaaggcttcggaagacgacagaagatcaaaagaacgaagcaaagatcttgaacgggaaggtagcagagacagggtccgagctagcagtcgtgaccgtgatctttcacgtgatagtgaccgtagaagtcgagaccgtgacaggcatcatgatcgtgatcgtggttatgatcgctacgaccgggatagaggaagagaccgtgattcaaggagccgacataggtcacggtcaagggaccgtgttagggattatgatcgaccaaggcgttatgaccgatactagcagtgaagaggatgcaaggttttctttttggttcttgcacaaacgtttgcttttctaaatttatcggtttgtgattgtttt

SEQ ID NO: 5972 - DNA, 1877 bp, Theobroma cacao
aaatcaaaactcgcaacaaattaaaggaacgaagtgcaattcaagaagacaaaagtgaaaaacataaaagtattcatcccttactttaaaatataagaaactccaagggcatatgcataaagcaaaatccatcagagcccccaaaaatactcgaccctaaaacaacaaaccctagaaaaagtctctctaactgttctgcgagagaaggaaaaagagacaaagaagagagtgttttagctcaaatattcccctttcactttccgagagaaagagaaggaggggaaatcgaccaaaagagaagaaaatggacgcaatgaggaaacagctcgatgtgcttatgggagctaatcgaaatggcgatgtaagggaagtaaatcgcaagtactacgatcgcgatgtttgccgtctctttttgtccggcctttgccctcacgagctcttccaattaacgaaaatggatatggggccatgcccaaaggtccactctttgcagctgaggaaagaatatgaagaagccaaggcaaaaggtgttgataactatgacagagaattggaagatgccattgatagactcattgttgagtgtgataggaaaattggcagagctctaaagcgtcttgaagatgaggatgccaaagctgctattgctatatcagtttctgatgttacacagacgcctgaagtacttgagctgtcaaagcaaataaaggagaaactgaaagaagctgatcaacatgatcttgaaggcaagacagatcttaagattcgagctctggaagaagtagaagaatttagaaccaaaagagcagacaagcagtccatgctgcttttggatgcattcaacaaagatagagcatcgctgcctcaacccctcccaaatccaccagcattggcacctctacctgtacctgcacctgatccccgtacgcaggagatgatcaatgagaagctaaagaaagcagaagatcttggtgagaaaggaatggtggatgaagcacaaaaagcattggaagaggctgaagcgcttaagaagctacctgccagacaagagcctgttctggattcctcgaagtacacagctgctgatgtccgcatcactgatcaaaagcttcgtgtttgtgacatttgtggagcatttttgagtgtttatgacagtgaccgacgtttagcagatcattttggaggcaaacttcatttaggctatatgcaaatccgggataaactagctgagcttcaggtaagtgtaatggtttacggcttactgatttatgcctaccatcagaaaatttcccttatagtccttatggtataatgtttcacattcttctataccgattctcagttagtgtgccctctgaagaaagaaacaagagccgcaaacttgatcggcatgatgacagaagatcaaaggaacaaagtaaggattgtgacagagaatctagtcgggatcatgaccgaggagatagccgtgaccgagggagggattatgatcgtaggagcagggaccgggacaggtattatgatcgagatcgtggacatgatcgggatcgtgagagagattacgagcgctcacgcagttatgattcaagaagtcgtcgcaggtcacgttctcggtctaaggaacgttctagggattatgatcgccacaggcgtgatcgatactagatggttgttgctatcaagtggatggatatgaaatcagtgttgtttaggtcagtggtgaaatcatgtagggattaatatttaattgtgtgattgtactgatgctttttgcggagtttggcagtttcttctattttgctggatgtatcaactgcttcgtttcttgactaaaatttttaagagcaacttttttttaaaaaaaattaaaagtaaat

SEQ ID NO: 5973 - DNA, 1662 bp, Echinacea purpurea
ggttcagaactcccccaataaaaccgaacgccaaaaccctaaccaccgcgtgctcgccggagagcccaacgattccgtccagatggatgcaatacgaaagcagctcgatgtgctgatgggagccaatcggaacggtgacgtcacagaagtcaatcggaagtactacgatcgcgatgtttgccgtctgttcttagtcggcctttgtcctcatgaactgtttcaactcactaaaatggacatgggaccatgcccgaagattcactcgcctcagctgaggaaagaataccaagaagcaaagtcaaaaggtcaagataattatgatagggaattggaggatgttatcgacagactcattgttgaatgtgacagaaaaattgcaagagctcttaaacgtctcagtgaggaggatgctaaagcagctattgctatctccgtgtcagaagttacccagacacctgagattcttgagttgtcaaagcagataaaggagaagctgaaagaagctgatcaatatgaccttgatggaaaagtagatatgaagattcgagctctggagacagttgaagaactcagaactcaaagagcagataaacagtcaatgctcttattagatgcatttaacaaagaccgagcttctttaccttcacctcttccaaaccctccagcattggcaccattgcctgtgcctaatcctgatgctcgcactcaagagttgattaatgagaagctgaaaaaagcagaagagcttggcgagcaaggtatgttggatgaagcacaaagagcacttgaagaggctgaggcacttaaaaagctttcaatgcacttgcctcctcgtcaggaacctgttacagactcctctaagtttactgctgcagatgtgcgagttactgatcagaagttacgtgtctgtgacatttgtggagcttttttaagtgtttacgacagtgaccgccgcttagcggatcattttggaggaaagcttcaccttggttatatgcaaattcgcgagaagttagctgatcttttggaagagagaaccaatagaagaaaagctccggaagaagacagaagatcaaaagaaagaagcaaggatcttgaacgagagggtagcagagaccgtgaccgagcaagtagccgtgatcgtgaccgcacacgtgatagtgatcgtaggagccgagatcgtgataggcatcatgaccgtggtcgtggttatgaccgccatgagcgtgatagagaaagggaccgtgattcaagaagccgtcatagatcacggtcacggtcaagggaccgtgttagggactatgatcgaccaaggcgttacgacaggtactagcagcaagttagcaatgaagcgggtgaaaggttttcttttcacgttcttgcacaagaattattttttattgtcggtctatggagttctaacgttggttttaacaccggatctaatcggtactataacagattatctatccttttttgtatttgttatgacttccgggtttccctaatgtttgctagaaaggaattcatgttgatgttcctacttgtggtatcatttaccctcatgttcttgtgttaatcaaatttatgtatgaaaaacgaccgttatggacgacttaatatttgaggcgtacaacgcgcgaaactatacacttatcgaga

SEQ ID NO: 5974 - DNA, 1725 bp, Sesamum indicum
ggagagaggacttggcatcgaaggagtaggagcaatggatgcgctgaggaagcagctggatgttctgatgggggcgaatcgaaacggtgacgcccaggaggtaacgcggaagtactacgatcgcgacgtctgtcgcctattcctcgctggcctctgccctcacgagcttttccaactcactaaaatggataagggaccatgccccaaggtgcactcattgcagctgaggaaagaatatgaggaagcaaaagcaaaaggtcttgataattatgatagggacttagaggataacatagatagacttattattgagtgcgatcgtaaaatagcaagggctttgaagagacttgatgaagaggatgctaaagccgctattgcaatctcagtatcagaagttacccagacaccagagattattgagttgtcaaagcaaatcaaagcaaaactgaaagaagctgatcaagctgacctagaaggcaagacagacgtgaagattcgagcattggaagaggttgaagaactaagaacaaaaagagcagacaagcagtcgatgcttcttttggatgctttcaacaaagaccgtgcatctcttcctcagcctgtgacaaatgcttctcagacaccaatgccagcagctgttccagatcctcgcatacaagaaatgattaatgagaagttgaagaaagctgaagatcttggtgaacaaggaatggtagatgaagcgcagaaagcacttgaagaggctgaagcgctgaagaagctgccagcgcggcaggaacctgtgctggattcctccaagtacacagctgccgatgtgcgcattactgatcaaaagctccgtgtttgcgacatttgtggagcattcctcagtgtttatgacagtgatcgtcgtttagcagatcattttggtgggaagctccacttaggctatatgcaaattcgtgaaaagttagctgagcttcaggaagagagagacaagaaacgtaaagcctatgaagaagaaagaaggccaagagatcggagaagccgtgaccgtgacagggaatctagcaaggatcttggtagaggtgatagccatgaacgtggaagggattatgatcgtaggagcagagatcgtgataggcatcccgatcgtgagcgtgattatgaccgagaacgtgaaagagatagagaacgttctcgcagctatgactcaaggagtcaccgaaaatctcgatcccggtcgagagaacgttcaagagattatgatcgctacagcaggcgttatgatcgttattagctggacaaacagaaagagtggttcatgtaggggacggttctaaagtttgtatcttctgtctattaccgctgtggtactctctaggaagatgttggttattctggattctggtatattgcaccggtcggtagagtgaaggaatgctgtctgtatgctagtttttatgtgaggtgcagagattcatttcatgcagattgccgctcgtcttcatttgcttggactacaaacgtgttgcaatgacccgaaattttcatgttacatgaattcatcaaacggtggttttttatggcagctttgaggaagactcgagctttgcccacaatgtatcgtcatccttctccctgattgagctatatttgtagcgagtggtagggagaaaaccttttccggatcattcttctaacagaattaatataataatgctccggaaaaggttttctccctac

SEQ ID NO: 5975 - DNA, 1493 bp, Vinca minor
tctttcaacagagagattgatttagggtttctgtagaaatctagttcaacaatggattcgattaggaagcaattagacgtgttaatgggagccaatcgaaatggtgatgttacggaggttgatcgcaagtacttcgatcgtgatgtttgtcgtctcttcctctctggcctctgtcctcacgaacttttccagcttactaaaatggatatggggccttgcccgaaggtgcattcattgcagctgaggaaagaatatgaggaatcaaaggcaaagggtgttgacagctatgatagggacctggaggatgttatagataggttgattattgagtgtgatcggaaaattgctagagctcttaaaagacttgatgatgaagatgctaaggcagccattgccatctctgtatctgaagttacccagacgccagagacccaagaattgtcaaaagaaataaaacagaagctgaaagaagtggatatttatgatctcgaaggcaagacagatatgaagattcgagctcttgaagtgttggaagagctcagaactaagagagctgacaagcagtccatacttctcttggatgcattcaacaaagatcgagctttacttcctcagcccctaacaaacaatccacagttagcacacgtgcctgaaactgcacccgatcctcgtgtgcaggagatgattaatgagaaactgaagaaggccgaggatcttggcatggaagggatggttgatgaggcacagaagttactggaagaggcagaggcacttaagaagctacctgcacgccaagaacctgctccagactcctcctccaagtacacggctgctgatgtgcgcattactgatcagaagctacgtgtatgtgacatttgtggagcatttctgagtatttatgacagtgatcgtcgtttagcagatcattttgggggaaagcttcatttaggctatatgcaaatccgcgaaaagctagcggagcttcaggaagagagaaacaagaagcgaaaagcatgtgaggaggagagaagatcaaaggaacgaaaaagcctagaccgtgaaccaagtaaagatagggaccgtggtgatggccgtgaacgagttagggatcatgaccgtaggagcagggatcgtgatcgatacaatgaacgcgatcgtggctataatagggagcgggagagggatagggatcgttctcgtagctatgattcaagaagtcgcaggaggtcaaggtcacgctcacaagaaaattctcgggattatgatcgccgcaggcgctcggaccgttactagctgttgctgtgagggtgagagttgaagtagtagtcttgcttttgtcaatgcttgatggtctgtaggaatcttgaaggtgcctgctattttgtggattttggaggttgtccctgtatttgtttaactagtgggataaactactgttagacagatcttagtttaactaattaaatgctacttgtttttatgattattgaatc

SEQ ID NO: 5976 - DNA, 1494 bp, Arnica chamissonis
attttgttccgatggatgcaataaggaagcagctagatgtgttgatgggcgcgaatcggaatggtgacgtcacagaagtcaaccggaagtactacgatcgtgacgtctgccgtctcttcttagtcggcctttgcccgcacgaactcttccaactcactaaaatggacatgggaccatgcccgaaggttcattcatttcatctgaggaaagaataccaagaagcgaagtcaaaaggtcaagataattatgatagggaattggaggatgttatagacagactcattgttgaatgtgacagaaaaattgcaagagctcttaaacgccttagtgaggaggatgctaaagcagctattgctatctctgtatcagaagttacccagacacctgaaattcttgagttgtcaaagcagataaaggagaagctgaaagaagccgatcaatgtgaccttgaaggaaaagcagatatgaagattcgagcactggaggtggttgaagaactcagaactcaaagagcagataaacagtcaatgcttctattagatgcatttaacaaagatcgagcttctttaccttcacctcttccaaaccctccttcattggcaccattgcctgtgcctactcctgatgctcgcactcaagagttgattaatgagaagttgaaaaaagcagaagatcttggcgagcaaggaatgttggatgaagcacagaaagcacttgaagaggccgaagcactgaaaaagctttcaatgcacttccctcctcgtcaagaacctgttacggactcttctaagtatactgctgcagatgtgcgagttactgaccagaagttacgtgtctgtgacatttgtggagcttttttaagtgtttacgacagtgaccgccgcttagcggatcattttggaggaaagcttcaccttggctatatgcaaatccgtgagaagttagctgatcttttggatgagagaaacaataagaggaaagctccggaagatgatagaagatcaaaagaacggagcaaggatcttgaacgagaaggtagtagggaccgagccggtagccgagaccgagccagtagccgtgaccgtgaccgtacacgtgatagtgaccgtaggagccgagaccttgataggcatcatgaccgtggtcgtggttatgaccgctatgatcgtgacagggaaagagaccgtgattcaaggagccgacatagatcacgatcacgatcaagggatcgtgtcagggattatgatcgaccaaggcgttatgaccggtactagcaatgaagcggatgaaagaaggttttcttttcttgttactgcacatttttttttgttgtcagttggtgatgttttaacctcagatttgtaaccggatctaattgggtactagaacaagaccattctctttgtattcgttatcatttcggggtttcatttatgttttctagaagcaggtacaactgtttacggagtcttttctaatatggattgtggttct

SEQ ID NO: 5977 - DNA, 1827 bp, Aquilegia formosa
cttagatattctctcacttgtttcttcttctctgtttgcgtgagggtgagagagagagaaaagaaaggcaaaagaagaagaagaagaagaaagaactgaaatcaacaatagaaaccctagaaaaaccctaaaaagaaagaaagaatttggacaggagaatggatgctttaagaaagcaattagatgttttgatgggagcgaatagaaacggcgacgtaactgaagtgaatcgaaagtattacgatcgagatgtttgtcgtcttttcttggctggtctttgtcctcatgaactattccaattaactaaaatggatatgggaccttgttccaagatacactcattgcagcttaggaaagattacaatgatgccaaagcaaaaggtggtcataattttgatagggaattggaagatgtcatagataggctgattgtagagtgtgatcggaaaattgcaagagctcttaagcggttggaggatgctgatgctaaagctgctattgctatctctgtatctgaagttacccagacacctgaggtacttgagttatcaaagcaaatcaaggaaaaattgaaagaggttgatcaacttgattttgaaggcgaaacagatggtaagattcgggctatggaagtagttgaagatctcagaactaaaagagcagacaaacagtccgtgcttcttcttgatgctttcaataaggatagagcttccttgccacaaccactattgaaccctcccccattggctccattacctgtgtatgcccctccagatcctcacacccaggaaatgatcaatgagaagctaaagaaggcagaggatcttggtgagcaagggatggtggatgaggcacaaaaggcactcgaggaggctgaagctctgaagaagttgggtgcaaggcaggaagcagttctagactcttcaaagtatactgctgctgatgttcgcattactgatcagaagctacgagtgtgtgacatttgtggagcatttttaagcgtgtatgacagtgaccgccgtttggccgaccattttggaggaaagcttcatttgggttatatgcagatccgcgagaagttagcggaacttcaggaagaaagagaggcaggtcgaaaagtggcccgtactgaagatgatagaagatcaaaagagcgcctgcaagaccatgaaagggcatcaagcagggatcgggctcgtgatagggaggatcgaggtggtagccgagagagaagaagggaatctgatcgtaatagtgaccgcaataggtactatgatagagaccgaggttatgatagggaaagggaaagagatcggtctcgcagtcatgattcgaggagccgcaaaaggtcacgttccaggtccagggatcgctctagggatcatgggcacaggcggcatgatcgttactaaagttggtactgttgttgcgaaaggagattggttgatgcagaaaaaaagaagagctttagtgtaatattgtttccgtcgatgtagaatgtcaacagaagagtgctgcaatgatctctttgtagaagttcagtgctgctccttttcagctccttagtagttgtacttggcaaatatggccaactgttgtgttgtggtcttttgcagactgatataacaatgatctgatgtctgctatcaagttggatgtttcatgttgagaactgctgcaactattagcagtttattaagtatgtctggaactactagcagtttattgattgtgtctgcaattattagcagtttatctagtatgttttcttacctgtgtatgagaattttgactatcattcctgaagttgctattcagagcaaaatc

SEQ ID NO: 5978 - DNA, 1577 bp, Linum usitatissimum
ccacgcgtccgcggacgcgtggggaaaacaacaaaccctaaccttctcgctcggatcgatttcgcggccaagcagaaagggagggagcaacgatggatgcgatgaggaaacagctcgatgtgctcatgggagccaatcgcaacggtgacgtcagggaggtcaatcggaagtacttcgatcgtgatgtttgccgcatgtacttggtcggcctgtgtcctcacgagctattccagttgacgaaaatggatatgggtccttgcccaaaagtccactcgttgcagctgaggaaagaatatgaagaagctagggcaaagggtgttgataactacgaccgagaactggaagatgtaattgatagactcatagtcgagtgtgacaagaagattggtagagcactcaaacgtcttgatgatgaagatgatgcaaaggctgccattgcaatatctgtttctgaggttactcagactccagaggtgattgagttatctagacagatcagggaaaaactgaaagaagttgataaacatgatcttgaaggcaagacagactccaagatccaaactcttgaagaggttgaaaaactcagaagtgaaagagcagagaagcagtctgcacttcttctggaagcttttaataaagatagggcatcattaccccagcccctgccaaatccacctccactggcagcaatgcctgctgcagctccagatccacgtacacaagaaatgataaacgagaagctgaagaaagcagaggatcttggtgagaaagggatggtagatgaagcccaaaaagccttggaagaggctgaagcactcaagaagctgcctgccaggcaggacccaacagtcgataactccaagtatacagctgcagatgttcgcattaccgatcagaagctccgtgtttgtgacatttgtggagcatttttgagcgtgtatgatagtgaccgacggttagctgatcattttggaggaaagctacatcttggctatatacaaattcgtgaaaagattgctgagcttcaggaagaaaaaaacaagttcaggaatgttgagcgtaatgatgaacgaagatccaaagatcggagcaaggaggctgaccgagaacctagcagggatcgggacagaggtaatagccgtgaccggggcagtgacaggggaagcagagactatgatcgtagaagcagggatcgtgataggtatcatgatcgggaacgtgacagagattcagatcgctctcgtggttatgaaagaagtcgtagaaggtcgcgatctcaagaacgctccagggattatgaccgccacaggcgtcatgatcggcattaggatttgtcggcgaagaagagttggggtacgtcagttggtagagagtgaggaatgttttgtggagattggacttggtttgctttaatttgtacctgagggagggaagaggatcattttgtactgtaagagaggattaatcttgctgatggttatggaatgtacttgtcgaagaagtagctagctactattattattattattgtgtcgagtctttgcaggataataacatctatattggtatcgtttcat

SEQ ID NO: 5979 - DNA, 1624 bp, Eutrema halophilum
aaaaaaaaatcttgtataccagaaacaacaaatcaaaacccaatctctctgttcgcagggaggatcgattcgtgcttccgagaatcatattgtgagagagagagagagagagataacgaagatggacgccatgaggaagcagctcgatgtgctcatgggagcgaaccgaaacggcgacgtgacggaggtgaatcgcaaatactacgaccgcgatgtttgtcgtctctacctatctggtctctgccctcacgagctttttcaattgacgaaaatggatatgggtccttgcccaaaggtgcactcgctgcagctgaggaaagaatataaagaagcaaaggcaaaaggtgttgacaactacgatagggaattagaagatgcgatagacaggcttattgttgagtgtgatagaaagattggtagggcccttaagcgtcttcaggaagaggatgccaaagctgccattgcgatttcagtcaccgaagttactcagtcacctgaaattctcgagctatcgaagcaaatcaaagagaagatgaaggaagcagacctgcatgatcttgaaggaaaaacggatctgaagattagagctcttgagttagttgaagagatgaggactaagagagctgacttacaggctgtgctgctgttggaggccttcaacaaagatagggcatccctgccacagcccatcccagctcagccgccagctgcagcattacctccgcctgatcctcgtactcaagagatgatcaatgagaaattaaagaaagctgaagagtttggcgaacaaggaatggttgatgaggcgcagaaagcactagaagaggctgaagctctgaagaagcttacggctaggcaagaacctgtagtggattcaaccaagtacacagctgctgatgtgcgcattacagaccagaagctgcgtctatgtgacatatgcggagcatttttgagcgtctatgacagtgatcgtcggttagctgatcattttggagggaagcttcatttgggttacatgctgatccgcgacaaattagcagagctgcaggaggaaaagaacaaagttcacaaggaacgggtcgaagaaaggagatcaaaggagaggagcagagagcgagaatcaagtaaagacagagacagaggagatagccgtgaccgtggaagagatcttgaccgtaggagtagggatcgtgacaggcaccatgaccaccgtgaacatgacagaaactataatcagtcacgtgggtatgattcaagaagccggcgcagttcacggtcccggtctagggaaagaccgagggattatgatcgccgcagacgccatgaccgctactaagacgccagctgccagagacggttgcagcaagtttaagaggttttcacagatgcgtttaggatcaatctggagttgcaaaacactcatttgtttttcttatgtgttctaagatttttgagattgtaagttgctaagtttgtaagaagagcttcttcggatgttttttattctcctggtttatcttttgttataaatgttgacttcaaagactcgtgagtaaaaagattgtgatgattacatagctctttcacttgtgagatgtgtatgactcatcatgaatttggtcat

SEQ ID NO: 5980 - DNA, 1758 bp, Chenopodium quinoa
ctcaaacccaaaaaccctaatttgaagaactcgctccttttttcagaggagagagaaaatggatgcgtttcggaagcaattagatgtgttaatgggtgctaatcgtaacggagatgttactgaagttaatcgcaagtatttcgatcgagatgtttgccgtctctttttgtctggtctttgtcctcacgaacttttccagttaacgaaaatggatatggggccatgtccaaaggtgcattcgttgcaattacggaaagaatatgaagaagcaaaggccaagggcgttgataactacgacagggatttagaggatgtcatagacaggctcattgtagaatgtgacagaaaaattactagagctctcaagcgtcttgcagatgaggatgctaaagctgctattgcaatttccgtgtctgatgttacccagacagaagagatcatagagttgtccaagcagatcaaagagaagttgaaagaagctgaccagtcggatcttgaaggcaaaacagatcttaaaattcgagctttggaagaagttgaagaattaaggacaacaagagctgataaacagtctatgcttcttttggacgctttcaacaaagacagagcctctctaccgcagccacttcccaatcctcctccattggctcctttacctatgcttagtcctgatgctcgtactcaagaattgataaacgagaaactgaagaaagcagaggatctaggtgagcaagggatggttgatgaagcacagaaagcattagaggaagctgaagcgttaaagaggcttgcgccaaggccggacccctcagcagatccagcaaagtatactgccgctgatgttcgcattactgatcagaagctacgtgtctgtgatatttgtggagcattcttgagtgtttatgatagtgatcgtcgtttagcagatcattttgggggaaagcttcatttgggatacatgcaaattcgtgagaaattagctgagcttcaaggaagaaaaaacagaagcgcaaggttcatgaagaagatagaaggtctagagagcgcagccgtgaagtagaacgtgcacccagtaaggacagggaaagaggtgatagtcagcatagggattatgaccggagaagcagggaccgtgataggcacagtgacagggatcgtgtttatgaccgtgaacgtgaaagagatagggagcgatcccgcagtcatgattcaagaagtcgccgaaggtctcgttcacggtccagagaacgttccagggattacggccgtgactatgatcgtagcaggcgtcatgaccgagatagatactagagcttcatgtactgcattgtcagcatgaacaagtttacctttgctgcgtaaattatgtgtttttttttctatctttctttgagacaaagtactcgggagtattcaggttgtggacttcgcgtttcttcatcacttaggttggtttttcgaacgaatgagatgcttattttgctagttgaagaaagagtacggtaattttcccgtgtaatagcttaggatgtatgaaaagaaaatcttgattatggtgagatggatgctctgcttaacctctcctttgtgccttatttttcattttatactccgtataatttatttttggtctttagttgattgtgaataatgatgtgcaaatgttcaagttttccatttgacacaatcatttgctttataaaatgtgccaaatgattgtgatataaatttgtcttcctaaataatggcacattggca

SEQ ID NO: 5981 - DNA, 1620 bp, Orobanche aegyptiaca
aaaccgaaccaaaccctactagtagtcggagagagggggaaattgtgcagaagaagaagacgatggacgcgctgaggaagcagctggatgttctgatgggagcgaatcgaaacggagactcccaggaggtgacgcgaaagtactacgatcgtgatgtatgccgcctttttctcgccggtctttgcccgcacgagcttttccaactcacgaaaatggataaaggaccatgccccaaggtgcattcactgcagctgagaagagaatatgaggaagcaaaagcaaaaggtcttgataattatgacagggacttagaggataacatagacagacttattgtcgagtgtgatcgtaaaattgctagggctttgaggaggcttgacgaagaggatgctaaagcagccattgcaatctcggtttcagaagttacccagacaccagagatgattgagttgtcaaagcaaattaaagaaaaaatgaaagaagccgatcaatctgatcttgaaggccaaacggacacaaagattcgagctttggaagaggtcgaagagatgagaacgaaaagagcagacatgcaggcaatgcttcttttggatgctttcaacaaagatcgtgcatctcttccacagccccttgtaaatgctccacaagcgacacccttgccggcagctgttccggatcaacgcatacaagaaatgattaatgagaagctaaagaaagctgaagatctcggtgaacaaggaatggtggatgaagcacagaaagcattggaagaggctgaagcactcaaaaagctgccagcccgactggaacctgtgctggactcctcaaagtacacagccgctgatgtgcgcattactgatcagaagctccgtgtctgcgacatttgtggcgcattcttgagtgtttatgacagtgatcgccgattagcagatcattttgggggaaagctccacttaggctatatgctaattcgtgacaagttagctgaactccaggaggagagagacaagatacgcaaagcccatgaagaagagagaaggtcaagagatcgtaaaagccacgaccgcggcagggaatcaaaggatcgtgatagaggagatagccgcgaacgtggaagggattatgatcgtaggagcagagatcgtgataggcattacgattatgatcgagaacgggaaagagatagagatcgttctcgcaactatgactcaaggagtcaccgaaggtctcgctcccggtcaagagaacgttcaagagattatgatcgtcacagtaggcgttacgaccactattagtggacgaaaacggctttatcttggggatggacggacttctatttatagacgccgtggtactctgcaggaagatgttttgcttattgtgttttgtaaggatatcaagtttgagatattgctctatttggtagtgtgtggatggtctgtatgttagttgtcaaaagtccagatgttgatttctcatgcggaggggtaagcttcacttgcttgagattttatatttctgtgaagtttattttctgtcagttgatactaattatatataaattcaggctgatcgtgtgttgtatatttgagattttattgaattattttggttatatgt

SEQ ID NO: 5982 - DNA, 1601 bp, Panax ginseng
catagagacgagagagaaatggacgcactgcgaaagcagctagacgttctgatgggagcgaacagaaacggcgacgttcgagaagtgaaccggaagtattacgatcgcgatgtctgtcgtcacttcttagttggcctctgccctcacgaactcttccaactcactaaaatggatatgggaccttgtccaaaggtgcactcgctgcagttgaggaaagaatataaagaatccagagcaaaaggtcaagacaattacgaaagggagttggaagatattattgacaggcttataattgagtgcgacagaaaaattgctagagctctcaaacgtctaaccgatgaagatgctaaagcagctattgcaatatctgtttctgaagttaccacaacacctgaggttctcgagttatcaaaggagataaaggagaagctcaaagaagctgatcaccacgatcttgaaggcaagacggatatgaagatccgagctttggaagtggtagaagaactcagaactaaaagagcagacaaacagtcaatgcttctattggtcgccttcaacaaagaccgggcttctttgccccagccccttccgaaccctccaccattggcaccattccctgtggttgttcctgatgctcgcacacaggagatgataaatgagaaactgaagaaagccgaagatcttggtgagcaaggtatggtcgatgaggctcaaaaagcattggaagaagctgaagaaatcaagaagttgcctggcatccgtcaagaacctgttctggattcctcaaagtacactgctgctgatgtgcgcattactgatcagaagttgcgtgtctgtgacatttgtggagcatttttgagcatttatgacaggcttttgggcccagttttacgaggataaacttatgcagctaaagaattgatcgtcgattggcagatcattttggaggaaagcttcacctaggctatatgcaaatccgtgaaaagttggcagatattaaggatgagagagacaataaaaggaaggcctctgaagaactgagaagatcaaaagagccaagcagggatcatgatagagaaggaagtagggatcgaggaggaagccgtgaacggcgaagggaccatgatcgcaggagcagagatcgtgacaggcataatgaccgagatcgtgggtatgatcgagaacgtgacagagagagagaccagtcacgcagctatgattcaaggagtcgtcggagatcacgttcacgatcaagggagcgtgctagggactacgatcgccacaggtgctatgatcgatactagctgacaaatatctattgaatgattaaatctggaaatttgtcttctggtacgtattaatgcctagagatttatgtttggagaaaaaatgatggcttctttaatttgttgtacttccgctacagaatagtaatggtagaaagaacagtttcgtactatcatgtttctgctgaagatccacattttcatgcattggttgtttcaactccatggcgtttcgattgtaaggaaatttgtggtattttttttttcttgttttgagtagtcgctttgaacagcaggcctaattcaatggaattt

SEQ ID NO: 5983 - DNA, 2048 bp, Amborella trichopoda
ctccatataaattcagtaaactctcgctgtaacattcgcagaaagcagtgccctaaaatatctctccctctttctcttctctgtcctctctctcttctctttcctctctctctgtgagttctggttgagctttggcgggaaaaacccctaccatggacgctctgagaaagcagctggacgttttgatgggggcgaataggaatggcgacgtgagggaagttaaccgtaaatattatgatcgagatgtttgtcgcctgtttctttctggtctttgccctcatgaactttttcaattaacgaaaatggatcttggcccttgtccaaaggtgcactcattgcagctgaggaaagaatatgaagaggccaaggcaaaaggtactgataattatgatagagacctggaggatcaaatagaaagacttattgtggagtgtgataggaaaattactagagcccttaagcgtcttgaggatgaggatgctaaggctgccattgctatatctgtttctgaggttacccagtcacccgaagttctggagttatcaaagcagataaaggaaaaacttaaagaagttgatactctagatttggaagggaagacggacagtaaaatcagagccttagaagtggtagaagagcttagagctaaaagagctgataagcagtcaatgcttctacttgatgccttcaacaaggacagagcttctttgccacagccactccaaaaccctccatcattggcacccttaccagtacctcttcctccagatcctcgtacacaggaaatgataaatgaaaagttaaaaaaatccgaggaacttggtgaacttggaatggttgatgaagcacagaaagcattggaggaggcagaggctcttaaaaagttgagtgcaagacaggaaccagttgttgactctgcaaaatatactgctgctgatgtgcgcattactgatcagaagttacgtgtttgtgacatttgcggggccttcctaagtgtttatgacagtgatcgtcgtttagctgatcatttcggaggtaagcttcacttgggctacatgcagattcgtgagaaattaggagaacttcaggaagagagaaataagagtcgaaagtcagatcgagctgaagatgatagaaggtcaaggggccaaagtcgggaccatgaaacgggtgggagcagggacagggatagagagagggatgagagaggtgggagtcgtgataggggtagggatcgggatcgtcgaggaagggatggtgaccgtggctacgataggggccgtaattacgaccgtgagcgcgaaagagaagcagatcgctcccgtattaatgatttgaggagtcggaagaggtcacgttcgaggtcaaaggaacgttcgagagattatgatcgtgagagaagtgatcgccacaggcgctatgacagatacaataggtactaatacatcaccagggtgtgctttttgttgcaggcgctatgacagatacaataggtactaatacatcaccagggtgtgcttttaaaatgcttctatgagttagtggttgcagacttgtgaatgattttcaatgtatgactccatcacatgggattacttgcgtcttatttcacaatactttttaaaactctgattaccaagagtttgcatctctctcagaaaaaaggtttagttagttaggattttttgctctctctctacctttttggtatcaacccgtttgcccaaggacgtccaaaacttcccatcgatgatgccttaaaaatgtggagttgtgtcatgctctgaaagttctaactgacccagcatttacatcttctcatctctgaatttctgttagttttaggatttttcatgggacttggtttcaagtgtttgggtgctggatatcagcatttaatgccctttgctttatttcaaggccatcaagttattaccttaccaactggtttttaggttggttttttatttgtttgaacattggttttaggttggtttttgactgtgattctaaaaaatagaatagaattttgagtttgatcacaaaaa

SEQ ID NO: 5984 - DNA, 1826 bp, Artemisia annua
tactccaacgggacacacaaacacacacatatacaaaaccctaacttaaccagcgcgtgctctgacgcacaccaatccaccatccccccaccatggacgcgatacgtaagcagctggatgtactaatgggagcgaaccgtaacggtgacgtcacagaagttaatcggaagtattacgatcgtgacgtgtgccggttgttcttagtcggattgtgtcctcatgaattgtttcaactcactaaaatggacatgggaccatgcccgaaggtgcactcatttcaactgaggaaagaataccaagaagctaaggcgaaaggccaagacaactacgatagggaattagaggatgttatagacaggctcattgttgaatgcgacagaaaaattgccagagctttaaaacgtcttagcgaggaggatgctaaagcagctatagcgatatctgtatcagaggttacgcagacacctgagattcttgagttgtcaaagcaaataaaggagaagctgaaggaagctgatctatatgacctggaaggaaaagcagatatgaagattcgagctctggagatggttgaagaattcagaactcaaagagctgacaaacagtcgacgcttctactagatgcattcaataaagatcgagcttctttacctcaacctcttccaaacccgccaccactggcaccgttgcctgtggctactcccgatgctcgaactcaggagttgattaacgagaagctgaaaaaggcggaagaacttggcgagcaaggaatgttagacgaagcccaaaaagcactggaagaggctgaagcgctcaaaaagctttcaattcatttgccgcctcctcgtcaggaacctcctacagactccgctaagtatactgctgcggatgtgcgagttactgatcagaagttacgtgtttgtgacatttgcggagcttttctcagtgtttatgacagtgaccgtcgcttagcggatcattttggaggaaaacttcatctgggctatatgcagattcgtgagaagttagctgatcttatggaagagagaagcaataaaaggaaggctccagaagaagaccgaagatcaaaagaacgaagcagggatcttgagcgtgaaggtagcagagatcgggatcgtgcaagtagccgtgaccgtgaccgtctaagggatagtgatcgcaggagccgagatcgtggtgacaggcacaacgatcgtagtcgtggctatgaccgctatgatcgtgattcaaggagtcgacacagatcacgttcacggtcaagggaacgtgtccgcgattatgatcgaccaaggcgttatgaccgatactaaagccatggaacagatgaaagaaggtttcttttcgagtccctgcgcaaacatttgtttttatcagctggtgtttcacctttaagattattgatggatttagttgggtactagaagaagttatgcgttggtattttgtttcatttcgggattatcttttcattttctagtgcagcagctctatgtatcaccatgttgggagtttctagtgaaggattgcagcactttttatatcctctgtatcgtataaatgtatgctgaagttatttctttgatggattgtggttatgatggaaatattagaacatgttttagactgaagggtggtcttcttcagaatggtattagtggtttgaactttgaaataactaacctgtttgcctgagaaattgtcatataaacaaagatattcttcgttttcttttccgatatgtacttatgtaataaacagctaaacatcatcaaggtggcatattatgtatatatacatttgagtga

SEQ ID NO: 5985 - DNA, 1633 bp, Eutrema parvulum
aaaaaaatttgggtacaccagaacaaacaaatcgaaactcaatctctctgcccgcagggagtgatcgattcgtgcttccgagaatcatattgtgagagagagagagagagagataacgaagatggacgccatgaggaagcagctcgatgtgctcatgggagcgaaccgaaacggcgacgtgacggaggtgaatcgcaaatactacgaccgcgatgtttgtcgtctctacctgtctggtctctgccctcacgagctcttccaattgacgaaaatggatatgggtccttgtccaaaggtgcactctttgcagctgaggaaagaatataaagaagcaaaggcaaaaggtgttgacaactatgatagggaattggaagacgcaatagacaggcttattgttgagtgtgataggaagattggtagggcccttaagcgtcttcaggaagaggatgccaaagccgccattgcaatttcagtcacagaagttactcagtcccctgaaattctcgaactgtcgaagcaaatcaaagagaagatgaaggaagcagacctgcatgatcttgaaggaaaaacggatctgaagattagagctcttgagttagtggaagagatgaggactaagagagctgacttgcaggctgtgctgctgttggaggccttcaataaagatagggcatctttgccacagcccatcccagctcagcagccagctgcagcattacctccgccggatcctcgtactcaagagatgatcaatgagaaattaaagaaagctgaagagtttggcgaacaaggaatggttgatgaggcgcagaaagcactagaagaggctgaagctcttaagaagcttactgctagacaagaacctgtagtggattcaaccaagtacactgctgctgatgtgcgcattacagaccagaagctgcgtctatgtgacatatgcggagcattcttgagcgtctatgacagtgatcgtcggttagctgatcattttggagggaagcttcatttgggttacatgctgatccgtgacaaattagcagagcttcaggaagaaaagaacaaagttcacaaggaacgggtggaagaaaggagatcaaaggagaggagcagagagcgagaatcaagtagagacagagacaggggagatagccgtgaccgtggaagagatcttgaccgtagtggaagagatcttgaccgtaggagtagagatcgtgacaggcatcatgaccaccgtgaacatgacagaagctataatcagtcacgtggctatgactcaagaagccggcgcagttcccggtcccgatctagggaaagaccgagggattatgatcgtcgcagacgccatgaccgctactgagacgctgccagagacgattgcagcaagtttaagaggcttttacagaagcgtttaggatcaatctggagttacagacactcttttgtttttctttgtgttaaaagatttttggagattgtaagttgctaagtttgtaagaggagcttcttcggatgttttttaagcttttcatatgtttttgacatctgagacttgtgagtagaagattgtggtgattccatggctctctcggatgcgacttagataatcaaatttgtcataaaattaaatgagtat

SEQ ID NO: 5986 - DNA, 1434 bp, Musa acuminata
gacttcacagcgagggtcgacacagcttcgatatcttgtcttctctctctctgcgttcgatccttacaaaaggccccatcgcccgcggctgattgttcgttgaggtgggagtcggagagagggggaacccaaaacccctcgtcgaaaccctaaccctagatagagtgacagagagagagagagagagagaggatggacgccatcaggaagcagctcgacgtgctcatgggggccaaccgcaacggggacgtgacggaagtgaaccgcaagtactacgaccgcgacgtctgccgcctcttcttggccggcctctgcccccatgacctcttccagcttacgaaaatggatatgggtccctgtccgaagattcattccttgcagctgagaaaagaatatgaagaagcaaaagcaaaaggtgatcataattttgatagagaacttgaagatatgatagaaagactcattgtagagtgtgaaaggaaaattcaaagagccctcaagcgacttgaggatgaggatgctaaggctgctatagcaatatctgtatccaaggttactcagacgcctgaagccatcgaattgtcgaagcaaataaaggagaaattaaaagaagctgatgtattcgattttgaaggaaaaactgatagtaaaattcgggtcctagaggtggtggaagaactcaaagcccaaagagctgacaaacagtcggtgcttcttcttgatgctttcaacaaagacagggcttctttgccacagccaattcaaaatccttctccattagcaactctgcctgttcttaatcctccagaccctcatacccaggaaatgattaatgaaaaactaaagaaagcggaagatcttggtgagatgggtatgatagatgaagcccagaaagctctagaagaggcagaagctctgaaaaagctgggtgcacggcaagagccagtcctagaatcttcgaagtatagtgctgctgatgttcgaataactgatcagaagttgcgggtatgcgatatttgtggagcattcttgagtgtctatgacaatgaccgtcgcttggctgatcattttggagggaaacttcatctgggctatatgcaaatccgtgagaaactagcagaactccaggaagagagaaacaaaaagcggaagattgaccgttctgaagatgatagaaggtcgaaagaacggagtagggatcatgacagggcaggaagcagggatcgagacatagatagagaggttcgaggtgataatcgagatagaggcagagaacacgatcgaagaaatagggatcatgatcggcattatgatagagatcatagagaccgagacagagatactgatcgatctcgcaactatgattcgaggagtcgaagaaggtcacgttctcgatcaagggatcgtggcagagattatgaccggcataggtat

SEQ ID NO: 5987 - DNA, 1804 bp, Eutrema parvulum
aaaatgtcagttgggggtaagaacctgaatttatttaatcttaagggactataattgagagactgaaccctaattaccaaaaaaatttgggtacaccagaacaaacaaatcgaaactcaatctctctgcccgcagggagtgatcgattcgtgattcagaggaatcaaagtgggtgagaaagagagagagataacgaaagatggacgccatgagaaagcagctcgatgtgctcatgggagctaaccgaaacggcgacgtgacggaggtgaatcgcaaatactacgaccgcgatgtttgtcgtctctacctgtctggtctctgccctcacgagctcttccaattgacgaaaatggatatgggtccttgtccaaaggtgcactctttgcagctgaggaaagaatataaagaagcaaaggcaaaaggtgttgacaactatgatagggaattggaagacgcaatagacaggcttattgttgagtgtgataggaagattggtagggcccttaagcgtcttcaggaagaggatgccaaagccgccattgcaatttcagtcacagaagttactcagtcccctgaaattctcgaactgtcgaagcaaatcaaagagaagatgaaggaagcagacctgcatgatcttgaaggaaaaacggatctgaagattagagctcttgagttagtggaagagatgaggactaagagagctgacttgcaggctgtgctgctgttggaggccttcaataaagatagggcatctttgccacagcccatcccagctcagcagccagctgcagcattacctccgccggatcctcgtactcaagagatgatcaatgagaaattaaagaaagctgaagagtttggcgaacaaggaatggttgatgaggcgcagaaagcactagaagaggctgaagctcttaagaagcttactgctagacaagaacctgtagtggattcaaccaagtacactgctgctgatgtgcgcattacagaccagaagctgcgtctatgtgacatatgcggagcattcttgagcgtctatgacagtgatcgtcggttagctgatcattttggagggaagcttcatttgggttacatgctgatccgtgacaaattagcagagcttcaggaagaaaagaacaaagttcacaaggaacgggtggaagaaaggagatcaaaggagaggagcagagagcgagaatcaagtagagacagagacaggggagatagccgtgaccgtggaagagatcttgaccgtagtggaagagatcttgaccgtaggagtagagatcgtgacaggcatcatgaccaccgtgaacatgacagaagctataatcagtcacgtggctatgactcaagaagccggcgcagttcccggtcccgatctagggaaagaccgagggattatgatcgtcgcagacgccatgaccgctactgagacgctgccagagacgattgcagcaagtttaagaggcttttacagaagcgtttaggatcaatctggagttacagacactcttttgtttttctttgtgttaaaagatttttggagattgtaagttgctaagtttgtaagaggagcttcttcggatgttttttaagcttttcatatgtttttgacatctgagacttgtgagtagaagattgtggtgattccatggctctctcggatgcgacttagataatcaaatttgtcataaaattaaatgagtatacactgactgagaagtaaattaatccacttctgctggtttcaacacataatggtaatagaatgagtaattgttgaaacagggaaagacaaatg

SEQ ID NO: 5988 - DNA, 1843 bp, Brassica rapa
aaaaagaaaaatcgtgtataccaaatcgaaacccaatctctgtgtccgcagagaaggatcgatcagaaagagagagagcaagtaaagagcgatatcgaagatggacgccatgagaaagcagctcgacgtgctcatgggagccaaccgaaacggcgacgtgacggaggtgaatcgcaaatactacgaccgcgatgtttgccgtctctacctctctggtctctgccctcacgagctcttccaattgacgaaaatggatatgggtccttgcccaaaggtgcactctttgcagctcaggaaagaatataaagaggcaaaggcaaaaggtgttgacaactacgatagggagttggaagacgcgatagacaggcttattgttgagtgtgataggaagattggtagagctcttaagcgtcttcaggaagaagatgcaaaagctgctattgcgatttcagtaaccgaagttactcagtcacccgaaattctcgaactatcaacgcaaatcaaggagaagatgaaggaagcagatcttcatgatctcgaaggaaagacggatatgaagattagggctcttgagttagttgaagagatgagaactaagagagctgacttacaggctgtgctgctgttggaggcctttaacaaagatagggcagccttgccacagcccatccctggtcagccgccagctgcggcattgcctccgccggatcctcgtacgcaagagatgatcaatgagaaattaaagaaagctgaagagttcggcgaacaaggaatggttgatgaggcgcagaaagcacttgaggaggctgaggctcttaagaagcttgctcctagacaagaacctgtggtggattcaaccaaatacactgctgcagatgtgcgcattacggaccagaaactgcgtttatgtgacatatgcggagcattcttgagcgtctatgacagtgatcgtcggttagctgatcattttggagggaagcttcatttgggttacatgctgatccgtgataaactagcagagcttcaggaggaaaagaacaaagttcacaaggaacgggtcgaagagaggagatcaaaggagaggagcagagagcgagaatcaagtagagacagagacagaggaggtagccgtgaccgtggaagagatatagaccgtaggagtagagatcgcgacaggcaccatgaccaccgtgaacatgacagaaactataatcagtcacgtggctatgactcaagaagccgtcgcagctcgaggtcccggtctagggaaagaacgagggatcatgatcgccgcagacgtcatgaccgctactaagacgctgtcagagaaggttgcagcaagtttgagatgttttcaaagatgcgtttaggatcaccaatctggagttacaaacacttgttttcgtatgtgttaaaagatatttgagattgtaagttgctaagtttgtaagaggagtttcgttggatttcttcaaactttttaatatgttgacatcaaagacttgcgagtagaaaagacctgtggtgattacatggctctctcagatattacttatatcttcataaaaattgccataaaactgattagtatttgttgggcaaagtggtttattctacttctgctggttaccacagattggtaattataatgaatcattgtcaaaatcaggcaggaaaaatgctagacacaagtagcttagaatcattaactgtccgacacaagtggcttagaatccacgagcgattttaatgttttagtataaagtttgatatataactcctataaactatacagaataaatagcatggattgattcaacctcaactcagcgtactatgtact

SEQ ID NO: 5989 - DNA, 1534 bp, Brassica napus
gagagaaggatcgatcagaaagagagagagcaagtaaagagcgatatcgaagatggacgccatgagaaagcagctcgacgtgctcatgggagccaaccgaaacggcgacgtgacggaggtgaatcgcaaatactacgaccgcgatgtttgccgtctctacctctctggtctctgccctcacgagctcttccaattgacgaaaatggatatgggtccttgcccaaaggtgcactctttgcagctcaggaaagaatataaagaggcaaaggcaaaaggtgttgacaactacgatagggagttggaagacgcgatagacaggcttattgttgagtgtgataggaagattggtagagctcttaagcgtcttcaggaagaagatgcaaaagctgctattgcgatttcagtaaccgaagttactcagtcacccgaaattctcgaactatcaacgcaaatcaaggagaagatgaaggaagcagatcttcatgatctcgaaggaaagacggatatgaagattagggctcttgagttagttgaagagatgagaactaagagagctgacttacaggctgtgctgctgttggaggcctttaacaaagatagggcagccttgccacagcccatccctggtcagccgccagctgcggcattgcctccgccggatcctcgtacgcaagagatgatcaatgagaaattaaagaaagctgaagagttcggcgaacaaggaatggttgatgaggcgcagaaagcacttgaggaggctgaggctcttaagaagcttgctcctagacaagaacctgtggtggattcaaccaaatacactgctgcagatgtgcgcattacggaccagaaactgcgtttatgtgacatatgcggagcattcttgagcgtctatgacagtgatcgtcggttagctgatcattttggagggaagcttcatttgggttacatgctgatccgtgataaactagcagagcttcaggaggaaaagaacaaagttcacaaggaacgggtcgaagagaggagatcaaaggagaggagcagagagcgagaatcaagtagagacagagacagaggaggtagccgtgaccgtggaagagatatagaccgtaggagtagagatcgcgacaggcaccatgaccaccgtgaacatgacagaaactataatcagtcacgtggctatgactcaagaagccggcgcagctcgaggtcccggtctagggaaagaacgagggatcatgatcgccgcagacgtcatgaccgctactaagacgctgtcagagaaggttgcagcaagtttgagatgttttcaaagatgcgtttaggatcaccaatctggagttacaaacacttgttttcgtatgtgttaaaagatatttgagattgtaagttgctaagtttgtaagaggagtttcgttggatttcttcaaacttttaatatgttgacatcaaagacttgcgagtagaaaagacctgtggtgattacatggctctctcagatattacttatatcttcataaaattgccataaactgaa

SEQ ID NO: 5990 - DNA, 2097 bp, Populus trichocarpa
accaaaaacccaactactgtaatttaagaagaagaaaaaaatctctcaatcaaaccctggtgctagagagactcgtctctcactcgatctcaacaaaacaagcatacagagacagagagaaagcaagaaagcaagcagcagcagtgtctgtctctctcagtcgagattggagaaatagaagatggatgcgatgaggaagcagctggatgtgctcatgggagcgaatcgaaacggcgacgtaagagaggtcaatcgcaagtactacgatcgtgatgtttgtcgcttgtacttggttggcctttgccctcacgagctcttccaactaacgaaaatggatatgggaccatgcccgaaagtccattccttgcagctgagaaaagattatgaagaagcgagggcgaaaggtgttgatagctatgatgtggagttagagaatgttattgataagcttattgtcgaatgcgataagaaaatcggtagagcacttaagcgtcttgaagatgaggacgccaaggcagctattgctatttcagtcactgaggttacccagactcctgaggttattgagctgtcgaagcagattaaggagaagctgaaagaagctgacaaatatgatcttgaaggcacaacagattttaagattcaagctttggaagaagtggaaaaactcagaagtgaaagagcagagaagcagtctgcgcaacttttggaggccttcaataaagacagggcttctttacctcaacctatgccaaatcccccaccatcagcacccatgccgctacctactcctgatcctcgcacccaggagatgataaatgagaagctgaagaaagcggaggatcttggtgagcaagggatggtagatgaggctcaaaaagcattggaagaggccgaagcacttaaaaagcttcctgccaggcaggagcctactactgatcagaagctacgtgtttgtgacatttgtggagcttttctgagcgtgtatgatagtgaccgacgacttgcagatcattttggagggaagcttcatttaggctatatgcaaattcgtgagaaactcacagagcttcaggaaaacaagcaccgcaagggtgaccggtacgatgatagaagatcaaaagaacggagtagagaccgtgacagagaatcaagcagggatcaagatcggggagatagccgtgaccgggggagggattatgatcgaaggagcagagatcatgacaggtataatgaccgggatcgtggatatgatcgtgaacctgagcgctcccacagttatgattcaagaagtcttcgcagatcacgttctcgatctagggaacatacaagggattatgatcgccataggcgctatgaccgatattaggatcttgttgctgagcagttgggtatggaaatttgtgtttgtttcctaggtcagtaaacttgtggttttgaatctcaagtatgagtttctgtctttctgatactttcagtggagtttgacagttttctgctaatgtcgtaggcaccggagttgaactgttttctaagttctttatgtttatagtcatgcctgtgcaacatgaatttcagagctgcacgcccttttcattcttctcatattattatccttgcctccccacccgctcacacaagtgtcatgcgtggctcagccatagctagggttttatctacagaaatttccttacccttaatttagtttagattcagctctaatggctttatgctaccggtggtgttgaggatgctgctttgacaaattgtaattctttttccatgacaacaaattcacagaagctttatttttgggtttgggaaagttggattgggttgcccagcatgaagctggtacctgtttactttctatatttgcttactgacgtagtttgcttttttttccccccaccagagtgaaaatcaggacacgtacattctagataaatgttagtaaaaagtgtccgtccagtggctgtgagatgcagctgaattcgattttgtttttcaaatttgcctgacattttggatcttctgagcatgtgctctctcttggttttgaaaagattactacacaaatataggtgcttttgggtt

SEQ ID NO: 5991 - DNA, 1551 bp, Ambrosia trifida
ctctggttcagaattccccgataccctaaccaccgtctgcttccttctccggcgacgagatggacgcaatagaaagcagctggatgtgctgatgggagccaatcgtaacggtgacgtcaccgaagtcaatcgaaagtactacgatcgtgacgtctgccgtctcttcttagtcggtctctgtcctcatgaactcttccaactcactaaaatggacatgggtccatgcccaaaggttcactcatttcagctcaggaaggaataccaagaagcaaaggcaaaaggtcaagataattatgatagggagttggaggatgttatagatagactcattgttgaatgtgacagaaaaattgcaagagctcttaaacgtcttagtgatgaagatgctaaagcagctattgctatctctgtgtcagaagttacccagacacctgagattcttgaattgtcaaagcagataaaggagaagctgaaagaagctgatcaatatgaacttgaaggaaaaacagatatgaaaattcgagctctagagatggttgaagaactcagaactcaaagagcggacaaacagtcaatgctcttattagatgcatttaacaaagatcgagcttctttaccttcacctcttccaaatcctccatcattggcgccattgcctgtgcctgttcctgatgctcgcactcaagagttgattaatgagaagctgaaaaaagcagaagagcttggcgagcaaggaatgttggatgaagcacaaaagcacttgaagaggctgaagtcactcaaaagctttcagttcacttgcctcctcgtcaggaacctgttacagactcctctaagtatactgctgcagatgtgcgtagttactgatcaagaaattacgtttttgtgactattgtggagtctttttaagtgtttacgacagtgaccgccgcttagcggatcattttggaggaaagcttcaccttggctatatgcaaatccgtgagaagttagctgatcttttggaagagagaactaataaaaggaaggctccggaagatgacagaagatcaaaagaacgaagcaaggatcctgaacgagagggtagccgagaccgggccggtagccgtgatcgtgaccgtacacgtgatggtgaccgtaggagccgggatcgtgataggcatcatgaccgtggtcgtggttatgaccgctatgatcgtgatagagaaagagaccgtgattcaagaagccgtcatagatcacggtcacgctcaagggaccgtgttaaggattatgatcgaccaaggcgttatgaccggtactagcaataaagcaggtggaaggttctgttttcacgttgttgcacaagcattttttttttgctgtcggtttgtggagttttaatcttattagatttcatagtggatctaatcggtactagaacagacttaatctttgtatttgttatcatttcggggtttccataatatatgctaggaaggaattcatgttgatggtcctacttgtggtatcatttaccctgatgttcctgttgtgttgatcaaaaaagaa

SEQ ID NO: 5992 - DNA, 1563 bp, Brassica napus
gtcggatcgatcagaaagagagagaaagagagcaagtaaagagcggatatcgatcgaagatggacgccatgagaaagcagctcgatgtgctcatgggagccaaccgaaacggcgacgtgacggaggtgaatcgcaaatactacgaccgcgatgtttgccgtctctacctctctggtctctgccctcacgagctcttccaattgacgaaaatggatatgggtccttgcccaaaggtgcactctttgcagctcaggaaagaatataaagaggcaaaggcaaaaggtgttgacaactacgatagggagttggaagacgcgatagacaggcttattgttgagtgtgataggaagattggtagagctcttaagcgtcttcaggaagaagatgcaaaagctgctattgcaatttcagttaccgaagttactcagtcacccgaaattctcgaactatcaacgcaaatcaaagagaagatgaaggaagcagaccttcatgatcttgaaggaaaaacggatatgaagattagggctcttgagttagttgaagagatgaggactaagagagctgatttacaggctgtgctgctgttggaggcctttaacaaagatagggcagccttgccacagcccattcctggtcagcagccagctgcagcattgcctccgccggatcctcgtacgcaagagatgatcaatgagaaattaaagaaagctgaagagttcggcgaacaaggaatggttgatgaggcgcagaaagcactggaggaggctgaagctcttaagaagctgactcctagacaagaacctgtggtggattcaaccaaatacactgctgcagatgtgcgcattacggaccagaaactgcgtttatgtgacatatgcggagcattcttgagcgtctatgacagtgatcgtcggttagctgatcattttggagggaagcttcatttgggttacatgctgatccgtgataaactagcagagcttcaggaggaaaagaacaaagttcacaaggaacgggtcgaagagaggagatcaaaggagaggagcagagagcgagaatcaagtagagacagagacagaggaggtagccgtgaccgtggaagagatatagacggtagaagcagagatcgcgacaggcaccatgaccaccgtgaacatgacagaaactataatcagtcacgtggctatgactcaagaagccggcgcagctcgaggtcccggtctagggaaagaacgagggattatgatcgccgcagacgtcatgaccgctactaagacgctgtcagagaaggttgcaagcaagtttgagatgttttcaaagatgcgtttaggatcaccaatctggagttacaaacacttgttttcgtatgtgttaaaagatatttgagattgtaagttgctaagtttgtaagaggagtttcgttggatttcttcgaacttttaatatgttgttgacattaaagacttgcggtagaaaagacctgtggtgattacatggctctctcagatattacttatatcttcttaaaaaattgccataaaactgattagtatttgttgggac

SEQ ID NO: 5993 - DNA, 1923 bp, Amorphophallus konjac
tgtttatagtcttctgtccaacgtcgtcgcaagaaatcccctaaaaccctcatcgcggggtgttcttcctccctctgggcttccagctgggctgaaccctagccgtagcgatggacgccatccggaagcagctcgacgccctcatgggggccaacaggaacggggacgtgagggaggtgaaccggaagtactatgacagagacgtgtgccgcctctacctggccggtctctgcccgcacgacctgttccagctcacgaagatggatcttggtccttgtccaaaggtgcactcgctgacactgaggaaagaatatgaggaagccaaagcgaaaggtgctcacaattttgatcgcgagcttgaggatttaatagagaagctaattgttgagtgtgaacggaagattcaaagagccctcaagcgtttgtcagatgaagatgccaaagctgcagttgcgatatctgtgtcggacgttacccagtcactcgaagttctagagctgtcaaaacagattaaggagaagctgaaagaagttgacgcccttgacttggaggggaagagtgatgacaaaattagggttatggaagtcgtggaggagctcagaaccaagagagctgacaaacagtcaatgcttcttttggatgccttcaacaaagacagagcctctctaccacaaccacttcaaaatccacctcccttggctcctgttcctgcacctgctcctccagatcctcaaacacaggaactgataaatgaaaaacttaagacggcagaagcacttggtgaacaggggttggtagatgaggctcaaaaattactagaagaagcagaagctttgagaaagtcaggagcacgacaggagccagttctagattcttcaaaatatactgctgctgatgtgcgaattactgatcagaagttacgtttgtgtgacatttgtggagcattcttgagtgtctatgacaatgaccgtcgtttggctgaccattttggggggaagcttcacttgggttatatgcaaatccgtgaaaagttaacggagcttcaggaagagaggaagaaagggcgcaaagtggatgagcggaggtccagagaacgtgagcccgatagagctgccagcagggatcgggatagggataggaatgatagaggcgacaatcgggagcaagaaagagattttgatcgacggagtagagaccatgatcgccattatgatcgagatcgtggttatgatcgtgaacgggagcgagagccggaccggtctcgaggttatgattcaaggaaccggcgcagatcacgctctcgttcaagggatcgtggcagggattctgatcggcacaggagacatgaccggtatgatcgccattgagttcttcatttcacatgggccatcggaggtaaagaggcataggacctgtttgttgcaagatgccatggaggttatctcagatctgtatttgcatggggagacttgcgttctggactgtccctagtttagccggtctatggattttcccggtttgcagtattgtagaaggaaatgctgggtttctggcggtcggtaccttgtataacattttgctgctttatgtccgtctaaattaccaaagcgctgaggtgtcgtcaacactttctggcttcgccgttctatgaaatgcctctagttgagggaccattacatcacctgatttgggtcgtcggtttccacggttgctcgatagcccagttgttgatggtaggtttctaaccagatgctagtacagttaacaaagcctataacttgcagattccatggaaatgggagaggagaaatagcgacggctgcgaaggggcgggggtatttaggagggttcctaggaaacagtacggttctttacgctttcccttactttcgttggttcgcgtactatacgatgttaatgtac

SEQ ID NO: 5994 - DNA, 1748 bp, Eutrema halophilum
aatgttagctggtaagaaaacttaaaattattttaattttaggggcccataatttgagacagaaccctaatgattaaaaaaaaatcttgtataccagaaacaacaaatcaaaacccaatctctctgttcgcagggaggatcgattcgtgcttccgagaatcatattgtgagagagagagagagagagataacgaagatggacgccatgaggaagcagctcgatgtgctcatgggagcgaaccgaaacggcgacgtgacggaggtgaatcgcaaatactacgaccgcgatgtttgtcgtctctacctatctggtctctgccctcacgagctttttcaattgacgaaaatggatatgggtccttgcccaaaggtgcactcgctgcagctgaggaaagaatataaagaagcaaaggcaaaaggtgttgacaactacgatagggaattagaagatgcgatagacaggcttattgttgagtgtgatagaaagattggtagggcccttaagcgtcttcaggaagaggatgccaaagctgccattgcgatttcagtcaccgaagttactcagtcacctgaaattctcgagctatcgaagcaaatcaaagagaagatgaaggaagcagacctgcatgatcttgaaggaaaaacggatctgaagattagagctcttgagttagttgaagagatgaggactaagagagctgacttacaggctgtgctgctgttggaggccttcaacaaagatagggcatccctgccacagcccatcccagctcagccgccagctgcagcattacctccgcctgatcctcgtactcaagagatgatcaatgagaaattaaagaaagctgaagagtttggcgaacaaggaatggttgatgaggcgcagaaagcactagaagaggctgaagctctgaagaagcttacggctaggcaagaacctgtagtggattcaaccaagtacacagctgctgatgtgcgcattacagaccagaagctgcgtctatgtgacatatgcggagcatttttgagcgtctatgacagtgatcgtcggttagctgatcattttggagggaagcttcatttgggttacatgctgatccgcgacaaattagcagagctgcaggaggaaaagaacaaagttcacaaggaacgggtcgaagaaaggagatcaaaggagaggagcagagagcgagaatcaagtaaagacagagacagaggagatagccgtgaccgtggaagagatcttgaccgtaggagtagggatcgtgacaggcaccatgaccaccgtgaacatgacagaaactataatcagtcacgtgggtatgattcaagaagccggcgcagttcacggtcccggtctagggaaagaccgagggattatgatcgccgcaggtaactatgatcaagaaaacagacatcttattatttactgtaaatcttttggttgcatttaaactaaatgttttaactccgtcgcagacgccatgaccgctactaagacgccagctgccagagacggttgcagcaagtttaagaggttttcacagatgcgtttaggatcaatctggagttgcaaaacactcatttgtttttcttatgtgttctaagatttttgagattgtaagttgctaagtttgtaagaagagcttcttcggatgttttttattctcctggtttatcttttgttataaatgttgacttcaaagactcgtgagtaaaaagattgtgatgattacatagctctttca

SEQ ID NO: 5995 - DNA, 1504 bp, Arabidopsis lyrata
atcaaaaacccaatctctctgttcgcagagaggatcaattcgtgattcagagaatcaaacttggtgtgtgtgagataacgaagatggacgctatgaggaagcaactcgatgtgctcatgggagctaacagaaacggcgatgtcacggaggtcaatcgcaaatactacgaccgtgatgtttgccgtcttcacctatctggtctctgccctcacgagcttttccaattgacgaaaatggatatgggtccttgcccaaaggtgcactctttgcagctgaggaaagaatataaagaagcaaaggcaaaaggtgttgacaactatgatagggaattggaagatgcgattgataggcttattgttgagtgtgataggaagattggtagggctcttaatcgtcttcaggaagaggatgccaaagctgccattgcaatttctgtcacagaatttactcagtcgcctgaaattcttgaattatcgaagcaaatcaaagagaagatgaaggaagcagacctgcacgatcttgaaggcaaaacagatctgaagattagagctcttgagttagttgaagagatgaggacgaagagagctgacctacaggctgtgctactgttggatgccttcaacaaagatagggcatccttgcaacagcccgttccagctcagcaaccagctgcagcgttacctcctcccgatcctcgtactcaagaaatgatcaatgaaaaactaaagaaagcagaagagcttggtgaacaagggatggttgatgaggcgcagaaagcactagaagaagcggaagctcttaagaagcttactgctaggcaagaacctgtagtggattcagccaagtacactgctgttgacgtgcgcattacagaccagaagctgcgtctatgtgacatatgcggagcatttttgagcgtctatgacagtgatcgtcggttagctgatcattttggagggaagcttcatttgggttacatgctgatccgcgacaaattggcagagcttcaggaggagaagaacaaagttcacaaggaacgggtcgaagaaaggagatcaaaggagagaagtagagagcgagaatcaagtaaagacagagacggaggagatagccgtgaccgtggaagagatgttgaccgtaggagtagagatcgcgacaggcaccatgaccaccgagaacatgacagaaactataatcagtcacgtggctatgactcgagaagccggcgcagttcgcggtcccggtctagggaaagaccgagggattatgatcgccgcagacgccatgaccgctactaagaccctgccaaagatggttgcaccgggtttaagaggttcttacagatgtgtttaggatcaatttggagttgcaaacactttcatttttctttgctcaagtgttttaaggattttttgagattgtaagttactaaagtttgtaagaggagcttctccagatatttttgatttttatgttgttgacatcaaaagacttgcgagtagaa

SEQ ID NO: 5996 - DNA, 1509 bp, Arabidopsis lyrata
atcaaaaacccaatctctctgttcgcagagaggatcaattcgtgattcagagaatcaaacttggtgtgtgtgagataacgaagatggacgctatgaggaagcaactcgatgtgctcatgggagctaacagaaacggcgatgtcacggaggtcaatcgcaaatactacgaccgtgatgtttgccgtcttcacctatctggtctctgccctcacgagcttttccaattgacgaaaatggatatgggtccttgcccaaaggtgcactctttgcagctgaggaaagaatataaagaagcaaaggcaaaaggtgttgacaactatgatagggaattggaagatgcgattgataggcttattgttgagtgtgataggaagattggtagggctcttaatcgtcttcaggaagaggatgccaaagctgccattgcaatttctgtcacagaatttactcagtcgcctgaaattcttgaattatcgaagcaaatcaaagagaagatgaaggaagcagacctgcacgatcttgaaggcaaaacagatctgaagattagagctcttgagttagttgaagagatgaggacgaagagagctgacctacaggctgtgctactgttggatgccttcaacaaagatagggcatccttgcaacagcccgttccagctcagcaaccagctgcagcgttacctcctcccgatcctcgtactcaagaaatgatcaatgaaaaactaaagaaagcagaagagcttggtgaacaagggatggttgatgaggcgcagaaagcactagaagaagcggaagctcttaagaagcttactgctaggcaagaacctgtagtggattcagccaagtacactgctgttgacgtgcgcattacagaccagaagctgcgtctatgtgacatatgcggagcatttttgagcgtctatgacagtgatcgtcggttagctgatcattttggagggaagcttcatttgggttacatgctgatccgcgacaaattggcagagcttcaggaggagaagaacaaagttcacaaggaacgggtcgaagaaaggagatcaaaggagagaagtagagagcgagaatcaagtaaagacagagacggaggagatagccgtgaccgtggaagagatgttgaccgtaggagtagagatcgcgacaggcaccatgaccaccgagaacatgacagaaactataatcagtcacgtggctatgactcgagaagccggcgcagttcgcggtcccggtctagggaaagaccgagggattatgatcgccgcagacgccatgaccgctactaagaccctgccaaagatggttgcaccgggtttaagaggttcttacagatgtgtttaggatcaatttggagttgcaaacactttcatttttctttgctcaagtgttttaaggattttttgagattgtaagttactaaagtttgtaagaggagcttctccagatatttttgatttttatgttgttgacatcaaaagacttgcgagtagaagattt

SEQ ID NO: 5997 - DNA, 1620 bp, Silene vulgaris
aatcctcaatcaatttaccgaagatttgaaaacaaaaaaatcaaagatggattcgcttcgaaagcagctagacgtattaatgggggcgaatcgaaacggagatgttagagaagtcaatcgcaagtatttcgatcgtgatgtttgtcgtctttttttatctggtctttgtcctcatgaacttttccaattaacgaaaatggatatggggccgtgtccgaaggtgcactcgctgcagctcaggaaagaatatgaagaggctaaagctaaaggggtcgataattatgaccgggatttggaagatgttatagatagactcattgtcgagtgcgacagaaagatcactagagctcttaagcgtcttgctgatgaggatgctaaagccgctattgcgatttctgtgactgaagtaacacagacagaagaaatcgatgagttgtcgaagcagatcaaagaaaagttgcaccaagttgatcagtttgatcttgaaggcaagactgatcataaaattcgactcctggaagaaattgatgagttgagaactaaaagagctgataaacagtctatgcttcttttagatgctttcaacaaagatagagccgctctaccacagccacttactaatgctcctccattggtgcctcttccggtggttgctcccgatgcccgtacccaggaactgataaatgagaagctgaagagggctgaggatcttggtgagcaaggaatggttgatgaagcgcagaaagttatggaggaagctgaagctttgaagaagcttgcaccaagaccagagcctgttggggattctgcaaaatatactgctgcagatgttcgcatcaccgatcagaagctccgtgtctgtgatatatgtggagcattcttgagtgtttatgacagtgatcgtcgtttagcggatcattttggtggtaagcttcatctgggttacatgcaaattcgtgagaagcttgctgagcttcaggaagagaagaacaagaaacgcaagctgattgaagatgatagaaggtccagagaacgtagccatgaccgtgaacgggcatccagcagggacagggacagaggtgatcgcagaagcagagatcgcgataggcatggtgacagagatcgtggttacgaccgtggagatagagaacgttctcgtagttatgatgccagaagtcggcgccgatctcggtctcgttccagggaacgctctagggactatgtccgtgattatgatcgaaacaggcgctatgatcgtgatcgctactagatgtgtactctacttatctagcctaggagtggtgcgtgatcaggtttcatgtcatccccgcccccttcccttagcgaggcaagagaacctttaagcattgtgttgtggatctatcatcgtagctgactgttaatcgtattggactaaggtcttgttgttgtggacaagtatcaggtgacctagaaaactagggagttaattggtaagtgaaaattcacctgtctatactctagtcctgccagatatattacttgagtttttattgtacaatcggtttccatgatctgtatgattaaaacgccatgtttcaagtcttgaagcttttgcaaaatctatagtattgggtagcc

SEQ ID NO: 5998 - DNA, 1595 bp, Vigna unguiculata
cggacgcgtcggcaaggagaggtttagtttagggaggggaaaaacattgtcttgtgtctatgtgcagaagctcaaggcattgaactcactctccttgggcagcatcaatggcggcagaatcatctcgcagaaaccccaaacgtccatttgtggaagaagatgacgaattaagcaaaaaaccaccagcaaaaaaggttaggtttccaaagggcaagaaagtgaagccaggagatgaagttgtcgacaaaggaaatgtcgaggagggtgaagttgacttaatgaatccccaagtagctgccaaagctgccaaagagcgggcaaatcaaagaaatcaatttactgctgaactctttagtgaggacactggaggtatcggaatagacttatcagttggtgaagtgacatatgaggataacgagaattttgttgacgatgggattcaaatcgagcctttcaacctagataaagaaagggaagaaggttattttgatgcagcaggaaattttgttgaatatgtaagagagaatgagattaaggatgcgtggcttgataatattgaagttgatccaaaatattctgcattaaaatctgtaccaactaatgatgtggatgagggcccggccgacctttcttctaaagatattggcatcatgaagaggcggattgcaaatgttcttgaacctggggaaacggttttgcaagccttgagaaggttaaaaggtagcagtgacagaaaggcaaaaatgtctgctgagactaaggttgtatttgaccagctaactgaggatgctatgaagctgatggagaatgatgtttatcatgaaaagcgagaggtttttgatcgtgaagcggaaggatatgagaagttagtgcgggcaaaggaaggcacgtcaaatcaacatttggctagtggagaagcctctggcaatggtgaaggtgattatgatatgtttgctgacgaggatgaacctgataccagtaagccatctacagatgaaaataatgcagttagccagtcttcatcggatgccataaattctggcattgagggtggagcattgcaaaatgattatgtgtttgatgaatcttctgggtactattacagcagcagtttgggctattattatgatccaaatactgggctttattgctctgcagcatcaggacaatggtactcatttaatgaggagactggcacctatgaagaagttgacgaggctgcatccaacgtgaactgagggacttgtctcagggaacaataggctagttatagcatagccacaatcattgtctgcgagtggctcatgtacagaccgaaacactcttgaactttttgtacgttatgagggactgctaccactgctcagagttgtgcttttatctcttataaggttgttgttttatattaactaaactttttgcttaaaaatcacttagaatgatcccttgaagttagaagcaatacaaattatacaatgtttacccatatcaatttgtgagacatgttcacttatgccctcaaattgcaaatcactttgcttgtgcaattagataattatttttttttacatcattttcttgaagagggcgtcaaa

SEQ ID NO: 5999 - DNA, 1397 bp, Vigna unguiculata
tgactttgatcttgcccaaaccaaaccctagctctcatttcttcgctctgtagccagtggaatctgcggagcagcaatcaccagcaggggctcctgcattgtggctttcaacatttaattgaaattggtaattgggaatggttttggtcttgctgctatactatctctagtttggtctcaactccttgtcagtttttgtagcatttgttttgttggggcagaccatggatgacttgtttgattcttctttgaacttggaggacacccattacaaggaaggctacgatgaaggccacagtgacggcctcgtcgctggcaaggaagaaggcagacaggttggcctcaaggttggttttgaaattggagaggagcttggtttctataggggttgtgttgacatttggaattcggcacttcggcttgatccgacttgtttctctccacgggccaaaacaattattggccagatggaggagttgattgagaaataccctctcatggatccggaaaatgtacaagtgcaagaaatcatggatagcctgaggctgaagttcaagatggtttgttcttccttgcatgtcaaacttgagtatagtggatatccaaagtcttctacagaggccaatgatattcagttttgagctacttgatattttcagtcttctagagataccagtgtgtagagagacacttagctggctagaattggctcagcttgataaggaagtggggtgatctgcaatacaaggtgtgaaaacagagatgcataatagaaaattggcttctggaaggccctctggaactgatggctccgattactccttccggatggttgttgattcaaggtatcagctagttgcaaaggggaagaaacgcctctccctgcactttattaccgaggctgcgttgctaataataggagcaatatttgcatattttccaggaatagaagcagatactctaaatacagttgcctattcgtctgtttttgttagtgttgtttcactaatcattgggaatataggtagaagacgcagtcgatctggcttattgagattttatgcaatcgtatcctccattgcaatgcttcccttgattgcttctcttgcaaagaaacatctgttactgaaggctatccaggattctaaactttggagtgcagggaagtatgatgtcaatgatctatctcatttccaaattggcttgctgttatatctagtcaccttgtctgtgctcaagctttgtactgtcaaagcagttgtttcacttctttttaacatggctccacccaagaaaacctcttagccccttcaacagtttggggtccaaatccaactttctgtcattgttctttatgtcactatcttttatgagagatgttgaggtcagctgagaga

SEQ ID NO: 6000 - DNA, 1230 bp, Cajanus cajan
agtttaatctaaaattaaatgaaaaagaaatgggagatatttgacggtgaaattcttacgcgaacggaagtctgaaaccaaaccctagctccattgtttcacttcttctctcttcagcttgtggcagtggcagaacagcaatcacaggcaggtgattttatttttctttccttctgttttgtttgcgcttgcttttgttgttcgagaggacctatttttctttctgcctttttttctggagaagatcgaatgggaaatgaaattgaatcagtaagcactgtttacattaacatcggtggaagttttacgctattctctatgtgtgttgtttaatttcttagtgaattttatgattattggatttgggcttgttttgtgagaaattacagtgcagacttctttccaatcttgataaaatgtctgctgcattgttgcttattttcacttgattggaatcgggttttggtccttttactatgttatatcacctttagtttgatctcaacttggtatcagttttgtagcatttgttgtgttggagcaggcccatggatgacttgtttgattcctcgctgaatttggaggacacccattacaaggaaggctatgatgaaggctacagccatggccttgtcgctggcaaggaagaagccagacaggttggcctcaaggttggctttgaggttggtgaggagcttggtttctatagggggtgtgttgacatttggacttctgcaatccagcttgacccgacctgtttctctccaaggggcaaaacaattattggccagatggaggagttgatccagaaataccctctcatggatccggaaaatgtacgagtgcaagagatcatggatagtcttaggcttaagttcaagatggtttgttcttcattgcatgttaaacttgagtataatggctatccaaaatcttctacagaggccaatgatattcagttttgagccacttaagatagtttcagtcttctagagatatccaagtgtagagaaacactaagttggttataattgactcagcttgattaggaaggagggtcatctacatttcaaggtgtgaaaacaaagaagatgcaacatagaaaattggcttctggaaggccctctggaactgatggctctgattactcctaccgtatggtagttgattcaaggtatcaattggttgcaaaggggaagaaacgcctctctcgacactttatcattgagg

SEQ ID NO: 6001 - DNA, 434 bp, Glycine max
ctatggatgacttgtttgattcttcactgaacttggaggacacccactacaaggaaggctatgacgaaggctacagccatggccttgtcactggcaaggaagaagctaggcaggtcggcctcaaggttggctttgaggtgggcgaggagcttggtttctataggggttgtgtcgacatctggactactgcgatccagctcgacccaacctgtttctctccacgggccacaaaaattattggccagttggaggagttgatccagaaataccctctcatggatccggaaaatgtacaagtgcaagagatcatggatagcctcaggctcaagttcaagatggtttgttcttccttgcatgtcaaacttgagtataatggttatccaaaatcttctacagaagccaatgatattcaattttgagctacttatgatatt

SEQ ID NO: 6002 - DNA, 724 bp, Glycine max
gatacctatagattccccaaatctaacactagcttgcgtgccctagctcactacgtcgctcgtcacggttccgtcagtgcttttccgccgccgtcgcggttcaaacttgaaaagcgtttgttgtgttggagtaggctatggatgacttgtttgattcttcactgaacttggaggacacccactacaaggaaggctatgacgaaggctacagccatggccttgtcactggcaaggaagaagctaggcaggtcggcctcaaggttggctttgaggtgggcgaggagcttggtttctataggggttgtgtcgacatctggactactgcgatccagctcgacccaacctgtttctctccacgggccacaaaaattattggccagttggaggagttgatccagaaataccctctcatggatccggaaaatgtacaagtgcaagagatcatggatagcctcaggctcaagttcaagatggtttgttcttccttgcatgtcaaacttgagtataatggttatccaaaatcttctacagaagccaatgatattcaattttgagctacttatgatattttcagtcttctagggatatccatgtgtaggaaaactctgagttgggcaagttaatgaacaaattacatgttctcattttacaaacattttgtgtaagtcaatgtattgaataattattttataataaaaatgataatgtatacattgtttatgaa

SEQ ID NO: 6003 - DNA, 824 bp, Glycine max
gaaggatgtctcggcaggtgagcttgggaggaaataatatcatttccgttctcaaaatcataacagtacttcgcgtgccctagctcactccgtcgctcctcacccttccggcagtgcttggtcgtggccgtcacggttcaaacttcaaaagcatttgttgtgttggagtaggctatggatgacttgtttgattcttcgctgaacttggaggacacccattacaaggaaggctatgacgaaggctacagccatggccttgtcactggcaaggaagaagctaggcaggttggcctcaaggttggctttgaggttggcgaggagcttggtttctataggggttgtgtcgaaatctggacttctgcgatccggctcgacccaacctgtttctctccacgggctaaaacatttatttgccagatggaggagttgatccagaaataccctctcatggatccagaaaatgcacaagtgcaagagatcatggatagcctcaggctcaagttcaagatggcttgttcttccttgcatgtcaaacttgagtataatgggtatcccaaatcttctacggaggtcaatgatattcaattctgagctagttatgatattttcagtctttagggatatccatgtgtagggaacctctgagttgggttagttgatgaacaaattacgcgttatcattttacaaacatttgtgcaagtcaatgtatcgaataattattttatattaaaaatgatgatatatacattgtttatgaacgtaatcttggtaaattgtgtagagaatatttaatatttatacaagaatcactgctttcttttgt

SEQ ID NO: 6004 - DNA, 887 bp, Glycine max
gactacattttaatggttcgaaggatgtctcggcaggtgagcttgggaggaaataatatcatttccgttctcaaaatcataacagtacttcgcgtgccctagctcactccgtcgctcctcacccttccggcagtgcttggtcgtggccgtcacggttcaaacttcaaaagcatttgttgtgttggagtaggctatggatgacttgtttgattcttcgctgaacttggaggacacccattacaaggaaggctatgacgaaggctacagccatggccttgtcactggcaaggaagaagctaggcaggttggcctcaaggttggctttgaggttggcgaggagcttggtttctataggggttgtgtcgaaatctggacttctgcgatccggctcgacccaacctgtttctctccacgggctaaaacatttatttgccagatggaggagttgatccagaaataccctctcatggatccagaaaatgcacaagtgcaagagatcatggatagcctcaggctcaagttcaagatggcttgttcttccttgcatgtcaaacttgagtataatgggtatcccaaatcttctacggaggtcaatgatattcaattctgagctagttatgatattttcagtctttagggatatccatgtgtagggaacctctgagttgggttagttgatgaacaaattacgcgttatcattttacaaacatttgtgcaagtcaatgtatcgaataattattttatattaaaaatgatgatatatacattgtttatgaacgtaatcttggtaaattgtgtagagaatatttaatatttatacaagaatcactgctttcttttgttatttttgtgcatagttgttagaattgtgtggtttgtaactatg

SEQ ID NO: 6005 - DNA, 808 bp, Lupinus angustifolius
tagtttaggtaaggaacaaagcccataacctaaaggattagtttaggtgaagatcctctctacaagggcaattgcaaagaaacaaaagcctagcaaaaaccatactctccatacataaaacatcttttgtctgtaaccacaaaaccttgtatcatcgttaaagttcaaatcttttcttcccaaatcatcagccatggacgacatcttcgattcttctctgaatttagaggaaacccatttcaaggaaggctacgacgaaggttacacccacggcctcatctccggcaaggaagacgccacccaagtcggtctcaaggtcggttttgaaatcggtgaggaactcggtttctacagaggctgcgtcgatatctggacctctgtgattcgggtcgacccgacccaattctcgcaacgtgcaaaaacgggtatcacccagatggaggagttgcttcacaagtaccctctcatggaccctgaaaactcgcaagtgcaagagatcatggatagcctcagaataaagttcaagatggtttgttattctttgcatgtgaagcttgagtataatggttatcccaaatcttctgctgaggccaatgatattcagttttgattttgaaggtagtaatagcatttgggaggaaaagaagtttcttttttgtgtgggagtctagaagttattctttggttatggagacaattaagattccatgaattgtttccttgtcatggtctttcttgtaatgctatatatataattttatttaaggcaccctgaaatctgattaataatatttcaaattattcttgt

SEQ ID NO: 6006 - DNA, 1095 bp, Lupinus angustifolius
ccacaacgcaaacaaacaaaaaaccatactcttcaatcttcatacctaaaaaatcatttgtttctgatcagaaaagttcgtatcatagtttaagttcaaatcttttattccgaaatcatcaaccatggacgacatcttcgattcatctctgaatttggaagaaacccatttcaaagaaggctacgacgaaggttacacccacggcctcatctccggcaaagaagacgccacccaagttggtctcaaagttggttttgaaatcggtgaggaactcggtttctacagaggctgcgtcgatatctggaactccgttattcgggtcgacccgacccaattctctcaaagggcaaaaacgggtatcacccagatggaggagttgcttcacaagtaccctcttatggaacctgaaaactcccaagtgcaagaaatcatggatagcctcagaatcaagttcaagattgtttcttcttctttgcacgtcaagcttgactataatggttatcccaaatcttctgctgaggccaatgatattcagttttgattttttaaggtagtaatagcacttgggaggggaaaaaagtttcttttctatgtgggtgtctagaagttattctttggttatggagacaattaagattccatgaattgtttccttgtcatgctctttcttgtaatgttacatatatcatttaattttaaggtaccctgaaatctgataaatgatatttaaaattattcttgtggcaagaagcttggttccctttgtgatttctcttaagcaagttgtcaactttgagcattaaggtatcatttgattaactgatcggctcgtgtgattaaggtttagttgttgttggtaggtatcagcttcaagccttgtgaataatataataggcgcaggaatgttctgccccttaaataggttttggttcgaattacattagtcggtatctgacaagtttacttactcatatttttattgatgttatatttcttctaggactgagtgtagtttcgtttttagctttttgttctacttgaagtactgtcaaaatatataatatactatggagtatggattttctgttgccattt

SEQ ID NO: 6007 - DNA, 1049 bp, Glycine max
aaaaacatgaatcataaaaaaatttctctgtcaaacacgtaggtttctatgaaacattttcctttttaaaagtaagttcctttccatgctacgctacgcaccttttcaccggttttccatcttctgaatcccacgaattccaaatactagagacaccttacttcattttttttttccagcatctgagaattagcagtgagtaacaattgagaatgaacaaaggtgcagccggaggattagggggcggcgctggcgccggaagcgggcccactgcggctgcggcggcggcggcggcgcagaagcggaagactctggtgcaaagagtcgaaggcgatatcgccaacatcgtcgacaatttcagccaccttgtcaacgttgcaagggtaaatgatccactagttagaaattcacaggaagcttttatgatggagatgcgtgctgctaggatggtccaggcagctgattctctattgaagttggtgtcagagcttaagcaaactgcaatattttcaggatttgcctctcttaatgatcatgtagaacaaagaaggattgaatttaatcagctggcagaaaaaacagatcacacattatccagagtaggggaggaagctgctgctagcctaaaagaacttgaatctcattattcttcttctgcactgaagactatgcaaaacctgcagccatagttaagaatctatcgatgcaatgagcacttatcacttgatggattatgctttttttagtgtaataggtttttttttggtttaaaatcgttgtaatatccttgtttggattaggattaagaagtagaaactgttatttctttaccgaggaaatggaaagcatgattataattattgataagcaaggaatttcaaatgatgtggctgttgtaacaaatttctgttatctgaaatcgtttaagacatgtttggtggttaggatataataagatgggatagaataaaaggggacatttttatattttttggtacatattttgttaagttatctaattgcatttatgagaatacgaaggttgggat

SEQ ID NO: 6008 - DNA, 989 bp, Glycine max
cctttttaaaagtaagttcctttccatgctacgctacgcaccttttcaccggttttccatcttctgaatcccacgaattccaaatactagagacaccttacttcattttttttttccagcatctgagaattagcagtgagtaacaattgagaatgaacaaaggtgcagccggaggattagggggcggcgctggcgccggaagcgggcccactgcggctgcggcggcggcggcggcgcagaagcggaagactctggtgcaaagagtcgaaggcgatatcgccaacatcgtcgacaatttcagccaccttgtcaacgttgcaagggtaaatgatccactagttagaaattcacaggaagcttttatgatggagatgcgtgctgctaggatggtccaggcagctgattctctattgaagttggtgtcagagcttaagcaaactgcaatattttcaggatttgcctctcttaatgatcatgtagaacaaagaaggattgaatttaatcagctggcagaaaaaacagatcacacattatccagagtaggggaggaagctgctgctagcctaaaagaacttgaatctcattattcttcttctgcactgaagactatgcaaaacctgcagccatagttaagaatctatcgatgcaatgagcacttatcacttgatggattatgctttttttagtgtaataggtttttttttggtttaaaatcgttgtaatatccttgtttggattaggattaagaagtagaaactgttatttctttaccgaggaaatggaaagcatgattataattattgataagcaaggaatttcaaatgatgtggctgttgtaacaaatttctgttatctgaaatcgtttaagacatgtttggtggttaggatataataagatgggatagaataaaaggggacatttttatattttttggtacatattttgttaagttatctaattgcatttatgagaatacgaaggttgggat

SEQ ID NO: 6009 - DNA, 669 bp, Glycyrrhiza uralensis
aaagagaaaagctggatccgaccgactccgagtacaccaggacaggagggtcgagggcgcgactgagacagacagccacactctttctgcttcttagaacatctaagagaagaagggagaatgaacaaaggcggaccaggcggcggcggcggtagcggccccacggcggctgctgctgctgcggcggctcagaagcagaagacgctgttgcagagagtggaaggcgatatcgccaacatcgtcgacaatttcagccacctcgtcaacgttgccagggtaaacgatccacctgttagaaattcacaggaagcttttatgatggagatgcgtgctgctaggatggtccaggcggctgattctctacttaaattggtgtcggagctgaagcagactgcaatattttcaggatttgcttcccttaatgaccatgtagaacaaagaagggttgagtttaaccaactggcagaaaaaacagaccacacgttatctagagttggagaggaagctgcagctagcctgaaagaacttgaatctcattattcttcttctgcgcagaagactattcaaaatctgcaaccgtagttgagaatctatttcaatgcagcttgcacctgtcacttgatgtaaaatatttttctggtatagaagtaggttcaccccccccccccc

SEQ ID NO: 6010 - DNA, 923 bp, Cajanus cajan
tctcgatctcaatctcacatttccaagcactgatagaaaacacaaaaaatctcacactgagaagtagtagtagtagtgagtaacaattgagaatgaacaaaggtggagcaggagggttaggtggtggttccggcgccggaagcggacccacggcggcggccgctgcggcggcggcgcagaagcagaagacgctgctgcatagagtcgaaggtgatatcgccaacatcgtcgacaatttcagccacctcgtcaacgttgcaagggtaaatgacccaccagttagaaattcacaggaagcttttatgatggagatgcgtggtgctaggatggtccaggcagctgattcactattgaagttggtgtcagagttgaagcagactgcaatattttctggatttgcctctcttaatgatcatgtagaacaaagaaggaatgaatttaatcagttggcagaaagaacagatcgcacgttatccaatattggggaggaagccgctgctagcctaaaagaacttgaatctcattattcttcttctgcgcaaaagactttgcaaaacttgcaaccatagttgagaatctatgaatgcagtgtgcatagtctcttttagtataatagttttttttttttcttggtttgaaatctttacaatatccttgtactgtataatctcttcattgagaaaattgaaaaacaaattagttgcattcattttgaatctttggatgtaattagcatattagaaaggggcaaaatctttggttcactctttcatgggattacaatttctgaggtgcaagcaatttcaaatgaattgactatcttaataaaattgtcatctgaaattgtttaggacatgttggagctagactgtgagagtatgattaaatatgatagaatatgagaagacttttgtattaagtta

SEQ ID NO: 6011 - DNA, 812 bp, Lupinus angustifolius
catgtttagggttagggttgttttttgaatttgttctttatgcttaataattaaatcttgaaaggttgtgtaagtgagattggtgaaggagaatgaataaaggtggaggagcgttaggtggtggtggtggaagtgggcccactgctgcggcagctgctgcggctgctcagaagcagaagacgttgctgaacagggttgaaggtgacatcgctaatatcgtcgacaacttcagccaccttgttaatgttgctagggtaaatgatccaccagtaagaaactcacaggaagcttttatgatggagatgcgtgctgctagaatggttcaggcagctgattctctacttaagttggtgtcggagttgaagcagacggcgatcttttcaggatttgcttcgcttaatgatcatgtagaacaaagaagggttgaattcaatcaattgggagaaaaaacagataggttgttatctagaattggagaggaagctgctgctagccttacagaatttgaatctcattattcttcttctgcacaaaagactattcaaaacttgcaacaaccatagttaagagtgtattcatgcagcttgcatcaatcacttgatgaaatatttttatgcttataaaattatatgggttttaaagctttatgaatttccttgtttggatgactgtaatataggattaggaagtagaaattgttattccatttatgaggaaatggtgattatgaaatttggcttgctcattttgtatgtatgaaatgtatgtggtgtaaattagaaataggataaatgagttttcttatatcaaaa

SEQ ID NO: 6012 - DNA, 1226 bp, Glycine max
gatttattagcatcgaattcattccttaaaagtaaaagtagctagttgggtaaataaatggtaaaggtagctggtggaggaaatttgatttccattctatactacacttttcagttttcaccccttttctttaaattcactattttcatcttttcaatcccacgaattccaaatactatagacacctttttctaccatctacagtgctgagaagtagcagtgagcaacaactgagattcttgttagaaaagaatgaacaaaggtgctgcaggagggttagggggcggcgccggaagtgggcccaccgcggctgcggctgcagcagcggcgcagaaacagaagacgctgttacaaagagttgaaggcgatatcgctaatatcgttgacaatttcaaccacctcgtcaacgttgcaagggtaaatgatccaccagttagaaattcacaggaagcttttatgatggagatgcgtgctgctaggatggtacaggcagctgattctctgttgaagttggtgtcagagctgaagcagactgcaattttttcaggatttgcctctcttaatgatcatgtagaagaaagaaggattgaatttaatcagctggcagaaaaaacagatcgcactttatccagagttggggaggaagctgctgctagcctaaaagggcttgaatctcattattcttcttctgtgcagaagattatccaaaacccacaaccatagttaagaatttatcaatgcagattaagaagtagaaacgttaatttctgtactgagaagaatggaaagcaaatagccagcactgagtgagtggatgtaattagatgaggagtcaacttggaaagaggcaagatcgttgtgcactctttcatatgattacagttactgggaggtaagaaatttcgaatgatgtggttgttgtaacaaatttctgttatctgaaatcatttaggacttgttcggtggctaagatataattaggatagaatataaggagacactttgctgaagttatcaatgtcatttatgagaatacgaaggttgggatatttattttgaagtttgttaggatgtatatttttgggggtattttattcctacaaaaattatattcccatgttctagtagattttattcccaagattcccttgtgtagggttgttgagtaacttttacaaagaaaaagttataaagaacacgaacaagaataaaatttcttaaaactt

SEQ ID NO: 6013 - DNA, 1181 bp, Glycine max
cgaattcattccttaaaagtaaaagtagctagttgggtaaataaatggtaaaggtagctggtggaggaaatttgatttccattctatactacacttttcagttttcaccccttttctttaaattcactattttcatcttttcaatcccacgaattccaaatactatagacacctttttctaccatctacagtgctgagaagtagcagtgagcaacaactgagattcttgttagaaaagaatgaacaaaggtgctgcaggagggttagggggcggcgccggaagtgggcccaccgcggctgcggctgcagcagcggcgcagaaacagaagacgctgttacaaagagttgaaggcgatatcgctaatatcgttgacaatttcaaccacctcgtcaacgttgcaagggtaaatgatccaccagttagaaattcacaggaagcttttatgatggagatgcgtgctgctaggatggtacaggcagctgattctctgttgaagttggtgtcagagctgaagcagactgcaattttttcaggatttgcctctcttaatgatcatgtagaagaaagaaggattgaatttaatcagctggcagaaaaaacagatcgcactttatccagagttggggaggaagctgctgctagcctaaaagggcttgaatctcattattcttcttctgtgcagaagattatccaaaacccacaaccatagttaagaatttatcaatgcagattaagaagtagaaacgttaatttctgtactgagaagaatggaaagcaaatagccagcactgagtgagtggatgtaattagatgaggagtcaacttggaaagaggcaagatcgttgtgcactctttcatatgattacagttactgggaggtaagaaatttcgaatgatgtggttgttgtaacaaatttctgttatctgaaatcatttaggacttgttcggtggctaagatataattaggatagaatataaggagacactttgctgaagttatcaatgtcatttatgagaatacgaaggttgggatatttattttgaagtttgttaggatgtatatttttgggggtattttattcctacaaaaattatattcccatgttctagtagattttattcccaagattcccttgtgtagggttgttgagtaacttttacaaagaaaaagttataaag

SEQ ID NO: 6014 - DNA, 656 bp, Lupinus angustifolius
gagagtggtgaaggagaatgaataaaggtggaggagtgttaggtggcggtggcggtggcggaagtggccccactgcggcggcggctgctgccgctgctcagaagcagaagacgttgctgaatagggttgaaggtgatatcgctaatatcgtcgataatttcagccaccttgttaatgttgctagggtaaatgatccaccagtaagaaactcacaggaagcatttatgatggagacgcgagctgctaggatggttcaggcagctgattctctacttaagttggtgtcggagctgaagcagaccgcgatcttttctggatttgcttctcttaatgaccatgtagaacaaagaagggatgaattcaaccaattgggagaaaaaacagacaggttgttatctagaattggagaggaagctgctgctagccttacagaatttgaatctcattattcttcttctgcacaaaagactgttcaaaacatgcaaccatagctaacaatgtattcatgcagtttgcatctatcacttgatgaaagatgttttatggtataaaattatatgggttttaaagctttatggatttccttgtttggatggctgtaatttaggattaggaagtagaaattgttattctatttatgaggaaatggtgattat

SEQ ID NO: 6015 - DNA, 1077 bp, Medicago truncatula
agaaaagaacacaagttcttccctcttctcttcttcgttcctccatctatacacaacaacaaaccaccaattctcaaaattatattcttccaccattccccaacttgaagcacttgattacaaagtcaggaagttagaaacaaagaggagcttttgaattagggttcaattgaagaggagaaattaggaaataaagcttagagcaaagaattagagaaagagttcgcatcaaaggaagagttaaggagctagcatcaccatctcatttatcaattaagagtttcatcaccgagtggagaataagagaatgaacaaaggtggaccaggcggaggtgggcccactgcggcagcggcggcagcggctgctcagaaacagaagacgttgttgcagagagtggaaggtgatatcgccaacattgtggacaatttcagccacctcgtcaatgttgccagggtaaatgatccacctgttagaaattcacaggaagcttttatgatggagatgcgtgctgctaggatggtccaagcagctgattcgttacttaaattggtatcggagctgaagcagactgcaatattttcaggatttgcttcccttaatgaccatgtagaacaaagaaggcttgagtttaaccaactggcagaaaaaacagaccacacattatctacgattggagaggaagctgcagctagcctgaaagaacttgaatcccattattcctcttctgcgcagaagactattcaagatgtacaaccctagttgagatcaaatcaatgttgctggcatctgtaacttgatgtaagatatctttagtataaaagtaggttgtatttttttgtttaatgatagtgaatctcaacgcagtggttagagacagagttgtttgtgtgacttggaggttgtaggtttgtggaatagactcacaaacttgtcaacttttaatttaaaaatatttataatttccttgtttggatgactgtataatttctcacaaatctacatttccatccaatctagtgctaggtactccctccggtctccaattatacatatcggattcaattttttaatcaaat

SEQ ID NO: 6016 - DNA, 1061 bp, Medicago truncatula
ctctaatcacaccaaacaccgtgagacacccactcttcttctcgcctcacgactctgttcttactcagtcacgtttcccgccgctggtttctcttctctcgcctcttgttgtcagaaaagggaaagattcaaagaaccaacttcttggctttgtcaggaggaaccccaatttcagtatatataactacgacaagaaaaattcgataaagacactgctatcacactttgcctttttcacgactttgttgttctttaattggttagccgacccctcaagagtttcatcaccgagtggagaataagagaatgaacaaaggtggaccaggcggaggtgggcccactgcggcagcggcggcagcggctgctcagaaacagaagacgttgttgcagagagtggaaggtgatatcgccaacattgtggacaatttcagccacctcgtcaatgttgccagggtaaatgatccacctgttagaaattcacaggaagcttttatgatggagatgcgtgctgctaggatggtccaagcagctgattcgttacttaaattggtatcggagctgaagcagactgcaatattttcaggatttgcttcccttaatgaccatgtagaacaaagaaggcttgagtttaaccaactggcagaaaaaacagaccacacattatctacgattggagaggaagctgcagctagcctgaaagaacttgaatcccattattcctcttctgcgcagaagactattcaagatgtacaaccctagttgagatcaaatcaatgttgctggcatctgtaacttgatgtaagatatctttagtataaaagtaggttgtatttttttgtttaatgatagtgaatctcaacgcagtggttagagacagagttgtttgtgtgacttggaggttgtaggtttgtggaatagactcacaaacttgtcaacttttaatttaaaaatatttataatttccttgtttggatgactgtataatttctcacaaatctacatttccatccaatctagtgctaggtactccctccggtctccaattatacatatcggattca

SEQ ID NO: 6017 - DNA, 920 bp, Trigonella foenum-graecum
atcatcttcctcacatcaagttcctcctgtgaaacgattcccatacaccttcaactgcaactcccaactcgctcaaaccccttcttgctcgcagaacccaaaccctaatcgctcaaactcggttgattcgagtcaataaagacactgctaccaccatctaaattcacaaagcaacattttggcttttcacgactttgttgttttttaatttgttagtcggcccctctgagagtttcatcatagaggggagaagagaatgaacaaaggtggaccaggtggaggtggacccactgcagcagcagcggcagctgctgctcagaaacagaagacattgttgcagagagtggaaagtgatatcgccaacattgtcgacaatttcagccacctcgtcaatgttgccagggtaaatgatccacctgttagaaattcacaggaagcttttatgatggagatgcgtgctgctaggatggtccaagcagctgattctcttcttaaattggtatcggagctgaagcagactgcaatattttcaggatttgcttcccttaatgaccatgtagaacaaagaagggttgagtttaaccaactggcagaaaaaacagaccacacattatctacaattggagaggaagctgcagctagcctgaaagaacttgaatcccattattcctcttctgcacagaagactattcaaaatgacaaccgtagttgagactctaccagtgctctgcatgcacctgtcacttgacgtaagatatctttagtttaaatgtagattgtatttttgttgtgatagagaatcttgacgcaatggttagagacagaattgtcttggtaactaggaggttgtaggttttatgaatgactattgcaaatgtaagacaaggtcgcctacaatagatttgcaatgggattggagg

SEQ ID NO: 6018 - DNA, 1142 bp, Pisum sativum
tttctgggtcatgtgcatcttatttttaacttacacagaaaaactgagcttctttttcacctgcttactaggttaaccgtcgccggtccatatttctcgaccaccgtcgccgttgtggattaacaccaccgcgccggtccctctatctcggttgtggtccttattttctcatacgataaaggcactgctaccacccatctaaactcacaatgcaaaattttcccttttgaccacttcactcttcttcaattggttagtcgacccctccgagtgcttgtcacagagaggagaagagaatgaacaaaggtggaccaggtggcagtgggcccactgcggctgcggctgcagctgcggcacagaagcagaagacgttgttgcagaaagtggaaggtgatattgccaacattgttgacaatttcagccacctcgttaatgttgccagggtaaacgatccacctgttaggaattcacaggaggcttttatgatggaaatgcgtgctgctaggatggtccaagcagctgattctctacttaaattagtgtcggacctgaagcagactgcaatattttcaggatttgcttctcttaatgaccatgtagaacaaagaaaggttgagtttaaccaactggccgaaaaaacagaccacacactatcgaggattggagaggaagctgcagctagcctgacagaacttgaatcccattattcttcttctgcacaaaagactattcaagatatacaacaaccatagttgagattctatatcaatgcttcttgcacatgtcacttttaagatatcattagcataaaagtactagtagattgtatctttttgctcttttttttggaaagcgaggcttgacacaagggttagagttgtctgcatgaagatgaggttgtaggatcaagttgtggaatcagatttatgcaaatataagacaaggctttgcagtagatttaaaatttatatgttttccttgtttggatgattgtagttcattattaggaattgttattccattgtatagaaaatggaaaacaacatagcctcgcacattctaaatgcatggataaactcattcaaatgattgctaactaaacgaatagcaagcaatatttcatatctcaaaaaaaaaaaaaa

SEQ ID NO: 6019 - DNA, 678 bp, Prunus mume
tgtagtgtaagggacgagagagagagaagaagaatgaataaggggggaggtgcagcgtcaggtggcggattgggaggtgggggaagtgggcccactgcggctgcggcggcagcagcagctcagaagcagaaggcgttgctgcagagagtggagacggacatcgccaacatcgtcgacaatttcagctccctcgtcaacgtctccagggtgaacgatcctcctgttagaaactctcaagaagctttcatgatggagatgcgtgcagctagaatggttcaggcagctgattctctgctcaagttggtgtcagaactgaagcagacggcaattttttcgggatttgcctcccttaatgaccatgtagagcaaagaatagtggagttcaaccagcaggctgagaagaccgaccagatgttggctagaatcggagaggaggcagctgctagcctcaaggagcttgaatcccattactattcttctgcactgaggactagtgaaaacttgcagccatgaacttgacaataatttaaactagacattagtttggtgattgtttcttgaatcatgtatacacaggcagaaacaatgtacttgtacgatgcaaacagattttcactcttaaaatatcttttattttcgccctgaattgaattgaatgaattctatcgttatttttgg

SEQ ID NO: 6020 - DNA, 733 bp, Prunus persica
ctcctccccatcgcagtgcttcgccggacttctgccaccgctctaccagacttctgactctgttcctccgctctactccttcctccacggttatagtgtaagggacgagagaaagagagaagaagaatgaataaggggggaggtgcagcgtcaggtggcggattgggcggtgggggaagtgggcccactgcggctgcggcggcagcagcagctcagaagcagaaggcattgctgcagagagtggagacggacatcgccaacatcgtcgacaatttcagctccctcgtcaacgtctccagggtgaacgatcctcctgttagaaactctcaagaagctttcatgatggagatgcgtgcagctagaatggttcaggcagctgattctctgctcaagttggtgtcagaactcaagcagacggcaatcttttcgggatttgcctcccttaatgaccatgtagagcaaagaatagtggagttcaaccagcaggctgagaagaccgaccagatgttggctagaatcggagaggaggcggctgctagcctcaaggagcttgaatcccattactattcatctgcactgaggactagtgaaaacttgcagccatgagcttgacagtaatttaaactagacattagtttggtgattgtttcttgaatcatgtatacacaggcagaaacaatgtacttgtacgatgcaaacagattttcattcatcaaatattttttattcaccc

SEQ ID NO: 6021 - DNA, 1500 bp, Cicer arietinum
ccttaactaaaaacccacaaaaatagtcgcttttttctgttcttttctgactttcttagcacatatgataaacgtgtgggacccagcaattttattctttcgtctctatttctccttttctttctcttcactatttcgttcccttctaaatcactcaaaccaaacacacccacaccacaacctgtagaaacgagtagaagctactgccgtttcacctgtgaaggcttcatcactttgtcactgagtttcgtcacaaggaaagaaggagagaatgaacaaaggtggaccaggtggtggtgggccgaccgcggcagcagcggcagctgcagcccagaagcagaagacgttattgcagcgagtggatggtgatattgctaacattgtcgacaattttagccacctcgtcaatgtggccagggtaaatgatcctcctgttagaaattcacaggaagcttttatgatggagatgcgtgctgctaggatggttcaaggagctgattctctacttaaattggtgtcggagctgaagcagactgcaatattctcaggatttgcttcccttaatgaccatgtagaacaaagaaaggttgagtttaaccaactggcagaaaaatcggaccgcacattatctaggattggagaggacgctgcagctagcctgaaagaacttgaatcccattattcatcttctgcacagaagactaatcaaaatatggatccgtagttgagaatccacatcaatgctttgctttcacctgtcacttaatgtatgatatctttagtataaaaatagactgtattgtttttccgaaagtgagtcttggcacaacggttagggttgtatgactaggaggttgtaggttctaagttgtggaataatggaatcaatctcttgcaaatttaagacaaggttgtctacaatagatctgcaatgagattgacccttttatggatctacaattttgttgtttggacttctttatctcttttattaggaatggttatgacttaactcattattaggaattgttatcccattatagagaaaatagaaagcaacatagccttgcatattataaatgcatggaatattagacgtagttgtgccatatggaagaatgtagaattaaatgagaagcacgcaatcatttaacgtgtgatttttctccgtcatctcattttgtcttcatctttgtcatttggtagttttgttgtcaattaatgttccaatgtcattgttactgccaccttaattcttcaaccatttctgcgacactatctactgttggagacactattgttgcttggcatcaggtgtggtttttgttgtctaatattactctcttgttgggttttggaattgacaatatagtgaaatggggaatttcaagtgttttaaaactttccaaggatctatgcattaaccatacataatgtttagagagttgcctctcatgagaatgcaattataggatacctgtattgttaatgtaacgccct

SEQ ID NO: 6022 - DNA, 926 bp, Arachis hypogaea
ttcaagacagactcaaggccccaaccatccccaacctctggtctcagctcactcccaaagaatcacagattcactcgctctcgctcactcaccgcagttccgcacggtcaccgccgaacacaacggctgccaacgacggaggacgtcactcgtcgcttccctagccggctcctctgcctcgtccccacgccgccagtgtctgctcgcctctgccttctccatctgtgtcgtccccgccgccttggctccggcgtgcctagcctgtctctgccttcgcctcggcctcgtgcctcttctgcctctgcttcctccatcgtcatcgtgttggctcctcttcgaagctctgctctcgttcaccggtggactgctctgcaaccgcgaacactgcaacggccccaagttggaaaaccgtccctgactttgtttctgactttcggcttctgcagcgtagtgtaggtccgagtgaataaacaaaatgaataaaggaggaccagtaggtggaggagggttgggggttggtggaagtgggcctactgcagcggctgctgcagctgctgctcagaagcagaagacattgctgcagagggtggaaggtgacattgccaatattgtggacaatttcagccaccttgtcaatgttgccagggttaatgatccacctgttagaaattcacaagaatcttttatgatggagatgcgtgctgctaggatggttcaggcagctgattcgttacttaagttggtctcggagctgaagcaaacagctatcttttcagggtttgcttctcttaatgaccatgtagaacaaagaagggttgaatttaacgaactcggggagaaaactgatcgtttgttgtctagaattggagaagaagctgctgcaagtcttaaggaacttgaaactcattattcttcttctgcgcaga

SEQ ID NO: 6023 - DNA, 513 bp, Bruguiera gymnorhiza
ggagcgagaatgaacagaggcggggtgggagttgggcccggcggggctctaggagcgggaagtggacctacggcggcggccacggcggcagcggctcagaagcagaaaacgttgatgcagagagtcgagacggatattgctaacatcgtcgacaatttcacccacctcgtcaacgttgccagggtcaatgaaccaccagttagaaactctcaagaggcttttatgatggaaatgcgtgctgccagaatggttcaagcagctgactcattacttaagttggtgtcagagctgaagcaaacagcaattttttcaggatttgcatctcttaacgatcacgtagaccaaaggataactgagtttaatcatctagctgagaaaacagatcgcatgttagctagagttggagaggaggcagctggtagcctcaaggagcttgaatctcattactattcttccgctcacaggacaaatcaaaacctgccgccatgaaatgaggtctataattatatcagt

SEQ ID NO: 6024 - DNA, 589 bp, Euphorbia peplus
atttgaacttgtttcactctattcggtttgtttcaagctggtgagaatagaataaaggtggagctggacctggggtttctggaggagggggaagtgggccgacagcagctgcagctgcagctgccacacaaaagcagaagtcattactgcaaagagtagaaacagatatcgccaacatcgttgataatttcactcaccttgtcaatgttgccagggttagtgaccctcctgttagaaattcgcaagaggctttcatgatggaaatgcgtgctgccaggatggttcaagctgctgactctctacttaagttggtgtctgagcttaagcagactgcaatcttttcaggatttgcctcgcttaatgaccatgtagaccaaagaatagcagatttcaatcaactggcagagaaaacagatggcattgttagctagaataggagaagaggctgctgcaagtctcaaggaacttgaagctcactactattcttcagcgcagaggacgagtcaaaacttgcagccgtgaatgtgaggtaccgaaagaaagaatatgctcttcaattcttaaactgggttgggctatctttggaatt

SEQ ID NO: 6025 - DNA, 1636 bp, Malus domestica
gcgagtcgatcgaatacacagaagaagggagagttgtgtacaagttgtgcttcagaaaatccgatccgcaaacaccaccagttctgcttcttcgaatttcttcaaatccggaagagaaaaaaaaatagttggggaagcatgattggagtagggaagatcaagcaatactccaatgtcctcgacaagcccctcagcaagggcaaacaggaggttagtttgagtgcgtttgcgttcttgttttcggagctcgttcagtacaatcagacgcaggttgacaacattgccgagttagaacgaaggctggaggatgcaggatatgctgttggggctcgagttctggagcttctttgccatagggataagggaaacaggagggagacacggttgctgggtatcctgtcttttgtgcatagcacggtgtggaaggtgttatttggaaaggtagctgactcccttgagaaaggcactgaacatgaagatgagtacatgattagtgagaaggagctccttgtgaacagatttatttcgattccaaaagacatgggaacctttaattgtggagcatttgttgctggaattgtaaggggagttttggatggtgctggtttcccagctgtggtaacagcgcattttgtaccagtggatggacagcaacggcctcgaacaaccattttgattaagtttgctgaagaggtgactgattatctttttgttctccactatgttagatctgatgttccaattttgtcttcgtattctaatcttgttgtctttttccctctccaagtggttctccgtaataccatgaagaaagttgagacttctagatggattatcaagctagtgagattttcaccgcttagacgagcattcagaagaagaatgaataagggcggaggtgcagcgtcagggggaggaggattgggaggcgcggggagcgggcccaccgcggctgctgctgtggcggcagctcagaagcagaaggcgctgcttcacagagtagagaacgacatcaccaacatcgtcgacaatttcagccaactcgtcaacgtctccagggtgaatgatccgcctgttagaaactctcaggaagctttcatgatggagacgcgtgctgctcgaatggtccaggcagctgattctctacttaagttggtgtcggaattgaaacagacggcaatattttcagggtttgcctccctcaatgaccatgtcgagaaaagaattgtggagttcaaccagcaagccgagaacacagaccgcttgttggctagaatcggcgaggaggcagctgctagcctcaaggagctcgaatcccattactactcttccgcgctgaggactgctcaaaacttgcagccatgagcttggcatttacagtagaaactagtgtggtgcttttacttaattaagatcattggtattttgtctgaaagtgtatttttgtttaacgttttcaaactaccctaaaccctaccttaagtcgcaaaaccaagcgtagtgacattctaaaattcctacagtcgaccctacttgaagggataaggctttgttattgtttgttttcaaacaaccttaaagtctcaaaggggtgaaatttgctgcttctctgtgaattctgtaaaattgtttttac

SEQ ID NO: 6026 - DNA, 1204 bp, Eucalyptus grandis
ggccgaggtaggggctgaaacctcgaagaaccagttcgtcttccgccaggcgctccaccccatctcctcgcttatctcgtcgtcgtggttggtgctgtacgtggagatgcagtggcgcttgtagaacctggtgatctccagaagctcgaggtgcagggggttcggaactgcgccgagttcggaggtctcaactcggctccgagggcagagccgaagagtagagtcgctggttttgaaaggaagaagcttctggagatcaatccttcgccgattcactcaagaactgtccctttcgctgctttgctcgccatcctcttgtggtccaatccagataatgaacagaggaggaggagcaggagcaggactaggtagtgggagcgggcccacggctgctgcagcagttgcagctgcccagaagcagaagacactcttacaaagagttgaaaatgacattggcaacattgtcgacaatttcagtcatcttgtgaatgtcgccagagtgaatgaccctccagtcagaaactcacaagaagctttcatgatggagatgcgtgcagcaagaatggttcaagcggctgattcactgctgaaattggtatcggagctgaaacagactgccatattttcaggattcgcatctctaaacgaccatgttgaacagagaatcgtcgagttcaaccaacaagccgaaaaatcggatcgtacattgtctagaattgcggaggaggcagccgccagtctcaaagagctcgaatctcattactactcttcgttgcagaggacgactcatcccaccgaatcttagtggaacatggctgtgatcttgtgtattaattgtggggattattgtgacttgttacttatcttgaagctaacaaaagctatgtacactacatggagcctctagggtattctttaacttcagcagggtgattgagaggcttgctcttgccgttccagagccatgtgaggggatgaatttgattatctaaataaggagtattgaaggagatatttgactttggaattcgtccaaaaaacttgtagatgactactcagtgcaaatctctctcagcaaagagattagcaacttggacttcaagtcattgcgtttgtctcctgtacttctatatctacgaatttgcagctaaaggttggatgagatggaaagcttttacataattgctgccatgtgattccccgg

SEQ ID NO: 6027 - DNA, 773 bp, Eucalyptus grandis
atgctttcgttcggaggtggcgtggcaagaattggtagttcggttttgatgtgcaagcgagcgagcgaacgaagaataatgaacagaggaggaggagcaggagcaggattaggtagtgggagcgggcccacagctgctgcagcagctgcagctgcccagaagcagaagacactcttacaaagagttgaaaacgacatcggcaacattgtcgacaatttcagtcatcttgtgaatgtcgccagagtgaatgatcctccagtcagaaactcacaagaagctttcatgatggagatgcgcgcagcaagaatggttcaagcggctgattcactgctgaaattggtatcggagctgaaacagactgccatattttcgggatttgcgtctctaaacgaccatgttgaacagagaattgtcgagttcaaccaacaagctgaaaaatcggatcgtaccttgtctagaattgtggaggaggcagctgccagtctcaaagagcttgaatctcattactactcttcgttgcagaggacgactcatcccacagaatcttagtggaagatggctgatcttgtgtattaattgtggggattattgtgactttttacttatcttgaagctaacaaaagctatgtacactacatggagcttctagggtattcttttacttcagcagggtgattgagaggcttgctcttgccgttccagagccatgtgaggggatgaatttgattatttaaatagggagtatatatataatgaccgatggaccgtcggag

SEQ ID NO: 6028 - DNA, 451 bp, Lotus japonicus
caggagtgggtggcagcggcggcggtggcggacccactgcatcggctgctgctgccgcagttcagaagcagaagacgttgttgcagcgagttgaaggcgatatcgccagcatcgtcgacaatttcagccacctcgtcaatgttgctagggtaaatgatccacccgttagaaattcacaggaagcttttatgatggagatgcgtgctgccaggatggtccaggcagctgattctttgctaaaattggtgtctgagctgaagcagactgcaatattttcaggatttgcttcgcttaatgaccatgtagaacaaagaaaggtggaatttaaccaactgggagaaaaaacagacagcatgttatctagaattggagaggaagctgctgctagcctgaaagaacttgaatctcattattcttcttctgcacagaagactattcaaaatcagcaacc

SEQ ID NO: 6029 - DNA, 643 bp, Fagus grandifolia
gtgactagtgttttattctgctatcagaactcagaccacagctctcccaaccaacgaatctttatattcaataactgctcttcacaaagttcttggtttcaggctttcttttgtatcagagagagagaagaaatgaataaaggcggagcaggaggagtgggtggaggcggaagtgggaccagtggtgccggaagtgggcccacggcggcagctgcggcagcggcagctcagaaacagaagacattgctgcagagagtcgaaggcgatattggtaacatcgttgacaacttcagccacctcgtcaatgtctcccgggtgaatgatcttcctgtcagaaattcacaagaagctttcatgatggagatgcgtgcagctagaatggttcaagcagctgactctctacttaagttggtgtcagagcttaagcaaacagcaatcttctcaggatttgcatcccttaatgaccatgtggagcaaagaactgctgaatttaaccaacaggcagagaagacagatcacatgttggcaagaattggagacgaggcagctgccaactcaaggagctcgagtcgcattatttacttcagcggagaggaaatcaaacctgcagctatgattatgaacggtgcataggagaagcatg

SEQ ID NO: 6030 - DNA, 736 bp, Arachis hypogaea
aggaccagtaggtggaggagggttgggggttggtggaagtgggcctactgcagcggctgctgcagctgctgctcagaagcagaagacattgctgcagagggtggaaggtgacattgccaatattgtggacaatttcagccaccttgtcaatgttgccagggttaatgatccacctgttagaaattcacaagaatcttttatgatggagatgcgtgctgctaggatggttcaggcagctgattcgttacttaagttggtctcggagctgaagcaaacagctatcttttcagggtttgcttctcttaatgaccatgtagaacaaagaagggttgaatttaacgaactcggggagaaaactgatcgtttgttgtctagaattggagaagaagctgctgcaagtcttaaggaacttgaaactcattattcttcttctgcgcagaagaatatttaaaaccttaaaccatagtgtttatatatatatatatatatatatatatacaatgctttgcacctgacactttgatgaaaactctttgactgtatataattgattctttttttagcccggttctaagttctgaatatggatgaatgtaaattaggactaggaattatataagctagatattccattactgagaaagttggaaggaatatagcctagcacattttaagtgcaacggattctatggatggtttaaatgtagcttgaaattacgagtaagagcaatgctta

SEQ ID NO: 6031 - DNA, 911 bp, Vaccinium corymbosum
taccagtctaccagttgaagaagatctaccatgaataaaggaggtgttggaggcggtagtggaggtggtgggccaactgcttctgcggcagctgctgcggctcaaaaaacagaagacattgttgcaaagagtcgataatgacatcggaagtattgttgacaatttcagtttccttgttaacgttgcacgggtcaacgatccaccagttagaaattcacaagaagcattcatgatggagatgcgtgcagccagaatggttcaggcagctgactcgctactaaaaattggtgtccgagttgaagcagacagcaatcttctctggttttgcttccctcaatgaccacgtagaacaaagaatagacgagttcaaccaacaggcggagaaaacggaccgcttgttggctagaattggagaggaagcagctgctagtctcaaggagctcgagtcacattactattcttctgcactgaggacaagccaactccctcagccatgaatgagggctccatatatctaaagcagttcatctgttagaacttagaacagattacaatagttctagtcagagttcatggagagtctatcttttgagaagagacccttgtggtgcatctctttgttgttcccaggctgaattatgcagaaccatgtttgatcgttcttgttccaactcttgtatgtatctcagaagtagaaggttttggttctttctttttgttatcgacctgttattcaaatgggcgttgtaatttacaatttgtatccaataccatcggtgactaggaaatgttactgggcatcttgtctaaagccggagttgattaaaagtgaatcacctccaaatattgatccccattcttttctcgtataatagaatcaaccagcactcctccttcgcattcaagaaaac

SEQ ID NO: 6032 - DNA, 2494 bp, Eucalyptus grandis
atgcagagtgttttcaggttatcctttacaatatgttgttcgatatggatttcaagtgcggatatgtatcgtgtcatgagaaaatattggagcatcttgaatattactctgtctgatgtaagagactttgtccatgcagacgccttatatattttcgcattccctccaagcaaacagcctttggccacaccatctcctccaaattttctgagtgactataagctacatagtttggcttttggctctgctcagaaaggtatgatcgtgcaagaggatgaggaagatcaagaaatcattaatcagaagttcaagacctgtaaattagaactaaagaggaagatgaaggaatgctcaattacgccaaaagccttatcgacttttcgtccgaacgacctccacgatttggctcattcgcatcgcagccgtccaacctcccttgcgaaaccgtcgccctctgttgctcgcctccggagccaccgcaatcgccgccgctgccgccgccgccgccgacgacgacgacaggtccgttctctctctctctctacaccgagctcagcctgtcgcagttcaggggctccaatcacccgaaaaacctggtcgaaagctcgtagagccagcgacgcgcgcgcggttgagaaatggagcggcgagcttgctttcgtttcggttccagcttcatttttgttagggttttcaggcggagtatcgagggggactgtcgagattgcgctgcggaagaaggtatggcgaagtgccaatgtgtagtggagatgctgcggggtcaagaaggcatcggaccgtgacgacattcgtgtcgtggttttttcgaactgatgagcaagagagcgagtattgagatcgggaagaatggattttgatgcatgggatgctttcgttcggaggaggtggcgtggcaagaattggtagttcggttttgatgtgcgagcgagcgagcgaacgaagagtaggttgcggaagcatttctccgggagtgtgggggtgttttcttggagggctttcgcgtcgtgaatgatgctgaattttggtcgagagctgtgtagggggagagtcgatttgtttgctgttgttgccgctctcttcatcgaattggacgatcagtttttttggcctttcattatgatatgttgattttcttttgtgctgtttcacagcatgtcgtctgttaattcctttgccgaggcggcttgtcgtctggctttaggttcaatatctgtggctttcgtgtttatattcatcttggaagttcagaattacttttagtttgcaatggatctacttgtttattaacctagtttgaatagtgtccccgatgtcctctgttttgatgaggtgtaatttgcaaagcaatgccatttatttaagaatttgatatagttttttcagtctatggacgtgctcaaagttctctatcttgctttctcttgccctttgtcttttcagtaattcccatgacttgatgttggcattcctgttgtcttctagatcggactgcttcttgatttaggtagattaattggttggacaatgtttacagttgttgacattgtttgcctgtcacttgcaaatttgacatggggtgacaaatgtcttatgatccttttctcttttttatggtgtagcttggtccactgtcacaatattaaccagtaaactagcaaacactgatcaagtgcccgtaaacttacacgtacagtcctgtattgccttatggctgaagattaagtgtatgttaacttgcttatgtagataatgaacagaggaggaggagcaggagcaggactaggtagtgggagtgggcccacagctgctgcagcagctgcagctgcccagaagcagaagacactcttacaaagagttgaaaacgacatcggcaacattgtcgacaatttcagtcatcttgtgaatgtcgccagagtgaatgaccctccagtcagaaactcacaagaagctttcatgatggagatgcgcgcagcaagaatggttcaagcggctgattcactgctgaaattggtatcggagctgaaacagactgccatattttcgggatttgcatctctaaacgaccatgttgaacagagaatcgtcgagttcaaccaacaaggtgaaaaatcggatcgtaccttgtctagaattgcggaggaggcagccgccagtctcaaagagctcgaatctcattactactcttcgttgcagaggacgactcatcccacagaatcttagtggaagatggctgtgatcttgtgtattaattgtggggattattgtgactttttacttatcttgaagctaacaaaagctatgtacactacatggagcttttagggtattctttaacttcagcagggtgattgagaggcttgctcttgccgttccagagccatgtgaggggatgaatttgattatctaaatagggagtatttgactttggaattcgtccaaaaaacttgtcgatgactactcagtgcaaatctct

SEQ ID NO: 6033 - DNA, 877 bp, Euonymus alatus
gccgggcgccatcgtcaaacctcatctctctttgccagcaccatcgtctcccagaacccatctctctgccagcaccatcgtcgcccagatcccatcttcgccaagaacatctgctactggtacggcttctatcggtttgaggtgggtgtgataaaaatgatgagtaaaggcggatcagccggcggtggcggaatgggaggtagtggcccaactgcggctgctgcggcagcggctgcccaaaagcagaagactttgatgcagagagttgagaccgacatcgccaacatcgttgacaatttcagccatcttgtcaatgtttctagggttgatgatccacctgtgagaaattcacaagaagctttcatgatggagatgcgtgcagctagaatggttcaggcagcagactctttgctcaagttggtgtcagagctaaagcaaacagcaatattttcaggatttgcttctcttaatgatcatgtaaagcaaagagcaaaggaatttgaccatcttgcagaaacgacggatagtgtattggcaagaatcggagacgaggcagctgccagcctgagggagcttgaatcacactattattcttctgctcaaaggacagctccaaatgtacagccataaacgtagtatggaagtgatgctcgacttgaaaagactaccattgatatccagtaacttatttaactcgtgtgtagttctagacatgactgtatcgcatgcttggaaatgatttctgtctatgttgtgaatcacctgaccttcctgtttagtcccaacaggaaggtggtagtgttactagtgaatgttatgtggtacttattagtttttttaagatctcagaagtttgtttggattcaagcaaccaaaa

SEQ ID NO: 6034 - DNA, 831 bp, Catharanthus roseus
cccaacccagcccaacccctcgacacacgacagccactctcttctctgccaccgccgcggccgcctcgccgctctccagtgccacaaaagcagttgagggattgtaatgaacaaaggaggtattggtcttggaagtggtgggggaggaggaccaactgctgctgcggcagctgctgcagctcaaaagcagaagactttgctgcaaagagttgatgctgacatcggaaatatagtcgataatttcagtttccttgtcaatgttgcaagggtaaacgacccaccagtccgaaattcacaagaagctttcatgatggagatgcgtgcggccaggatggttcaagcagccgattcactgcttaagttggtttcagagttaaaacaaaccgcaatcttttcaggatttgcctctctcaatgaccatgtagagcagagaatagaggaattcaatcaacaggcagaaaaaaccgagagtactgtagccagaatcggagaagaggcagctgctagccttaaggaactcgagtcacactactactcttctgctcaaagaacagaatcacatgacaaccaataattaaattatacctatttttgcatcgaagaccttatttttgtatctttgatgtgagggaatttgaaatttcaaacttccatcccctagctaataatctcttgaaatccctttgttaagcttggacgacaacacattagccacctgattgttcactgtattgccgttactttatcttgttgcagatccaacttcgattgcttcccagcggttacttttgacttctgttattaggcaatcaataaatgagcgcttgaata

SEQ ID NO: 6035 - DNA, 816 bp, Vitis vinifera
acatcccacaggaagagcgttgtattgtgttgaacttcttctcggcttctctctctttcttcaattttgatttcacacccagcgctgccggcgatcatcacgccatcactagcgactgcctacgagccatccgcagcacccacttcaaccccatcgccgggaaatgaacaaaggcggaggcgccggtggagggccaacagcagcggcggcagcggcggcggctcagaaacagaaaactttgttgcagagagttgaaactgacatcgctaatgtggttgatcacttcactttcttagttaacgttgctcgggtgaatgacccgccagtcagaaattcacaggaggctttcatgatggagatgcgtgcagccagaatggttcaagcagctgactcactactgaagttggtgtcagagctgaagcagactgcaatcttttcaggatttgcatctcttaatgaccatgtagatcaaagagaggctgagtttaaccaacaggcagaaaaaactgaccacttgttagctagaattggagaggaggcagctgctagcctcaaggagcttgaatctcattattattcttctgcacagaggacaagcgaacccccacagccatgaagactgatctaggacaataagcgatgtagtgcccccttgaaaatcaaaatactataatttgagttcatgtgtaggttaaacaggtcaaaatagtttcactgtggtatatgtagttcagtttgaatttcaaccctagatgtattattactaatggcaaatgagaatctgtctttttcaaggtttccttccactataggcca

SEQ ID NO: 6036 - DNA, 809 bp, Vitis vinifera
acatcccacaggaagagcgttgtattgtgttgaacttcttctcggcttctctctctttcttcaattttgatttcacacccagcgctgccggcgatcatcacgccatcactagcgactgcctacgagccatccgcagcacccacttcaaccccatcgccgggaaatgaacaaaggcggaggcgccggtggagggccaacagcagcggcggcagcggcggcggctcagaaacagaaaactttgttgcagagagttgaaactgacatcgctaatgtggttgatcacttcactttcttagttaacgttgctcgggtgaatgacccgccagtcagaaattcacaggaggctttcatgatggagatgcgtgcagccagaatggttcaagcagctgactcactactgaagttggtgtcagagctgaagcagactgcaatcttttcaggatttgcatctcttaatgaccatgtagatcaaagagaggctgagtttaaccaacaggcagaaaaaactgaccacttgttagctagaattggagaggaggcagctgctagcctcaaggagcttgaatctcattattattcttctgcacagaggacaagcgaacccccacagccatgaagactgatctaggacaataagcgatgtagtgcccccttgaaaatcaaaatactataatttgagttcatgtgtaggttaaacaggtcaaaatagtttcactgtggtatatgtagttcagtttgaatttcaaccctagatgtattattactaatggcaaatgagaatctgtctttttcaaggtttccttccacta

SEQ ID NO: 6037 - DNA, 1068 bp, Vigna unguiculata
aggggaccacaactcagacctcaattcttagccgccattgtctcttcttcctccttctccatttcctttccctctttctcagcctttttcgattacccatttcgagattttgatctcatggccctcgctccctctaaagtttctcccttttcagggttatccctcacagaagctgttgggggaaccgtgaaaaacccaacttgttctgtttctttgggttttctgaataagaaagtgaaaagcagaaaccttggggtttctgcctcaactgcgcctctcactggggtgatctttgaaccctttgaggaggttaagaaggaagagcttgctgttcccactgctccacaggtttcgttggctcgtcagtattatgctgatgagtgcgaatctgcaattaacgagcagataaatgtggaatacaatgcttcctatgtgtaccactccttgtttgcatactttgacagggacaacgtagctctgaagggatttgccaagttcttcaaggaatctagtgaagaagaaagagagcatgctgaaaagcttatgaaataccagaacactcgtggtggaagagttgttcttcaccccatcaagaatgtaccttcagaatttgagcatgtggaaaagggagatgcattatatgcaatggaattagctttgtctttggagaagttggtgaatgagaaacttcggagtgtgcacagtgtggcagggagcaacaatgaccctcaattggcagacttcattgaaagcgagtttttgtctgaacaggttgaatcaattaagaagatatcagagtatgtggctcaactgagaagggttggaaagggtcacggtgtgtggcactttgatcaaagtctgcttcatgcttgaacttgaatagtttttattagtctttgtttacatttgctcttccattacattccgggctgttttctaatttagaagtagtagttaaaagtttttcctttgtactgaggtgtaagaacttgtagtttgtggtagcaagtatcatatgtaaaagactgcagacatattatgcaataacatttgatatctgcttttcaa

SEQ ID NO: 6038 - DNA, 1118 bp, Glycine max
ccacgcaagcttcatccaaatccaccccaacacaaatcttagccgccattgatttttcctcttccatttctcttactttctcagcctttttcgattacccatttggttatttcgccctaatggctcttgctccatccaaagtttccaccttttctggtttttctcccaaacccagtgttgggggtgctcagaaaaacccaacttgctctgtttctctgagctttttgaatgagaaacttggaagcagaaaccttagggtttgtgcctcaacggtgcctctcactggggtgatttttgaaccgtttgaggaggttaagaagagcgagcttgctgttccaactgctccccaagtctcgttggctcgtcagaactacgctgatgagtgtgaatctgcgattaacgagcagataaatgtggaatacaatgcttcctacgtgtaccactccttgtttgcatactttgacagggacaacgtggctctcaagggatttgccaagttcttcaaggaatctagtgaggaagaaagagagcacgctgaaaagctcatgaaatatcagaacactcgcgggggaagagttgtacttcaccccatcaagaatgtcccctcagaatttgagcatgtggaaaagggggatgcattgtatgcaatggaattagctttgtctttggagaagttagtgaatgagaaacttctgaatgtgcacagtgtggcagatcgcaacaatgaccctcaaatggccgacttcattgaaagcgagtttttgtctgaacaggttgaatcaattaagaaaatttcagagtatgtggctcagttgagaagggttggaaagggtcacggtgtttggcactttgatcaaagacttcttgattaggaagatgctgcttaatcttgaatagccttattattagtcttcatttacatttggtcttttctgaaattctgggttgttttctaatttagtagtatttaaatgtttttcctatgtactgagatttaggaactcggagtaatgtaattgctagtagcacatgtaaaaggctgcaagcctattatgcaataacatttgatatctgcatttcaattatctccagtaaaatgtcattggttaaagcttaaa

SEQ ID NO: 6039 - DNA, 1072 bp, Glycine max
atccaaatccaccccaacacaaatcttagccgccattgatttttcctcttccatttctcttactttctcagcctttttcgattacccatttggttatttcgccctaatggctcttgctccatccaaagtttccaccttttctggtttttctcccaaacccagtgttgggggtgctcagaaaaacccaacttgctctgtttctctgagctttttgaatgagaaacttggaagcagaaaccttagggtttgtgcctcaacggtgcctctcactggggtgatttttgaaccgtttgaggaggttaagaagagcgagcttgctgttccaactgctccccaagtctcgttggctcgtcagaactacgctgatgagtgtgaatctgcgattaacgagcagataaatgtggaatacaatgcttcctacgtgtaccactccttgtttgcatactttgacagggacaacgtggctctcaagggatttgccaagttcttcaaggaatctagtgaggaagaaagagagcacgctgaaaagctcatgaaatatcagaacactcgcgggggaagagttgtacttcaccccatcaagaatgtcccctcagaatttgagcatgtggaaaagggggatgcattgtatgcaatggaattagctttgtctttggagaagttagtgaatgagaaacttctgaatgtgcacagtgtggcagatcgcaacaatgaccctcaaatggccgacttcattgaaagcgagtttttgtctgaacaggttgaatcaattaagaaaatttcagagtatgtggctcagttgagaagggttggaaagggtcacggtgtttggcactttgatcaaagacttcttgattaggaagatgctgcttaatcttgaatagccttattattagtcttcatttacatttggtcttttctgaaattctgggttgttttctaatttagtagtatttaaatgtttttcctatgtactgagatttaggaactcggagtaatgtaattgctagtagcacatgtaaaaggctgcaagcctattatgcaataacatttgatatctgcatttcaatta

SEQ ID NO: 6040 - DNA, 1195 bp, Glycine max
tctgttatcaatccaacggttcaaaaattcagatctcacactcaaaattcccaaaacacccctctcccctcctacatatatcctctttgtcccacgcaagcttcatccacatcctccacaacacaactccactcttagctgccattggtttttcttcttccatttctcttcctttctaagcttttttcgattacccatttggagattctgtcctaatggctcttgctccttccaaagtttcctccttttccgggttttctcccaaacccagtgttggggatgctctgaaaaacccaacttgctctgtttctctgagctttgcgaatgtgaaacttggaagcagaaaccttagggtttgtgcctcaactgtgcctctctcaggggtgattttcgaacccttcgaggaggttaagaagggtgaacttgctgttccaacggctccccaagtctcgctggctcgtcagaactacgctgatgagtgtgaatctgccattaatgagcagataaatgtggaatacaatgcttcctatgcgtaccactccttgtttgcatactttgacagggacaacgtggctctcaagggatttgccaagttcttcaaggaatctagtgaggaagaaagagagcacgctgaaaagctcatgaaatatcagaatactcgcggtggaagggttgttcttcacgccatcaagaatgtcccctcagaatttgagcatgtggaaaagggggatgcattgtatgcaatggaattagctttgtctttggagaagttagtgaatgagaaacttctgaatgtgcacagtgtggcagatcgcaacaatgaccctcaattggcagacttcattgaaagcgagtttttgtctgaacaggttgaatcaattaagaaaatttcagagtatgtggctcagttgagaagggttggaaagggtcacggtgtttggcactttgatcaaagacttcttgattaggaagatgctgcttaatcttgaattaccttattagtagtcttcgtttacctttggtcttttctgaagttctgggttgttttctattttaaaatagtatttaaatgtttttcctatgtactgggatttaggaactcggagtaatgtaattgctagtagcacatgtaaaaggctgcaagcctattatgcaataacatttgatatatgcttttcaacgatctctctccagt

SEQ ID NO: 6041 - DNA, 1079 bp, Glycine max
atccacatcctccacaacacaactccactcttagctgccattggtttttcttcttccatttctcttcctttctaagcttttttcgattacccatttggagattctgtcctaatggctcttgctccttccaaagtttcctccttttccgggttttctcccaaacccagtgttggggatgctctgaaaaacccaacttgctctgtttctctgagctttgcgaatgtgaaacttggaagcagaaaccttagggtttgtgcctcaactgtgcctctctcaggggtgattttcgaacccttcgaggaggttaagaagggtgaacttgctgttccaacggctccccaagtctcgcttgctcgtcagaactacgctgatgagtgtgaatctgccattaatgagcagataaatgtggaatacaatgcttcctatgcgtaccactccttgtttgcatactttgacagggacaacgtggctctcaagggatttgccaagttcttcaaggaatctagtgaggaagaaagagagcacgctgaaaagctcatgaaatatcagaatactcgcggtggaagggttgttcttcacgccatcaagaatgtcccctcagaatttgagcatgtggaaaagggggatgcattgtatgcaatggaattagctttgtctttggagaagttagtgaatgagaaacttctgaatgtgcacagtgtggcagatcgcaacaatgaccctcaattggcagacttcattgaaagcgagtttttgtctgaacaggttgaatcaattaagaaaatttcagagtatgtggctcagttgagaagggttggaaagggtcacggtgtttggcactttgatcaaagacttcttgattaggaagatgctgcttaatcttgaattaccttattagtagtcttcgtttacctttggtcttttctgaagttctgggttgttttctattttaaaatagtatttaaatgtttttcctatgtactgggatttaggaactcggagtaatgtaattgctagtagcacatgtaaaaggctgcaagcctattatgcaataacatttgatatatgcttttcaacga

SEQ ID NO: 6042 - DNA, 1169 bp, Cajanus cajan
tatcccacgcaagcttcatccaccacaaacacaactctcctccccacagccgccattgattcttcttcctcttgttctcccatttctcgactcttttccgttacccatttggttattccgccctcatggctctcgctccttccaaagtttcctccttttcagggttatctctcacaaccagtggtggggatgttcccaaaaacccaacttgctcttcttatttgagcttcgtgaataagaaattcggaagcagaagcctcagggtttgttccgcctctactgcgcctcttactggggtcatttttgaaccctttgaagaggtcaagaagggtgagcttgctattcccaccgctccccaagtttcgttggctcgtcagaactatgctggtgactgtgaatctgcaattaacgagcagataaatgtggaatacaatgcttcctatgtgtaccactccttgtttgcatactttgacagggataacatcgctctcaagggacttgccaagttcttcaaggaatctagcgaagaagaaagagagcatgctgaaaagcttatgaaatatcagaacacacgtggtggaagagttgtacttcaccccatcaagaatgttccctctgaatttgagcacgaggaaaagggggatgcattgtatgcaatggaattggctttgtcgttggagaagttggtgaatgagaaacttctgaatgtgcacagtgtggcagacctcaacaatgaccctcaaatggctgacttcatcgaaagtgagtttttgtctgaacaggttgaagcaattaagaagatatcagagtatgtggctcaattgagaagggttggaaagggtcacggtgtttggcactttgatcaaagacttcttcacgagggaaatgctgcttgatcttgaatagtcaagtcactagtcttttgtgaatttctgtgttgttttctatttcagagtagtatttaaatgtttttccttatgtactgaggtttaggaacttgttgtaacgtaattgctagtatcacatgtaaaaggctgcaggcctattatgctataacatttagtatctgcttttcaaggatctctctatgcaatatctgcttttaatctctgccgtaataatgtccttaattactacttggtcttaatgaatgaaacaaacactgatga

SEQ ID NO: 6043 - DNA, 1099 bp, Cyamopsis tetragonoloba
cacgaggctcagaacaaaaccgccgttgctccttctccttccatttctctgtttttcaaatctttttcattacccattttgagattctgcccttatggctcttgctacgtccaaagtttcatccttttctggcttttctctctcgaacattgttggggattgtgggagaaacccaacttcttcttcttcttctctgagctttgctatctcttccccacctccttctctgagcctcggtgagaaatggggaagcagtagggtttctgcttcaactgtacctctcactggggtgatattcgaaccatttgaggaggtcaaaaaggataatcttgctgttccaacagcatctcaaatttcattggctcgtcagaactatgctgatgagtgtgaatctgtaattaacgagcagatcaatgtggaatacaacgcttcctatgtgtaccactccttgtttgcatactttgacagggacaatgtggctctcaagggatttgccaagttcttcaaggaatccagtgaagaagaaagagagcatgctgaaaagcttatgaaatatcagaacattcgtggtggaagagttgtacttcaccccatcaagaatgtcccctcagaatttgatcatgaggaaaagggggatgctttgcatgcaatggagttagctttgtctttggagaagttagtaaatgagaaacttctgaatgtgcacagtgtggcagaccgcaataatgaccctgaaatggcaaacttcatcgaaggcgagtttttgagtgaacaggtagaatcaattaagaagatatcagagtatgtggctcaattgagaagggttggaaagggtcacggtgtttggcacttcgatcaaagacttctcaattaggaagatgctgcttgatcttgaatggccttctgtttagcctatgtttacatttggtcttatctgaagttagttgttttctattgcagaatagtattggtgtgttttgcctatgtactgagtttaactcagagtaatgtaatagctagtatcacatgtaaaaggctacaggcctgttaagcaataacatgtgataactattttcaatgtttttgtctgcaattaaaa

SEQ ID NO: 6044 - DNA, 696 bp, Vigna unguiculata
atggcagcaccaatctttaacactcccttcttcacactctttgtttttttctctctccaactttatctctctttctcgtcctctccctccatccatgaccttctccgttccaaaggactaccccctggtctcttgccagaagaggtaaagtcctacactttctcccaaaatgggcacttggaagtgttcctagacgcaccttgcttgaccaagtacgagaacagagtcctctttgagcaagttgtcactgccaaccttacctacggtagcctcataggagttgaaggtctccaacaagaagaactctttgtctggctccctgtcaaggacataatcgtaaatgacccttcttcagggttgatactctttgacattggccttgcccacaaacaactctctctctccctctttgaagatccacctcactgcaagcccgaaggtgggttgaggaatcatgtgaggaaggaaaaaggtttggaggtcctgaggtagaaaaagatgccaccctgtgtttcaggcatcacttgttgtctttttctatgtcatgtttatataattttagccttgcaatgcaactatagttaatgagtaggtgcttaggttgagcatgtaaaaatgtgaagagagagaaagagaaaaaaaaaactaaggaatctgatgtcgtaatcaaatttacaagttgtaatttttcttcta

SEQ ID NO: 6045 - DNA, 643 bp, Cyamopsis tetragonoloba
cacgaggtttaacactccttccttcatcacactcttcatttccctctctctcctcttctcactttctctctcttcttcatccattcatgaccttctccgctcaaaagggttgccacctggtctgttaccagaagaggtaaagtcctacactttctcagaaaatggtcgcttagaagtgttcctagacgcaccatgcttgacaaagtacgagaatagggttctgtttgagcaagtggttactgctaatctcacctatggtagtctcataggtgttgagggtcttcaacaagaagaactttttgtgtggcttcctgttaaggacataatcgtcaatgatccttcttctggcttgattctctttgacattggactcgctcataaacagctttctctctctctctttgaagatcctcctcattgcaaaccagaaggtgggttgaggaatcatgtgaggaaggagaaaggatttgagtccttaaggtagaaaaagatgccaccctgtttttcaggctttcagttgttgtctttttctatgtcatgtttatataattttagcctttcaatttgcaaactatagtcatatgagtaggtgtttttatgtagtgtagaggttgaggttggttttgatatcatgtaaaggata

SEQ ID NO: 6046 - DNA, 1001 bp, Glycine max
ctcatcaaaagaaaagaaactccccttaaagcttaaaccccctcatgttcttttttctctttttggtctaagcaaaccaccccaccatggcagcaagagcaacagcaatctttaacactccctcctcctcctccttcttcacattcacactctttctctctctctctctcctcctccaactttctctctcctccccctctccctccatccacgaccttctccgctccaaaggcttgccccccggcctcctcccagaggaggtgaaatcctacagcttctccgaaaccggccacttggaagtcttccttgacgcgccgtgcctgaccaaatacgagaacagagtcctcttcgagcaagtcgtcaccgccaacctcacctatggaagcctcataggagtggagggtctccagcaagaggagctcttcgtgtggctacccgtcaaggacataatcgtaaatgacccctcctcggggttgatactgtttgacattggcctcgcccacaaacagctctcgctctccctctttgaagatccgcctcactgcaaacatgaaggtgggttgaggaatcatgtgaggaaggaaaaaggtttcgaggccctgaggtagaaaaagatgccaccctgttttttacatgcttcacttgttgtctttttctttggtcatgtttatataaattttagccttgcaatattattgcaactatatagtagtcatatgaattaatgaaagtaggtgcttgtagcgtagaggttgagcattgtaaaaatgtgaggagagagagggaaaaaaaaaaaggaaaaaaactatggaatctgatgatgtcgtaatcaaatttacaagttgtaatcttctaacttttgttcattatgttgtttctgttttgagataaaaagatataataagtgtcaaagcaaaggatcaaatctaggtttatgaattcgcaaagcaatgactaggaaacttgccaacgaaaatggaagaaaaaaaaggcatttggaa

SEQ ID NO: 6047 - DNA, 1120 bp, Glycine max
tccggatttaaaaaataaaaatgaaatgaaaagaaagttgatcaccaacaaccaagggcaacatagtcactccacacaccaataaccttttcttaaacagtctctacattttccaccctcatcaaaagaaaagaaactccccttaaagcttaaaccccctcatgttcttttttctctttttggtctaagcaaaccaccccaccatggcagcaagagcaacagcaatctttaacactccctcctcctcctccttcttcacattcacactctttctctctctctctctcctcctccaactttctctctcctccccctctccctccatccacgaccttctccgctccaaaggcttgccccccggcctcctcccagaggaggtgaaatcctacagcttctccgaaaccggccacttggaagtcttccttgacgcgccgtgcctgaccaaatacgagaacagagtcctcttcgagcaagtcgtcaccgccaacctcacctatggaagcctcataggagtggagggtctccagcaagaggagctcttcgtgtggctacccgtcaaggacataatcgtaaatgacccctcctcggggttgatactgtttgacattggcctcgcccacaaacagctctcgctctccctctttgaagatccgcctcactgcaaacatgaaggtgggttgaggaatcatgtgaggaaggaaaaaggtttcgaggccctgaggtagaaaaagatgccaccctgttttttacatgcttcacttgttgtctttttctttggtcatgtttatataaattttagccttgcaatattattgcaactatatagtagtcatatgaattaatgaaagtaggtgcttgtagcgtagaggttgagcattgtaaaaatgtgaggagagagagggaaaaaaaaaaaggaaaaaaactatggaatctgatgatgtcgtaatcaaatttacaagttgtaatcttctaacttttgttcattatgttgtttctgttttgagataaaaagatataataagtgtcaaagcaaaggatcaaatctaggtttatgaattcgcaaaccaatgactaggaaacttgccaacgaaaatggaagaaaaaaaaggcatttggaata

SEQ ID NO: 6048 - DNA, 1376 bp, Cajanus cajan
agggcaacatagtcactccacttcccccccataaccttttcttaaacagtctctacattttccagcctcatgaaaagaaaaagaaactccctaaaccccccttcatgttcctttttctctttttggtctaagcaaccacaaccaccccaccaccatggcaatcttgatcacactctttctctccctctctctcctcctccacctctctctctcctcctcctcctccatccacgacctcctcaggtccaagggcctcccccctggcctcctccccgaagaggtcaagtcctacactttctcccaaaatgggcacttggaagtgttcctagaggcaccttgcttgaccaagtacgagaacagggtcctcttccaacaagttgtcactgccaacctcacctacggtagcctcataggtgtccaaggtctccaacaagaggagttgttcgtttggctacctgtcaaggacataatcgtaaatgacccttcttcgggcttgattctctttgacattggccttgcctacaaacaactctctctctctctctttgatgatcacactctttctctccctctctctcctcctccacctctctctctcctcctcctcctccatccacgacctcctcaggtccaagggcctcccccctggcctcctccccgaagaggtcaagtcctacactttctcccaaaatgggcacttggaagtgttcctagaggcaccttgcttgaccaagtacgagaacagggtcctcttccaacaagttgtcactgccaacctcacctacggtagcctcataggtgtccaaggtctccaacaagaggagttgttcgtttggctacctgtcaaggacataatcgtaaatgacccttcttcgggcttgattctctttgacattggccttgcctacaaacaactctctctctctctctttgaagatccccctcactgcaagccccaaggtgggttgaggaatcatgtgaggaaggaaaaaggtttcgaggccctgaggtagaaaaagatgccaccctgtttttcaggcttcagttgttgtctttttctatgtcatgtttatataattttagccttgcaatgccaccactatagtcatatgagttatgagtaggtgcttgtagcgtagaggttgagtgagcatgtaaagatgtgagagaagagggggaaaaaaaggaagaaaaaaaaaaaaacaaaaactaaggaatctcatgtgtaatcaattttacaagttgtaatcttctaacttttggttcattcgccgcttgttttgtttcaagataaaaagatgtgataagtgtcaaagcaaaggatcaaatctaggtttatgaattcgcaaagcaatgactaggaaacttgccaacga

SEQ ID NO: 6049 - DNA, 805 bp, Lupinus angustifolius
ctctcacttcaatctaaaagaaaactcctcttatgttcctttctctttttggtccaaaagaaaaacatggcattccttaaactcttcacaaccttgttctccttctctctcctcctcctactatctccctcactttctctctcttctccttcttcttcaattcatgaccttcttcgttcaaaagggttaccagctggactgttaccagaagaggtaaagtcctacactttctcagaagatggttgcttaaaagtgttcttagatgcaccttgcatgaccaagtatgagactagagtgttctttgagcgtgtggtcactgctaaccttacctatggtagcctcataggtgtggagggtcttcaacaagaagagctttttgtatggctacctgttaaggatatcatagttaatgatccctcatcagggttgatactatttgacattggccttgcttataagcagctttctctctctttatttgaagatccacctcattgcaagccacaaggtgggttgaggaatcatgtgaggaaggaaaaaggattcgaggcccttagatagaggggggaaaatgacacccgttttttcaagcttgagttattgtctttttgttctgtcttgtttatatcaattttagcctctgcaacaactagtcatagtatatgtgtaggtgtttgtagcttagaggttgaggttgatgaagaggctgagaggcatgtaaagatgtggggagaggtagagaaacaaactatggaatcttatgatgtcttaatcaattttacaaattctaattaatcttcaatct

SEQ ID NO: 6050 - DNA, 1824 bp, Vigna unguiculata
aagtcccatgtgggttcttaggatccactcactcaactctaatactcgtgttccttcttttctcttcaaaaaacttgtgactctcaaacaccctttttctccttttcattcttcttctccttttctacctccaatggctgcacctcgctactgcctctctacataacgtcaatttcgcctccttttccatctgggtcttttgaattgcgaccgccacgccactgtcttctttcgcttctgggccttgctcagaagtcagaatgatgtctgtcacaggcaaaaccattgattttgctggaaaaaatttggtctcatgtggatgctcttccaatgcttcttttgataggtacacagtcaggaactacgccagggttagttctaaagggtgtggtaaaggccatggaacatgtaggttgttctgttgtacgaggaggaacactcagtgtcgagtttcttctatgaagactgcagaacctaccgtgaatggggggactcaagcaattgaaggccttaacaaaggattgaacttgaagggttattcagaaaccccaatttctgcagctaggttctttgaggcggttgctgatgatttgttaactctcaataaaaatctgcagtcgattgtaggagcagaaaatccagttttaatgtctgcagctgagcagatttttagtgctggtgggaagaggatgagaccagctctggtgttcttggtggcaagggcaactgcagagttgcttggcttgaaggagcttactgtaaagcatcgacgtttagcggagatcattgaaatgattcatactgcaagtttgatacatgatgatgtactagatgagagtgaccttcgaagagggaagaaaactatccatcaaatttttggaacaagagttgcagtgctggctggagacttcatgtttgcacagtcatcatggtatctagccaaccttgaaaatattgaagtcattaaactaatcagccaggtgatcaaagattttgcaagtggggaaataaagcaggcctcaagtttgtttgattgtgatgttgaacttgaagagtatctaattaagagctattacaagacagcatccttgattgcggccagcaccaagggagctgcgatcttcagcggtgccgacagcggcatcactgagaaaatgtatgaatatggaaggaatctgggtctgtccttccaaattgtggatgacattttggatttcactcaatcagcagagcaactgggaaagccttctggcagtgaccttgccaagggcaaccttactgcaccagtaatatttgcactggagaaagaaccaaaattgagggatatcattgagtctgaattcagtgaggatggttcccttgatgaggccatcaatttggttaagagttgtgggagcattgaaagggctcaagagttggccaaagagaaagctgatcttgcaattcaaagtctccaatgccttcctcagagtgtgtatcgtttagcccttgaggatatggtggcatataaccttcagcggattgcataagcttatgcatgctgaagtataaggacacactgttttaaaaaaaaaaaaaacacaaaaacattcttttggttctaatatatagggataagagcctttaacatgttgtcatttcaagaattcctccaaattctgctcctgtgctacttttggggtacctatatacgcatcgaaggacaaagcaattgcacattctcataatttaatatatttgcagcttctccctcaaaagtaaagagcaagaacataatatattcctttattttatcaatacaagttgcagtatattctttccccc

SEQ ID NO: 6051 - DNA, 2052 bp, Glycine max
tcataatcaaatgtcctaagcaagcagcatgagtcacagatttcactgtctccaactgataagaaacgtagtcccatgtgggctcttaggatccactcacttaactctaaactcgtcgtttgtgtgtgttttccctctttccacttcaaacttgtgacccagaaagaccctcttttttttttactttccattctcctccttttcttcctccaatggctgcacctcgctgcctaacgtgaaattagtctcattttccatctgggtcttgtgaattgcgattggaaccgcgttttctcgcttctgggcttggcttagaagtagtcagaatgatgtctgtcacaggcaaaggcattgattttgctggcaaaaacttggtctctggctgctcttcaaatgcttcgtttgattggtacactgtgaggaactatgccaaggcgaatagtaataattctaatgggtgtggcagaggccatggacgtaaattggtttgttgtaagaggaggagcactcaatgtcgggtttcttctatgaagactgcacagcctactgtgaatggggggactcatgcaattgaaggccttaccacaggattggacttgaagggttattcagaagcccccatttccccagctaggttttttgaagcggttgccgatgatttgctaactctcaataaaaatcttcagtcgattgttggagcagaaaatcctgttttgatgtctgcagctgagcagatttttagtgctggtgggaagaggatgagaccagctctggtgttcttggtgtcaagggcgactgcagagttacttggcttgaaggaacttactgtaaagcatcgacgtttagcagagataattgaaatgattcatactgcaagcttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattgaagtcattaaacttatcagccaggtgatcaaagattttgcaagtggggaaataaagcaggcttcgagcttgtttgattgtgatgtacaacttgatgagtatctaattaagagctattacaagacagcgtcgttgattgctgccagcacaaaaggagctgcgatctttagtggttctgacagcagtgtcactgagaaaatgtatgaatatggaaagaatcttggtctatcctttcaagttgtggatgacatattggatttcacgcaatcagcggagcaactgggaaagcctgctggcagtgaccttgccaagggcaacctgactgcaccagtgatttttgcactggagaaagaaccaaaattgagggatatcattgagtctgaattcagtgaggttggttcgcttgacgaggccatcaatttggtcaagagttgtgggggcattgaaagagcacaagagttagcaaaagagaaagctgatcttgcaattcaaagtctccaatgcctacctcagagtgtgtttcgtttagcccttgaggatatggtggcatataaccttcaacggattgcataagcttgtgcatgccgaggacactttgttaaaaaaaaaaaacacaaacctttttttggtcctaatatagggatgagagagccttgaactttttgtcatttcaagaatatccagcaaatctacacttgtgctacttttggggtacttatatagtcattgaagggcaaagcaagtgcgcattctcatcatttaatatatttgcagcttcctgcaaagtccaataacataatatattccattattgtatcaatacaagtctgcagtacattctttccccccattgttcctttctgggatcttgaaaacagtaagaataaaaaaagataattgatgtttaatttgtgtattttctgaaggcagtatacaatttggcttgtaaactccatctcgtattggcttgctcatttattgtcatactttattctctatcattgcaaaagattttcaatttttaatt

SEQ ID NO: 6052 - DNA, 1960 bp, Glycine max
aagaaacgtagtcccatgtgggctcttaggatccactcacttaactctaaactcgtcgtgtgtgtgtgttttccttctttccacttcaaacttgtgacccagaaagaccctcttttttttttactttccattctcctccttttcttcctccaatggctgcacctcgctgcctaacgtgaaattagtctcattttccatctgggtcttgtgaattgcgattggaaccgcgttttctcgcttctgggcttggcttagaagtagtcagaatgatgtctgtcacaggcaaaggcattgattttgctggcaaaaacttggtctctggctgctcttcaaatgcttcgtttgattggtacactgtgaggaactatgccaaggcgaatagtaataattctaatgggtgtggcagaggccatggacgtaaattggtttgttgtaagaggaggagcactcaatgtcgggtttcttctatgaagactgcacagcctactgtgaatggggggactcatgcaattgaaggccttaccacaggattggacttgaagggttattcagaagcccccatttccccagctaggttttttgaagcggttgccgatgatttgctaactctcaataaaaatcttcagtcgattgttggagcagaaaatcctgttttgatgtctgcagctgagcagatttttagtgctggtgggaagaggatgagaccagctctggtgttcttggtgtcaagggcgactgcagagttacttggcttgaaggaacttactgtaaagcatcgacgtttagcagagataattgaaatgattcatactgcaagcttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattgaagtcattaaacttatcagccaggtgatcaaagattttgcaagtggggaaataaagcaggcttcgagcttgtttgattgtgatgtacaacttgatgagtatctaattaagagctattacaagacagcgtcgttgattgctgccagcacaaaaggagctgcgatctttagtggttctgacagcagtgtcactgagaaaatgtatgaatatggaaagaatcttggtctatcctttcaagttgtggatgacatattggatttcacgcaatcagcggagcaactgggaaagcctgctggcagtgaccttgccaagggcaacctgactgcaccagtgatttttgcactggagaaagaaccaaaattgagggatatcattgagtctgaattcagtgaggttggttcgcttgacgaggccatcaatttggtcaagagttgtgggggcattgaaagagcacaagagttagcaaaagagaaagctgatcttgcaattcaaagtctccaatgcctacctcagagtgtgtttcgtttagcccttgaggatatggtggcatataaccttcaacggattgcataagcttgtgcatgccgaggacactttgttaaaaaaaaaaaacacaaacctttttttggtcctaatatagggatgagagagccttgaactttttgtcatttcaagaatatccagcaaatctacacttgtgctacttttggggtacttatatagtcattgaagggcaaagcaagtgcgcattctcatcatttaatatatttgcagcttcctgcaaagtccaataacataatatattccattattgtatcaatacaagtctgcagtacattctttccccccattgttcctttctgggatcttgaaaacagtaagaataaaaaaagataattgatgtttaatttgtgtattttctgaaggcagtatacaatttggcttgtaaactccatctcgtattggcttgctcatttattgtcatactttattct

SEQ ID NO: 6053 - DNA, 2057 bp, Cajanus cajan
gaaggaagaatcatgagtcacagatttcattctcatcgctttctctctccaactgataagaaacgtagtcccatgtgggcttttaggatccactcactcgcctctaactcttgtgtgttccttctttccacttcaaacttgtgagctagaaacacccttcttttttcattctttccattcttcttcttctctgttcttccttcaatggccttacatcgctcctgggtctctgcctaacgtgaaattggcctcattttccatctgggtattgtgaattgggattgagactgcgttttttcgcttctgggcctggctcagaagtcagaatgatgtgtgtgacaggcaaaagcattgattttgctggcaaaaacttggtctcttgtggctgttcttccaatgcttcgtttgacaggtacactgtgaggagctgcgtgaaggtgaattccaaagggtgtggtggcagtggcagaggccatggggctcgtaaattggtttgttgtaggaggaggaacactcaatgtcgtgtttcttctatgaagactgcggagcctacgctgaatggggggactaaagcaattgaaggccttaccacaggattggacttgaagggttattctgaatcccccatttcgccggctaggttgtttgaagtggttgctgatgatttgctaactctcaataaaaatcttcagtcgattgtaggtgcagaaaatccagttttaatgtctgcagctgagcagatttttagtgctggtgggaagaggatgagaccagctctggtgttcttggtgtcaagggcaactgctgagctacttggcttgaaggaacttactgtaaagcatcgacgtttagcagagataattgaaatgattcatactgcaagtttgatacatgatgatgtactagatgagagtgaccttcgacgagggaagaaaactgttcatcaaatgtttggaacaagagttgcagtgctggctggagacttcatgttcgcacagtcatcatggtatctagccaaccttgaaaatattgaagtcattaaacttatcagccaggttatcaaagattttgcaagtggggaaataaggcaggcatctagcctgtttgattgcgatttacatcttgatgagtatctaattaagagctattataagacagcgtccttgattgctgccagcacaaaaggagctgcgatcttcagcggtgctgacagcagcatcactgagaaaatgtatgaatatggaaagaatcttggtctatccttccaagttgtggatgacatattggatttcactcaatccgccgagcaactgggaaagccagctggctccgaccttgccaagggcaacctgactgcaccggtaatctttgcattggagaaagaaccaaagttgagggatatcattgagtctgaattcagtgaggttggtgcccttgatgaggccatcaatttggtcaagggttgtgggggcattgaaagagcacaggagttggcaaaagagaaagctgatcttgcaattcagtgtctccaatgccttccccagagtgtgtttcgtttagctcttgaggatatggtggcatataatcttcaacggattgcataagcttatgcatgctgaggacccctttaaagaatcacaaaagcattcttttggtatatagggatgagagccctgaactttttgtcatgtcaagaatttccaacaaatctactcctgtgctacttttggggcattagtatagacattgaaggacaaagcaagtgcgcattctcatcatttaatatattttgatgagaacataatatatttcattattgtatcaatacacatctccagtatattctttttccaatcttcctttctggaatcttgaaaacagtaatagaataaaaaatgatgattgatatttttttttctgattccttttctcatgtattttctgatgatagcatacaattggacttgtaaagtccatcttgtcttggtcttgctcattcatcatcatgctttcttctattctatcactataaaagattttcaaatttaagtatttgc

SEQ ID NO: 6054 - DNA, 2198 bp, Glycine max
gctgagttctcttaaattcattgttaaaattggcttgtgacaaaatgacacaggagaatttgagccatcctaagcaagcagcatgagtcacagatttcattctctctccaactgataagaaacgtagttccatgtgggctcttaggatccactcacttaactctaaactcgtcgtgtgtgttccttctttccacttcaaacttgtgacccagaaaaaagaccctttccattctcctccttttcttcctcctccactggctgcacctcgctgccgtgtctctgcctagcgtgaaattggcctcatttcccatctgggtcctgtgaattgcgattggaaccgcgttttccccgcttctgggcttggctcagaagtagtcagaatgatgtctgtcacaggcaaaagcattgattttgctggcaaaaacttggtctcttgtggctgctcttccaatgcttcttcgtttgataggtacactgtgaggaactatgccaagctgaatagtaataattctaaagggtgtggcagagatcatggggctcgtaaattggtttgttgtaagaagaggagcactcattgtcgggtttcttctatgaagactgcacagcctacggtgaatggggggactcatgcatttgaaggccttaccacaggattggacttgaagggttattcagaagaccccatttcccctgctaggctttttgaagtggttgccgatgatctgctaactctcaataaaaatcttcagtcgattgtaggagcagaaaatccagttttgatgtctgcagctgagcagatttttagtgctggtggaaagaggatgagaccagctttggtgttcttggtgtcaagggcgactgcagagttacttggcttgaaggaacttactgcaaagcatcgacgtttagcagagataattgaaatgattcatactgcaagtttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattcaagtcattaaactcatcagtcaggtgataaaagattttgcaagtggggaaataaagcaggcttcaagcttgtttgattgtgatgtacaacttgacgagtatctaattaagagctattacaagacagcatccttgattgctgccagcacaaaaggagccgcgatctttagtggtgctgacagcagcgtgactgagaaaatgtacgaatatggaaggaatcttggtctatccttccaagttgtggatgacatattggatttcactcaatcagccgagcaactgggaaagcctgctggcagtgaccttgccaagggcaacctgactgcaccagtaattttcgcactggagaaagaaccgaaattgagggatatcatcgagtctgaattcagtgaggttggttcccttgaggaagccatcaatttggtcaagagttgtgggggcattgaaagagcacaagagttagcaaaagagaaagccgatcttgcaattcaaagtctccaatgcctacctcagagtgtatttcgtttagcccttgaagatatggtggcatataaccttcaacggattgcataagcttgtgcatgctgatgacacattgttaaagaaaaaacacaaaaagattcttttggtcctaatatagggatgagagagccttgaactttttgtcatttcaagaatttcaagcaaatctacacttgtgctacttttggggtacttttatagtcattgaagggcaaagcaagcgcgcattctcatcatttaatatatttgcagcttcctgcaaagtacaagaacataatatattccattattgtatcaatacaagtctgcagtatattctttccccccattcttcctttctgggatcttgaaaacagtaaaataaaaaatgataattgatgtttcttttttttttttttctgtttctttttcttctgtattttctgagggtagtataaaatttggcttgtaaactcaatctcgtcttggccttgctcattcattgtcatactttattctatcttatcattgcaaaagattttcaatttttaagtatttgcaatcataaagcttggttatgtaaattgaatcctctgatcaatttattta

SEQ ID NO: 6055 - DNA, 2103 bp, Glycine max
gacacaggagaatttgagccatcctaagcaagcagcatgagtcacagatttcattctctctccaactgataagaaacgtagttccatgtgggctcttaggatccactcacttaactctaaactcgtcgtgtgtgttccttctttccacttcaaacttgtgacccagaaaaaagaccctttccattctcctccttttcttcctcctccactggctgcacctcgctgccgtgtctctgcctagcgtgaaattggcctcatttcccatctgggtcctgtgaattgcgattggaaccgcgttttccccgcttctgggcttggctcagaagtagtcagaatgatgtctgtcacaggcaaaagcattgattttgctggcaaaaacttggtctcttgtggctgctcttccaatgcttcttcgtttgataggtacactgtgaggaactatgccaagctgaatagtaataattctaaagggtgtggcagagatcatggggctcgtaaattggtttgttgtaagaagaggagcactcattgtcgggtttcttctatgaagactgcacagcctacggtgaatggggggactcatgcatttgaaggccttaccacaggattggacttgaagggttattcagaagaccccatttcccctgctaggctttttgaagtggttgccgatgatctgctaactctcaataaaaatcttcagtcgattgtaggagcagaaaatccagttttgatgtctgcagctgagcagatttttagtgctggtggaaagaggatgagaccagctttggtgttcttggtgtcaagggcgactgcagagttacttggcttgaaggaacttactgcaaagcatcgacgtttagcagagataattgaaatgattcatactgcaagtttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattcaagtcattaaactcatcagtcaggtgataaaagattttgcaagtggggaaataaagcaggcttcaagcttgtttgattgtgatgtacaacttgacgagtatctaattaagagctattacaagacagcatccttgattgctgccagcacaaaaggagccgcgatctttagtggtgctgacagcagcgtgactgagaaaatgtacgaatatggaaggaatcttggtctatccttccaagttgtggatgacatattggatttcactcaatcagccgagcaactgggaaagcctgctggcagtgaccttgccaagggcaacctgactgcaccagtaattttcgcactggagaaagaaccgaaattgagggatatcatcgagtctgaattcagtgaggttggttcccttgaggaagccatcaatttggtcaagagttgtgggggcattgaaagagcacaagagttagcaaaagagaaagccgatcttgcaattcaaagtctccaatgcctacctcagagtgtatttcgtttagcccttgaagatatggtggcatataaccttcaacggattgcataagcttgtgcatgctgatgacacattgttaaagaaaaaacacaaaaagattcttttggtcctaatatagggatgagagagccttgaactttttgtcatttcaagaatttcaagcaaatctacacttgtgctacttttggggtacttttatagtcattgaagggcaaagcaagcgcgcattctcatcatttaatatatttgcagcttcctgcaaagtacaagaacataatatattccattattgtatcaatacaagtctgcagtatattctttccccccattcttcctttctgggatcttgaaaacagtaaaataaaaaatgataattgatgtttcttttttttttttttctgtttctttttcttctgtattttctgagggtagtataaaatttggcttgtaaactcaatctcgtcttggccttgctcattcattgtcatactttattctatcttatcattgcaaaagattttcaatttttaagtatttgc

SEQ ID NO: 6056 - DNA, 1711 bp, Lotus japonicus
gcaattactggttcttccgaatgatgactgtgacaagtagcagcattgattttgctgggaaaaacttggtttattgtggctgttcttccaatgcatcgtttgacaggtacactgtgaggaactatcagaagctgaattctaaaggctgtggagctcgtaaatcgatttgctgtaagagaaagagcacccaatgtaaagtttcttctatgaagactgcagagcctgcgttgaatgggggaactcaagcaattaaaggccttacaggaagattggacttgaagagttcttcttcagaaacccccatttcaccagctaggttgtttgaagttattgctgatgatttgttaacgctcaataaaaatcttcaatcgattgtaggtgcagaaaatccagtcttaatgtctgcagctgagcaaatctttagtgctggtgggaagaggatgaggccagctctagtgttcttggtgtctagggcgacagcggagctacttggattgaaggaacttactctaaagcatcgacgtttggcagaaataattgaaatgattcatactgcaagtttgatacatgatgacgtattggatgagagcgacctaagaagagggaaagaaacggttcatcaactgtttggaacaagggtggcagtactggctggagacttcatgtttgcacagtcatcatggtacctagccaaccttgaaaatattgaagtcattaaacttatcagccaggtgattaaagattttgcaagtggggaaataaagcaggcttctagcttatttgattgtgatgttcaactagaggagtatctaatcaagagctattacaagacagcctccttgattgctgccagtaccaaaggggctgcaatttttagcggtgctgaccacagcatcactgagaaaatgtatgaatatggaaagaaccttggtctttccttccaagttgtggatgacattttggatttcactcaatcggcggagcaactgggaaagcctgctggcactgaccttgccaaaggtaacctcactgcacctgtaattttcgcattggaaaaagaaccaaaattgagggatatcattgagtctgagtttagtgagactggttcccttgatgaggccatcaccttggtcaagagttgtggaggcattgaaagagcacaagagttggcaaaagagaaagctgatcttgctattcagagtctccaatgccttcctcagagtgtgtttcgtttagctcttgaggatatggtgacatacaaccttcaacgaattgcataaacttgtgcatgctgaggacatattattaagaaaatcagaaacatacattcttaggtcctaatataaggaggggaaacttgacatttgaacttctttcatttcaagaatttccatcaaatgcctgcctgcctccctgttctagatcagggtgataatatagatattgaagaatcaagaaagtgcagagtctcatcatttaatatatttgcagcttcctgcaaatcaaagattgttgtatttatacacttttttagtatattctttaccccatttttctttccaggaatcatgaaaacggtaagggaatggaaaataaaacttgtcaattttttccttctgtattttctgaagaaaaccattgagcttgtaaacttatcatacgctggtgtgctatcacgaggaacaattttcatatttcgatattcaaaatt

SEQ ID NO: 6057 - DNA, 1836 bp, Trigonella foenum-graecum
ctctccgaccgataagaaaccaacaagacatgtcccatgtggtttcttagtatccactcacttaactcgtgttgccttgttccacttcaccaaaacttgtgacccatataaccaaaaaagttccctttttcctgtgtattcttctcttcttcttgttttctccattttccaaaacaccccttcttcactccaatggttgtaacttttgctatttaaacccctcaaagttgcttcattttccatctgggttttgtgaattgtgactgatacttcttgaatgatgtctgtcactagcaaaagcattgatttttttgggaagaacttggtttcttgtggctgttcttccaatgcttcttttcataggtatgaggtgaagaattatgctaaggtgaattctaaagggtgtagaaatggagctcgtaaattggtttgttgtaagaagaggaacactcctcaatatcgtgtttcttctatggagactgcagagcctactttgaatggtggaactcaagcaattaaagaccttgcaaaaggattgaacttgaagagttatccagaaacccctatttcacctaataggttgtttgaagtagtctctgatgatcttctaacactcaataaaaatcttcaatctattgtaggcgcagaaaatccagttttaatatctgcagctgagcagatctttagtgctggtgggaagaggatgagaccagctctcgtgttcttggtgtcaagggcgaccgcagagctacatggcctcgaggatcttactgtaaagcatcgacgtttagctgagatagttgaaatgattcatactgcaagcttgatacatgatgatgtgttagatgagagtgacctaagaagagggaaggaaactgttcatcaaatgtttggaacaagagtggcagtgctggctggagacttcatgtttgcacagtcatcatggtatctcgccaaccttgaaaacattgaagtcattaaacttatcagccaggttattaaagattttgctagtggagaaataaagcaagcttctagcttgtttgattgcgatgttcaacttgacgagtatctaatcaagagttattttaagacagcctccttgattgccgccagtgtaaaaggagctgcagttttcagcggttctgacagcagcctgaccgagaaaatgtttgaatacgggaagaatctcggtctctccttccaagttgtcgacgacatattggatttcacacaatctgcagaacaacttggaaagcctgctggcacggacctcgccaaaggtaacctgaccgctcctgtaattttcgcattggaaaaagaaccgaaattgagggatatcattgagtctgaatttagcgagattggttctcttgacgaagcgatcaagttggttaagagttgtgggggaatcgaaagagcacaagagttggcgaaagagaaagctgatcttgctattcaaagtcttcaatgtcttcctcaaagtgtgtatcgtttagctcttgaggacatggtgacatataatcttcaaaggattgcataagtttgtgcatgatgagacacattaagaaaatcaagaataatacattattatttcaacttgtcatttcaagattttccaacaaatccatcgacaccttccccttgtactacttttggggtactagtgtatagacactgaaggataaaaaacaagtaacataatatattccattactgtatttatgatcttatacatgtatcagtatattcttttccccatttttattttcttggatctggttgtaagggaataaaaaatgaaaaaaaatactaataaattatttttgttgtttc

SEQ ID NO: 6058 - DNA, 2105 bp, Cicer arietinum
catttttcaattcatattatcctcaaaaatcaaatgtttgaagcaagaatcatgaatcacatatttcattctctctctccgaccgataagaacccaacaagacaagtcccatgtgggttcttaggatccactcacttaacttgtgtttctaaccttttttcacttcaacataactaaactcgtgacccattaaaccaaaaaaaacataaaaacacccctttttttctgtgtattcttctctctttttcctcttattttcttcttgttccaagttcccaacttacacacttttttcctccaatgctattaacttcttcttgggtctctatttaaaccccaaagttacttcattttccatctgggtatttttgattgtgatttataagtttttgaatgatgtcttttacaagcaaaagtattgagttttttgggaaaaacttggtttcttgtggttgttcttccaatgcttcttttgataggaataaggtgaggaattatggaaaagttaattctaaaggatgtggaaatggagctcgtaaattgatttgttgtaagaagaagaacactactcaatatcgtgtttcttctatggagactgcagaacctactttgaatggtggggctcaagcaattaaagaccttgcaaaaggattgaacttgaagagttattcagaaacccctatttcacctaataggttgtttgaagtagtttctgatgatcttcaaacactcaataaaaatcttcagtctattgtaggggcagaaaatccagttttaatatctgcagctgagcagatctttagtgctggtgggaagaggatgagacctgctctcgtgttcttggtgtcaagggcgactgcagagctacttggcttggaggatattactgtaaagcatcgacgtttagctgagataattgaaatgattcatactgcaagtttgatacatgatgatgtgttagatgagagtgacctaagaagagggaaggaaactgttcatcaaatgtttggaacaagagttgcagtgctggccggagacttcatgtttgcgcagtcatcatggtatctcgccaaccttgaaaatatcgaagtcattaaacttatcagccaggtgattaaagattttgctagtggagaaataaagcaggcttctagcttgttcgattgcgatgttcaactcgacgagtatctaatcaagagttattacaagacagcttctttaattgctgccagtacaaaaggagctgcagttttcagtggttctgacagtaacatcaccgagaaaatgtacgaatacggaaagaatctcggtctatccttccaagttgtggacgacatattggatttcacacaatcagcagagcaactcggaaagcctgctggcactgaccttgccaaaggtaacttgactgctccagtaatctttgcattggagaaagaaccgaaattgagggatatcatcgaatctgagtttagtgagatcggttcactcgatgaagccattgcgttggtaaagagttgtggcggaattgaaagagcacaagagttggcgaaagagaaagctgatcttgctattcaaagtattcaatgtcttccgcaaagcgtgtatcgtttagctctcgaggatatggtgacatataatcttcaacggatcgcgtaagcttgttcatgctgatgatacataaagaaaatcagaataatacattttattctttggtcctataatatatggaagagaaccttgattttgaacaagacatactacaccttcttccccttgtgctactttttggggtactaatacagatattgaaggatcaagtaaatgcacattctcatcaatttatatgtttgcagttatctgcaaattaaagcacaagcaacaacaatatatattccattattgtattatataattttatacataaatcagtatattcttttccccatttttatgttcttggttttggttgtaagggaataattttttttttctatttccttttgttctgtatcttttcttgaatttgctcatactattttcactaacttattaaatactaatactttcttgttgaaaaagttaatcaacaattgattggaacc

SEQ ID NO: 6059 - DNA, 1695 bp, Medicago truncatula
ttccacttcaccaatacttgtgacccataaaaagaacccttttttctgtgtactcttctctttttctagttctcttccattttccataacacccccttcttcacacttcttcctccaatggttgctatttaaaccccctcttaagttgcttcattttccatctgggttttgtgaattgtctttgttacttcttgaatgatgtctgtcactagcaaaagcattgatttttttggtaaaaacttggtttattgtggctgttcttccaatgcttcttttcatagatatgaggtgaagaattatgctaaggtgaattctaaagggtgtggaaatggagctcgtaaattggtttgttgtaagaagaggaatactcatcaatatcgtgtttcttctatggatactgctgagcctactttgaatggcggaactcaagcaattaaagaccttgcaaaaggattgaacttgaagagttatccagcaacccctatttcaccaaataggttgtttgaagtagtctctgatgatcttctaacactcaataaaaatcttcagtctattgtaggcgcagaaaatccagttttaatatctgcagctgagcagatctttagtgctggtgggaagaggatgagaccggctcttgtgttcttggtgtcaagggcgaccgcagagctacatggccttgaggatcttactgtaaagcatcgacgtttagctgagatagttgaaatgattcatactgcaagtttgatacacgatgatgtgttagatgagagtgacctaagaagagggaaggaaactgttcatcaaatgtttggaacaagagtggcagtgctggctggagacttcatgtttgcacagtcatcatggtatctcgccaaccttgaaaacattgaagtcattaaacttatcagccaggtgattaaagattttgctagtggagaaataaagcaagcttctagcttgtttgattgtgatgttcagctcgacgagtatctaatcaagagttattttaagacagcctccttgattgctgccagtgtaaaaggagctgcagttttcagcggttctgacagcagcatgaccgagaaaatgttcgaatacgggaagaatctcggtctctccttccaagttgttgacgacatattggatttcacgcaatcggcagagcaacttggaaagcctgcaggtacggacctcgccaaaggtaacctgaccgctccagtaattttcgcattggagaaagaaccgaaattgagggatatcatcgagtctgaatttagcgagattggttctcttgacgaagcgatcaagttggttaagagttgtgggggaatcgaaagagcacaagagttggcgaaagagaaagctgatcttgctattcaaagtcttcaatgtcttcctccaagtgtgtatcgtttagctcttgaggacatggtgacatataatcttcaaagaattgcataagtttgtgcatgatgagacacatttagaaaatcaagaataatacatgattatttgaacttgtcatttcaagattttccaacaaacccagtgtatagacattgaaggatcaagaacaagtaacataatatattccattattgtatttatgatcttatacatgtatcagtatattcttttttccattttattttcttggatctggttgtaagggaatacaaaatttaaaatgaaaaa

SEQ ID NO: 6060 - DNA, 1643 bp, Arachis hypogaea
gctcatttcgcatttgggtcttttgtgattttaattttagtattggtttttctgtttggttcttcatcacattcttcagcttctgggcttggcgcagaagttcagaatgatttctgtgacaagtaaaagcattgattatgctgggaaaaacttggtttcttgtggatgctcctccaatgctaacactgtgagaagctatgctgcaagggtgaattctaaagtgtggggaagaagaggaggtcatggtgctgccaattttgtctgctgcaagagtaggagcattcagtgcagggtttcttctatgaagactgctgaacctactgttaatggtggaactgatgcaattcaaggaattccaacaggattggacttgaagagttattcagaaacccccatatcaccatcaaagttgtttgaagtagttgctgatgacctgcagacactcaacaaaaatcttcaatcgattgtaggtgcagaaaatccagttttaatgtctgcagctgagcagatatttagcgccggtgggaagaggatgagaccggctctggtgttcttggtgtcacgggctacagcagagctacttggcttgaaggaccttactgtcaagcatcgacggttagcagagataatcgaaatgattcatactgcaagtttgatacacgatgatgtattagatgagagtgacttacgacgagggaaggaaactgttcatcaaatgttcggaacaagagtggcagtgttggccggagacttcatgtttgcacagtcgtcatggtatctcgccaaccttgaaaatatcgaagttattaaacttatcagtcaggttattaaagattttgcaagtggtgaaataaagcaggcttctagcttgtttgattgtgatgttgaactcgacgagtatctaattaagagctactataagacagcctctttgattgctgccagtaccaaaggagctgcaatttttagtggcgccgaccgaaacatcactgagaaaatgtttgaatatggaaagaatctgggtctatccttccaagttgtggatgacatattggattttacacaatcggccgagcaactaggcaaacctgcaggcactgaccttgccaaaggtaacctcactgcaccggtgattttcgccttggaaaaagaaccaaagttgagggacatcattgaatcagaattcagcgagaccagttcccttgacgaagccatcaagttggtcaagagttgtggtggcatcgaaagggcgcaagaattggcaaaagagaaagctgatcttgctattcagagtcttcaatgccttcctccaagcatatttcgattagctcttgaggatatggtagcctataaccttcagaggattgcatgagcatttgcattgcagagaacatattattgaaaagaaaatcagaagaacattctttgatactaatagaaggatgagaatcatgacatttgaacttatgtcatttcaagaatttccagcaaatgcttccacatgagctactttggggggtttatattatagaaattgaaggacaaagcaaacacagtgtcatcacttaatatatttgcaacttgcaaattaaattacatggaaataatatatatatatatactccattgttgtataaacagca

SEQ ID NO: 6061 - DNA, 1912 bp, Lupinus angustifolius
gtctccaaaactgataagaaaccaaacattttagtcttatgtggtctcttacgatccactcacttaactcatttttctctttgttccttccaaacaattcaaaacacttgacccagaaacacacacctttcgttttcactctttgttcttttctacttcttcttccaatgactataacatgccattgtaactcttcttagagagaaattcacttcattttccttctgggttttgtgatttgggattagaacttgctcatttatcgtttaacttgtcacgatgatgtctgtgacaagtaaaagcattgattttgttgggaaaaacttggtttatggtggttgtttttctaatgcttcgtttgaccgttatacagtgaggaattatgcaaaggtgaattctaaagggtttttggggagaggccatggagctagtaattctatttgctgcaagaagaggagtactcagtgtcgtgtttcttctattatgaatattgtggagtcaactttgaatggtggaacacaagcaattcaaggtcttactggattggatttgaagaattattctgaaacccctatttcctccactcagttgtttgatgtggttgctgatgatctgcaaatgctcaataaaaaccttcaatcgattgtaggtgcagaaaatccagttttaatgtctgcagctgagcagatctttagtgctggtgggaagaggatgagaccggctctcgtgttcttagtgtcaagggctacggcagagttgcttggcttgactgaacttactgcaaagcatcgacgtttagcagagatcattgaaatgattcatacagcaagtttgatacatgacgatgtattagacgagagtgacctacgaagagggaaggaaactgttcatcaactattcggcacaagagtggctgtgttggccggagatttcatgtttgcacaatcatcatggtatctagccaaccttgaaaatattgaagtcattaaacttatcagccaggttattaaagacttcgcgagtggtgaaataaagcaagcttctagcttgtttgattgtgatgtcaaactcgacgagtatctaattaagagttactataagacggcctccttgatggctgccagtacaaaaggagcagcaatttttagcggcgcagacaacatcatctctgagaaaatgtacgaatacggaaagaaccttggtctatccttccaagttgtggatgacatattagatttcacacaatcagcggagcaactaggaaagcctgccgcgaccgacctttctaaaggtaatctgactgcaccagtaatcttcgcattggagaaagaaccgaaattgagggatatcattgagtccgaattcagtgagaccggttcccttgccgaggccatcgaattggtcaagggctgtggaggcattgaaagggcacaagagttggcaaaagagaaagctgatcttgctattcaaagtctccaatgccttcctcagagtgtatttcgtttagctcttgaggatatggtggcttataatcttcaaaggattgcttaagcttgtgcatgaaatcagaaaatcagaaaaaaaaagcattcttttggtcttaatataaaggatgatattgagagtcttgacatttgaacttgtatcattttcaagaattctcagaaaatccttttaatgcttcaccctgagctagttttgggtagtaatatagacattgaaggacaaaacaaacacacctcataatttaatgtatatttgcagcttcatgcaaaattgaagtactaggaaaataatattattccattattgtatcacaacagtacattcttctttttctgggatcatgagggaatgaaaatgtgataattttactattttatagtttaaattaccttaaaaatcttgatta

SEQ ID NO: 6062 - DNA, 1683 bp, Medicago truncatula
ggcacgagggtactcttctctttttctagttctcttccattttccataacacccccttcttcacacttcttcctccaatggttgctatttaaaccccctcttaagttgcttcattttccatctgggttttgtgaattgtctttgttacttcttgaatgatgtctgtcactagcaaaagcattgatttttttggtaaaaacttggtttattgtggctgttcttccaatgcttcttttcatagatatgaggtgaagaattatgctaaggtgaattctaaagggtgtggaaatggagctcgtaaattggtttgttgtaagaagaggaatactcatcaatatcgtgtttcttctatggatactgctgagcctactttgaatggcggaactcaagcaattaaagaccttgcaaaaggattgaacttgaagagttatccagcaacccctatttcaccaaataggttgtttgaagtagtctctgatgatcttctaacactcaataaaaatcttcagtctattgtaggcgcagaaaatccagttttaatatctgcagctgagcagatctttagtgctggtgggaagaggatgagaccggctcttgtgttcttggtgtcaagggcgaccgcagagctacatggccttgaggatcttactgtaaagcatcgacgtttagctgagatagttgaaatgattcatactgcaagtttgatacacgatgatgtgttagatgaaagtgacctaagaagaggggaagaaactgttcatcaaatgtttggacaagagtggcagtgctggctggagacttcatgtttgcacagtcatcatggtatctcgccaaccttgaaaacattgagtcattaaacttatcagccaggtgattaaagattttgctagtggagaaataaagcaagcttctagcttgtttgattgtgatgttcagctcgacgagtatctaatcaagagttattttaagacagcctccttgattgctgccagtgtaaaaggagctgcagttttcagcggttctgacagcagcatgaccgagaaaatgttcgaatacgggaagaatctcggtctctccttccaagttgttgacgacatattggatttcacgcaatcggcagagcaacttggaaagcctgcaggtacggacctcgccaaaggtaacctgaccgctccagtaattttcgcattggagaaagaaccgaaattgagggatatcatcgagtctgaatttagcgagattggttctcttgacgaagcgatcaagttggttaagagttgtgggggaatcgaaagagcacaagagttggcgaaagagaaagctgatcttgctattcaaagtcttcaatgtcttcctccaagtgtgtatcgtttagctcttgaggacatggtgacatataatcttcaaagaattgcataagtttgtgcatgatgagacacatttagaaaatcaagaataatacatgattatttgaacttgtcatttcaagattttccaacaaacccagtgtatagacattgaaggatcaagaacaagtaacataatatattccattattgtatttatgatcttatacatgtatcagtatattcttttttccattttattttcttggatctggttgtaagggaatacaaaatttaaaatgaaaaaataataatgattattatttttctgattttc

SEQ ID NO: 6063 - DNA, 1927 bp, Lupinus angustifolius
atcctaaattcatatgtctgaagcaacatgcatgagtcacagatttcattctcttccaaactgataagaaaccaaacactttagtcttatgtggtctcttaggatccactcacttaactccaacttcttctgttccttcatcaacactttaatattgtgacccataaaattacaccctttgttttcattatattgttcattgtttcttctttttctaccatatcttataactcaacttcatttctgccactttgaatctacttagagggaatttcacttcatttcccatctgggttttgttgattggtattggaacttgattattttctatctaacttgtcagaatgatgtcattgacaagtaaaagcattgattttgttgggaaaaacttgatttttggtggttcttgttctaatgcttcttttgatagttacatagtgaggaattatgcaaaggtgaatggaggtagtagaatggtttggtgcaagaggaggagcactcaatgtggtgtttcttctattatgaagattgtagaaccaacattgaatggtggaactcaagcaattcaaggccttaatggattggacttgaagaattactctgacgcccctatttccccagctcagttgtttgatgtggttgctgatgatctgaaaacactcaataagaaccttcagtcgattgtaggtgcagagaatccagttttaatgtcggcagctgagcagatatttagtgctggtgggaagaggatgagaccggctctcgtgttcttggtctcaagagcgacagcagagctacttggcttgaatgaacttactgtaaagcatcgacgtttagcagagataattgaaatgattcatactgcaagtttgatacacgacgatgtattagatgagagtgacctacggagagggaagaaaactgttcatcaactgtttggaacaagagtggcagtgttggctggagatttcatgttcgcacagtcatcatggtatttagccaacctcgaaaacattgaagttattaaacttatcagtcaggtgattaaagacttcgcgagtggtgaaataaagcaagcttctagcttgtttgattgcgatgttcaactcgacgagtatctagttaagagttactataaaacagcttccttgattgctgccagtacaaaaggtgcagcaattttcagcggtgctgacaacatcatcactgagaaaatgtacgaatatggaaagaatctcggtctgtccttccaagttgtggatgacatattagatttcacacaatcagcagagcaactaggaaagcctgctgcaaccgacctttccaaaggtaacctgactgcaccagttatttttgcattggagaaagaaccgaaattgagggatatcattgagtctgaatttagtgagcctggttccctcgatgaggccatcgaattggtcaagagctgtgggggcattgaaagggcgcaagagttggcaaaagagaaagctgatcttgctcttcaaaatctccaatgccttcctcagagcgcgtttcgtttagctcttgaggatatggttgcatacaatcttcaacggattgcgtaagcatgtgcatgctgtggacacattctgtgtattaagaagatcagaaagataaaataaaaaaagcattctttggtcttaatataaaggatgatactgaaattcttgacatttgatcttttattatgttcaagaattttcagcaattcctttaaatgcttcccccatgagctagttttgggtactaatatatagacattgaaggactaagcaaacatacctcataatttaatgtatattttcagctacatgcaaagttgaagtacaaggaaaataatattattccattttccattcacaacattacattcttaatctcattcttcttttttctaggatca

SEQ ID NO: 6064 - DNA, 517 bp, Vigna unguiculata
ctagtttagaccgcagcaaaacaatggcttcggaagaaacccagaacaaagcgacaacagagcagtcgagcagcgagcttctggcgagcgcgaagctggtggcggacgcggcgcagtcgacgctccggaacgaaagcgacaaggtggacaaggcgaaggtggcgggggcggcgggggacctgcttgacgcggcggggaagtatgggaaactggacgagcagaagggcgtaggacagtacgtggacaaagctgccgattatctgcatgggtacaaggacaaggctgctgcaccttctcaatctgaagattccaaacctcaagagggtggtggtttggccggtggtattgcaaatttggctggaggatttttcaagtagttctgctacaacaaaaaggactcactttcttcttcttgtggttgttcttctatgatgtaataagactcaataaatatgatctggtctggtgtttgtagaagaaagaccttttcttagttccacaaacatgctaattacta

SEQ ID NO: 6065 - DNA, 1330 bp, Vigna unguiculata
cattgtctctcgcttcccacaaggtacaatccatagaattctgatggcagccatggcaaccacaaccctaacttcaaaccccaagctttcattcttcgaccacaagcccacctccttccatggaaagcccgtttctcagtaccgtctcacacccacaaaatgctccgccaaaccacccgcaatctccatgtccctaactacacccccttacgacttccaatctttcaagttccaacccatcaaagaatccatcgtcgcacgcgaaatgacgcgccgctacatgaccgacatgataacctacgccgacaccgacgtcgtggtcgtgggggcgggctccgcgggcctctcctgcgcgtacgagctgagcaagaacccggccgtgcaaatcgccataatcgagcagtcagtgagccccggcggcggcgcatggctcggcgggcagctcttctccgccatggtggtgcgcaagcccgcccacctcttcctggacgagctcggtgttgcctacgacgagcaggaggactacgtggtgatcaagcacgcggcgctgttcacctccaccatcatgagcaagctcctggcacgccccaacgtgaagctcttcaacgccgtggcggcggaggacttgatcgtgaaggaagggagggttgccggagtggtcacgaactgggctctggtttctatgaaccacgacacacagtcctgcatggaccccaacgtgatggaggctaaggttgtagtgagttcttgcgggcacgatggaccctttggcgccaccggggttaagaggttgaagagtattggaatgatcgataacgtccctggaatgaaggccttggacatgaacactgctgaggatgctattgtgagactcaccagagagattgtgcctggcatgattgtgactggtatggaagttgcagagatcgatggagctccaagaatgggtcctacttttggggcgatgatgatatcaggtcaaaaagcagcacacttggcgttgaaggcattggggaggaacaatgcaatcgatggaacgtgtggggttggaagggaagaacctgagcttatgtttgcttctgccaacactgaagacattgttgatgcttaaacttcatcacacacattctgtttcagctccagcttatcatttgaattctggaataaataaagaaatatgtgaatgatgaaggataaaagagagtgtacctgttatgtctttgtttgggtggatagacaaattgtcaacaccggtcagcgacaagtcaaattattaaataaagaagagatagttaaattattgcttgttttattaaaaaaaaaaaaaaaa

SEQ ID NO: 6066 - DNA, 1374 bp, Glycine max
ccccactccgctcccctatcaataacatcttaaagtcccaactttttctacttaccttttctcttaatccaaatacgatggcagccatggcaaccacaaccctctcttcaaaccccaaactctcattcttcaacggaaagcccgtcacatattcttcccgcgtcgcgcccaccaccaaattatcctcatccaaacaaggcacaatttccatgtccctaaccccacccccctacgacctccagtccttcaaattccagcccatcaaagaatccatcgtgtcacgggaaatgacgcgccgctacatgaccgacatgataacctacgccgacaccgacgtcgtaatcgtcggagccggttcggccgggctctcctgcgcgtacgagctcagcaagaaccccgccgtgagcgtggccatagtcgagcagtcagtgagccccggcggcggcgcgtggctcggcgggcagctcttctccgcgatggtggtccgcaagccggcgcacctcttcctcgacgagctcggcgtggcgtacgacgagcaagaggactacgttgtcataaagcacgcggctttgttcacgtccaccatcatgagcaggctcctcgcgaggcccaacgtgaagctcttcaacgcggtggcggcggaggacttgatcgtgaaggaagggagggttgccggggttgtgaccaattgggctctggtttcgatgaaccatgacacgcagtcatgcatggaccccaacgtgatggaggcgaaggttgtggtgagctcttgtgggcacgatggaccctttggcgccactggggttaagaggttgaagagtattgggatgattgatagcgttcctggaatgaaggctttggatatgaatgctgctgaggacgctattgtcaggctcactagggagattgtgcctggcatgattgtcactggcatggaggttgcagaaattgatggctccccgagaatgggtccgacgtttggggcgatgatgatatcagggcagaaggcggctcatttggcgttgaaggctttgggtaggaacaatgcaattgatggaacgtgtggagttggaagggaagaaccccagcttattttggcttctgcggacactgaggaaattgttgatgcttaaattaagtttcaaattatataccttttcttttctgttttgtctctgcttatgatttgaattttagaataaatttttaaaaatgtgaatgatgaaggagacaatacctgttgttacttctttgaatttggactcacctatagcagatgaaaccaaattatcaaggatgggagagatagacgccacttaatacatttttaatacttactgtatgaattaaattcaagcgctagatgataatgcc

SEQ ID NO: 6067 - DNA, 1616 bp, Glycine max
gaaaaatatcggaaatgaaatcctcctgagccgttcatattctatctccaccccaaaaaagcatacagttttctagatttttcagtcagatatttcattcttcactcccccgtctcagtttataaaaccccactccgctcccctatcaataacatcttaaagtcccaactttttctacttaccttttctcttaatccaaatacgatggcagccatggcaaccacaaccctctcttcaaaccccaaactctcattcttcaacggaaagcccgtcacatattcttcccgcgtcgcgcccaccaccaaattatcctcatccaaacaaggcacaatttccatgtccctaaccccacccccctacgacctccagtccttcaaattccagcccatcaaagaatccatcgtgtcacgggaaatgacgcgccgctacatgaccgacatgataacctacgccgacaccgacgtcgtaatcgtcggagccggttcggccgggctctcctgcgcgtacgagctcagcaagaaccccgccgtgagcgtggccatagtcgagcagtcagtgagccccggcggcggcgcgtggctcggcgggcagctcttctccgcgatggtggtccgcaagccggcgcacctcttcctcgacgagctcggcgtggcgtacgacgagcaagaggactacgttgtcataaagcacgcggctttgttcacgtccaccatcatgagcaggctcctcgcgaggcccaacgtgaagctcttcaacgcggtggcggcggaggacttgatcgtgaaggaagggagggttgccggggttgtgaccaattgggctctggtttcgatgaaccatgacacgcagtcatgcatggaccccaacgtgatggaggcgaaggttgtggtgagctcttgtgggcacgatggaccctttggcgccactggggttaagaggttgaagagtattgggatgattgatagcgttcctggaatgaaggctttggatatgaatgctgctgaggacgctattgtcaggctcactagggagattgtgcctggcatgattgtcactggcatggaggttgcagaaattgatggctccccgagaatgggtccgacgtttggggcgatgatgatatcagggcagaaggcggctcatttggcgttgaaggctttgggtaggaacaatgcaattgatggaacgtgtggagttggaagggaagaaccccagcttattttggcttctgcggacactgaggaaattgttgatgcttaaattaagtttcaaattatataccttttcttttctgttttgtctctgcttatgatttgaattttagaataaatttttaaaaatgtgaatgatgaaggagacaatacctgttgttacttctttgaatttggactcacctatagcagatgaaaccaaattatcaaggatgggagagatagacgccacttaatacatttttaatacttactgtatgaattaaattcaagcgctagatgataatgccaagtgactacttaacacaaaatagccacatcaaaagtagaataatttctaaagtataaatattaatatgttattataagtgttctatttaaaagaaatttttgaaaatggttaaa

SEQ ID NO: 6068 - DNA, 1571 bp, Glycine max
ttttctagatatttccactcatcactcccagtctcagtttataaaaccccactccactccaacaataatatcatcaagtcccaacaactattctacttaccttttctcttaatccaaatatcatcatctgaaacgatggctgccatggcaaccacaaccctctcttcaaacccgaaactctcatttttccacggaaagcccgttacatattcttcccgcgtcgcacccaccaccaagttattctcatccaaacaaggcacaatctccatgtccctaacccaacccccatacgacctccaatccttcaaattccaacccatcaaagaatccatcgtctcacgcgaaatgacgcgccgctacatgaccgacatgataacctacgccgacaccgacgtcgtaatcgtcggagccggctcggcggggctctcctgtgcgtacgagatcagcaagaaccccgccgtgagcgtcgccataatcgagcagtccgtgagccccggcggcggcgcgtggctcggcggacaactcttctccgccatggtggttcgcaagccggcgcacctcttcctggacgagctcggcgtggcgtacgacgagcaagaggactacgttgtgataaagcacgcggctttgttcacgtccaccatcatgagcaggcttctagcgaggcccaacgtgaagctcttcaacgcggtggcggcggaggacttgatcgtgaaggaagggagggttgcaggggttgtgaccaactgggctctggtttcgatgaaccatgacacgcagtcttgcatggaccccaacgtgatggaggctaaggttgttgtgagctcttgtgggcacgatggaccttttggcgccaccggggttaagaggttgaagagtattggcatgattgatagcgttcctggaatgaaggctttggatatgaatgctgcagaggatgctattgtgaggctcacgagggagattgtgcccggcatgattgtcaccggcatggaggtggcagaaattgatggctccccaaggatgggtccgacgtttggggcgatgatgatatcagggcagaaggcggctcatttggcgttgaaggcgttggggaggaacaatgcaattgatggaacgtgtggagttggaagggaagaaccccagcttattttcgcttctgcagacactgaggaaattgttgatgcttaaacttactttcaaattagctagatatatagcttttcttttcttttctttctgtttggtccctacttaattatgattttaattttggaataaatgaacaacatgtgaattatgaaggagacaatacttgttgttacattgtatttggacagcacgtgccacgtatagcagaggaaaccatatattatcaaggatgggagagatagacgccacttaatttttttcatctattctcaatcgatgaaaagtgaccagtatatttctttctataaggtatctgcttgtctacgggatagtatccactcaattgttatgtaaattgtaagaaagtgacgttaataaaggctatgttaacatattttggggctaaagtttattttgcc

SEQ ID NO: 6069 - DNA, 1490 bp, Glycine max
atcatcaagtcccaacaactattctacttaccttttctcttaatccaaatatcatcatctgaaacgatggctgccatggcaaccacaaccctctcttcaaacccgaaactctcatttttccacggaaagcccgttacatattcttcccgcgtcgcacccaccaccaagttattctcatccaaacaaggcacaatctccatgtccctaacccaacccccatacgacctccaatccttcaaattccaacccatcaaagaatccatcgtctcacgcgaaatgacgcgccgctacatgaccgacatgataacctacgccgacaccgacgtcgtaatcgtcggagccggctcggcggggctctcctgtgcgtacgagatcagcaagaaccccgccgtgagcgtcgccataatcgagcagtccgtgagccccggcggcggcgcgtggctcggcggacaactcttctccgccatggtggttcgcaagccggcgcacctcttcctggacgagctcggcgtggcgtacgacgagcaagaggactacgttgtgataaagcacgcggctttgttcacgtccaccatcatgagcaggcttctagcgaggcccaacgtgaagctcttcaacgcggtggcggcggaggacttgatcgtgaaggaagggagggttgcaggggttgtgaccaactgggctctggtttcgatgaaccatgacacgcagtcttgcatggaccccaacgtgatggaggctaaggttgttgtgagctcttgtgggcacgatggaccttttggcgccaccggggttaagaggttgaagagtattggcatgattgatagcgttcctggaatgaaggctttggatatgaatgctgcagaggatgctattgtgaggctcacgagggagattgtgcccggcatgattgtcaccggcatggaggtggcagaaattgatggctccccaaggatgggtccgacgtttggggcgatgatgatatcagggcagaaggcggctcatttggcgttgaaggcgttggggaggaacaatgcaattgatggaacgtgtggagttggaagggaagaaccccagcttattttcgcttctgcagacactgaggaaattgttgatgcttaaacttactttcaaattagctagatatatagcttttcttttcttttctttctgtttggtccctacttaattatgattttaattttggaataaatgaacaacatgtgaattatgaaggagacaatacttgttgttacattgtatttggacagcacgtgccacgtatagcagaggaaaccatatattatcaaggatgggagagatagacgccacttaatttttttcatctattctcaatcgatgaaaagtgaccagtatatttctttctataaggtatctgcttgtctacgggatagtatccactcaattgttatgtaaattgtaagaaagtgacgttaataaaggctatgttaacatattttggggctaaa

SEQ ID NO: 6070 - DNA, 1573 bp, Cajanus cajan
aaaatatccgaaatggaagccctcgagagccgttcaaattctatctccaaccgcaaaaagcatagagtttgtagatttttcagtaagatatttccctcccatcactccctttctcgcttataaaacctacaacactacactgacaaatatcaagtcctaacatatatcactacttccctttctctctccaacaatggcagccatggcaaccacaaccctcaagctctcattcttccagggaaggcccatgactccgcgcgtcgcagccaccaaacccatggccagcaccttcccacaggcaacaatatccatgtccctaacacaaccctcctacgacctgcaatccttcaacttccaacccatcaaggagtccatcgtctcccgcgaaatgacgcgccgctacatgacggacatgataacctacgccgacacggacgtggtgatcgtgggggcgggctccgccggcctctcctgcgcctacgagctgagcaagaacccggccgtccgcgtggccataatcgagcagtcggtgagccccggcggcggcgcctggctgggcgggcagctcttctccgccatggtggtgcggaagccggcgcacctcttcctggacgagctgggcgtggcctacgacgagcaagaggactacgtggtgatcaagcacgcggcgctcttcacctccaccatcatgagcagggtcctggccaggcccaacgtgaagctcttcaacgccgtggcggcggaggacttgatcgtgaaggaggggagggtcgccggagtggtcacgaactgggccctggtgtccttgaaccacgacacccagtcctgcatggaccccaacgtcatggaggctaaggttgtggtaagctcttgcggacacgacgggccttttggcgccaccggggttaagaggctcaagagtattggcatgattgatagcgttcccggaatgaaggccctcgatatgaacactgctgaggacgctattgtcagactcactagagagattgtgcccggcatgattgtcaccggcatggaggttgcagaaattgatggtgcccctaggatgggacccacgtttggggcgatgatgatatcggggcagaaggcggctcatttggcgttgaaggcgttggggaggaacaatgccattgatggcacgtgtggagctgcaagggaagaaccagagcttattttcgcctctgcggatactgaggaaattgtcgacgcttgaacgttactactattagatatatagcttttcttttctctgttttgccttggctattatgatttgaattttggaatgaataaacaaaacaaacatgtgaatgatgaagtgatcaagagacaacacctgttgttaaatctttgtgtttacaggaacaaatggaacaggtgccacctattaatattagaggaaataagttatcaaggatatgattataattaatttgatttaggagatacttttattagtctttaactttccaaggtgtaaaaaagctctccactagaaaatacttcaatgaaaaatatataccaatggcaagtgaatttaacacgaaatcaa

SEQ ID NO: 6071 - DNA, 1206 bp, Arachis hypogaea
gtccatcgtcgtcttcttcttaccactattcttaattaattaattcccttccaatggcagccatggccaccaccaccgccctctcctcaaacctcatcaaggcctccgccttccacggcacaccggtcgccacttccagagtcactcccatcaaatcccaacagcagcagagccaaaccatctccatgtccatggccacacccccttacgacctccaatccttcaagttccaacccatcaaggagtccatcgtcgcacgcgagatgacccgccgctacatgaccgacatgatcacctacgcagacaccgacgtaatcgtggttggtgccggctccgctggcctctcctgtgcgtacgagctcagcaagaacccctcaatccgcgtcgccatcatcgagcaatccgtcagccccggcggtggggcctggctcggcggccagctcttctccgccatggtggttcgcaagcccgcccaccgcttcctggacgagttggaggtggcatacgacgagcaagaggactacgttgtcataaagcacgcggcgctgttcacttccaccatcatgagcaagttgctggcgaggcccaacgtgaagctgttcaacgccgtggcggcggaggatctgattgtgaaaggagggagagttggtggagttgtcacaaactgggccctggtgtcgatgaaccatgacacacagtcgtgcatggacccgaacgtgatggaggccaaggttgtggtgagctcgtgcgggcacgacgggcctttcggcgccaccggggttaagaggctgaagagcatcggcatgattgacagcgtgcctggaatgaaggcccttgacatgaacaccgcggaggatgccattgttaggctcaccagggagattgtgcctggcatgattgtcaccggcatggaagttgctgagattgatggtgcccccagaatgggtccaacattcggagcaatgatgatatcagggcagaaggcagctcatttggcgttgaaagcattgggaaagagcaatgccatcgatgggacttgtggacttgaaattgaagaaccccaatttgttttggcctctgctgatactgaggacattgttgatgcttgaagttttctattcaacttaggattttctttttttcttctgctttccctacctacgatttgcatttgggaataaataaagaaaaaatgtgaacgaaaaa

SEQ ID NO: 6072 - DNA, 1378 bp, Arachis hypogaea
ggtctcagtgtccatcgtcgtcttcttcttaccactattcttaattaattaattcccttccaatggcagccatggccaccaccaccgccctctcctcaaacctcatcaaggcctccgccttccacggcacaccggtcgccacttccagagtcactcccatcaaatcccaacagcagcagagccaaaccatctccatgtccatggccacacccccttacgacctccaatccttcaagttccaacccatcaaggagtccatcgtcgcacgcgagatgacccgccgctacatgaccgacatgatcacctacgcagacaccgacgtaatcgtggttggtgccggctccgctggcctctcctgtgcgtacgagctcagcaagaacccctcaatccgcgtcgccatcatcgagcaatccgtcagccccggcggtggggcctggctcggcggccagctcttctccgccatggtggttcgcaagcccgcccaccgcttcctggacgagttggaggtggcatacgacgagcaagaggactacgttgtcataaagcacgcggcgctgttcacttccaccatcatgagcaagctgctggcgaggcccaacgtgaagctgttcaacgccgtggcggcggaggatctgattgtgaaaggagggagagttggtggagttgtcacaaactgggccctggtgtcgatgaaccatgacacacagtcgtgcatggacccgaacgtgatggaggccaaggttgtggtgagctcgtgcgggcacgacgggcctttcggcgccaccggggttaagaggctgaagagcatcggcatgattgacagcgtgcctggaatgaaggcccttgacatgaacaccgcggaggatgccattgttaggctcaccagggagattgtgcctggcatgattgtcaccggcatggaagttgctgagattgatggtgcccccagaatgggtccaacattcggagcaatgatgatatcagggcagaaggcagctcatttggcgttgaaagcattgggaaagagcaatgccatcgatgggacttgtggacttgaaattgaagaaccccaatttgttttggcctctgctgatactgaggacattgttgatgcttgaagttttctattcaacttaggattttcttttttttcttctgctttccctacctacgatttgcatttgggaataaataaagaaaaaatgtgaacgaaaaatattaaatccgtttcgtttttatctccgtaagctaagattatacaatatgtacattaaaaatcaattattaataaacaataaatattaaaatataaatatataataaaaataaattaaattatacattattataacataaatatattaataattaattttat

SEQ ID NO: 6073 - DNA, 1552 bp, Gossypium raimondii
cctccatttaccacacaaacgcaccccaaaaacagttttgacccattcaatggcagccatggcaacaaccctcacttcactgtcttccacccccaaaccatccttcttagaccacaagtcatccttccatggcacccctttagcttctcgctttactcccattaaatcctcctcccaaaccgccaccatttccatgtccttaacccctccttacgacttgcagtcctttaaattccaacccatcaaagaatcctatgtcgctcgtgaaatgacacgccgttacatgatggacatgattacctatgctgacaccgatgttatcatcgtcggcgccggctctgcaggtctctcctgtgcttacgagattagcaaaaaccccaacatccgtgtcgccataattgaacagtctgttagccccggtggaggcgcatggctcggtggccaactattttcagccatggttgtgcggaaaccggctcacagattccttgacgagctcggcatccagtacgatgaacaagaagactacgtagtgatcaagcacgcagctctgttcacctcaacagtcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggacgcaattgttagacttaccagggaggttgtgcctggcatgattgttacgggaatggaagttgcagagattgacggagccccaagaatgggtccgacatttggagcaatgatgatatcagggcagaaggcagcacatttagccttgaaggcattgggacagccaaatgcgatagacgggaccttcagcgaagctgaaagagtacaaccagagtttgttcttgcttctgctgaaacagaggagattgtggatgcttgaacatatttgacagcgggtttggttttcagggaatggactccataaagattatatgtaaatgaaactacaccgttgtggaatggtgtgtgtgaaagactggagctggacaaaaggaggacttttgctttgagttttggtttaattgagttatgcttaatgtccatattatcttagaaaatgaagagaaaaaaatgttgtgcaatattaaatgaaggaaaggtgaatgttgctgcaactccaggttgtgggccatacctgaaacccctgggtttgagcagagatgcattattaccactaatgtgttatcgatatgcccttctggactttgaacaatttgtaagcccctttcagaacaaaaacagaaagcaaattgtaagccgttttgttcaataacaaaacttgcaacctaaaaggaattagctatggcagttgtct

SEQ ID NO: 6074 - DNA, 1471 bp, Gossypium hirsutum
gggatcacaaacgcaccccaaaaacagttttgacccattcaatggcagccatggcaacaaccctcacttcactgtcttccacccccaaaccatccttcttagaccacaagtcatccttccatggcacccctttagcttctcgctttactcccattaaatcctcctcccaaaccgccaccatttccatgtccttaacccctccttacgacttgcagtcctttaaattccaacccatcaaagaatcctatgtcgctcgtgaaatgacacgccgttacatgatggacatgattacctatgctgacaccgatgttatcatcgtcggcgccggctctgcaggtctctcctgtgcttacgagattagcaaaaaccccaacatccgtgtcgccataattgaacagtctgttagccccggtggaggcgcatggctcggtggccaactattttcagccatggttgtgcggaaaccggctcacagattccttgacgagctcggcatccagtacgatgaacaagaagactacgtagtgatcaagcacgcagctctgttcacctcaacagtcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggacgcaattgttagacttaccagggaggttgtgcctggcatgattgttacgggaatggaagttgcagagattgacggagccccaagaatgggtccgacatttggagcaatgatgatatcagggcagaaggcagcacatttagccttgaaggcattgggacagccaaatgcgatagacgggaccttcagcgaagctgaaagagtacaaccagagtttgttcttgcttctgctgaaacagaggagattgtggatgcttgaacatatttgacagcgggtttgattttcagggaatggactccataaagattatatgtaaataaaactacaccgttgtggaatggtgtgtgtgaaagactggcgctggacaaaaggaggacttttgctttgagttttggtttaatcgagttatgcttaatgtccatattatcttagaaaatgaggagaaaaaaatgttatgcaaagtaattctaagtgctacataatttaaccaatattaaatgaaggaaaggtaaatgttgctgcaactccaggttgtggtccatacctgaagcccttggggttgagcagagatgcgttattacaactaatgtgttgtcgatatgcccttctggactttgaac

SEQ ID NO: 6075 - DNA, 1611 bp, Gossypium hirsutum
atattttcagctctcccccctgcaaacaagcttaaataacaccccaagttgatactcgttaccatatcccctccatttaccacacaaacgcaccccaaaaatagttttgacccattcaatggcagccatggcaacaaccctcacttcactgtcttccacccctaaaccatccttcttagaccacaagtcatccttccatggcacccctttagcttctcgctttactcccattaaatcctcctcccaaaccgccaccatttccatgtccttaacccctccttacgacttgcagtcctttaaattccaacccatcaaagaatcctatgtcgctcgtgaaatgacacgccgttacatgatggacatgataacctatgctgacaccgatgttatcatcgtcggcgccggctctgcaggtctctcctgtgcttacgagattagtaaaaaccccaacatccgtgtcgccataattgaacagtctgttagccccggtggaggcgcatggctcggtggccaactattttcagccatggttgtgcggaaaccggctcacagattccttgacgagctcggcatccagtacgatgaacaagaagactacgtagtgatcaagcacgcagctctgttcacctcaacagtcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggacgcaattgttagacttaccagggaggttgtgcctggcatgattgttacgggaatggaagttgcagagattgacggagccccaagaatgggtccgacatttggagcaatgatgatatcagggcagaaggcagcacatttagccttgaaggcattgggacagccaaatgcgatagacgggaccttcagtgaagctgaaagagtacaaccagagtttgttcttgcttctgctgaaacagaggagattgtggatgcttgaacatatttgacagcgggtttgattttcagggaatggactccataaagattatatgtaaataaaactacaccgttgtggaatggtgtgtgtgaaagactggcgctggacaaaaggaggacttttgctttgagttttggtttaatcgagttatgcttaatgtccatattatcttagaaaatgaggagaaaaaaaatagttgtgcaatattaaatgaaggaaaaggtgaatgttgctgcaactccaggttgtgggccatacctgaaacccctgggtttgagcagagatgcattattaccactaatgtgttatcgatatgcccttctggaccttgaacaacttgtaagcccctttcagaacaaaaacagaaagcaaattgtaatcccttttgttcaataacaaaacttgcaacctaaaaggaattagct

SEQ ID NO: 6076 - DNA, 1855 bp, Gossypium raimondii
gggttgtgaattttccagaagaaagccgaaggagcctagcagcaggagataccattatacccatatcccaagctaatagcaaatttccaagcattatgaaccgttcaaattccatcttccatcactgcttttcagattttttgagcagatattttgatccagcttcagcactccagttcagatattttcagctctcccccctgcaaacaagcttaaataacaccccaagttgatactcgttaccatatcccctccatttaccacacaaacgcaccccaaaaacagttttgacccattcaatggcagccatggcaacaaccctcacttcactgtcttccacccccaaaccatccttcttagaccacaagtcatccttccatggcacccctttagcttctcgctttactcccattaaatcctcctcccaaacctccaccatttccatgtccttaacccctccttacgacctgcagtcctttaaattccaacccatccaagaatcctatgtcgctcgtgaaatgacacgccgttacatgatggacatgattacctatgctgacaccgatgttatcatcgtcggcgccggctctgcaggtctctcctgtgcttacgagattagcaaaaaccccaacatccgtgtcgccataattgaacagtctgttagccccggtggaggcgcatggctcggtggccaactcttttcagccatggttgtgcggaaaccggctcacagattccttgacgagctcggcatccagtacgatgaacaagaagactacgtagtgatcaagcacgcagctctgttcacctcaacaatcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggacgcaattgttagacttaccagggaggttgtgcctggcatgattgttacgggaatggaagttgcagagattgacggagccccaagaatgggtccgacatttggagcaatgatgatatcagggcagaaggcagcacatttagccttgaaggcattgggacagccaaatgcgatagacgggaccttcagcgaagctgaaagagtacaaccagagtttgttcttgcttctgctgaaacagaggagattgtggatgcttgaacatatttgacagcgggtttgattttcagggaatggactccataaagattatatgtaaataaaactacaccgttgtggaatggtgtgtgtgaaagactggcgctggacaaaaggaggacttttgctttgagttttggtttaattgagttatgcttaatgtccatattatcttagaaaatgaagagaaaaaaatgttggcaatattaaatgaaggaaaggtgaatgttgctgcaactccaggttgtgggccatacctgaaacccctgggtttgagcagagatgcattattaccactaatgtgttatcgatatgcccttctggaccttgaacaatttgtaagcccctttcagaacaaaaacagaaagcaaattgtaatcccttttgttcaataacaaaacttgcaacctaaaaggaattagctatggcagttgtctaaaaattttattgaaagaagctcaagtctttaaaattggctaaggttattttcc

SEQ ID NO: 6077 - DNA, 1568 bp, Gossypium hirsutum
caaacgcaccccaaaaacagttttgacccattcaatggcagccatggcaacaaccctcacttcactgtcttccacccccaaaccatccttcttagaccacaagtcatccttccatggcacccctttagcttctcgctttactcccattaaatcctcctcccaaaccgccaccatttccatgtccttaacccctccttacgacttgcagtcctttaaattccaacccatcaaagaatcctatgtcgctcgtgaaatgacacgccgttacatgatggacatgattacctatgctgacaccgatgttatcatcgtcggcgccggctctgcaggtctctcctgtgcttacgagattagcaaaaaccccaacatccgtgtcgccataattgaacagtctgttagccccggtggaggcgcatggctcggtggccaactattttcagccatggttgtgcgaaaaccggctcacagattccttgacgagctcggcatccagtacgatgaacaagaagactacgtagtgatcaagcacgcagctctgttcacctcaacagtcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggatgcaattgttagacttaccagggaggttgtgcctggcatgattgttacgggaatggaagttgcagagattgacggagccccaagaatgggtccaacatttggagcaatgatgatatcagggcagaaggcagcacatttagccttgaaggcattgggacagccaaatgcgatagacgggaccttcagcgaagctgaaagagtacaaccggagtttgttcttgctgctgctgaaacagaggagattgtggatgcttgaacatatttgatagggggtttggttttcagggaatggactccataaagattatacgtaaatgaaactagaccgttctggaatggtgtatgtgaaagactggagctggacaaaaggaggacttttgctttgagttttggtttaattgagttatgcttaatgtccatattatcttagaaaatgaagagaaaaaaatgttgtgcaatattaaatgaaggaaaggtgaatgttgctgcaactccaggttgtgggccatacctgaaacccctaggtttgagcagagatgcattattaccactaatgtgttatcgatatgcccttctggactttgaacaatttgtaagcccctttcagaacaaaaacagaaagcaaattgtaagccgttttgttcaataacaaaacttgcaacctaaaaggaattagctatggcagttgtctaaaaattttattgaaagaagctcaagtcttt

SEQ ID NO: 6078 - DNA, 1495 bp, Gossypium hirsutum
caccatcaatggtagccatggcaacaaccctctcttcactatcttccacccccaaaccatccttcttagaccacaagtcatccttccatggcacccctttagcttctcgctttactcccattaaatcctcctcccaaatctccaccatttccatgtccttaacccctccttacgacctgcagtcctttaaattccaacccatccaagaatcctatgtcgctcgtgaaatgacacgccgttacatgatggacatgattacctatgctgacaccgatgttatcatcgtcggcgccggctctgcaggtctctcctgtgcttacgagattagcaaaaaccccaacatccgtgtcgccataattgaacagtctgttagccccggtggaggcgcatggctcggtggccaactcttttcagccatggttgtgcggaaaccggctcacagattccttgacgagctcggcatccagtacgatgaacaagaagactacgtagtgatcaagcacgcagctctgttcacctcaacaatcatgagcaagctcttggcaaggcctaacgtgaagctattcaatgctgtggctgctgaggatttgatcgtgaaggaaaacagagtcgccggtgtggttacaaactgggctttggtgtcaatgaaccatgacacacaatcttgcatggacccaaacgtgatggagtccaaggttgtggtcagttcttgtgggcatgacggaccatttggagccaccggagtcaagagattgaagagtattgggatgatcgatagcgtccctggaatgaaggcactggatatgaatactgccgaggacgcaattgttagacttaccagggaggttgtgcctggcatgattgttacgggaatggaagttgcagagattgacggagccccaagaatgggtccaacatttggagcaatgatgatatcagggcagaaggcagcacatttagccttgaaggcattgggacagccaaatgcgatagacgggaccttcagcgaagctgaaagagtacaaccggagtttgttcttgctgctgctgaaacagaggagattgtggatgcttgaacatatttgatagggggtttggttttcagggaatggactccataaagattatacgtaaatgaaactagaccgttctggaatggtgtgtgtgaaagactggagctggacaaaaggaggacttttgctttgagttttggtttaattgagttatgcttaatgtccatattatcttagaaaatgaagagaaaaaaatgttgtgcaatattaaatgaaggaaaggtgaatgttgctgcaactccaggttgtgggccatacctgaaacccctgggtttgagcagagatgcattattaccactaatgtgttatcgatatgcccttctggaccttgaacaatttgtaagcccctttcagaacaaaaacagaaagcaaattgtaatcccttttgttcaataacaaaacttgcaacctaaaaggaatta

SEQ ID NO: 6079 - DNA, 1356 bp, Lotus japonicus
atcacctcttcttttgtgtatataacctccatcctcttacactgccaagtaccaactcactgtgatcctttctatctctaacactcttctccaaaacctcttcactcagttaacaatggcagccatggccaccacaaccctcacctcctccctcatttccaacccaaaatcctcattctcctccttccatggaaaacccatctccacccgcaccacctccatcaaatccaccacccaacaaaacacaaccaccatctccatgtccttgaactcccctgcttacgatctcgaagccttcaaatttgcacccatcaaggaatccatcgtctcacgtgaaatgacccgccgctacatgactgacatgatcacttacgccgacaccgacgtcgtcatcgtcggcgctggatccgccggcctctcatgcgcctacgagctcagcaaggacccttccatcagcatcgccatcattgagcagtctgtcagccccggcggcggcgcgtggctcggtggccagctcttctccgccatggtggtccgtaagccggctcacctcttcctcaacgagatcggcgtcgactacgatgagcaggaggactacgtcgtgatcaagcacgctgccctgttcacctccaccatcatgagcaagcttctggcgaagccgaatgtgaagctgtttaacgcggtggcggccgaggatttgatcgtgaaggaagggagagttgctggggtggttaccaactgggctttggtgtcaatgaaccatgacacacagtcatgcatggacccaaacgttatggaggctaagattgttgtgagttcctgtggccatgatgggcccttcggtgcaactggagtaaagaggttgaagagcattggcatgatcgacagtgttcctggaatgaaggcactggatatgaacacagctgaagacgctattgttaggttcacaagggaggttgtaccaggaatgatagtgactggcatggaggtagctgaaattgatggtgccccaagaatgggtccaactttcggtgctatgatgatatctgggcagaaagcagcccatttggcgttgaaggcattggggaagaacaatgctattgatggaacatgtgaagctgtgagggaagagccagagcttgttttggcttctgttgatgctgaggagactgttgatgcgtagagcttataatttagattgttttagattttttttccttttttttttctggtttacccccctgtcaatgatatgaattttgggataaataaagcaactgtgaatgaaacccgttgtttcatctttgcattcagattagttttctgaagcaacaaaaaagatcttttcattcagat

SEQ ID NO: 6080 - DNA, 1324 bp, Cicer arietinum
tactcttctttctcgcagccacaatggccacctcatctatcaccacttctctctcttcaactcctaaatcctcattcttcaatggaagatcaattgctacccgcacctcccacttaatcaaatccacctcccataactattcttcagtctccatgtccctcaacacacctccttacgatcttcaatccttcaaattccaacccatcaaagaatccatcgtctctcgtgaaatgacacgccgttacatgacagacatgattacctatgccgacaccgacgtcgtcatcgtcggtgccggttccgccggtctttcatgcgcttacgaattaagcaaaaatcctaacatcaatatagccataatcgaacaatccgtcagtcccggcggcggtgcatggctcggcggccaactcttctccgccatggttgtccgcaaaccagctcacctcttcctcgacgaaattggcgttgactacgacgaacaagaagactacgttgtaatcaaacacgctgctttgttcacttcaacaatcatgagtaaacttctcgctagacctaacgtgaaattgttcaatgctgttgctgccgaggatttgattgtgaaagaaggaagagttggtggtgttgttacgaattgggctttggtttcaatgaaccatgatacacagtcttgtatggatcctaatgttatggaagctaaggttgttgtgagttcttgtggacatgatggtccttttggtgccactggtgttaagaggttgaagagtattggtatgattgactttgttcctggaatgaaagcacttgatatgaatactgcggaagatgctattgttcgtcttactagggaggttgttcctggtatgattgttactggtatggaagttgctgaaattgatggagctccaagaatgggtccaacatttggagctatgatgatatcagggcagaaggcagctcatttggcattgaaggcattggggaggaacaatgcaattgatggaacatgcgattctgcaagggaagaacctgagcttgttttggcttctgttgaattagaggacactgttgatgcttaaagtttccagttaaatcgatttagtttttagcttattttccatttgcttttcttctgcctgtgatttggactcaataatgaataaagaaaatgcgaatgaagtgatgggttgtatatttgaataggttgtttatttgaataattggaagactggttatgggattcatgggtattgtccttctagctggaactgaattttgaggtttgttaaactctttccattccgtaattttaaatcttacagaaaag

SEQ ID NO: 6081 - DNA, 6873 bp, Cicer arietinum
gtatcttttaatttgtgatgtggatgtacaaaatagtaactgacagccgttcaacacccacttgaattaattgtgagcctttcaaattgtatcctcttcacctctttccttctttataaaactcatctgctactcttctctcacaaatatcaattacctttctattcctaaaatactcttctttctcgcagccacaatggccacctcatctatcaccacttctctctcttcaactcctaaatcctcattcttcaatggaagatcaattgctacccgcacctcccacttaatcaaatccacctcccataactattcttcagtctccatgtccctcaacacacctccttacgatcttcaatccttcaaattccaacccatcaaagaatccatcgtctctcgtgaaatgacacgccgttacatgacagacatgattacctatgccgacaccgacgtcgtcatcgtcggtgccggttccgccggtctttcatgcgcttacgaattaagcaaaaatcctaacatcaatatagccataatcgaacaatccgtcagtcccggcggcggtgcatggctcggcggccaactcttctccgccatggttgtccgcaaaccagctcacctcttcctcgacgaaattggcgttgactacgacgaacaagaagactacgttgtaatcaaacacgctgctttgttcacttcaacaatcatgagtaaacttctcgctagacctaacgtgaaattgttcaatgctgttgctgccgaggatttgattgtgaaagaaggaagagttggtggtgttgttacgaattgggctttggtttcaatgaaccatgatacacagtcttgtatggatcctaatgttatggaagctaaggttgttgtgagttcttgtggacatgatggtccttttggtgccactggtgttaagaggttgaagagtattggtatgattgactttgttcctggaatgaaagcacttgatatgaatactgcggaagatgctattgttcgtcttactagggaggttgttcctggtatgattgttactggtatggaagttgctgaaattgatggagctccaagaatgggtccaacatttggagctatgatgatatcagggcagaaggcagctcatttggcattgaaggcattggggaggaacaatgcaattgatggaacatgcgattctgcaagggaagaacctgagcttgttttggcttctgttgaattagaggacactgttgatgcttaaagtttccagttaaatcgatttagtttttagcttattttccatttgcttttcttctgcctgtgatttggactcaataatgaataaagaaaatgcgaatgaagtgatgggttgtatatttgaataggttgtttatttgaataattggaagactggttatgggattcatgggtattgtccttctagctggaactgaattttgaggtttgttaaactctttccattccgtaattttaaatcttacagaaaaggatgttttatgttatgctagaacttttgccagagattatatgtagcttggcattgcccttttgtggcagtggcacagatttgagctggaatttgagtattgaagaatttttataatagagtacattttgtttggacttgttatggttagtgtaatgttagttggatcgtgttgcagtcatttttatttctgaaatttatgctgttaagttgattgttatgtattaagttgcgcccttaaaactggttatgtagagacttgtttttttgtgcaagtccaagagagataaagccatttgtccgatgtttggggtgtagctatgaatgagaaaatcaagtgggttttgttaaacccatagatctctattaagttgcttatcctgaccaaaatttgatccacttagcacttctggaggagagaattctgttgaccaaaaataaccatgtccagagttgcttactacttgcaattgtgtttggttgggaggggaggggagccaaatcccaattttagctcccctccaagagtggggggatctagaggggagaaagtatttatatcatatttggatttaagtaggcttttatttaatgtgatcttaaatattacaatggttgaatatgtaattttacactatccctctattaagatctcttccctcccctcgttaaaccaaagacaaaagattttaaaatcccgcctccctccgttgaacaaacagtcccttagaatatcctaattttgttgtctctaaatagttttgtcaaaacgtgttattttccgaaaatctttgttataactaaagagttctgcggctgcatctgcatctgccagccgttataactctgacaccattgttttgttgaggcatcatgatttgattaatattggaagagaccccttaaaaaatatagtcgcctttgtaattgttattgtcgtacatttcaaagttgatgtgaggaatgcttaataaagagaatagaaattgtaatagaaataaaggggtgttatgctttgacctctgatggggtaatccaaaagaaactagtactaagagcattttgttttgggccataacatgggtcttaagggcacattttttttattgaaaacacaatgattgaatttttagagttgaaaactcaagtttaagacaaaattttacatttaaatcattcacatgggcgtcaacattgggacacatgtctcttttgttttatactccaagtggtgtcatagtggagtagcatagctaattgattgattcagcacagttttgcatagggggcagtattcagcaaagttttgcacagttcaaaagccttttctagaggtaatgagtcaaagcttctacggtgccatatcgattatttcatcaaaactaaaattaagataactgaaatatattgaaacacttaatttgagtgatgacctatcatggcatcctctaaaaatggcggccacaaaacattactagttggcatccgatcctttttataaaaaaaacaaaactaagtagaaatttcggaaaatttatttgacaggaaatcacataatgatatgccaattgacagtgcattagtgcaaaggcgcgaaacttaacgcccagttgcagcctgacaattatagcgtcactgctggttttgttacaattcttaataacagaaggaaatgttagaactcgagaagattattctaatgtgaacaactgggtagaagaatagtgtaagaccaacataaacataagaacaggagtaagatcaagacatgcatgattcatgttaagcaatagcaacttagcatgtatactttcaaaaggaccatgcaacatttttttcttacaagcataaaaaaaaacgtcatactaaactagctaataatcgtgatatccacgtcaagacgaccaacaaactacctactttatgaaaatcagaaataatagtgatatccatatacactatcattctttattaaacctgtcaaatctatctagcttcgttggcaatcactatggttagatgtccatttttcaccgcaagcatagcaaaattcgaatcggcacctgcaaataaacaccaccggcttattcttattcacaattcaagtaaaaaaaaaaacaatttacactatttttttttacacataattacccttttgatgataaactcaaaaactgcatgatcatgtttaaaatgcaaacaatttttttcttcccttttcttatgtttccaaacaaagagttgtatagttgtgaagaaaactgacttacctgatatggttttcttcttttccaaaaataataaataaaaacctaaagaaaatagatcgtggatgtaagagccattaatttacactaccagtaaataagagccattaattttaaaatatcatggaatttttacactaccaaaataaagggtggttgttggatgttagcacaatgtagttttacagtgatatcgcaaactcactagactcaaaaacttaaacccttcgctttagcagctagttttgttcgaatgatctaagttctatataaaaacatatgaaaacccatctatcgagcaccacttatgaaagagtggtccctcatccttcctgtttcattttgcaaagatgacttacgccgcctaatatcagtataaaaacataataatgcgactcactaactgcatgtgatatgcaaacagccttcaaattttttgatatagaatttgcatttgggacaccttttccatttttcctgatgagcaagctctctaacaagaagatcttgatttcatcatccctagggaacattggcagcttaaaagaaatatttttacaaaataacaatttgactggtcaaattccagcaaatcttattggaaaaccaggacttatcatcagaacttccggcaatagtttcttgtcacctccagcaccttgagataaagactttccttttgtcaagattttttgcgtgcttggattattctgattttggtggaaattcttcattttcaactcgaaaaccgaaggtcgaacttcaactcaaccttctcttgataagagcatatagatttattgttttgacttggagtgtactttctgattggtggaacagattcattcaactttgattctcagttccttgaaagttagaatgttctgttatcattgtataggcattatttattattttattaaaaaagttcatgcctttttggtgttttttgtttttcatactcgttttatattctggttttagtgtactacatgtattttaaaaaagaaaaaacttataacggtctcatgctagaaaactcaggtttattaatatcagattgaaatggaatggaatagaagaagtataattgaataaaaaactatcattgtattgaataattttataatggaatgcaaagtgtatggattacattccacggaaatgtatcctctttcactttttatgctctccattttcgaaaatggaccccctgctacttctacacagtgcaacggctaatgtgatattaggtaactttaaataactcaaaactataataataaagaggagaattaaagagaaaaaaaatagggaaatcccactccattccataccctcaaattgacagggaaaagaagcggagagtattgaatggaatatgacaaaaattaaagtatatgcaggtgtagagtctaatctattgaaataactgacagactaaacatgtctttgtacatgatttaatttccaatcgcgattaaagataagtcattgaaagtgattggcaaaaatattccttgctaagtcacatcccaatgatcataattttaaatatcaacacacctagtttatatgccccatccctaaaacgaaccctttgtgctatacaaaggttgattctaatttagtgtttcatacttcccaatcattagcttcttttattcttgaaactttgttatgatattaatgtatcaaacttctttcaatcctatactattagttatagtcacaaagaaactctcaactataacctgtgagtctcaagattcaacttctaaaaaaaatctcaacaaaaatatactctcttcaaattttagattaaatacatcaattttattcgatctattttttctcgtaaatatgaccaaaagaatggacaaattattattatttacaccgctaatataaaataaacttgtcacatgactaataacttttgtgtttcaaatcaaatgcttggcaattggcatcttaaaaaaatatttacttgggcaaggcaaaaggcatacactcaaattatgatgctcatgtgggactcacatgcagaacaactctgcatctatcatgtgaaatatctcctccttcttggtcagctattcagacaaagcagaaacatatttttggctttagtgatgatgccaactccaatgcaatgcatgcacaatccaatgattatacaagtcaggatttacattgtaataattttctcagatccatccaaattaacacctattctacaccaaaggcaacaacacatagtttgttggaataataataataaccaaccaataaaagaaataaaacaaacaaacttattcatcaaactaaattataagcttgagcttccataataatctttgaaatttaatttacctctctaattttcctttcttaagtgaaaaaagaggagggaagacactgctcttcatctgtgtacaaattggcacgttaatcatttgtctaattctaatagtagctgatcttgttctttccaacccttttttttacctcttcacatgttgttgctcgttgtttcttgaaccttctttgatttaagaagtgattaaagtaatgtgaaaattaatatcaggttttttttagatcttttcaagtgcaaattaattgattttagtgcaattaacttgaagatggtaagaaacatttgattaagatgtgatcacgcttttgttggtgatttttgtagggtccaacatttggagctatgatgatatcagggcagaaggcagctcatttagcattgaaggtattggggaagaacaatgcaattgatggaacatgcgattctgcaatggaagaacctcaacttgttttggcttcggttgaatcacactgttgatacacattgtttatgcttaaagtttacaattaaatcaattcagtttttagcttattttcatttgcttttctccatcttgtgatttggactcaataatgaataaagaaaatgcgaatgaagtgatcatacttgtgtcactcagagtatattttttcatatctgtatttagacaaacaaattgtcagaacatgtagtaatttacgaactatttatgacaaaagaagaagataaatggtgtacccaatctatca

SEQ ID NO: 6082 - DNA, 1407 bp, Cicer arietinum
cctttctattcctaaaatactcttctttctcgcagccacaatggccacctcatctatcaccacttctctctcttcaactcctaaatcctcattcttcaatggaagatcaattgctacccgcacctcccacataatcaaatccacctcccataactattcttcagtctccatgtccctcaacacacctccttacgatcttcaatccttcaaattccaacccatcaaagaatccatcgtctctcgtgaaatgacacgccgttacatgacagacatgattacctatgccgacaccgacgtcgtcatcgtcggtgccggttctgccggtctttcatgcgcttacgaattaagcaaaaatcctaacatcaatatagccataatcgaacaatccgtcagtcccggcggcggtgcatggctcggcggccaactcttctccgccatggttgtccgcaaaccagctcacctcttcctcgacgaaattggcgttgactacgacgaacaagaagactacgttgtaatcaaacacgctgctttgttcacttcaacaatcatgagtaaacttctcgctagacctaacgtgaaattgttcaatgctgttgctgctgaggatttgattgtgaaagaaggaagagttggtggtgttgttacgaattgggctttggtttcaatgaaccatgatacacagtcttgtatggatcctaatgttatggaagctaaggttgttgtgagttcttgtggacatgatggtccttttggtgccactggtgttaagaggttgaagagtattggtatgattgactttgttcctggaatgaaagcacttgatatgaatactgctgaagatgccattgttcgtcttactagggaggttgttcctggtatgattgttactggtatggaagttgctgaaattgatggagctccaagaatgggtccaacatttggagctatgatgatatcagggcagaaggcagctcatttggcattgaaggcattggggaggaacaatgcaattgatggaacatgcgattctgcaagggaagaacctgagcttgttttggcttctgttgaattagaggacactgttgatgcttaaagtttccagttaaatcgatttagtttttagcttattttccatttgcttttcttctgcctgtgatttggactcaataatgaataaagaaaatgcgaatgaagtgatgggttgtatatttgaataggttgtttatttgaataattggaagactggttatgggattcatgggtattgtccttctagctggaactgaattttgaggtttgttaaactctttccattccgtaattttaaatcttacagaaaaggatgttttatgttatgctagaacttttgccagagattatatgtagcttggcattgcccttttgtgg

SEQ ID NO: 6083 - DNA, 1362 bp, Gossypium hirsutum
caacattcagatattttctaactctctccatttagaaaaagcttaaatacccaaagtttggattcatcactctcaactagatccctttcatctaccacacaaacttagctgaaagatcaatggcagccatggcaacagctctcacctcactgtcttcaagccccaaaccatctttcctagaccacaacaagtcatccttcagcggcactccaattccttctcgcttcactcccatcaagtcctcctcacacaactcaaacatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtctaaggttgtggtcagttcttgtggacatgatggaccttttggagccactggggtcaagagattgaagagcattgggatgattgacagcgtccctggaatgaaggcactggatatgaacacggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcacacttagccttgaaggcattggggcagcccaacgccgtagatgggaccttcagcgaagctgaaagggtacagcctgagtttgttctagctgctgctgaaacagaggagactgtggatgcttgaaaaaatatttgataattttctggaaatggaataaataaagaaacatgtggatgaaattagatctttttggaatgaattgatggattgaatgtgaacaaaaggtgagctttggatttgattaatgtccatataatgttggaaaatgaagaaaataatatctagattgagattt

SEQ ID NO: 6084 - DNA, 1363 bp, Quercus alba
gctcacactcatcattctaagcctttgattacctcacaacatcatcgttccccaaaactatatcaaacacttcaatggcagccatggctacaaccttcacttcttcactcccaaaaccatctttcttagacaacaataagtcctgcttccatggcacgcccatcactacctctcgcttcacacccatcaaatccaccccacaaaactccaccatttctatgtccttaaccccaccatacgacctaaaatctttcactttccaacccattaaagaatccactgtctctcgtgaaatgactcgccgatacatgacagacatgatcacttacgctgatactgatgttgtcatagtcggtgctggctcagctggtctctcatgcgcttatgaactcagcaaaaacccttcaatccgtatagctattattgaacaatccgttagccctggtggtggtgcatggcttggtggccagctcttttcagctatggttgtacgtaaaccagctcatcatttccttgacgagcttgaaatcgagtatgatgagcaagaaaactacgttgttatcaagcacgcagctttgttcacatccacaatcatgagcaagctattggctaggcctaacgtgaagttgttcaacgctgtggcagctgaggatttgatagtgaaggaagagagggtctcgggtgtggtgaccaactgggctttggtttcaatgaaccatgacactcagtcttgcatggatcctaatgtgatggaggctaaggttgtggtgagctcgtgtgggcatgatgggccatttggagccaccggagttaagaggctgaagagtattggaatgattgatagtgtgcctgggatgaaagcccttgacatgaacactgctgaggatgccattgtcaggcttactcgagagattgtgcctggtatgattgttactgggatggaggttgcagaaattgatggtgccccaagaatgggtccaacatttggggccatgatgatatcgggtcaaaaggcggcacacttggccttgaaggcgttgggacagcccaatgcaatcgatgggacatacagtgaagctgggggcgtacaaccagagcttattcttgctgctgctgagactggggagattgttgtggatgcgtgatgatacgaggccttttggattgttaaaatttggaataaataaaggaagtgttgatgaaaatagaccattttggtagggattactagatattggatgtggatatttgtatgtgatggggaaaattcattttgatttgtgttaaattaagttctagtttagtaagcatatatactatatatattggaaggtgtattttgagaagattattgccattgaaa

SEQ ID NO: 6085 - DNA, 1286 bp, Gossypium raimondii
ctttcatctaccacacaaacttagctgaaagatcaatggcagccatggcaacagctctcacctcactgtcttcaagccccaaaccatctttcctagaccacaacaagtcatccttcagcggcactcaaattccttctcgcttcactcccatcaagtcctcttcacacaactctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtctaaggttgtggtcagttcttgtggacatgatggaccttttggagccactggggtcaagagattgaagagcattgggatgattgacagcgtccctggaatgaaggcactggatatgaacacggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcacacttagccttgaaggcattggggcagcccaacgccgtagatgggaccttcagcgaagctgaaagggtacagcctgagtttgttctagctgctgctgaaacagaggagactgtggatgcttgaaaaaatatttgataattttctggaaatggaataaataaagaaacatgtggatgaaattagatctttttggaatgaattgatggattgaatgtgaacaaaaggtgagctttggttttgattaatgtccatataatgttggaaaatgaagaaaataatatctagattgagattttattgggc

SEQ ID NO: 6086 - DNA, 1549 bp, Theobroma cacao
ggtcccaatatcccaagtagatagcaaaaatccaagcattatgaaccgttcaaattctatcttcatcaaccttttcattttttttcagatttttccaacagatattttgatcaagcttcgacactccattttagatattttcatctctctcggtctctccgtccttcaaaaaagcttaaatgccccatgttgacactcagtcactcatcactccccaccgtatctccttcatttaccacacaaaggcaccccaaaacactccactacaatcaatggcagccattaccgctaccctcccctcactgtcttcaagccccaaaccatctttcttagaccacaagtcatccttccatggcaccccgattgcttctcgcttcactcccattagatcctcctcccaggactccgccatttccatgtccttgaatactcctccttatgacttgcaatcctttaacttccaacccatcaaagaatcctacgtcgctcgtgaaatgacacgccgttacatgatggacatgattacttatgctgacactgatgttatcatcgtaggcgccggctctgcgggtctctcttgtgcttacgagattagcaaaaaccccagcatccgtgttgccataattgaacaatctgtcagccctggtggaggcgcatggcttggtggtcaactattttcagccatggttgtgcgcaaaccagctcacatattcctagatgagctcggcatccaatatgatgagcaagaaaactacgtcgtcatcaagcatgcagctttgttcacctcaacaatcatgagcaagcttttggccaggcctaacgtgaagttgttcaatgctgtggctgccgaagatttgatagtgaaggataacagagttgccggagtggtaactaactgggctttggtgtctatgaaccatgatacacaatcttgcatggacccaaatgtgatggaggctaaggttgtggtcagttcctgtgggcatgatggaccttttggagcgactggagtcaagagattgaagagtattgggatgattgatagcgtccctggaatgaaggcactggatatgaatactgcagaggatgcaattgtcaggcttaccagggagattgtgcctggcatgattgttacaggaatggaagttgcagagattgatggagccccaagaatgggtccaacatttggagcaatgatgatatcaggacagaaagcagcacacttagccttgaaggccttggggcagcctaatgcaatagatgggaccttcatcgaaggtggaagagtacagccagagtttgttcttgctgctgctgagacagaggggactgtggatgcttgaaaatatattatagggaattcgattttcaggggaatggaataaataaagaaagatgtggatgaaattagaccattttgggatagggtgatagggttggaagtggataaaaagtggacttttaatttgatttttggttcaaatgagttctgattaatgttcatatactgctggaaaatgaagaaaaaaaaactttactagtttgggat

SEQ ID NO: 6087 - DNA, 1709 bp, Theobroma cacao
ttaaacttcaaaggccaaccaataactacaatgccagcccatcactgtagtaggttcagctcgatgaatacaatgcagaaatgaaagttcaaaggcacaacgtttccctttcccaagaaaagcaagccagcaacgatatcagtagcacagacactatcatggtcccaatatcccaagtagatagcaaaaatccaagcattatgaaccgttcaaattctatcttcatcaaccttttcattttttttcagatttttccaacagatattttgatcaagcttcgacactccattttagatattttcatctctctcggtctctccgtccttcaaaaaagcttaaatgccccatgttgacactcagtcactcatcactccccaccgtatctccttcatttaccacacaaaggcaccccaaaacactccactacaatcaatggcagccattaccactaccctcacctcactgtcttcaagccccaaaccatctttcttagaccacaagtcatccttccatggcaccccgattgcttctcgcttcactcccattagatcctcctcccaggactccgccatttccatgtccttgaatactcctccttatgacttgcaatcctttaacttccaacccatcaaagaatcctacgtcgctcgtgaaatgacacgccgttacatgatggacatgattacttatgctgacactgatgttatcatcgtaggcgccggctctgcgggtctctcttgtgcttacgagattagcaaaaaccccaacatccgtgttgccataattgaacaatctgtcagccctggtggaggcgcatggcttggtggtcaactattttcagccatggttgtgcgcaaaccagctcacatattcctagatgagctcggcatccaatatgatgagcaagaaaactacgtcgtcatcaagcatgcagctttgttcacctcaacaatcatgagcaagcttttggccaggcctaacgtgaagttgttcaatgctgtggctgccgaagatttgatagtgaaggataacagagttgccggagtggtaactaactgggctttggtgtctatgaaccatgatacacaatcttgcatggacccaaatgtgatggagtctaaggttgtggtcagttcctgtgggcatgatggaccttttggagcgactggagtcaagagattgaagagtattgggatgattgatagcgtccctggaatgaaggcactggatatgaatactgcagaggatgcaattgtcaggcttaccagggagattgtgcctggcatgattgttacaggaatggaagttgcagagattgatggagccccaagaatgggtccaacatttggagcaatgatgatatcaggacagaaagcagcacacttagccttgaaggccttggggcagcctaatgcaatagatgggaccttcatcgaaggtggaagagtacagccagagtttgttcttgctgctgctgagacagaggggactgtggatgcttgaaaatatattatagggaattcgattttcaggggaatggaataaataaagaaagatgtggatgaaattagaccattttgggatagggtgatagggttggaagtggataaaaagtggacttttgttttgatttttggttcaaatgagttctgattaatgttcatataccgttggaaaatgaagaaaaaaaaactttactagtttgggat

SEQ ID NO: 6088 - DNA, 1209 bp, Castanea mollissima
tcgttccccataaccatatcaagcacttcaatggcagccatggctacaaccttcacttcttctctcccaaagccatctttcttagacaacaataagtcctgcttccatggcacacccgtcactacctctcgcttcacacccatcaaatccaccccacaaaactccaccatttctatgtccttaaccccaccatacgacctaaaatctttcactttccaacccattaaagaatccactgtctctcgcgaaatgactcgccgatacatgacagacatgatcacttacgctgatactgatgttgtcatagtcggtgctggctcagctggtctctcatgcgcttatgaactcagcaaaaacccttcaatccgtatagctattattgaacaatccgttagccctggtggtggtgcatggcttggtggccagctcttttcagctatggttgtgcgtaaaccagctcatcatttccttgacgagcttgaaatcgagtatgaggagcaagaaaactacgttgttatcaagcacgcagctttgttcacatccacaatcatgagcaagctattggctaggcctaacgtgaagttgttcaacgccgtggcagctgaggatttaatagtgaaggaagagagggtctcgggtgtggtgaccaactgggctttggtttcaatgaaccatgacactcagtcttgcatggaccctaatgtgatggaggctaaggttgtggtgagctcgtgtgggcatgatgggccgtttggagccactggagttaagaggctgaagagtattggaatgattgatagtgtgcccgggatgaaagcccttgacatgaacactgctgaggatgccattgtcaggcttactcgagagattgtgcccggtatgattgttactgggatggaggttgcagaaattgatggtgccccaagaatgggtccaacatttggggccatgatgatatcgggccaaaaggcggcacacttagccttgaaggcattgggacagcccaatgcaattgatgggaaatacagtgaagctgggggcatacaaccagagcttattcttgctgcagctgagactggggagattgttgtggatgcgtgataatacaaatacaaggccatttggattgttaaatttgaaataaataaaggaagagtgttgatgaaaatagaccattttggtagggattactagatattggatgtggat

SEQ ID NO: 6089 - DNA, 1333 bp, Gossypium hirsutum
gatctttcatctaccacacaaacttagctgaaagatcaatggcagccatggcaacagctctcacctcactgtcttcaagccccaaaccatctttcctagaccacaacaagtcatccttcagcggcactcaaattccttctcgcttcactcccatcaagtcctcttcacacaactctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtctaaggttgtggtcagttcttgtggacatgatggaccttttggagctactggggtcaagagattgaagagcattgggatgattgacagcgtccctggaatgaaggcactggatatgaacacggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcacacttagccttgaaggcattggggcagcccaacgccgtagatgggaccttcagcgaagctgaaagggtacagcctgagtttgttctagctgctgctgaaacagaggagactgtggatgcttgaaaaaatatttgataattttctggaaatggaataaataaagaaacatgtggatgaaattagatctttttggaatgaattgatggattgaatgtgaacaaaaggtgagctttggttttgattattgtccatataatgttggaaaatgaagaaaataatatctagattgagattttattgggctgcaactagtttgattcatttttaagctcacccatctttttttt

SEQ ID NO: 6090 - DNA, 1777 bp, Gossypium raimondii
acaacattcagatattttcaactctcttcattttagaaaaaagcttaaatacccaagtttggattcatcactctccactagatccctttcatctaccacacaaacttagctgaaagatcaatggcagccatggcaacagctctcacctcactgtcttcaagccccaaaccatctttcctagaccacaacaagtcatccttcagcggcactcaaattccttctcgcttcactcccatcaagtcctcttcacacaactctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtctaaggttgtggtcagttcttgtggacatgatggaccttttggagctactggggtcaagagattgaagagcattgggatgattgacagcgtccctggaatgaaggcactggatatgaacacggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcacacttagccttgaaggcattggggcagcccaacgccgtagatgggaccttcagcgaagctgaaagggtacagcctgagtttgttctagctgctgctgaaacagaggagactgtggatgcttgaaaaaatatttgataattttcaggaaatggaataaataaagaaacatgtggatgaaattagatctttttggaatgaattgatggattgaatgtgaacaaaaggtgagctttggttttgattaatgtccatataatgttggaaaatgaagaaaataatatctagattgagattttattgggctgcaactagtttgattcatttttaagctcacccatctttttttttttaattaaaacccattcaacttcaacaaatatagttaagtacaaaagaatgtaattccgccggaaatcgaaaatgaatgtgagctcatacactctaagcttaaatgattaagtttgtctgttaatgtatcacctgaacaggctacgtattgaaaaataggaccgtcgaatagaaagataaaaatctgagcctcatttaacaattggcccaataaaagtaagtccatactatgaatgaattaagtttagagactaccaaaatacaattactctccaaaattacatgtgtaaagcttatagcttgtgcataacataacacaacaattatggcatgggcctccgcctatgttgggtcaataacc

SEQ ID NO: 6091 - DNA, 1284 bp, Vitis vinifera
atcactcttatccgtcttcatagcccatatcatcaatggcgtccatggctaccactctcacttctctttcttccaacccaaaaccagctttcttcgacaacaagtcctccttccatggctctcccatctcctatcgtgtccttcccatcaaggtctcccaccaaagccccacaatttccatgtcctccgtctctccatacgatcttcagagcttcaagttcgaacccatcaaggagtccatcgttgcgcgcgagatgactcgccgttacatgatggacatgatcacctacgccgacaccgacgtcgtcatcgtcggagccggctccgcggggctctcgtgcgcgtacgagctcagcaagaacccgtcaatccgtgtggcgataatcgagcagtccgtcagtcccggcggcggcgcgtggctcgggggccagctgttctcagccatggtggtgaggaagcctgctcatcacttccttgatgagcttggcatcgagtatgatgagcaggacaactacgttgtgatcaagcatgccgctctgttcacttccaccatcatgagcaagctcttggccaggcctaatgtgaagctcttcaacgccgtggccgctgaggatttgattgtgaaggaagagagggtggccggcgtagtcaccaactgggctttggtttcaatgaaccacgacacacagtcctgtatggaccccaatgtgatggaggcgaaggtggtggtgagctcttgcggccacgacgggcccttcggagccacaggagtcaagaggctgaagagcattgggatgattgacagcgtccccggcatgaaggcccttgacatgaacacagcagaggacgccattgtgaggctcaccagggagattgtgcctggaatgatcgttacaggcatggaagttgcagagattgatggggctccaaggatgggtcctacctttggggctatgatgatatcggggcagaaggctgcacatttggcattgagggcgctggggcagcccaacgccattgatgggaactacacagaagctgaaactatgcaaccggagctgattcttgctgcagcagagacaggggagatagtagatgcctgagaatttgtacaagggcagtttagatgattgagaagttgaataaataaagagaaaatgaggacactaaatagggatgaatgagatttatgttgatatgatggatttggagggattgggattcgatttcttgttcatgggctttgattaaaagtaaaagtaatgggtagtttttttcttccaa

SEQ ID NO: 6092 - DNA, 1696 bp, Vitis vinifera
ttcaagttccactctttttgaagatctttatttcagatattttcccatccctctcctccaaatccatgcttaaataccctgctctctgcccactcaacatcccccacttcagtcttcatagcccatatcatcaatggcgtccatggctaccactctcacttctctttcttccaacccaaaaccagctttcttcgacaacaagtcctccttccatggctctcccatctcctatcgtgtccttcccatcaaggtctcccaccaaagccccacaatttccatgtcctccgcctctccatacgatcttcagagcttcaagttcgaacccatcaaggagtccatcgttgcgcgcgagatgactcgccgttacatgatggacatgatcacctacgccgacaccgacgtcgtcatcgtcggagccggctccgcggggctctcgtgcgcgtacgagctcagcaagaacccgtcaatccgtgtggcgataatcgagcagtccgtcagtcccggcggcggcgcgtggctcgggggccagctgttctcagccatggtggtgaggaagcctgctcatcacttccttgatgagcttggcatcgagtatgatgagcaggacaactacgttgtgatcaagcatgccgctctgttcacttccaccatcatgagcaagctcttggccaggcctaatgtgaagctcttcaacgccgtggccgctgaggatttgattgtgaaggaagagagggtggccggcgtagtcaccaactgggctttggtttcaatgaaccacgacacacagtcctgtatggaccccaatgtgatggaggcgaaggtggtggtgagctcttgcggccacgacgggcccttcggagccacaggagtcaagaggctgaagagcattgggatgattgacagcgtccccggcatgaaggcccttgacatgaacacagcagaggacgccattgtgaggctcaccagggagattgtgcctggaatgatcgttacaggcatggaagttgcagagattgatggggctccaaggatgggtcctacctttggggctatgatgatatcggggcagaaggctgcacatttggcattgagggcgctggggcagcccaacgccattgatgggaactacacagaagctgaaactatgcaaccggagctgattcttgctgcagcagagacaggggagatagtagatgcctgagaatttgtacaagggcagtttagatgattgagaagttgaataaataaagagacaatgaggacactaaatagggatgaatgagatttatgttgatatgatggatttggagggattgggattcgatttcttgttcatgggctttgattaaaagtaaaagtaatgggtagtttttttcttccaagttgctagccatatgaaccaaagacaatgatgaataagtcaaaattcaatgggatgaaatcaaaagaccagcccgactcgaatctctggttgtgtaatcctgataaattcatggcagaggcagagtgactataactgataaattcatccaattgccattcctttcctgcccatctcccataccaaatctcaacttgattccgggtttgaatccaaaaatctcaacttccgttccaaaattgtccttaaaaaatatatatttttgtttaaataccaagttagacaaaattttgactaacaaagatttttttttat

SEQ ID NO: 6093 - DNA, 1457 bp, Trigonella foenum-graecum
atctcacacctcatcatctcctttataaaacccattcaactctactctcacaaaatacatcaccacttctcactaaacattttctatccccaaaatacccctaatggcatccatggccactgcatctctcaccacttccctctcttcaactcccaaatcctcattcttcaatggaagaccaattgctacccgcacccccaccaccatcaaatccaccccccaaaaaatcaccatgtcactaaccacacccccttacgacataaactcattcaaattcgcacccatcaaggaatccatcgtttcacgtgaaatgacccgccgttacatgacagacatgatcacctacgccgacaccgatgtcgtcatcgtcggtgccggttccgccggtctttcatgcgcttacgaattatccaaaaacccaaacatcagtatcgccatcatcgaacaatccgtcagccccggcggcggtgcatggctcggtggccagctcttctccgccatggttgtccgcaaaccagctcacctcttcctcgacgaaattggtgtcgaatacgacgaacaagaagactacgttgtcatcaaacacgctgctctattcacttcaaccatcatgagcaagcttcttgcaaaacctaacgtgaaattgttcaatgctgttgctgctgaggatttgattgtgaaagaaaatagagttgctggtgttgttacaaactgggctttggtttcgatgaaccatgatacacaatcttgcatggatcctaatgttatggaagctaaggttgttgtgagttcttgtggacatgatggtccttttggtgctactggtgttaagaggttgaagagtattggtatgattgattttgttcctggaatgaaagctcttgatatgaatactgctgaagatgctattgttcgtcttacaagggaagttgttcctggtatgattgttactggtatggaagttgctgaaattgatggtgccccaagaatgggtccaacatttggggcaatgatgatatcaggacagaaagctgcacatttggcattgaaggcattggggaggaacaatgcaattgatggaacatgtgaatctgcgagtgaaccagagcttattttggcttctgctgaatcacaggacactgttgatgcttaagtttacaaattaagtggatttagtttttagttgtttgaatctacaggtaaattgtagattttgtatgtggtttggattcaataatgaataaagaaaatgtgaatgagatgaatatataactgtattttcatttgtgttgagacaaacaatttggaagaacaaatagtagatgaaaatgtattatgaattaattaggacaagagaagaagagagatggtggacacaacccatcaacatatatccaagtaaaatcatgccatatataacaacaaagcagtccaaaatatgacattattgatatagt

SEQ ID NO: 6094 - DNA, 1237 bp, Gossypium hirsutum
ctttcagctaagtttgtgtggtagatgaaagccacacaaacttagctgaaagatcaatggcagccatggcaacagctctcacttcactgtcttcaagccccaaaccaacattcctagaccacaacaagtcatccttcagcggcactccaattccttctcgcttcactcccatcaagtcgtcctcacacaactctgccatttccatgtccttaacccctccttatgacttacaatcctttaaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtctaaggttgtggtcagttcttgtggacatgatggaccttttggagctactggggtcaagagattgaagagcattgggatgattgacagcgtccctggaatgaaggccctggatatgaacccggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcccccttacccttgaaggcattggggcagcccaaccccgtagatgggaccttcagcgaagctgaaagggtacagcctgagtttgttctagctgctgctgaaacagaggagactgtggatgcttgaaaaaatatttgataattttctggaaatggaataaataaagaaacatgtggatgaaattagatctttttggaatgaattgatggattgaatgtgaacaaaaggtgagcttt

SEQ ID NO: 6095 - DNA, 1393 bp, Lupinus angustifolius
aatcacactcccatcatatatcataactcataactcatcaattcattgaattgaattgaatggcagccatggccacttcaaccctcacctcctctttcgtctcttcaaacccaaaaagctcctccttccaattcaatggcaatccattttcctcacgcatgaaatccatccctcaacagcacaccagcaacacaatgatctccatgtccctaaccacacccccatatgaccttaactccttcaagttccaacctatcaaagaatcaatcgtctctcgtgaaatgacacgccgttacatgactgacatgatcacctacgccgacacggatgttgttgtcgtcggtgctggctccgcgggtctctcatgtgcctatgagctcagcaagaaccctaacatcagtatagccataatcgaacaatctgtcagccccggtggcggtgcatggcttggtgggcagctgttctctgccatggtggttcgtaaacctgctcaccgcttccttgatgagttggagattgagtatgatgagcaagaagattatgttgttataaagcatgcagcattattcacttcaaccatcatgagcaagcttcttgctagacctaatgtcaagttgttcaatgctgtggctgttgaggatttgattgttaaaggagggagagtgggtggtgttgtcaccaactgggctttggtttctatgaaccatgatacacagtcttgcatggaccctaatgtcatggaggctaaggttgtggtgagttcatgtggacatgatgggccatttggtgctactggggttaagaggctgaggagtattggcatgatagagagtgttcctggaatgaaagcacttgacatgaatgctgctgaggatgctattgttaacctcactagggagattgtacctgggatgattgtcactggcatggaagttgcggaaattgatggatccccaagaatgggcccaacatttggggccatgatgatatccgggcagaaggcagcacatttggcattgaaagcattggggaagaacaatgccattgatggaacatgtgaacttggaatagaaacacccaaccttgttttggcttctgctgaaactaaggagattgttgatgcttaaaccaatagatttgaaaatgaaacttatttttgtttttgccttttgttttgttttgtttcctttaatttagatctggaaaatatgaatgaacaagagatagtctcgtctcatttcataccatgtgaagaatagcaaattggtaaactatgctatattcacacaagggaatgatgttttgtgaacacgtacattttatgaaacaaggcatgtgagtgttttgaagtagaataaaaacatatattagtaaatgattccttttaagatat

SEQ ID NO: 6096 - DNA, 1219 bp, Gossypium hirsutum
gggatcatctaccacacaaacttagctgaaacattatggcagccatggcaacagctctcacctcactgtcttcaagccccaaaccatctttcctagaccacaacaagtcatccttcagcggcactcaaattccttctcgcttcactcccatcaagtcctcttcacacaactctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccccgacacacaatcctgcatggacccgaacgtgatggagtctaaggttgtggtcagttcttgtggacatgatggaccttttggagctactggggtcaagagattgaagagcattgggatgattgacagcgtccctggaatgaaggccctggatatgaacccggcagaggatgcaatcgttaggcttacaagggaaattgtgcctggcatgattgtaacaggaatggaagttgcagagattgatggtgccccaagaatgggtccaacatttggagcaatgatgatatcagggcagaaagcagcccccttagccttgaaggcattggggcagcccaaccccgtagatgggaccttcagggaagctgaaagggtacagcctgagtttgttctagctgctgctgaaacagaggagactgtggatgcttgaaaaaatatttgataattttctggaaatggaataaataaagaaacatgtggatgaaattagatctttttggaatgaattgatggattgaatgtgaacaaaaaggtgagctttgg

SEQ ID NO: 6097 - DNA, 1445 bp, Citrus sinensis
atttttcatcactctcaccgcctgacaagtgcttaaatacccacttccacggtcgcctttctaaaaaattccattgcaaacttcaaccctacgcaagtgtccaaacaaattaacataatggcagccatgtctacaaccctcacttcctcactctcttcaggccctaaatcttctttcttagaccacaagtcatctttccatggcagcccaatcatcacttctcgtgtcactcccatcagatcctcctcacaatcacaaacccacaccatttccatgtccttgactccacagtacgacttcaactcattcacattcgaccccatcaaagaatcaatcgtttctcgtgaaatgacccgccgttacatgactgacatggtcacctacgccgacactgacgtcatcgtcgtcggtgctggctccgccggtctctcctgcgcttacgagatcagcaagaacccctcaatccgtgtcgccataatcgagcaatcagtaagccctggtggtggcgcatggctcggtggccagctcttttcggcgatggtcgtgcgcaagccagctcagagattcctagacgagctcggcgtcgagtacgacgagcaagacaactacgtcgtgatcaagcatgccgcgttgttcacttcaacaatcatgagcaagctgttggcgaggccaaacgtgaagttgttcaacgctgttgcagctgaggatttgatcgtcaagggagggagagtaggtggcgtcgtcacaaactgggccttggtgtctatgaatcacgacacacagtcttgcatggaccccaatgtgatggaggccaagattgtggtcagctcgtgtggccatgacggcccttttggggctaccggtgttaagaggcttaagagtattggcatgattgactccgtccccggaatgaaagctctcgatatgaacactgcagaggatgctatcgttaggcttaccagggagatcgtgcctggcatgattgtcacgggcatggaagtcgcagagatcgacggtgcccctagaatgggacctacattcggggccatgatgatttcagggcagaaggcagcccatttggcgttgaaggcattggggcagccgaatgcgatagatgggacattcagtgaagttacggaagtacagccagagtttgtccttgctgccactgagaacagcgagattgttgatgcttaaaaattataaaatctgagaattatgtacattttgatgagaattcaaaatcaacaataaacccaaaaaaaataaaaattgtaactacgatcggccactaaatatcgtggggatggagaaatttggtgtaatttttcttcgatttttgttgagttccaaattaatgaattcaacagctaaaaaaaaaaaacacggcaatgctgcttttatgttgaaatagaaaataaaaaataaaagcaaatgtttacata

SEQ ID NO: 6098 - DNA, 1797 bp, Populus trichocarpa
cagatttttatttcagatattttcacatcccaccacttgctacacatccttaaataccaatcatctagactcgcatctctcaagcctcttctctagctttctccaatttcatttacattgacaaaaaccctttaacaaaaccttatcaagaactccttgaattacagccatggccactacccttaccccctatctatctgcaaacctcaagtcctctttcttggacaacaaatcatccttccatggcacacctatcacaactactacacgtttcactcccataaaatccacctctcctgccatttccatgtccttaacacaaccttcatatgatcttcagtcctttaagttccagcccatcaaagaatccatcgtctctcgtgaaatgacccgtcgttacatgacagacatggttacttatgcagacactgacgttgtcattgttggtgctggctctgctggtctttcttgtgcttatgagctcagcaagaacccttcagttcgtgttgctataattgagcaatcagttagccctggaggtggtgcatggcttggtggccagttattttcagctatgattgtgcgtaaaccagctcatagatttcttgatgagcttgaaattgaatatgatgaggcagataactatgtggttatcaagcatgcagctctgttcacctcgacaatcatgagcaaactcttggctaggcctaatgtgaagctgttcaatgctgtggcagcagaggatttaatagtgaaaggagggagagtttctggtgtggttactaactgggctttagtgtctatgaaccataacactcaatcttgcatggaccctaatgttatggaggctaaggttgtggttagttcttgtggacatgacgggccttttggagctactggtgttaagagattgaagagtattggcatgattgatagtgttcctggaatgaaagcactcgacatgaacgctgctgaagatgcaattgttaggcttacaagagagattgtgcctggtatgattgttacaggcatggaagttgcagaaattgatggagcaccaagaatgggtccaacatttggggcaatgatgatctcagggcagaaggctgcacacttggctttgaaggctttggggcagccaaatgccctagacgggacattcagtctacagccagagcttgtgcttgctgctgctgaggccggggatactgttgatgcatgaacacattaggacttcttgattagggacttgtactgtcaaaatcagaaaataaggattaaaaagaggccttttttcagggatggatgggattgatatggatatatatatgatagtggatgctcattttgattaaattgagttccaatttaatttgaaaaattacattatgttggccaaatcaatatctaccagtatggattaatgaatttgaaattgggaccaaaatcatgccaaaaaaatccaattttaaattttcttatcaacaaagaaaatcaaatcatcttgagggcttgtcaatggaaaaaactgattgaattttctgtattcttcattttagcctgatctctcagaatagttaattatgctacaaatgaagagagcctcaaagggactactgaatcttgtatttgttatgggaatgcgacagagtgtagaaatgttgtctccttctagattttagttcattgctttatgtaaggagtctttaatgcaattgaaaaccactatctagtaatttctatcgttcagattttactttgacaatctataacatgattcaatttatgccaaccaaa

SEQ ID NO: 6099 - DNA, 1230 bp, Medicago truncatula
ctcactaaacctcttctcttcccaaaatacccctaatggcatccatggccactgcatctctcgccacttccctatcttcaactcccaaatcctcattcttcaatggaagaccaattgctacccgcacctccaccatcatcaaatccaccccccaaaaaatcaccatgtcactaaccacacccccttacgatataaacaccttcaaattcgcacccatcaaagaatccatcgtctctcgtgaaatgacccgtcgttacatgacagacatgatcacctacgccgacaccgacgtcgtcatagtcggtgccggttccgccggtctttcctgcgcttacgaattatccaaaaacccaaacatcagtattgccatcatcgaacaatccgtcagccctggtggtggtgcatggctcggtggccagctcttctccgccatggttgtacgcaaaccagcccacctcttcctcgacgaaatcggtgttgaatatgacgaacaagaagactacgttgtcatcaaacacgctgctctattcacttcaaccatcatgagcaagcttcttgcaaaacctaatgtaaaacttttcaatgctgttgctgctgaggatttgattgtgaaggaaaacagagttgctggtgttgttacaaactgggctttggtttcgatgaaccatgatacacaatcttgcatggatcctaatgttatggaagctaaggttgttgtgagttcttgtggacatgatggtccttttggtgctactggtgttaagaggttgaagagtattggcatgattgatcatgttcctggaatgaaagcacttgatatgaatactgctgaagatgctattgttcgtcttacaagggaagttgttcctggtatgattgttactggtatggaagttgctgaaattgatggtgccccaagaatgggtccaacatttggggcaatgatgatatcaggacagaaagctgcacatttggcattgaaggcattggggaggaacaatgcaattgatggaacatgtgaatctgcaagtgaaccagagcttattttggcttctgctgaatcacaggacactgttgatgcttaagtttacaattaagtggatttagtttttagttgtttggatctacagtttaattttagatcctgcatgtggtttggattcaataatgaataaagaaaatgtgaatgaggtgactgtattttcatctatgtttagtcaaacaaattgg

SEQ ID NO: 6100 - DNA, 1512 bp, Medicago truncatula
cacctcatcatctcctttataaaacccattccaccccactctcacaaaatatatcaactctcactaaacctcttctcttcccaaaatacccctaatggcatccatggccactgcatctctcgccacttccctatcttcaactcccaaatcctcattcttcaatggaagaccaattgctacccgcacctccaccatcatcaaatccaccccccaaaaaatcaccatgtcactaaccacacccccttacgatataaacaccttcaaattcgcacccatcaaagaatccatcgtctctcgtgaaatgacccgtcgttacatgacagacatgatcacctacgccgacaccgacgtcgtcatagtcggtgccggttccgccggtctttcctgcgcttacgaattatccaaaaacccaaacatcagtattgccatcatcgaacaatccgtcagccctggtggtggtgcatggctcggtggccagctcttctccgccatggttgtacgcaaaccagcccacctcttcctcgacgaaatcggtgttgaatatgacgaacaagaagactacgttgtcatcaaacacgctgctctattcacttcaaccatcatgagcaagcttcttgcaaaacctaatgtaaaacttttcaatgctgttgctgctgaggatttgattgtgaaggaaaacagagttgctggtgttgttacaaactgggctttggtttcgatgaaccatgatacacaatcttgcatggatcctaatgttatggaagctaaggttgttgtgagttcttgtggacatgatggtccttttggtgctactggtgttaagaggttgaagagtattggcatgattgatcatgttcctggaatgaaagcacttgatatgaatactgctgaagatgctattgttcgtcttacaagggaagttgttcctggtatgattgttactggtatggaagttgctgaaattgatggtgccccaagaatgggtccaacatttggggcaatgatgatatcaggacagaaagctgcacatttggcattgaaggcattggggaggaacaatgcaattgatggaacatgtgaatctgcaagtgaaccagagcttattttggcttctgctgaatcacaggacactgttgatgcttaagtttacaattaagtggatttagtttttagttgtttggatctacagtttaattttagatcctgcatgtggtttggattcaataatgaataaagaaaatgtgaatgaggtgactgtattttcatctatgtttagtcaaacaaattggaaggacaattagtagatgaaattgaatgtatgaattatttaggacaagagaagaagagagatgatggagttaatcaatcaacatagtaatgtccgaaaaagaaaaaggcattgataacaactacgcagtccaaaaaaagagcaatgttttggaaataaactagtatgaaattattggtataaagtactctatccgtcgtataataataataactgagttattt

SEQ ID NO: 6101 - DNA, 1297 bp, Citrus clementina
atttttcatcactctcaccgcctgacaagtgcttaaatacccacttccacggtcacccttctcaaaaattccattacaaacttcaaccctacgcaagtgtccaaacaaattaacataatggcagccatgtctacaaccctcacttcctcactctcttcaagccctaaatcttctttcttagaccacaagtcatctttccatggcagcccaatcatcacttctcgtgtcactcccatcagatcctcctcacaatcacaaacccacaccatttccatgtccttgactccacagtacgacttcaactcattcacattcgaccccatcaaagaatcaatcgtttctcgtgaaatgacccgccgttacatgactgacatggtcacctacgccgacactgacgtcatcgtcgtcggtgctggctccgccggtctctcctgcgcttacgagatcagcaagaacccctcaatccgtgtcgccataatcgagcaatcagtaagccctggtggtggcgcatggctcggtggccagctcttttcggcgatggtcgtgcgcaagccagctcagatattcctagacgagctcggcgtggagtacgacgagcaagacaactacgtcgtgatcaagcacgccgcgttgttcacttcaacaatcatgagcaagctgttggcgaggcctaacgtgaagttgttcaacgctgttgcagctgaggatttgatcgtcaagggagggagagtaggtggcgtcgtcacaaactgggccttggtgtctatgaatcacgacacacagtcttgcatggaccccaatgtgatggaggccaagattgtggtcagctcgtgtggccatgacggcccttttggggctaccggtgttaagaggcttaagagtattggcatgattgactccgtccccggaatgaaagctctcgatatgaacactgcagaggatgctatcgttaggcttaccagggagatcgtgcctggcatgattgtcacgggcatggaagtcgcagagatcgacggtgcccctagaatgggacctacattcggggccatgatgatttcagggcagaaggcagcccacttggcgttgaaggcattggggcagccgaatgcgatagatgggacattcagtgaagttacggaagtacagccagagtttatccttgctgccactgagaacagcgagattgttgatgcttaaaaattataaaatctgagaattatgtacattttgatgagaattcaaaatcaacaataaacccaaaaaaaataaaaattgtaactacgatcggccactaaat

SEQ ID NO: 6102 - DNA, 1164 bp, Gossypium hirsutum
ctttatctaccacacaaacttagctgaaagatcaatggcagccatggcaacagctctcacctcactgtcttcaagccccaaaccatctttcctagaccacaacaagtcatccttcagcggcactcaaattccttctcgcttcactcccatcaagtcctcttcacacaactctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccacgacacacaatcctgcatggacccgaacgtgatggagtttaaggttgtggtcagttcttgtggacatgatggcccttttggagctactggggtcaagagattgaagagcattgggatgattgacagcgtccctggaatgaaggccctggatatgaacccggcagaggatgcaatcgttaggcttccaagggaaattgtgcctggcatgattgtaacaggaatggaagttgcagagattgatggtgccccaagaatgggtccaacatttggagcaatgatgatatcagggcagaaagcagcccccttacccttgaaggcattggggcagcccaaccccgtagatgggcccttcagcgaagctgaaagggtacaccctgagtttgttttagctgctgctgaaacagaggagactgtggatgcttgaaaaaatatttgataattttctggaaatggaataaataaagaaaccatgtggatgaaatt

SEQ ID NO: 6103 - DNA, 1336 bp, Tabernaemontana elegans
atcctttctttgctcatcctcaaatagcttcgttcccataatcatttgtaaaagcattatccatctcgatggcagccatggctacaaccctcacttcttcccctaagccaacattcttggaaaacaaatcctccttccatggcacccccgtcttatctcgcgttcagcccgtcaaatctagctctcagaatttctcaattaccatgtctgcaaccaccccacagtacaacttggattctttcagttttcaacccatcaaagaatccatcgtctcgcgggaaatgacaagaagatacatgatggacatgattacctatgctgacactgatgttgtaattgttggtgccggctctgcagggctctcctgtgcctatgagcttagcaaaaatcccaacattcgggttgcgattattgagcaatctgttagccctggaggtggagcatggctcggaggacagttgttctcagccatggttgtccgtaaaccagcgcacaagttcttggatgagcttgagattgagtatgatgagcaagataactatgtggttatcaagcacgctgcattgtttacatccacaatcatgagcaaactcttggcaaggcccaatgtaaaattgttcaatgccgtggccgttgaagatttgattgtgaagggtgacagagtggctggtgttgttaccaactgggctcttgtttccatgaaccatgacacacagtcatgcatggatcccaacataatggaggctaaggtggttgttagctcttgtggtcatgacggtccttttggagccactggtgtgaagaggttgaagagcattggaatgattgacagcgttccagggatgaaggctctcgacatgaatgcggcagaggatgcaattgttaggctcacaagagagatcgtgccagggatgattgtcaccggcatggaagtagctgaaattgatggagcccaagaatggggccaacttttggggccatgatgatctccgggcaaaaggctgcacatttggcattgagggctttgggacaaccaaatgttcttgatggaactcagagggaagcgggaactgctcaacctgagctcattcttgctgccgcagagacggacgaaatcgttgatgcttgaattgggccagagaaagggaaattaagaattctgccaggcactcaactagcaagaaatgaagaaaagattctagtccattttgttagggagtaattagcatggacgaagctatgtagatagactcggggatggtgtactgcttttgcttgttgtaccatcttttggattttgtgatcaaatggagacggcgttttcaattgttgggaa

SEQ ID NO: 6104 - DNA, 1497 bp, Populus trichocarpa
cccatcatctaaaatctcttctctcaagccctcgatcttctgtagctttctccaatttcttttacacagtcaaaaaccctttagcaaaaccttatcaaaaactccttcaattatagccatggcctctacccttacctcctctctatctataaacctcaaatcctctttcctggatcacaaatcatccttccatggcacacctatcacaactactggacgtttcactccaatcaaatccacctcttctgccattaccatgtccttggcacaaccttcatatgatcttcagtcctttaagttccagcccatcaaagaatccatcgtctctcgggaaatgactcgtcgttacatgacagacatggttacttatgcagacactgatgttgtcattgttggtgctggctctgctggtctttcttgtgcttatgagctaagcaagaacccttcagttcgcgttgctataattgagcaatcggttagccctggaggcggtgcatggcttggtggccagctgttttcagctatgattgtgcgtaaaccagctcatagatttcttgatgagcttgaaattgaatatgacgaggcagataactatgtggttatcaagcatgcagctttgttcacttcaacaatcatgagcaaactcttggctaggcctaatgtgaagctgtttaatgctgtggcagcagaggatttaatagtgaaaggaggcagagtttctggtgtggttactaactgggctttagtgtctatgaaccatgacactcaatcttgcatggaccctaatgtcatggaggctaaggttgtggttagttcctgtggacacgacgggccttttggtgccactggagtgaagagattgaagagtattggcatgattgacagtgttccaggaatgaaagcacttgacatgaacgcggcagaagatgcaattgttagacttacaagagagattgtgcctggcatgattgttacaggcatggaagttgcagaaattgatggagcaccaagaatgggtccaacatttggggcaatgatgatctcagggcagaaggctgcacacttggcattgaaggctttggggcaaccaaatgccctagatggaacattcagtctacagccagagcttgtgcttgctgcttctgaggctggagagatagttgatgcatgaacatagtaggactttttgattaggaacttgtatttatatatttcgaaccttcgcatgaacacgatctccacatgatgtactacttgtcccgaacttaagatatcgtttcattttttttttatagacttgtgtgagccgtggggttattttcaaaacctaattttatttaattttgcggcaatgaaaacaaatattttttaaaattccaataatttgcattctagaataaaaaagtatttcttcaattaaaatttatttttattacttctgaatttattttttatttgataaagtcatgtctcttttattaacaacatggttttttt

SEQ ID NO: 6105 - DNA, 1492 bp, Liriodendron tulipifera
  misc_feature (1450)..(1451): n is a, c, g, or t
  misc_feature (1473)..(1473): n is a, c, g, or t
ctcaaaaccgccttagaaaaaccctagaaaacccctaaaaccatcgtagctaccatggccaccacccttacctcttccctctcctccaaacccaagacccctttcctggaaaccacctccttccatggtcttcccataccatcacgaatccaatccgtccgttcatctccccaacaccaccaaaacgtctccatcaccatgtccacaagctcccccagctatgatctcaaatccttccaattccaacccatcaaggaatccatcgtctcccgtgagatgacccgtcgatacatgacagacatgatcacctacgccgacaccgatgtcgtcatagtcggcgctggctcagccggcctttcctgcgcctacgagctcagcaagaacccctctgtcagtgtcgcgataatcgagcagtcggtcagccctggtggcggggcatggctcggcggccagctcttctccgcgatggtggttcgcaagccggctcacatcttcctagatgagctcggcgtcgactatgatgagcaagacaattacgtggtcatcaagcacgcggcgctcttcacgtcgacgatcatgagcaagctcctcgctaggccgaacgtgaagctgttcaacgcggttgcggctgaggatctgatcgtgaagggtggacgggtcggaggcgttgtgacgaactgggcccttgtgtcgatgaaccatgatactcagtcttgcatggacccgaatgtgatggaggcgaaggtggttgtgagttcttgcggtcatgatgggccgtttggcgcaactggggtgaagagactcaagagcatcggaatgatcgatgcagtgccggggatgaaggctttggatatgaacacggcggaggatgcgatcgttaggctcacgagggagattgtcccagggatgatcgttactgggatggaagttgcagagatcgatggagcgccgagaatggggcccacctttggcgcaatgatgatatctggacagaaagcagctcatttggcattgaaggcattgggccagccaaacgcgttggatggcacttctacccttggaagccctctcccagaatttgtccttgcctctgctgaggcttctgagattgcagatgcttagacagcctttccaaaacccaagacaaaagagcccatcaaagcaacagatgagatttgtcaagtattggaatcctatgtgaggtgtttggcttctttttcaggtttcgtggagattttagaatcaggtttttcctacttttcaagtccttcactacaagtatctgtatttaggcaataatgtggtgaggtaatttgaaaaagactggtgggcccctttgggtctttgtggaccttttctggatttttatgggtgaggatcttgtgagtatctgatgctgtagatgggtcaccaccacatgatcatgtctagctttttctgtgttattaanntgaaaaagactggtggcccttntgggtgatcatggcctttt

SEQ ID NO: 6106 - DNA, 2604 bp, Amsonia hubrichtii
cagggtgtacatgtggaaacttctcgtaaaatgactgccgacggtaaacaggaagctgcctgatgtatctttttgcattttcattcagaaaccccagttcttcctctgatggagtcccaattagctccataagtagacgtagctggtgcacatgatctctaccaggaaatagaggcttccggtccatcaattccataaaaatgcaaccgactgaccatacatcaattgctgtggtataatcagaagaattcaacaataactcaggtgctcgataccatcttgtaacaacatattctgtcataaaatcagtttcagaggttacacgagccaatccaaaatcacatatctttagatcacaattggcattcaggagaagattgctaggcttcaagtctctgtgcaaaacatttgctgaatgtatgtatttcaatccacgaaggatctgatataagaaatactggcaatgctcctcggacaatgcttgattagagcggataatttgatgaaggtctgtgtccataagctcatatgcaatgtatacatcattaaatgactccctctgaggtgggggtattatgtctctgattgccacaacgttttcatgatccatgtgacgaagaagtttgatctcacgcagcgtccttttcgcatcaatcttgttatcaaaggcattcgctatcttctttattgctacgtgctcgttcgtctccgaattcaaagccgagcagacgatgccataggcgcctttaccaataggcataatgggaggtttgtatttagcggtgacctcaaagatgtttccgaaaatattatattgaatgaacctgccgccatggctgagcaccgccggaatattctccatcccagccgctgggtagggctgctgttgctgcgacggaggaggtggttgcgccgcctccgacatgaccgtgtccgactgctgagctgcaccaccgtccatttcccctctcaaattaattccaaaaaaaaaatacgaaaaagacgaaagaaggaattaaataaaaaagcaaagaatcaacaacaccctttctccctattcttcgagctgtctttctgagttttgtatatatagatatagagagagaaagctgtatgtatatctgggttcgttgggtcaatggatctctgattctgaagccatcagtggagtgtttatttatttctcttctctctcttcagttccagatagatttgtttttgaataaccttttgtaaagcattatccatctcatcaatggcagccatggctacaaccctcactttttcccctaagccaacattcttggaaaacaaatcttccttccatggctcgcccatcttgtctcgttctgctcagcccatcaaatctagctcacagaattttgggatcaccatgtctgcaaccaccccacaatataacttggattctttcaagtttcaaccaatcaaagaatccattgtttcacgggaaatgacaagaagatacatgacggacatgatcacctatgctgacacagatgttgtcatcgttggtgctggctctgctgggctgtcatgcgcctatgagcttagcaaaaaccctaacgtccggatcgccattattgagcaatctgttagccctggtggtggagcatggctcggaggacagttgttctcagccatggttgtccgtaaaccagctcacaagttcttggatgagcttgaaattgagtatgatgagcaagatgactacgtggttatcaagcatgctgcgttgtttacctcaacaatcatgagtaaactcttggcaaggcctaatgtgaaattgttcaatgctgtggctgttgaagatttgattgtgagggaaaacagagtggccggtgttgttaccaactgggctcttgtttccatgaaccatgacacacagtcatgcatggatcccaacgttatggaggctaaagtcgttgttagctcttgtggtcatgatgggccttttggagccacaggtgtaaagaggttgaggagcatcggaatgattgacagcgttccagggatgaaggctctcgacatgaatgctgcagaggatgccattgttaggctgacaagagagatcgtgccagggatgattgtcaccggcatggaagttgctgaaattgatggatccccaagaatgggtccaacttttggagccatgatgatctccgggcaaaaggctgcacatttggctttgagggctttgggacaaccaaatgctcttgatggaactcaaagggaagagggaattgctcacccagagctcatccttgctgctgcagagaccgatgaaattgttgatgcttgaatctgttcatagtagctagggaaattgagaattccgccagggcacccaaatcagcaagaaaataaagaaaagatttcactagtccatttattttgttagggagcgattaaatagattgaaggaaggaatatatgtagataaacttgcggatggtgtacctcttttgcttcttgtaccatcttttggattttctgttcaaattgagacagtgctctcaatttgttgccaatggcgcaaaaaatctatgcaacaaaataatctttgaagagttgaactgagtttgc

SEQ ID NO: 6107 - DNA, 1570 bp, Catharanthus roseus
aattgttgaatcattctgtggtgtttagaacttgtgataaaagatgtttctggtccctcaaattgcttcatatttacagtccttcgtaagacattatcaatggcagccatggctactaccctcacttcttccccaaaacccactttcttggaaacaaatcctccttccatggatcccctgttttatctcgtattcaatccataaaatcaaacacccagaatttctcggtaagtatgtccgcatccaccccgcaatacaatttagattctttcaaatttcaacccattaaagaatcaattgtttctagagaaatgaccagaagatacatgatggacatgatcacttatgccgacacagatgttgtaatagtcggcgccggctctgccgggctgtcctgtgcttatgaaattagcaaaaatcccaacattagagtagcaattattgaacaatccgttagtcctggcggcggagcatggctaggaggacaattgttttctgccatggttgtaagaaaaccagcgcataaattcttggatgaactcgaaattgaatatgatgaacaggacaactatgtagttatcaaacatgctgccctgtttacttccacaattatgagcaaattattagcaaggcctaatgtgaaattgttcaatgctgtggctgctgaagatttgattgtcaaaggtaacagagtggctggtgttgttactaattgggcacttgtttctatgaaccatgacacacaatcttgtatggatcctaatgtgatggaggctaaggttgttgttagttcttgtggacatgatggtccttttggtgccactggtgttaagagattgaggagtattggcatgattgatagtgttcctgggatgaaagcccttgatatgaatgctgcagaagatgccattgttaggcttactagagaaattgtgcctggaatgattgttactggcatggaagttgctgaaattgatggttccccaagaatgggtccaacatttggggcgatgatgatatcagggcaaaaggcagcacatttggcattgagggcattgggacaaccaaatgctcttgatggaacacaaagggaagtgggaattgctcaaccagagctaatttttgctgctgcagagactgatgatattgttgatgcttgagagaattccagctcttgaaagggcgaattccagttcttgaaagggctctcaatgatgatcagcaaccaatcaataaagaaaagatttttctttgtccattttgttaggaagcagtagaatgaacgaaatatgtgtagatagaaatccaccatggatgatggtgtactgcttttgcttcttgtaccatcatttggattttcatatggaaaaaaatggactcaacaaattatcttgaattggtgcaatcaagtgctttcgcctgagattttttaagtaaattacaactacttgcataattgtataattatgcaaacaaagtaacataaataaataatagagaaaatatattataaaaggaaaatatctgtatttgtcattattagttatataatagcatttagttaagtggt

SEQ ID NO: 6108 - DNA, 1655 bp, Lupinus angustifolius
gtgcatataaacccatattacaacactagtttcacagtttcattgtcctataatatacttagctttctctgatcttcttccataatacattttattccttcaattcaatggccacctcaaccctcacctcctctttggtcacttcaaacccaaaaacctcttcattccatggcactcccattccctcacgcatcacttccattaaatccattcctcaacaaaacaacaacaacaacaacaccaacataatctccatgtccctaagcacacagtcttatgaccttaactcattcaagttccaacccataaaagaatccaccgtctctcgtgaaatgactcgccgttacatgactgacatgatcacctatgccgacacggatgtcattgtcgtcggggctggctctgccggtctctcatgtgcctatgagctcagcaagaaccctaacatcagtgtcgccattatcgaacaatctgtcagccctggtggcggtgcatggctcggtggccagctcttctcggccatggtggttcgcaaaccagctcaccggttcctggacgagctagagattgagtatgatgagcaagaagactacgtggttataaagcatgcagcactattcacttcaaccatcatgagcaagcttttggctagacctaatgtaaagttgttcaatgctgtggctgctgaggatttgattgtgaaaggagggagagtgggtggtgttgtcaccaattgggctttggtttcaatgaaccatgacacacaatcttgcatggaccctaatgtgatggaagctaaggttgtggtgagttcttgtggacatgatgggccttttggtgctactggggtcaagaggcttaggagtattggcatgattgagagtgtccctggaatgaaggcacttgacatgaatgcagctgaggatgctattgttaagctcactagggagattgtgcccggtatgattgtcactggcatggaagttgcagaaattgatggatccccaagaatgggtccaacatttggggcaatgatgatatcagggcagaaggcagcacatttggcattgaaggcattggggaagaacaatgcaattgatggaacttatgaagttggagtagaggcaccagaccttgttttggcttctgctgaaactcaggacattgttgatgcttaaacaattaccttacaattgttttattttatttgcctttcttttgtttcctatgattagcaatcctatgatttcaattaccttacttttatggaacagttttggtatccaccatgccaaccaagatcaaaggaatctacaaaagtttcaaatacattacacaaatatttgatgaatgaatttaaaacagcacctgatttttcaacatcaattggtagcttcagtgctcgaagagatcttaatcctcctcctaattatgaagaacctccatcgggaagggttgctaagaagccaaacaggaaaaagataaagtcaacttctcccaagtcaaagccaattattcaagtctagcatcacatcttcaacaacatcaacataatatttggcaatgtgaatagcaaaaaacaaaacactaagaaaattagagacaaaccaaattacttgctaacagattgggagaaaaacagtaaaaaggaacat

SEQ ID NO: 6109 - DNA, 1325 bp, Lupinus angustifolius
atgacacaggcaccaattgtgcatataaacccaattacaacaccaggcagccactgcaatcatagttccaatcatatacctttcctttcttacataataatcaatataatggcagccatggccacctctcttactccttctcacatctcttcaaacctaaaacactcttcattccatggcactcccatctcctcatgcatcaactccaccactcgacaacacaacaacaacaacaacaacaacatgaacaagacaatctccatgtcccttaactcgcccccttatgacctgaactcattcaagttcaaacccatcaaagaatccattgtctctcgtgaaatgacacgtcgttacatgactgacatgatcacctatgcagacaccgatgtcattgtcgttggtgctggatctgctggtctctcatgtgcctatgagctcagcaagaaccctaacatcagtgtcgccatcattgaacaatccgtcagccccggtggtggtgcatggctcggtggccagctcttctccgccatggtggttcgcaaaccggcacacagattcctggacgagctcgagatcgagtacgatgagcaagaagactatgtggttataaagcatgcagcactattcacttcaaccatcatgagcaagcttctggctagacctaatgtgaagttgttcaacgctgtggctgctgaagatttgattgttaaaggaggaagagtgggtggtgttgtcaccaattgggctttggtttccatgaaccatgacacacaatcttgcatggacccgaacgtgatggaagctaaggttgtggtgagttcttgtggacatgatggaccttttggtgctactggggttaagaggctgaggagtattggcatgattgagagtgtccctggaatgaaggcacttgacatgaatgctgctgaggatgctattgttaagctcactagggagattgtccctggcatgattgtcaccggcatggaagttgcagaaattgatggttccccaagaatgggtccaacatttggggcaatgatgatatcagggcagaaggcagcacatttggcattgaaggcattggggaaggacaatgcaattgatggaacgtatgaagttggagcagaagcacctcagcttgttttagcttctgctgaaactaaggagattgttgatgcttaataaaatagcttttaattatttttatcccttgtctctttctttttgtttcctataatttaaggacatgcagcatttcctgttcgctatatatgtattattactgtctttccctatcatcataaatgtcttacttctcttat

SEQ ID NO: 6110 - DNA, 1351 bp, Eschscholzia californica
aaaacccctagaaattctcactctcactctctagaattccaaccatggcagccatgacaacatctcttctctcatcaaaacccaaatcaccattccttgaaaaagaatcatctttccatggaatttccatcccatcttcaagatcatcaattcaaccaatccgatcaaccaacaaagccaccaccatctcaatttctgcatccaacccacctccatatgatcttcaatcattcaaatttaaccccattaaagaatcaatcgtttctcgtgaaatgactcgtcgttatatgatggatatgattacttatgctgatactgatgttattgttgttggtgctggttcagctggactttcttgtgcttatgaaatcagtaagaaccctaatgttcgtgttgctctcatcgaacaatctgttagtcctggtggtggtgcttggcttggtggtcaacttttttccgccatggttgttcgaaaaccagctcataagttcttagatgaattggaaattgaatacgatgaacaagatcactatgttgttataaagcatgcagctttatttacttcaactatcatgagtaagcttttggcaagacctaacgtcaagcttttcaacgctgtagctgccgaagatttgatcgtcaaagaaggtaaagttgctggtgttgttacaaattgggctttggtttcaatgaatcatgacacacaatcttgtatggatccaaatgttatggaatcaaaaattgttgttagttcttgtggacatgatggacctttcggtgccaccggagttaaaagattgaaaagtattggattaattgacagtgttcctggaatgaaagctcttgacatgaacacagctgaagatgccattgttaggctaaccagagaaattgttcctggtatgattgttactggcatggaagttgcagaaattgatggtgctcctagaatgggaccaacatttggggcaatgatgatatcaggacaaaaggcagcacatttagcattgaaggcattaggtcaaccaaatgtgattgatggaaactacaaggaattggaaaatattcacccagaacttatccttgctgctgctgaagcatctgacattgttgatgcttagaggatgaaaatctagattaagaagtagatgaacaagatgaagatggaatcatctgatggttcatgaataagtattagtagtaaggaaggtttgcttgtgagtgttttaagtgatgtttcagtttgggttttcgacatcttttttgttgctcttggaatgttaaaaaagtatgcaaatggtgttgtactgctattatcctgtttgttttttttttgcaagctcggtcgttc

SEQ ID NO: 6111 - DNA, 1376 bp, Eschscholzia californica
tttggatccatacaagattgtgtgtcatgattcattgaaaccaaaaccctagaaattctcacactcactctctagaattccaaccatggcagccatgacaacatctcttctctcatcaaaacccaaatcaccattccttgaaaaagaatcatctttccatggaatttccatcccatcttcaagatcatcaattcaaccaatccgatcaaccaacaaaaccaccaccatctcaatttctgcatcaaacccacctccatatgatcttcaatcattcaaattcaaccccattaaagaatcaatcgtttctcgtgaaatgactcgtcgttatatgatggatatgattacttatgctgatactgatgttattgttgttggtgctggttcagctggactttcatgtgcttatgaaatcagtaagaaccctaatgttcgtgttgcgctcatcgaacaatctgttagtcctggtggtggtgcttggcttggtggtcaacttttttccgccatggttgttcgaaaaccagctcataagttcttagatgaattggaaattgaatacgatgaacaagatcactatgttgttataaagcatgcagctttatttacttcaactatcatgagtaagcttttggcaagacctaatgtcaagcttttcaacgctgtagctgccgaagatttgatcgtcaaagaaggtaaagttgctggtgttgttacaaattgggctttggtttcaatgaaccatgacacacaatcttgtatggatccaaatgttatggaatcaaaaattgttgttagttcttgtggacatgatggacctttcggtgccaccggagttaaaagattgaaaagtattggattaattgacagtgttcctggaatgaaagctcttgacatgaacacagctgaagatgccattgttaggctaaccagagaaattgttcctggtatgattgttactggcatggaagttgcagaaattgatggtgctcctagaatgggaccaacatttggggcaatgatgatatcaggacaaaaggcagcacatttagcattgaaggcattaggtcaaccaaatgtgattgatggaaactacaaggaattggaaaatattcacccagaacttatccttgctgctgctgaagcatctgacattgttgatgcttagaggatgaaaatctagattaagaagtagatgaacaagatgaagatgaaatcatctgatggttcatgaataagtattagtagtaaggaaggtttgcttgtgagtgttttaagtgatgtttcagtttgggttttcgacatcttttttgttgctcttggaatgttaaaaaagtatgcaaatggtgttgtactgctattatcctgtttgtttttttttg

SEQ ID NO: 6112 - DNA, 1375 bp, Sarracenia psittacina
tggcaaccatggctgcaaccctaactccatctctctcctccaagcccagaacctcagttctggaagctcaccactcgtccttccatggcgtccccatttcgcccccttctcgccaccagcccgtcaagtccggttccccccagaacttctccgtctccatatccgcctcgtctcctccgacgatctccgatcgttagatttgaaccgatcaaagagtcgatcgtttctcgcgagatgactcgcaggtacatgatggacatgatcacctacgctgacacagacgtcgtcatcgtcggcgctggctctgccggacttcctgcgcttatgaactcagcaagaatccatctgtacaggtggctatcatcgagcaatccgtgagtcccggcggtggcgcgtggctcggcggacaactcttctcggccatggtggtacggaagcccgcacatctcttcctcgatgagctaggcatcgactacgacgagcaggataactacgtcgtgataaaacacgcggccttgttcacgtcgacgatcatgagcaagttgctggcgcgaccaaacgtgaagctcttcaacgccgtggcggcggaggatttgatcgtgaagggaggcagagtcggcggcgtggtgaccaactgggctttggtgtcgatgaaccacgacacccagtcgtgtatggacccgaatgtgatggaggcgaaggtggtggtcagctcatgcggccacgacgggccgttcggagccaccggagtcaagaggctgaagagtatcgggatgatcgacagcgtgccggggatgaaggctctcgacatgaacgccgccgaggacgcgattgtgaggctgacgagggagatcgtgccggggatgatcgtcaccgggatggaagttgctgaaattgatggatccccaagaatgggaccgacatttggggcgatgatgatatcggggcagaaggcagcgcacctggcgttgaaggcgctggggctgcctaacgccgtggatgggacttacgttggtagcattcagcctgagctgatattggcctcggcggatgccgctgcggaaactgtggatgcttaagcgttgagtttaaccatcatgatgtccaaaataagataaggaaagtagctgcggcggcggctacgggtggtgactgattgtggctagatatatgggtgtaacttttgcaagtgaatgaataaattcaatggagtcatagatgcgattaggccgagttctgtgattattgtgtttttgcttgtctttttccctttcttcttggaagttggttgtgaatggtttcgtctttctaacaacgtgttcgtccagacctgactgacaagatggattataaggaaaaggaaaaatcttgattg

SEQ ID NO: 6113 - DNA, 1201 bp, Eschscholzia californica
aaaatcatcaaccatggcagccatggctacatctcttctatcctcaaaacccaaatcacctttcttagaaaaggaatcatctttccatggaattcaaattccatcaagatcatcaattcaacccatccgatcaaccacccatcaaaactcatcaatttctgcatcaaacccaccacaaccttatgatcttcaatcattcaaattcaaccccatcaaagaatcaattgtttctcgtgaaatgactcgtcgttatatgatggatatgataacatacgccgatactgatgtcattgttgttggtgctggttcagctggactttcatgtgcttatgaaatcagtaaaaaccctaacgtccgtgttgccctaattgaacaatcagtcagtcctggtggtggtgcttggttaggaggtcaacttttctcagccatggttgttagaaaaccagctcacaaattcttagatgaattggaaatcgaatatgatgaacaagatcattatgttgttataaagcatgctgctttatttacatcaacaattatgagtaagttattagcaagacctaatgtgaaactttttaatgctgtagcagctgaagatttgattgttaaagaaggtaaagttgctggtgttgttacaaattgggcattggtttcaatgaatcatgatacacaatcttgtatggatccaaatgttatggaatcaaaaattgttgttagttcttgtggacatgatggaccttttggtgctactggtgttaagaggttgaagagtattgggttaattgatagtgttcctggtatgaaagctcttgatatgaatacagctgaagatgccattgttaggcttactagagaaattgttcctggtatgattgttactggtatggaagttgctgaaattgatggtgctccaaggatgggaccaacatttggagcaatgatgatatcagggcagaaagcagcacatttggcattgaaggcattaggacagccaaatgtgattgatggaaattatgaagagttgggaagcattcaaccagagctcattcttgctgcagctgaatctgctgagatagttgatgcttagatgatgatcaagttgaagttaaagatgatgatgagatattgtccatctttaattcttcatctgatagtgcataaataagtagtactttatttgggtttggttctggttgttttt

SEQ ID NO: 6114 - DNA, 1251 bp, Vinca minor
atattatttactattttatctattaatttccaatggcagccatggctacaaccctcacttcttcttctcctaagccaactttcttggaaaccaaatcatccttctatgggtcacccgttttatcccgggttgtggttcaacccatcaaatccacttcccaaaattccccaatttccatgtccgcaaccaccccggattacaatctggattctttcaaattcagcccgattaaagaatccatcgtctcccgtgaaatgaccagaaggtacatgatggacatgataacctacgccgacaccgacgtcgttatagtcggcgccggatccgctgggctatcttgcgcctacgaaatttccaaaaatcccaacatcaatgtagccataattgaacaatccgtcagccccggcggcggcgcgtggctcggaggacaattattttccgccatgattgtccgaaaaccggcacacaaattcttggacgagctcgaaatcgagtacgatgaacaagataactatgttgtaatcaagcacgccgcacttttcacttccacaatcatgagcaaattattggctaggcctaatgtgaaactatttaatgccgtggcggctgaagatttgatagtgaaaggaaacagagtggctggtgtagttaccaattgggcccttgtttcaatgaaccatgacacacaatcttgtatggatcctaatgttatggaagctaagattgttgttagctcgtgtgggcatgatggtccttttggtgctactggtgtcaagagattgaagagtattggtatgattgatagtgttcctgggatgaaggctcttgatatgaatgctgctgaggatgccattgttaggcttactagagagattgttccagggatgattgttactggcatggaagttgctgaaattgatggttccccaagaatgggaccaacttttggagccatgatgatatcagggcaaaaggcagcacatttggcactgagggcactgggacaaccaaatgctcttgatggaactctaggagaaatgggaattccccaaccagacctcatccttgctgctgcagagagtgaagatatcgttgatgcttgagaatttctagtcaatttttccttttttcattttagggagcagtataatgaatcatgaatcttctatgtagataaataataaaataaaaactcgcggatgcttttgcttattgtgccatcatttggattttgaaatgggccagaagagt

SEQ ID NO: 6115 - DNA, 1109 bp, Citrus clementina
aaaaattccattacaaacttcaaccctacgcaagtgtccaaacaaattaacataatggcagccatgtctacaaccctcacttcctcactctcttcaagccctaaatcttctttcttagaccacaagtcatctttccatggcagcccaatcatcacttctcgtgtcactcccatcagatcctcctcacaatcacaaacccacaccatttccatgtccttgactccacagtacgacttcaactcattcacattcgaccccatcaaagaatcaatcgtttctcgtgaaatgacccgccgttacatgactgacatggtcacctacgccgacactgacgtcatcgtcgtcggtgctggctccgccggtctctcctgcgcttacgagatcagcaagaacccctcaatccgtgtcgccataatcgagcaatcagtaagccctggtggtggcgcatggctcggtggccagctcttttcggcgatggtcgtgcgcaagccagctcagatattcctagacgagctcggcgtggagtacgacgagcaagacaactacgtcgtgatcaagcacgccgcgttgttcacttcaacaatcatgagcaagctgttggcgaggcctaacgtgaagttgttcaacgctgttgcagctgaggatttgatcgtcaagggagggagagtaggtggcgtcgtcacaaactgggccttggtgtctatgaatcacgacacacagtcttgcatggaccccaatgtgatggaggccaagattgtggtcagctcgtgtggccatgacggcccttttggggctaccggtgttaagaggcttaagagtattggcatgattgactccgtccccggaatgaaagctctcgatatgaacactgcagaggatgctatcgttaggcttaccagggagatcgtgcctggcatgattgtcacgggcatggaagtcgcagagatcgacggtgcccctagaatgggacctacattcggggccatgatgatttcagggcagaaggcagcccacttggcgttgaaggcattggggcagccgaatgcgatagatgggacattcagtgaagttacggaagtacagccagagttatcctgctgccactgaga

SEQ ID NO: 6116 - DNA, 1410 bp, Sesamum indicum
ccttagatattttcaagacttgctgtccactgtcctctcacacttccttatatacactgctcatccaccgtctttcctccatcaactctcagcgctcttcgtttctcatctctttaaccctttccaggcagctttcaacaagatttcttcaatggcagccatggccgcaaccctcacctcttccctctccaaggcccaattctttgacaacaagtcctctttccatggctcccccttgtctacacgcgccgtccagcccatcaaatctgctccacaaagcctcgccatcaccatgtccgccgccgctccttacaatctggacaacttcaaattccaacccattaaagaatccatagtctcccgcgaaatgaccaggcgttacatgacggacatgatcacctacgccgacaccgatgttgtcgtcgttggcgccggttccgctggtctttcctgcgcctatgagctctccaagaatcccaacatcaacatcgccatcattgaacaatccgtcagccccggtggcggcgcctggctcgggggccagctcttctccgccatggtcgtccgcaaacctgctcacaagttcctggacgagctcgaagtcgagtacgacgagcaagacaactacgtcgtcatcaagcacgctgccctcttcacctccaccatcatgagcaaactcctggcccggcctaatgtgaagctgttcaacgcggtagcagctgaggatttgatcgtgaagggcggaagagtcgccggcgtggtgacaaactgggcgttggtttcgatgaaccacgacacacagtcttgtatggacccaaatgtgatggaggcgaaagtggtggtgagctcatgcggccacgacggacctttcggtgctaccggggtgaagcggctgaagagcatcggcatgatcgacagcgtgcccggaatgaaggctcttgacatgaacaccgccgaggacgccattgttaggctgaccagggagattgtgcctggaatgatcgtcaccggcatggaagtcgctgaaatcgatggagcacctagaatgggcccgacatttggggcgatgatgatatcagggcagaaagcagcgcacttggcattgagggcattggggcagccaaatgctttggaaggctcttacagggaagtgaaaacaggcgtggaggaattcatgctggcctctgcggagtctgatgagactgtagatgcataaatcgagggagtgagtcaaaagtgaagtgaacaatgttcagagaattcactgaaataaataagaagacggtgcagttcaattcaatattagggacttgtagaagtgtgtatgatttgttgagatggtgggcattgctttttcctgaaaatgtcatcttctttcctgttcatgaaccagatttttcctcacagtgg

SEQ ID NO: 6117 - DNA, 1616 bp, Populus trichocarpa
ctgcctctcttcacctctctatccccataaattctcgccatcttcttcactccgctgcactccatagctctaaacctcaacacacaaccaaacgcgctgtcgttcatcatggcaaccatggctacaactctcacttctctctcaacaaaatcccaaaaactctcccctttcgacacctcctcttccttccatggcactcccatctcaaaaccaacacttcgtatgcagcccacaaaatcatcatcgtcaccaaacgtttccatctccatgtcatctccaccgtatgatttgaatgctttcaagtttgaaccgatcaaagagtctatagtgtcaagagaaatgacaagaaggtacatgatggacatgataactcatgcagacactgatgttgttattgttggtgctggctctgctgggttatcttgtgcttatgagcttagcaagaacccttctgtcaaaattgccattgttgaacaatctgttagccctggtggtggtgcttggcttggtggtcagctcttctctgccatggttgtacgcaaaccagctcatctcttccttgatgagctcggtattgagtatgatgagcaagaagactatgtagtaatcaagcatgcagctcttttcacctccacaatcatgagcaaactccttgcccgtccaaatgttaagcttttcaatgctgtggctgcagaggacttgatagtgaaagaaggaagagtgggtggagtggtcactaattgggctcttgtgtcaatgaaccatgacacacaatcttgtatggaccctaatgtgatggaggccaaggtggttgtgagttcttgtggccatgatggaccatttggtgctactggggtcaagaggcttaagagcattggcatgattgatagtgtgccaggaatgaaggctcttgacatgaacgctgctgaagatgccattgtgaagcttactagggaagttgtgcctggaatgattgttactggcatggaagttgctgagattgatggctctccgagaatgggaccaacatttggggcaatgatgatatcagggcagaaggcagctcaccttgccttgaagtcactcgggatgcccaatgcactggatggaacatttgtgggaggcattcatccagagctgatcctggctgctgttgaatctgctgatattgcagagacttgagtggtagcaaagcaatagactcaaatatgtcagataaataaaaggcagtagaaatgtgttcgaggggtttcccagttgatgtggtcatggtaggttttagttaataatcttggtgtcttttcctttcgtttaagactctgttggcactcggcagttggaagaatttagttcatgctgctttcggaccttgttggctggcctatctgtcaattctctcggctgaatatagagggtttgatttgcatatgattgaaaaaacattttcttgattttctctatgagggcaagccattttagtgcagacccttttcaccatacctccatttgtgctgaaatggcgtcgccttctttctcataaaatatttaaatgccatcactgaaccatcgaaccaaatctcttttttgaaaaccaccgtgtggcctcattttccaaa

SEQ ID NO: 6118 - DNA, 1565 bp, Quercus alba
tctctatgcgcccgggattctcactgcactataataaggtccacttcatgggtgccacttgtaacaacaatacagccattctagacccttcaaatcctatcccctccgcacgtgtcaaccattcaccatcctgatattttctctaccccactcctccttaaaatccctcttcgcttccacattatcttcacaacctcagacagtctcacacacacaaacagaacctaaaacgctctgtcgtttgttaatctcattgaaaatggcaaccatggcttccactctcacctccaagcctcaaaccctcgctttcttcgactcctcttccttccatggcacccctttggccccaccttcttctctccgtgtccatcaacccgccaaatcttccgtggccccacatgcaatctccatgtccgcctctcctccgccgtacgatcttaaagggttcgccttcgagcccatcaaggagtccatcgtctcacgcgagatgacacgtaggtacatgactgacatgatcacctacgccgataccgatgtggtcgtggtcggtgctggctcagctggtctctcatgcgcttatgaactgagcaagaacccatccgtacaagtggccataatcgagcaatctgtgagccctggtggcggtgcatggctcggtggtcagctcttctctgctatgcctgctcatctcttccttgacgagcttgaaattgagtacgatgagcaagacaactatgttgtgatcaaacacgctgctctcttcacctcaaccatcatgagcaagctcttggctcgccccaatgtcaagctcttcaatgcggtggcagccgaggacttaattgtgaaagaaggaagagttggtggggtggtgaccaactgggccttggtgtccatgaaccacgacacacagtcatgcatggaccccaatgtcatggaggctaaggtggtagtgagctcatgtgggcacgacgggccatttggggccactggggtcaagaggctcaagagcattgggatgattgacagcgtacctggaatgaaggcactggatatgaacacagctgaggatgccattgtgaggcttactagggaaattgtgcctgggatgattgttactgggatggaagtggctgagattgatggagcgccaagaatgggacccacatttggtgccatgatgatctcagggcagaaagctgcccacttggccttgaaggcactgggacttcccaacgctctggatgcagaagccatccacccggagttgattctagctgccgcagattctgcagaaattgcagaagcctagaatcaaattttagagtttttaataattatatgtgccggaataaaatacagttcataggaatgagtttgtggtgtgcggagtgaggatgatgtttatatggtgggcttttcttcttttggtactttatggctttggaacttttaatgctagcatttagcatttagctttatttacttcttgtatgcttctcgcttggctagagacaaaagtgttattttctggaaaaaaaaaaaaaagttaattaatcgcgatctag

SEQ ID NO: 6119 - DNA, 1281 bp, Vinca minor
cagccatggctacaactctcacttcttctcctaagccaacattcttggaaaccaaatcatcctttcacgggtcacccgttttatcccgggtggttcaacccatcaaatccacttcccaaaatccttccccaattaccatgtcagcaacaaccccgaattacaacttggattctttcaaatttaacccgattaaagaatccatagtctcacgtgaaatgaccagaaggtacatgatggacatgataacctacgccgataccgacgtggtcatagtcggagccggctcagctgggctatcatgcgcatacgaaatatccaagaatcccaacatcaatgtcgccataattgaacaatccgttagccccgggggcggcgcgtggctgggaggacagttgttttcagccatggttgtccgaaaaccagcgcataaattcttggacgaactcgaaatcgagtacgatgaacaagataactatgttgtaatcaagcacgccgcccttttcacttcaacaatcatgagcaaattattggctaggcctaatgtgaagttatttaatgctgtggcggctgaagatttgatagtgaaagggaacagagtggccggtgtagttaccaattgggcccttgtttcaatgaaccatgatacacaatcttgtatggatcctaatgttatggaagctaagattgttgttagttcatgtgggcatgatggtccttttggtgctactggtgttaagaggttgaagagtattggtatgattgatagtgttcctggaatgaaggctcttgatatgaatgctgctgaggatgccattgttaggcttactagagaaattgttcctgggatgattgttactggtatggaagttgctgaaattgatggatccccaagaatgggaccaacatttggagccatgatgatatcagggcaaaaggctgcacatttggcattgagggcattgggacaaccaaatgcacttgatggaactctaggggaaatgggtattgcccaacctgacctcattcttgctgctgcagagaatgaagagattgttgatgcttgagaatcactcaaatcagcaagaaataaagagatattttcaagtacttttttttcttttttcttttttagggagtagtagaatgaatggatcttctatgtagatataaaactcacaggttgtgccatcatttggattttacaatgggaaaaatgttcttggtttctttacaatttcgtaattttattaccctaactaaaattttacaagactaccattc

SEQ ID NO: 6120 - DNA, 1251 bp, Scabiosa columbaria
acttcaaaaccagttcactaccattcacacctatccttcaacaatggcaaccatggctactctcacctcttccctctcctccgtctcctccaagaccaattcctcatacggaatcccaactttctcacaaccgcgtctccgttccgtcagatctaccccccaaaacctatccctatccatatccatgtccgcttcttctaggccgtacgatctcaacgcctttgagttctctccgatcaaggagtccatcgtgtcgcgtgaaatgacaaggagatacatgacggatatgatcacgtttgctgataccgacgttgttgtcgtcggcgccggatctgctggactctcctgcgcctacgagctcagtaagaaccctgacgttcaggttgctattattgagcaatctgttagccctggtggtggtgcgtggcttggtggtcaactattttcagctatgattgtacgtaagccagcacatcatttccttgatgagctagagattgattacgacgagcaagacaactatgttgttatcaaacacgcagcgttgttcacctcaacaatcatgagcaagttgctagccaggccgaacgtgaagctcttcaatgctgtggcagctgaggatttgatagtgaaagggggaagagtaggtggggtggtgaccaactgggctttagtatcaatgaaccatgatacacaatcctgcatggaccccaacgtcatggaggctaaagttgtggtgagctcttgtgggcatgatggaccatttggtgccactggtgttaagagactgaggagtattgggatgattgagagtgtgcctgggatgaaggctttggacatgaacacagctgaggatgctattgtgaggctcacaagggagattgttcctggcatgattgtcactggaatggaagttgctgagattgatggatctccaagaatggggccaacattcggagcaatgatgatatcaggacagaaggcggcacacctagcactcaaggcacttggattgcctaatgcattggatggcaactatgttggaagtgttcaaccagaactcatccttgcagccgctgatgctgctgatattgtggatgcttaagcttagttggtaaatgtgttaaaataaagctgaaaatggaggccgagtgtgcagaggcacctacggatgaataattagatccatgttggttgtggtgtttattttggtaggctggttcgtgtaggttgttttgcctttcttttgtg

SEQ ID NO: 6121 - DNA, 1354 bp, Ambrosia trifida
ctcttcatcatatatggcatccatgactacaaccttcacctcatctttctccaacaaaacatgtttcttggatcaatcatccttccatggtgttcccatcacttccccggtccggatccaacccgttaaatcgaaccaaaacaagaacatgcctatcaccatgtcggcgacaccttacgacctgggttcattcacctttcaacccatcaaggaggcgatcgtgtcccgtgaaatgaccaggaggtacatgactgacatgatcacctatgccgataccgatgttgttgtcgttggtgctggctctgctggtctctcttgtgcttacgagcttagcaaaaaccccaacgttcaggtagctatcatcgagcaatctgtgagccctggaggaggagcatggctcggaggacagctgttttcagccatggtggtccgcaaacccgcacaccacttcctcgacgagctcgagatcgagtacgacgagcaagaagactacgtggtcatcaaacacgctgctctcttcacatccaccatcatgagcaagcttttggcccgaccaaacgtcaagctcttcaacgcggttgcagccgaggatttgatcattaaggaagggagagttggtggtgttgtgaccaactgggctttggtgtcaatgaaccatgacacacagtcatgcatggaccctaatgtgatggaggctaaggtggttgttagctcatgtggtcatgatggtcccatgggtgccacaggggttaagcgtctcaggagcgttggaatgatcgaaagcgttcctgggatgaaggcgctcgacatgaacactgcggaggacgcgattgtgaagcttacaagagagattgtgcctggtatgattgttactggaatggaagttgctgagattgatggatctcccagaatgggaccaacatttggggctatgatgatatccggacagaaagcggctcatttggcattgaaggcacttggactgccgaatgcattggatggaacaagtgtgggaagtgttcaccctgagctaatccttgcggctgctgattctagtgagaccgtcgatgcctaaatgaagtaaatatttagaatgaaatccactattgaataaatgaggaacacgacgggtgaatcaatgtcgtttcattgttagtttgttcttgagagactctgtgtttttatgttattgtgaattgtctgtgtttatgtttggttcttccttgtatttgcctagaatttagagggtaaggttggtcgtattatgtatttgaagatgaaaaggattccaaggtacatgttatgtaccgagaattgttatgtatgtccgatcttcttaagattgaaaaaagaa

SEQ ID NO: 6122 - DNA, 1532 bp, Mimulus guttatus
gtgcatggcattcacgtgtataccaaacacagaagccttccaaatccacctgcatttataatttcaaaaaccaccattaattcaccctcatcccaaccttcgcctcccagattctctctcattaattcatcctcatcccttcaattctatatatataatttcctcactgtaaacaatcccaatttttatcactgtcaaaaaaaaaaaaatcaaaaatggcgaccatggcttctgccctagcctcaaaaccctcatttttcgacacccacaaaacttccttcaacggccagcccatctcccctgcagttcgccgccgccgccaggcaacccgatccgccaaaccaaatgggtcgcccatatccatgtcgtcggcttcttctcctccgggttacgatctgaatcagttcagatttgctccgattaaggaatcgatcgtttctcgggagatgacgaggaggtacatgacggacatgattacttatgccgacaccgatgttgtcgttgtcggggctggatccgccggactctcctgcgcttatgagctcagcaaaaacccttctgttcgggttgcgataatcgagcagtcggtgagcccaggtggcggagcatggctaggagggcagctcttctccgccatggtggtgcgcaaacccgcccacctcttcctagacgagctcggcttggaatacgacgagcaggacaactacgtggtgatcaagcatgcggccctcttcacctccacgatcatgagcaagctcctggccaggccgaatgtgaagctcttcaatgccgtggcggccgaagatctgatagtgaagggaggcagggtcgccggagttgtgaccaactgggctctcgtgtcgatgaaccacgacactcagtcttgcatggaccccaatgtcatggaggcaaaggtggtggtgagctcgtgcgggcacgatggcccgttcggtgctacgggtgtgaagaggttgaagagtattggaatgatcgatagtgttcctggtatgaaggcgttggatatgaatacggccgaggatgctattgttaggcttacccgagaaattgtgcccgggatgattgtcaccggcatggaggttgcagaaattgatggagctccaagaatgggccccacgttcggagcgatgatgatatcgggtcagaaggcggctcacattgcgttgcagtcactggggttggctaataatgtaggaagcatccacccggagatggtcttagctgcggttgatgatgctgaaattctcgatgcttgaacggaataaggaattaaatgtgattgaggtagaacgaaataaaatttaagcctttcgtttgctagatatcgatgtggtgctccttaattggagtatgtttctgtgtaagaacctatctggttgggcttttttcctggtttgtcttcaaaaactaccatcaatgtgtttgtgtgcttatttaaaatatatatatatatatatatatatatatatatatataaccatagccaactggagaatcctcttcctcacttatcc

SEQ ID NO: 6123 - DNA, 1454 bp, Echinacea purpurea
tacaaattcagatatttatcccacctacctctatttaactcccacacatcactcacgttctacacaaccaccttcaagcttttcatcatatcatcaatggcgtctatggctacaaccttcgcctcatctctctccaccaaacccaacacctctttcttcgatcaatcatccttctatggcgttccggtgtcgtctcccatccggatccagccggtcaaatcgagccataacaagaacacacctatctccatgtccgccacaccctacgatctcggatccttcacctttcaaccgataaaggagtcgatcgtgtctcgtgaaatgaccagaaggtacatgacggacatgatcacgtacgccgataccgacgtcgttgtcgtcggtgctggctctgctggtctctcgtgcgcttatgagcttagcaaaaaccctaacgttcaggtagccatcatcgagcagtctgtgagccctggtggaggagcatggctaggaggacaactgttttccgccatggttgtccgcaagccagcacaccacttcctcgacgagctcgagatcgagtacgacgagcaagaggactacgtcgtcatcaaacacgctgctctgttcacctccaccatcatgagtaagcttttggccaggccaaatgtgaagctcttcaacgctgtcgccgcagaggacttgatcatcaagggaggcagagtaggtggtgttgtgaccaactgggctttggtgacaatgaaccatgacacacaatcctgcatggaccctaatgtgatggaggctaaggtagttgtgagctcatgcggtcatgatggtcccatgggtgccaccggggtgaagcggctcaggagcgttgggatgatcgagagtgttccgggaatgaaagctcttgacatgaacactgctgaggatgagattgtgaagatgacaagagaggttgttccaggcatgattgtcaccggaatggaagttgccgagatcgatggatctccaagaatgggaccaacatttggggctatgatgatatctggacagaaggcggcacatttggcgttgaaggcgttggggctaccaaatgctttggacggaacactcgtcggaaccgtgcaaccggagctgatgcttgcagctgctgattccggtgagagtgtggatgcctagatgaagtagtaaatatttagaggttggaattggtgtttgaataaatcaatgttgtttgataaggcattgcgttttcttatgacttgttacgaatgaatggaagatgatgcctgtgttttcgttttctgttcttgtctatatgtgataaagctggttcaggtggggaactaaaataacattaataaaataaaatagtaatttagtggtattaatacttgtagatataacgaaaataaacaagaaaaattgtcccatatataaaagaaactaggggcgtattaacccgcagc

SEQ ID NO: 6124 - DNA, 1335 bp, Gossypium raimondii
ccagacttccgaggaacaccaaaaccttcttttgttttcttcttctaatcaatggcatcttccatagctacaactctcacttcctcttcaaagctttgcaggaacacttctctcttcgagtcttccttccatggggttccaattaaaccactttcttttcatttcaaaacaaagtcttccccgtgcaacgcatccatttccatgtctgcagcatcacctccaccctatgatctgaataatttcaggtttgaccccatcaaggagtccatcgtctcacgtgagatgacacgcaggtacatgatggacatgatcacctatgctgataccgatgtggtggtcgtcggtgccggctccgccgggctctcttgtgcctatgagcttagcaagaacccctccgtacagatagctattgtcgagcagtctgttagccccggaggtggtgcctggctcggtgggcagcttttctctgccatggtagtgcggaaaccagctcatcgcttcctcgacgaactcgccattgaatatgatgaacaagacgactatgttgtgatcaagcatgcagcccttttcacatccactatcatgagcaagcttctagcccgccccaacgtgaagctgttcaacgctgtggcggcggaggacttaatagtgaaggaagggagagttggtggtgttgtgacaaactgggccctggtgtcaatgaaccatgacactcagtcctgcatggaccctaatgtgatggaggccaaggtggtggtgagctcttgtggtcatgatgggccatttggagccaccggggtgaagaggttgaaaagcattgggatgattgatagtgtgccagggatgaaggcactggatatgaatacagctgaggatgctatagtgaggctgactagggaaattgtgcctgggatgattgtcaccgggatggaagttgctgagattgatggatccccaagaatggggccaacatttggagcaatgatgatatcagggcaaaaggcagcccatcttgccctgaaatcattaggattgcctaatgcaattgatggaacatatgtgggaagcattcacccggagctgatcttggccgctgcagattccgccgagaccgctgacgcttagttgcaagggtcatagttgctaaactgctatggagataggaggaattggaataatgtgcagtcattggtaggatttggaataatctcctgtaacttagtagcaaaaccttagcattttgtagcttgttgttcttctccttgcatgccttttaattgagttctgttctctttcttctttgtcttctatatacttgcaacttccacagttaag

SEQ ID NO: 6125 - DNA, 1302 bp, Vaccinium corymbosum
tcactcctcatcccaatcgaaacatctcaattcttcttccccaaccccatcatcaatggcatccgtcaccgcaaccctcacttcttctctctccaccaaaccaaaaacctcattcctagacacccaatcgtcttccttccatggcttccgacccaccaaggctgcggcggccccacacaacaaccacctctccatctccatgtccgcctcaccaccgccctacgatctcaagtcgttcaagttcgatcccatcaaggaatcaatcgtttctcgtgaaatgacccgcaggtacatgatggatatgatcacctacgccgacactgacgtcgtcgttgtgggcgctggatctgctggcctctcctgcgcttacgagctcagcaaaaacccatctgttcaggtggcaatcattgagcaatccgtaagccctggaggcggtgcatggctcggtggacaactcttctcggccatggttgttcgtaagccagcacatcgcttcctcgatgagctcgagatcgagtacgatgagcaggacacctacgtggtgatcaagcacgccgccctattcacatccaccatcatgagcaagctgttggctaggccaaatgtgaaactcttcaatgccgtggcggctgaggacttgatcgtgaaggaagggagagtcggtggtgttgtgactaactgggctttggtgtcaatgaaccatgacacacagtcttgcatggaccccaatgtcatggaggccaagatagttgtgagctcatgcggacatgacgggccgtttggagcaacgggagtcaagaggcttaagagtattgggatgattgatagtgttcccgggatgaaggcacttgacatgaacactgctgaggatgcaattgtcaggcttacaagggagattgtgcccggaatgattgtgactggcatggaggttgctgagattgatggagcccctagaatgggaccgacatttggggcgatgatgatttcagggcagaaggctgctcacctggcattgaaatcgcttggactgccaaacgcgctggatggaacatctgtcggaagcgttcaccccgagctgatcctagcttctgtagatggtgctgaaactgtggatgcctaagcgtatgaaaccgggtttgtccaataaataaaacttgttagtagttgggttgagatcctggaagatccagaagtggctgagtagattcaatttttgctcaggtggaattaggccatggttttgtgattgtagacctgtccttgtccttttcttttaaacttggttatgagaatggaagtaat

SEQ ID NO: 6126 - DNA, 1327 bp, Vaccinium corymbosum
actcctcactctcttcctcacactccaaaaccacccccaaaacaagaacaaacccctcgatcactccctcacttccttaatccaatggcaaccatggttacaaccttcgctccctctctctcctcaaaccccaaaacctctttcttcgaatcctcccaatctcgtcgcctccaacccatcaaatccaccccacacaaccacaaccacctcaccgtttccatgtccgctgccgcgtctccgccgtacgatctgaagtcgttcaagttcgatcccatcaaggagtcaatcgtgtcacgcgaaatgaccaggcggtacatgatggacatgatcacctacgccgacaccgacgtcgttgtcgttggtgctggatccgctggcctttcttgcgcttacgagctcagcaaaaacccatctgtccaggtggcgatcatcgagcaatccgtcagccccggtggcggcgcgtggctggggggccagctcttctcctctatggtggtccgaaaacctgcccacctcttccttgatgaactcaacatcgagtatgacgagcaagacaactacgtggtaatcaaacatgccgccctcttcacgtccacaatcatgagcaaactccttgcccgtcccaacgtgaagctcttcaacgctgtggcagctgaggacctgatcgtgaagggcggcagggtgggtggcgtcgtgaccaactgggcgttggtttcgatgaaccacgacacacagtcatgtatggatcccaatgtgatggaggcgaaagtggtagtgagctcttgtgggcatgatgggccgtttggggctacgggtgttaagaggctgaggagtattgggatgatcgagagcgtgcccgggatgaaggcacttgatatgaatgcggctgaggacgcgattgtgaggcttacgagggagattgtgcctgggatgattgttactgggatggaagttgctgaaattgatgggtccccaagaatggggccaacattcggggcgatgatgatatcaggacagaaggcagctcacctggcattgaagtccctgggacttccaaacgcggtggacggaacatatgttggaagtactcaccctgagctgatcctagcttctgcagatgctgtcgaaaccgtggatgcgtaaatgtaattagccgttgtctaataaagtaaaagagtgggtaagacttgctggtggtgtgagatggtgaagatgaataagtaggatcagtgaactcaatgtgttagttttgtttaggctaagttttgtgaatttgtgtgtccttttatctttatccttcttttggaactttggatgttagagtggc

SEQ ID NO: 6127 - DNA, 1453 bp, Tropaeolum majus
tcttcacattcttcatccatcctatctttctcatcagcccatacagatctcacaacgcttaacaatggcaacaatcgcttcaactctttctctctctacatccaaaactcagaagctttctcgcttcgattcttctttctatggcgttcccgtcaaccagtcactcccttttagagcgaaatccccaaacactgctcgtctcgcggtatctgcttctgctgccggtcagccatcttctcctccgtacgatctcaattctttcaccttcgatcccatcaaagagtccattgtgtctcgtgagatgactcgcagatatatgaccgacatgataacatacgctgacactgacgtcgttgttgtcggggccggatctgccggtctaacttgtgcttatgaaataagtaagaacccttccgttcaagttgcgatcatcgagcagtcagttagccctggtggtggcgcttggctcggtggccaactcttttctgcaatggttgtgcgcaaacccgctcacttgtttcttgatgagctcaacatagaatacgacgaacaagacaattacgttgtaatcaagcatgctgcactctttacttcgactatcatgagtaagctactcgcccgtcccaatgttaaactttttaacgcagtggcggccgaggacctgatagtgaaggaggggagagttggtggtgttgtaaccaactgggctctggtttccatgaaccacgatacacaatcctgcatggatcccaatgttatggaggcgaaggtagtggtgagttcatgtgggcatgatgggccatttggagccaccggagtgaagagattaaaaagcattggaatgattgatagtgtgcctggtatgaaggcactcgacatgaacaaagctgaagacgccattgttagacttacccgagagattgtgcctgggatgatagttactggcatggaggttgcggaaattgatggtgccccaagaatgggaccaacattcggcgccatgatgatatcaggccagaaggcagcccacattgcccttcagaaactggggcttcccaatgcattggatggaacctacgtgggaagtgttcaacctgagctgatcttagctgctgctgaatctgctgagatcgtggatgcttagaaagagtagctgcaaaagtcagggacccaataaagtgtaataattgtagctttgtataaaagggactcaagtaatccttggatggatgtatgcgattatgtgatctgagttttgtttatgatatggcttgtttcttcagagtggaagttttgttggatgggtatattagcttctttaccttattctctgtcttgtattccagaaattatcaccggctccctatccatcaaagtgttcctatgctgtcacattttcatttgttggatgcaacatatcaaatatcaaatgaatgacgtaatggagttgaga

SEQ ID NO: 6128 - DNA, 1520 bp, Coffea canephora
tacgatatagtatatatttatattttttttacaacagatccatcgctagtttgctacagtttaattttctagagaaactccaaataataccaatacaaacgaatccctatcttcctgcaggcgatacagccaaagtgatcctcactcagaagcgtcaaactatagtgcaggcaggcagggtttttgcttggggtaaattcaggcttccagttgtgtgtgaatccatggcaagcatggcaacagcaaccttcacctccactctttcatccaagcctagaacaactctctttgggaattcccgctcatccttccatggactacctgtatcttcatctcctcatcttcagccaattaaatcaaccccgcaaaattcctccttaatctccatgtctgcctcggctactcccccctatgatctccaatcttttacgtttgatcccatcaaagaatccatcgtttctcgtgagatgactcgccggtacatgatggacatgatcacctatgctgacactgatgttgtcatagttggtgctggatctgctggactttcttgcgcttatgaactcagcaagaatccttctgtccaggtggctataattgagcaatccgtgagccctggtggtggtgcatggctaggcggacaactcttttcagctatggttgtccggaagccggcacatcttttccttgatgagcttggtgttgactacgatgaacaagacaattacgttgtgatcaaacatgcagctttgttcacttcaaccatcatgagcaaacttttggctaggccaaatgtgaagctcttcaatgctgttgcagcagaggacttgatagtgaaggggagtagagttgggggcgtggttaccaattgggctctggtttccatgaaccatgacacacagtcttgtatggatcctaatgttgtggaggctaaggttgtggtgagttcttgtgggcatgatggcccctttggtgctactggtgttaagaggctcaagagtattggcatgattgaaaatgtccctggcatgaaagcgttggacatgaatgcagctgaggatgcaattgtgaggctcacaagagaaattgtgcccgggatgattgtcactggtatggaagttgctgagattgatggagcaccaagaatggggccaacattcggagccatgatgatatcagggcagaaggcggctcatcttgcattgaggtccctgggcttgcctaacgcattagatggaacatatgcgggaagtattcaccctgagctaatccttgctgctgctgatgcttcagagaccgtggacgcctgagtgtagaacactagagaactaaagatgaatgaatgaaaacaagaggtagtaatgtatataaataagagcgatgggtttgtagatttgcaactttcaaacgaatgaataaatttctgggactatagacgtgatgattatcaatgtagctgaaagttgtatgtgaaaaagtggtattggagcttcgcagttcttaaaaaaaaaaaaaaaaaa

SEQ ID NO: 6129 - DNA, 1226 bp, Fraxinus spp
ctgtatttctcggaaaaaaaatggcgaccatggcttctactttggccccaaaaaccacttttctggatgccaacaaatcctccttcaatggaataccaatttcttccccaatcagggtgcaacccatcaaatccacttcgcagaacctttcgatttcggcctcctcgccgccttatgatctgaaatcctttgaatttcagccgattaaagagtcgattgtttcaagggaaatgacacgcaggtatatgatggacatgatcacctatgccgacactgatgtcgtgattgttggagctggctctgctggactctcatgtgcttacgagctcagcaagaacccatccgtacaggtggctataattgagcaatctgtgagtcctggtggcggcgcgtggctcggaggccagctcttttctgctatggtggtccgtaagcctgcacatcatttccttgatgagctcgagattgagtatgatgaacaagacgactacgtggtcatcaagcatgctgccctttttacttccacaattatgagcaagctcttggctaggccaaatgtcaaacttttcaatgctgttgctgcagaggatttgattgtgaagggaggtcgtgttagtggcgttgtaacgaactgggctttggtgtccatgaaccatgacacacagtcgtgtatggacccgaatgtgatggaggctaaagtggtggtgagctcgtgtggacacgatggtccatttggcgccaccggggttaagaggctcaagagcattggcatgatagacaatgttccgggaatgaaggcattggacatgaacactgctgaagatgcaattgttaggctaactcgagagatcgtgcccgggatgatagttaccgggatggaggttgcagagattgatggggcaccgagaatgggtcctacctttggagcgatgatgatatcggggcagaaggcggctcaccttgctttgagatccttggggctgcctaacgagttggacgggacgaatgtgggaaatgtccaacctgagctgatcttggctgctgctgatgatggaactgagattgtggaagcttgaagagagtagttttgaagggtactaatgaagttgtagtaaatgaagggatgtgaataaatagtgttgtacatctcttgatgagagaggcttctagtgactgcttcagtgtttttagtgttctctgtgtgatgaactttggctagtatttac

SEQ ID NO: 6130 - DNA, 1292 bp, Ipomoea nil
cactctccacttccctatctgatcagataacattatcatctatcatatcttcatagccaccatccatggccgccgctactctcacctcctccctctcctctaaactcaaaccatctttcttcgatgccgccaaatcatcgttcaatggaacgcccgttgtttcttctcgcgttcaggccgtcaaggcttcctctcatcacaacctctcagtatctgcatcgcacaccccttacagccttgattccttcaagtttcaacccatcaaagaatccatcgtcgcccgtgaaatgacccggagatacatgacggacatgattacctacgccgacaccgacgttattgtggtcggagctggttccgccgggctttcctgcgcctacgagatcagcaagaaccccaacgtccgcgtcgccattattgaacagtccgtcagccccggcggtggcgcgtggctcggaggacagctgttctccgccatggtggtgcggaaaccggcgcaggtgttcctggacgagctggaagtggagtacgaggaggcagacaactacgttgtcatcaaacacgcggcgctcttcacctccaccatcatgagcaagctgctggccaggccgaacgtgaagctgttcaacgcggtggcggcggaggatctgatcgtgaagaacggccgagtgggcggagtggtcaccaactgggctctggtgtcgatgaaccacgacacccagtcttgtatggatcccaacgttatggaggccaagattgtcgtgagctcatgcggccacgacggaccgttcggcgccacaggcgttaagcggctgaagagcatcggaatgatcgattccgtgcccggaatgaaggccctcgacatgaacaccgccgaagacgcaatcgttaggctcaccagggagattgttcccgggatgatcgtcaccggcatggaagtcgcagaaattgatggagctccaagaatggggccaacatttggggcgatgatgatatcagggcagaaggcggctcacttggcgttgaaggctttgggtgaaccaaatgcgttggatgggagtgcaagcgaagttgcagcgccggagctcatccttgcctccgccgagaatgaagaaattgctgatgcttaagactttagatcatcgaaattgtatgaacaataataataaaattgttaggaatgaaggggacatgaagccttgtaggttctctttttaattggagagctgaggttgattgagatttagatcgaatggatatgccatggttggccacttggctgtttatgtgtt

SEQ ID NO: 6131 - DNA, 1560 bp, Mimulus guttatus
atgtttaaagaaaacaaaattcatgagaaaatctttttctttcagatatttttcacctttatctgttatatatactcttctttaattcatcaccactcacaccactctcctccgatcacaaccaccccacccaccggaaaacaaaagaaacgaaaagaaaaccagtctgcaacaatggcagccatggctacaaccctcagatcctccctcaccaagacctccttcttcgacaacaagtccaccttccacggcgccgccgtcgtgcccacacgcgccgcccagcccatcaaatccacccccaagaacctcgccgtcgccatggcctccaccccctacaacctcgacgacttcaaattccagcccatcaaggaatccatcgtcgcgcgtgagatgacgcgccgctacatgacggacatgataacctacgccgacaccgacgtggtcgtcgtcggcgccggatccgccggcctctcctgcgcctacgagctcagcaagaaccccgacatcaacatcgccatcatcgagcagtccgtcagccccggcggcggcgcgtggctcggcggccagctcttctccgccatggtggtccgcaagccggcccacaagttcctcgacgagctcgagatcgagtacgacgagcaggaccactacgtggtgatcaagcacgccgccctcttcacctccaccatcatgagcaagctcctcgcccgccccaacgtcaagctcttcaacgccgtcgccgccgaggatctcatcgtcaagggcggccgagtcgccggcgtcgtcaccaactgggccctcgtcgcccagaaccaccacacccagtcgtgcatggaccccaacgtcatggaggccaagatcgtcgtcagctcgtgcggccacgacggccccttcggcgccaccggcgtcaagcgccttaggagcatcggaatgatcgagagcgtccccgggatgaaggccctcgacatgaacaccgccgaggatgccatcgtcaggctcacccgagagatcgtccccggcatgatcgtcaccggaatggaagttgccgaaattgacggctctccaagaatggggcccacatttggagcgatgatgatttcgggacagaaagcagctcacttggcattgaaggctttgggattaccacatgctttggatggttcttacagtgaagctcaaccggagcttgttttggcttcggccgaggccgatgatgttgtcgaggcctagattccgagtcgactcgagaaaatgagatttgaataaaatgtaataagaggaggggattaattatttcgaattcggattttaattagggacttttatttaattagaagtactgaagtactatttatttgcagatttttgcttgaaatgtttccatcttctgtgtagttccttccccccttgttcatgatttcaagaagatctctctctacttacatagcttgtgattatgtgatttgtctcttactatacatattaacttatgaacaaccttcattactaatatcctttcgaatctagacggtccgattttggctatttgctaaaagtcgt

SEQ ID NO: 6132 - DNA, 1787 bp, Lippia dulcis
ctaagacaacccatatcaactaagtctaaattctaaaaccaccgcaaatggcagccatggccacggccctcacatcctccctctccaaaaccgccttcttcgacaccagatccgccttccacggcaccacactgcccacacgcgccgccgcgcagccggccagatccaccccacagaaccctgccatcactatgtccgccgccccctacaacctcgacaacttcaaattccagcccattaaagaatccatcgtctcccgcgaaatgaccaggcgttacatgaccgacatgatcacctacgccgacaccgacgtcgtcgtcgtcggcgccggctccgccgggctctcctgcgcctacgagctcagcaagaacccggacatcaacgtcgccatcatcgagcagtccgtcagcccgggcggcggggcgtggcttggcggccagctcttctccgccatggtcgtccgcaaacccgctcacaagttcctcgacgagctcgaaatcgagtacgacgagcagggcgactacgttgtcatcaagcacgccgctctgttcacctccaccatcatgagcaagctgctcgcgcggccgaacgtgaagctcttcaacgccgtcgcggcggaggatctgatcgtgaagggcggaagagtcgccggagtggtgaccaactgggctttggtgtccatgaaccacgacacgcagtcgtgtatggaccccaacgtcatggaggcgaaggtggtcgtgagctcctgcggccacgacggacctttcggcgccaccggagtgaagcggctgaggagcatcggcatgatcgacagcgttcccggaatgaaagccctcgacatgaacgccgccgaggacgccatcgttaagctgacgagagaaattgtgcccggaatgatcgttaccggcatggaagtcgctgaaatcgacggatctccgagaatggggccgacttttggggcaatgatgatttccgggcagaaggcggcgcatttggcgttgaaggctctggggcagccaaatgctttggaaggttcttacggtggagttaaagctgaggcggagctcttgctagcgtcggcggagtctgatgagaccgtggatgcgtaagtttagtgacgacggaaatggaatggaataagacgagagagagatgagtgtgaatgagtactgttagtcgatctttagtgtttagataaaagtggagatgctgtattgccttcgcttcaactatcatcttccttagttgtatggtcagagaagaaactcttctgcatttcggctttttagtacataaaatgcacaaaaaaaaaaggatatttgattaattggtgaatcgccggtaaatgaaatatatagaaacttggtaatttttattgagatttcaatcggtataaggaaagagtgttttatatttttgaagtgagataagggaagaatatttgatataaagttaattaaaagagatcaacgaagaataagtgtacacgattaatggaattgattttcttttcttaattttacagtgtaaaagtaaaacactcttctttcccttcgttatacagttggacaaaagaattgcgtgtggggctagaatttgttagaacttagaagagaaatggatacgtatctctgaacctcattgttgggctacgtgtgatattttttattgtggtgatgtgtgtaatctacattattaggtgtaaaaatgttcacgggagtcgtaggttcctttgcgttgggccttgtcattgtcccaagtccggggataactcaaaacccataaac

SEQ ID NO: 6133 - DNA, 1394 bp, Panax ginseng
tggtatcaacgcagagtacatgggtacaacccacgcagcaacttctgtcttcttcttcctctttctgtctctcatcaaaaataaaaaatggcgaccatggctacaaccttcgcatcttctctctcctccaaacctaagaccactaatttcttggaatcatccttcaatggagtttctatttctacggcgtctcgcctccaacctatcaaatcaggccaacaaaaccaccagttcaccgtctcggctttttcatcccctccatatgatctcaaatcattcaaattcgaacctatcaaggaatcgatcgtttcacgtgaaatgaccagaaggtacatgaccgatatgatcacttatgctgacaccgatgtcgtcgtcgttggcgctggctctgccggcctttcctgcgcctacgagctcagcaaaaccccatccgttcaggtggcaataattgagcaatctgttagccctggtggtggtgcatggcttggtgggcagctcttttcatcaatggttgttcgcaagcctgcacatcatttcctagacgagcttgagatcgagtacgatgagaaagatacttatgttgtgatcaagcatgctgctttgtttacctcaacaatcatgagcaagcttttggccagaccaaatgttaagctcttcaatgccgttgcagcagaggatttgattgtgaagggaggaagagtaagtggggtggtgaccaactgggctctggtttctatgaaccatgatacacagtcgtgcatggaccccaatgtgatggaggctaaagtggtggtgagctcttgtggacatgatggcccttttggggctactggagtgaagaggctcaagagtattgggatgatcagcagcgtgccaggaatgaaggccctggacatgaacacagccgaggatgcaattgttaggcttacaagggagatagtgccggggatgattgttactggaatggaagtcgcagaaattgatggagctccaagaatgggaccgacatttggagcaatgatgatatcaggacagaaggcagcacacttggcattaatggcactaggacaacctaatgccttggatggaacatatgttggtggtattcaggcagagcttatcgtagctacagctgatgctactgagatcgtggatgctcaagtgctgaagcaaatatgatcattgtagttgatctggatgagtactggtggatgaacctctcttgtgatggatttacttggggtttttcgttgaatgtttggtctttgtatgtgatcttgctttcctttgttagaactcgaatgttgaaatggtagtaactttttgctcaagttttataattgctgcattttgttctagtgttttaccctccggggctaatttagatttattca

SEQ ID NO: 6134 - DNA, 1305 bp, Panax ginseng
gggagtacaacccacgcagcaacttctgtcttcttcttcttctttctgtctctcatcaaaaataaaaaatggcgaccatggctacaaccttcgcatcttctctctcctccaaacctaagaccactaatttcttggaatcatccttcaatggagtttctatttctacggcgtctcgcctccaacctatcaaatcaggccaacaaaaccaccagttcaccgtctcggctttttcatcccctccatatgatctcaaatcattcaaattcgaacctatcaaggaatcgatcgtttcacgtgaaatgaccagaaggtacatgaccgatatgatcacttatgctgacaccgatgtcgtcgtcgttggcgctggctctgccggcctttcctgcgcctacgagctcagcaaaaccccatccgttcaggtggcaataattgagcaatctgttagccctggtggtggtgcatggcttggtgggcagctcttttcatcaatggttgttcgcaagcctgcacatcatttcctagacgagcttgagatcgagtacgatgagaaagatacttatgttgtgatcaagcatgctgctttgtttacctcaacaatcatgagcaagcttttggccagaccaaatgttaagctcttcaatgccgttgcagcagaggatttgattgtgaagggaggaagagtaagtggggtggtgaccaactgggctctggtttctatgaaccatgatacacagtcgtgcatggaccccaatgtgatggaggctaaagtggtggtgagctcttgtggacatgatggcccttttggtgctactggagtgaagaggctcaagagtattgggatgatcagcagcgtgccaggaatgaaggccctggacatgaacacagccgaggatgcaattgttaggcttacaagggagatagtgccggggatgattgttactggaatggaagtcgcagaaattgatggagctccaagaatgggaccgacatttggagcaatgatgatatcaggacagaaggcagcacacttggcattaaaggcactaggacaacctaatgccttggatggaacatatgttggtggtattcaggcagagcttatcgtagctacagctgatgctgctgagatcgtgaatgctcaagtgctgaagcaaatatgatcattgtagttgatctggatgagtactggtggatgaacctctcttgtgatggatttacttggggtttttcgttgaatgtttggtctttgtatgtgatcttgctttcctttgttagaactcgaatgttgaaatggtagtaactttt

SEQ ID NO: 6135 - DNA, 1246 bp, Ipomoea nil
gaaccattctctcaagttttgatttgatggcaaccatggcttctaccttggccgcttcttcctcagtatccaaaacctctttcttggatgctcataaatccttcttccatggaacccctgccgtctcttcacaacctgcaaggtcttttacacaaccccttaaatcccccatttccagaaacatggctatctctatgtccgcttcttctgcttctgcttccactcctcctccttacgatctcaaaagcttcacgttcgaacccatcaaggagtccattgtttctcgggagatgaccaggcggtacatgacggacatgatcacctacgccgataccgatgtcattgttgttggcgctggatctgctggcctctcttgcgcttatgagctcagtaagaaccctaacgttcaggtggcgataatagagcaatcggtgagccctggcgggggggcatggctgggcgggcagctgttttccgccatggtggttcgcaagccggctcatctgttcctggacgagctgggcgtggagtacgacgagcaagacaactacgtggtgataaagcacgcggcgctcttcacgtcgaccatcatgagcaagcttctaagcaggccgaacgtgaagctgttcaacgcggtggcggcggaggacttgatagtgaagggcgggagagtgggcggcgtggtcaccaactgggctctggtgtccatgaaccacgacacgcagtcgtgcatggaccccaacgtgatggaggccaaagtggtggtcagctcctgcggccacgacggccccttcggggccaccggagtcaagaggcttaagagcatcggcatgattgaaagtgtccccgggatgaaagctttggatatgaacacggcggaggacgcaatcgtaaggctgactagagaaatcgtgccggggatgattgtcaccggcatggaggtcgctgaaatcgatggagcaccaagaatgggaccgacgtttggagcgatgatggtatcagggcagaaggcggcgcatttggcactgaaatctctaggaatggctaatgctattgatggtgatgaggttggaagcattcacccacagctcataatggctgcggctgatgattcagaggtagtggatgcttaattcattagaagaaacagagggagcagatcgagtggttttaattattatgctagactagatttaagaccatgggtatgttggtctgcgtaatcaaatgaaggacatcaatgaat

SEQ ID NO: 6136 - DNA, 1346 bp, Elaeis guineensis
cctcagtctccttaaaaaaatggcgaccatggctacctcctccctagcctccaaacccaagacctccctcctcgaccaccaccaccaccactcctccttccacggcctcgccctcccctcccgcgtctccgccgctgcagccggccgctccccgaattcacgcagcctcttcatctccgcctccgccgccacccccaagtacgacctcaactccatccgcttcgaccccatcaaggagtcgatcgtctcccgcgagatgacccggcgctacatgacggacatgatcacccacgccgacaccgacgtcgtcgtcatcggggccggctccgcggggctctcctgcgcttacgagctctcgaaggacccctccgtccaagtcgccatcgtggagcagtccgtctcccccggcggcggcgcctggcttggcggccagctcttctctgccatggtggtccggaagcccgcccacctcttcctcgacgagctcggcgtcccctacgacgagcaggactcgtacgtggtcatcaagcacgcggcgctgttcacctccaccatcatgagccgcctcctcgcccgccccaacgtcaagctcttcaacgcggtggcggcggaggacctgatcgtgaaggaggggagggtcggcggagtggtcaccaactgggctctggtgtcgatgaaccacgacacccagtcgtgtatggatccgaacgtgatggagtccaaggtggtggtgagctcctgcgggcatgacggcccgttcggagctacgggagtgaagcggttgaaggacatcgggatgatcgactcggtcccgggtatgaaggcgctcgacatgaactcggcggaggacgcgatcgtccgcctcaccagggagatcgtccccgggatgatcgttaccggcatggaggtcgccgagatcgacggcgccccaagaatgggaccgacttttggggcgatgatgatatcggggcagaaggcggcgcatctggcgttgaaggctctggggaggccgaacgcgttggacgggaccatcggaacggagcaggtgcatccggagatggtgttggcctcatcggacggtggagatgtggtggatgcttagatggagtttgttctgaagaaatgatgtgaagggaataatatatcactgagagtgaggggagaggttgtgggtctgtggatggcatggtgggctgttgtttgtttgttatctgaggagtgcaaagaagtgtgaaacgtgtgttctgttctttgctgccggttccttgttgttaataatatgctactcagctggttgttagtgatatgccttttcttaattggatgttaataatatgccttttctt

SEQ ID NO: 6137 - DNA, 1368 bp, Ambrosia trifida
ctcttcatcatggcatccatgactacaaccttcacctcatctttctccaacaaaacatgtttcttggatcaatcttccttccatggtgttcccatcacttccccggtccggatccaagccgttaaatcgaaccaaaacaagaacatgcctatcaccatgtcagcgacaccttacgacctggttcattcacctttcaacccatcaaggaggcgatcgtatcccgtgaaatgacccggaggtacatgactgacatgatcacctatgccgataccgacgttgttgtcgttggtgctggctctgctggtctctcttgtgcttacgagcttagcaaaaccccaacgttcaggtagctatcatcgagcaatctgtgagccctggaggaggagcatggctcggaggacagctgttttcagccatggtggtccgcaaacccgcacaccacttcctcgacgagctcgagatcgagtacgacgagcaagaagactacgtggtcatcaaacacgctgctctcttcacatccaccatcatgagcaagcttttggcccgaccaaacgtcaagctcttcaacgcggttgcagccgaggatttgatcattaaggaagggagagttggtggtgttgtgaccaactgggctttggtgtccatgaaccatgacacacagtcatgcatggaccctaatgtgatggaggctaaggtggttgttagctcatgtggtcatgatggtcccatgggtgccacgggggttaagcggctcaggagcgttggaatgatcgaaagcgttcctgggatgaaggcgctcgacatgaacactgcggaggacgcgattgtgaagcttacaagagagattgtgcctggtatgattgttactggaatggaagttgctgagattgatggatctcccagaatgggaccaacatttggggctatgatgatatccggacaaaaagcggctcatttggcattgaaggcacttgggctgccaaatgcattggacggaacaagtgtgggaagtgttcaccctgagctgatccttgcagctgctgattctagtgagaccgtcgatgcctaaatgaagtaaatatttagaatgaaatccgctattgaataaatgaggaacacgaggtgtgaatcaatgtcgtttcattgttagtttgttgttgagagactttgtgtttttatgttattgtgaattgtctgtgtttatgtttggttcttccttgtattcgcctagaatttagaaggtaaggttggtcgtattatgtatttgaagatgaaaaggattccaaggtacatgttatgtaccgagaattgttatgtatgtccgatcttcttaagagtgaaaattctcttattttgtgcaaaaaagaa

SEQ ID NO: 6138 - DNA, 1151 bp, Flaveria ramosissima
ctcaataggcgtccatgactaccaccttctacctcatctctctgcaacaacaccaaaacctccttcttcgaccaatcatccttccatggcgttccgatctcatctccgatcaggatccactcacccaaatcaaaccaaaacaagaccacccccatcaccatgtccgcaaccccttacgacctcggctccttcaccttccaacccatcaaagaagccatcgtctcccgtgaaatgaccagaaggtacatgaccgacatgatcacctacgccgataccgacgtcgtcgtcgtcggtgctggctccgccggcctctcttgcgcctacgagctcagcaaaaaccccaacgttcaggtggccatcatcgagcaatccgtgagcccaggcggtggcgcgtggctcggaggacaactgttctccgccatggttgtacggaagcctgcacatcacttccttgatgagcttgagatcgagtacgacgagcaagacgactatgtggtgatcaaacacgctgctcttttcacctccaccatcatgagcaagctgttggctagaccaaacgtgaagctcttcaacgcggtggctgcagaggatttgatcattaaagaagggagagttggtggtgtggtgaccaattggggctttggtctccatgaaccatgacacacagtcgtgcatggaccctaacgtcatggaggctaaggtggttgtgagctcgtgtggtcatgatggtcccatgggtgccactggggtgaagaggctcaggagtgttgggatgatcgaaagtgttcctgggatgaaagctcttgacatgaacacggccgaagatgcgatcgtgaggctcacgagagagatcgttccaggtatgatcgtcaccggaatggaagttgctgagatcgacggatctcccagaatggggccaacatttggggctatgatgatatctggacagaaagcggctcatttggcgttgaaggcgcttgggcttccgaatgcattggacgggacgagtgtgggagtgttcaacctgagctgatccttgcggctgcggattctggtgagaccgtggtcgatgcctaaatggagtatatatttagggcgaagtcttctttcgaataaatggaaaaacgcggcttgtgaattatggtcgtatc

SEQ ID NO: 6139 - DNA, 1386 bp, Olea europaea
tctagaaaaacctctgtatttctcgggaaaaaataaaatggcgaccatggcttccactttggcctcaaaaaccactttcctggatgctaacaaatcctccttcaacggagtaccaatttcttccccgaccagggtgcaacccatcaaatccacttcacagaacctttcgatttctgcctcctcgccgccttatgatctgaaatccttcgaatttcagccgatcaaagagtcgattgtttcaagggaaatgactcgtaggtacatgatggacatgatcacctacgctgacactgatgtcgtgattgttggagctggctctgctggactctcatgtgcctacgagctcagcaagaacccatccgtacgggtggctataattgagcaatctgtgagtcctggcggcggagcttggcttggaggccagctcttctctgctatggtggtccgcaagccagcacatcatttccttgatgagctggagattgaatatgatgaacaagacgactacgtggttatcaagcacgcggctctttttacttccacaatcatgagcaagctcttagctaggccaaacgtgaagcttttcaatgctgttgctgcggaggatttgattgtgaagggaggtcgtgttggtggcgttgtgacgaactgggctttggtgtccatgaaccacgacacacagtcctgtatggacccgaatgtgatggaggctaaagtggtggtgagctcgtgtggacacgatggtccatttggcgccaccggggttaagaggctcaagagcattggaatgatagacaatgttcccggaatgaaggcattggacatgaacacagctgaagatgcaattgttaggctaactcgagagatcgtgcccgggatgatcgttaccgggatggaggttgcagagattgatggcgcaccgagaatgggtcctacatttggagcgatgatgatatcgggccagaaggcggctcaccttgctttgagaaccttggggctgcctaacgagttggacgggacgaatgtgggaaatgtccaaccggagctgatcttggctgctgccgatgatggtaatgagattgtggaagcttgaagaaagtagttttgaagtgtactactaatgaagtagtagtaaatgaagggatgtgaataaaaagtagcgttggacatctcttgatatgagagaggctttagtgactgcttcagtgtttttagtgttctctgtggtatgaacttcggcagtatttagtactacttttaagtcttccttttgcatcatttgccttaatgtcttcatgctcaacgtgtacttaacttgctatattccttttagacaatatagataaaaggatcatccggggatttgtgcacaagactccacccccc

SEQ ID NO: 6140 - DNA, 1329 bp, Cichorium intybus
tcttcatcattataccatatcattactggcggccagtggctactaccttaacaacatccctctctactaaggtaaagaccagtttcttggaccagtcctccttccatggagttcccatttcttccccaattcgtttccaatcactcaaatccacccaaaacaaaatgtcaattaacatgtctgcagcttctacgccttacgatcttaactccttcacttttcaaccgattaaggaatccatcgtgtctcgtgaaatgaccaggagatacatgactgatatgattacgtacgctgacaccgatgtcgtcgtcgttggtgctggatctgctggtctctcttgcgcttatgagctcagtaagaaccctaatgtccaggtagctattattgagcaatctgttagccccggcggtggtgcatggcttgggggacaactcttctccgccgtggttgtccgaaagccggcacacctcttcctcgacgaactcgaaatcgagtatgatgagcaagaacactacgtcgtgatcaaacacgctgctctattcacctccaccatcatgagcaagctgttggcgcgaccaaacgtgaagctcttcaacgcggtggccgccgaagatttaatcatcaaaggaggaagagtcggtggcgtggtgacgaattgggctctagtgtcgatgaaccacgatacacagtcgtgtatggaccctaatgtgatggaagctaaggtggttgtgagctcatgtgggcatgatggtcccatgggtgccaccggagtcaagaggcttagaagcgtagggatgatcgagagcgtcccagggatgaaggcgcttgacatgaacacagctgaagacgcgatcgtaaggcttacgagagagattgtccccggcatgatcgtgacagggatggaagttgcagagattgatggatctccaagaatggggccgacgtttggggcgatgatgatttcagggcagaaagctgcacatttggcgttgaaggcgttggggcttcctaacgctctcgatggatcatacgtcggaagtggccagccggagctgatacttgcggcggtagacggtggcgacactgttgaagcttgaatgtggtaggaattgagaccggagaataagaaatgtgggacaggggtggtggtggtttttggtggatataagattttgttttatgtgaatgaatgatgcctcctattaccctttcaataacttggtttctcggttatgatttgatcgagttaaaaaccagaacccaaagagttttcttatcttctaacttcaacaaaatagtttttaataatataaattgaattgagcaaaa

SEQ ID NO: 6141 - DNA, 1400 bp, Flaveria ramosissima
attggggaccacctcactcaccttctacacaatcccacaacacaaccaaacaccttcaagctcttcatcaatggcgtccatgactaccaccttcacctcatctctctgcaacaaaaccaaaacctccttctttgaccaatcatccttccatggcgttccgatctcatctccgatcaggatccactcacccaaatcaaaccaaaacaagaccacccccactcaccatgtccgcagccccttacgacctcggctccttcaccttccaacccatcaaagaagccatcgtctcccgtgaaatgaccagaaggtacatgaccgacatgatcacctacgccgataccgacgtcgtcgtcgtcggtgctggctccgccggcctctcttgcgcctacgagctcagcaaaaaccccaacgttcaggtggccatcatcgagcaatccgtgagcccaggcggtggcgcgtggctcggaggacaactgttctccgccatggttgtacggaagcctgcacaccacttccttgatgagcttgagatcgagtacgacgagcaagacgactatgtggtgatcaaacacgctgctctattcacctccaccatcatgagcaagctgttggctagaccaaacgtgaagctcttcaacgcggtggctgcagaggatttgatcattaaagaagggagagttggtggtgtggtgaccaactgggctttggtctccatgaaccatgacacacagtcgtgcatggaccctaacgtcatggaggctaaggtggttgtgagctcgtgtggtcatgatggtcccatgggtgccactggggtgaagaggcttaggagtgttgggatgatcgaaagtgttccggggatgaaagctcttgacatgaacactgccgaagatgcgatcgtgaggctcacgagagagatcgttccgggtatgatcgtcaccggaatggaagttgctgagatcgacggatctcccagaatggggccaacatttggggctatgatgatatctggacagaaagcggctcatttggcgttgaaggcgcttgggcttccgaatgcattggacgggacgagtgtgggaagtgttcagcctgagctgatccttgcggctgcggattctggtgagaccgtggtcgatgcctaaatggagtatatatttagggcgaagtttgcattcgaataaatggaaaaacgcggcttgtgaattatggtcgtatcgttgttagtttgttgttgagagatgatttgtggttatgttgttgtgaatggtctgttttcttgttttgtgtcttctctgtgttgttttctagaactataggaagttaagatgggtcatgtgatgtctttggagcatgaaaattgttatatatgttggagcttttagaaatttgggtctcagacc

SEQ ID NO: 6142 - DNA, 1936 bp, Citrus clementina
tgactcaccagtcatcatcactgctgcaaatcaaattacttctcattatcaaacttctaagcagcaggggaaggaggggttaaaaaaaaaaaacatggcagccatgacttctacagctttcgctccttcagtttcgtccaccaccaataagctctttgactcatcctttcatggggctcccatgtcaccttctcttctacgtcttcaacccatcaaatcttctcgtcccaacaacttgtccatttctgcttctgcttctcctccttatgacttgaacactttcaagtttgaccccatcaaagaatccattgtttctcgtgaaatgacacgcaggtacatgacggacatgatcacttatgctgacactgatgtggtagtggttggtgctggctctgctggcctctcttgtgcttatgagctcagcaaaaaccccaacattcagattgctattatcgaacagtctgttagccccggcggtggcgcgtggctcggtggacagctcttctctgccatggttgtgcgcaaaccagcccacatcttccttgacgagcttggcatcgactacgatgagcaagacaactatgttgtgatcaagcatgcagcgctgttcacctccactataatgagcaagctcctggcccgccccaacgtcaagctctttaatgcagtggcagccgaggacttgatagtcaaaggcggcagagttggtggtgtggtgaccaactgggcgttggtgtcaatgaatcacgatacacagtcttgcatggatcccaatgtaatggaagcgaaggtggttgtgagctcttgtggccatgatgggccttttggtgccactggagtaaagaggttgaagagtatcggaatgattgaggaagtgcctggaatgaaggcactggacatgaactctgcagaagatgctattgtgaggctgaccagggaggttgtgcctggtatgatagttaccggcatggaagttgccgagattgatggtgctcctagaatggggccaacatttggagcaatgatgatatcggggcagaaggctgcgcatttggcgttgaattcactgggccagccgaatgcattagacggtacatatgtgggaggcgttcaccctgagctgatcttagctgcagctgattctgctgagactgctgatgcttaatttggtaataacaggcatcatcactcatcagctgtgtgcatgcaaataaactctggcaaaaaagtagttgtatttaggtggttgtgatggatggttgatgcgaataatgagatgatgttgtgaggttttgtgaataaagtgtttgtttccggtccatcatggaacctttaattttaatttctttctcctcttgtaagaaaccgttgtgagtttttcggaggtgaatttgcagttgcgtatctagtccttgttatctgtgttgtatgtaagactgcccttgggctgttcccttttctttgctttgtatgtttataacttgaggcatcagccaatgggaaagtgctgatgtgattaagatcaatgatgaagatctgagcttactctgtttttgttgctagggcaagtattaacttcgatatgatcttgtgatgatcggagtaataagctgtaattgagaaattaagtaaggaccttttatggtgaaaattaagtgattgaatggtgtacatataagaaccccagtttcagtccatgttaggctgttgaaaagccgagatcaatagctcgttcaatttcccagcataatgcctgagataccgaatcaggctcctaaaactgggtagaatttcttgtcacaagggaaataaatgtagattactgaaatcccgtagtgttttgaaaactattttgtcgtgttaaaactctaatttgagagttggaatatgcaacgttgcaacattatcaataagaggatgtgggctctattgctgt

SEQ ID NO: 6143 - DNA, 1163 bp, Flaveria ramosissima
ccttcacctcatctctctgcaacaaaaccaaaaccaaaacctctttcttcgaccaatcatccttccatggcgttccggtctcatctccgatcaggatccactcacccaaatcgaaccaaaacaggaccacccccatcaccatgtccgcaaccccttacgacctcggctccttcaccttccaacccatcaaagaagccatcgtctcccgtgaaatgaccagaaggtacatgaccgacatgatcacctacgccgataccgacgtcgtcgtcgttggtgctggctccgccggcctctcatgcgcctacgagcttagcaaaaaccccaacgttcaggtcgccatcatcgagcaatccgtgagcccaggcggtggcgcgtggctgggaggacaactgttctcggccatggttgtgcggaagccggcacaccacttcctcgacgagctcgagatcgagtacgacgagcaagacgactatgtggtgatcaaacacgctgctctattcacctccaccatcatgagcaagctgttggctagaccaaacgtgaagctcttcaacgccgtggctgcagaggatttgatcattaaagaagggagagttggtggtgtggtgaccaattgggctttggtctccatgaaccatgacacacagtcgtgcatggaccctaacgtcatggaggctaaggtggttgtgagctcgtgtggtcatgatggtcccatgggtgccactggggtgaagaggctcaggagtgttgggatgatcgaaagtgttccggggatgaaagctcttgacatgaacactgccgaagatgcgatcgtgaggctcacgagagagatcgttccgggtatgatcgtcaccggaatggaagttgctgagatcgatggatctcccagaatggggccaacatttggggctatgatgatatctggacagaaagcggctcatttggcgttgaaggcgcttgggcttccgaatgcattggacgggacgagtgtgggaagtgttcaacctgagctgatccttgcggctgctgattctggtgagaccgtggtcgatgcctaaatggagtatatatttagggcgaagtctgctttcgaataaatagaaaaacgcggcttgtgaattatggtcgtatcgttgttagtttgttgttgagagatgatgtgt

SEQ ID NO: 6144 - DNA, 1524 bp, Lactuca sativa
ataaaatatctaaaaagtattaaaaaaacatttattaatttcgtaaactaccctactaactcttaataaaaaaaacatttattaataaaaatccaaaaagtagtggtaacgagcatcgtaccgattctacacctttcacaccatatccttccctcccgtcgcgatattttaatttccgtcactataaatccgcacagccgtctctaatattcctccgttcatcttccactgctcaccactccaccacccttttctctcatcgttttttagatcatcaatggcggccatggctaccacctttacaacatccatctccaccaaggcaaagaccagcttcttggaacaatcctccttccatggagttcagatttcttccccaattcgtctccaaccactcaaatccacacaaaacaaaatgtcgatcaccatctctgcagcttctacgccttacgatcttaactccttcacttttcaaccgattaaggaatcgattgtgtctcgtgaaatgaccagaaggtacatgactgatatgattacctacgctgacactgatgtcgtcatcgtcggtgctggatccgctggtctctcttgcgcttatgagctcagtaagaacccagatgttcaggtagcgattattgagcaatctgtgagccccggcggtggtgcatggctggggggacaactcttctccgccatgattgtccggaagccggcacacctcttcctcgacgaactcgaaatcgagtatgacgagacagaacactacgtcgtgatcaaacacgctgctctattcacctccaccatcatgagcaagctgttggcccgaccaaatgtgaagctcttcaacgcggtggcagccgaggatttgatcatcaaaggaggaagagtcggtggcgtggtgaccaactgggctctagtggcgatgaaccacgacacacagtcgtgtatggaccctaatgtgatggaagctaaggtggttgtgagctcatgtgggcatgatggtccgatgggtgccaccggagtcaagaggcttagaagcgtagggatgatcgagagcgttccagggatgaaggcgcttgacatgaacacagcggaagacgcgatcgtgaggcttacgagagagatcgttcctggtatgatcgtcacagggatggaagttgcagagattgatggatctccaagaatggggccaacgtttggggccatgatgatttcagggcagaaagctgcacatttggcgttgaaggcattgggacttcctaacgctctcgatggatcttacgtcggaagcagccagccggagctgatacttgcggcggcagacggtggcgagactgttgatgcttgaatgtggtaggaattgagagtggagaataaaagaagtgtgggatagggctgttgctgctgctgctcgtggttttgttttctgtgaatgaatgatatgatatgatgcccttatttcccttcaataacaacttggtttttcccgttgtgatttggtcgtgttaaaaaccaaaacccaat

SEQ ID NO: 6145 - DNA, 1196 bp, Flaveria ramosissima
cagcgggctctagccctaagcccacccttcacctcactctcctctacgcaaccaacaccaaaacctccttcttcgaccaatcatccttccatggcgttccgatctcatctccgatcaggatccactcacccaaatcaaaccaaaacaagaccacccccatcaccatgtccgcaaccccttacgacctcggctccttcaccttccaacccatcaaagaagccatcgtctcccgtgaaatgaccagaaggtacatgaccgacatgatcacctacgccgataccgacgtcgtcgtcgtcggtgctggctccgccggcctctcttgcgcctacgagctcagcaaaaaccccaacgttcaggtggccatcatcgagcaatccgtgagcccaggcggtggcgcgtggctcggaggacaactgttctccgccatggttgtacggaagcctgcacaccacttccttgatgagcttgagatcgagtacgacgagcaagacgactatgtggtgatcaaacacgctgctctattcacctccaccatcatgagcaagctgttggctagaccaaacgtgaagctcttcaacgcggtggctgcagaggatttgatcatcaaagaagggagagttggtggtgtggtgaccaattgggctttggtctccatgaaccatgacacacagtcgtgcatggaccctaacgtcatggaggctaaggtggttgtgagctcgtgtggtcatgatggtcccatgggtgccactggggtgaagaggctcaggagtgttgggatgatcgaaagtgttcctgggatgaaagctcttgacatgaacacggccgaagatgcgatcgtgaggctcacgagagagatcgttccaggtatgatcgtcaccggaatggaagttgctgagatcgacggatctcccagaatggggccaacatttggggctatgatgatatctggacagaaagcggctcatttggcgttgaaggcgcttgggcttccgaatgcattggacgggacgagtgtgggaagtgttcaacctgagctgatccttgcggctgcggattctggtgagaccgtggtcgatgcctaaatggagtatatatttagggcgaagtcttctttcgaataaatggaaaaacgcggcttgtgaattatggtcgtatcgttgttagtttgttgttgagagatgatgtgtggttatgtt

SEQ ID NO: 6146 - DNA, 1138 bp, Scabiosa columbaria
ctagctcactaccattcacacctatccttcaacaatggcaaccatggctactctcacctcttccctctcctccgtctcctccaagaccaattcctcatacggaatcccaactttctcacaaccgcgtctccgttccgtcagatctaccccccaaaacctatccctatccatatccatgtccgcttcttctacgccgtacgatctcaacgcctttgagttctctccgatcaaggagtccatcgtgtcccgtgaaatgacaaggagatacatgacggatatgatcacgtttgctgataccgacgttgttgtcgtcggcgccggatctgctggactctcctgcgcctacgagatcagtaagaaccctgacgttcaggttgctattattgagcaatctgttagccctggtggtggtgcatggctcggtggtcaactattttcagctatgattgtacgtaagccagcacatcatttccttgacgagctagagattgagtacgacgagcaagacaactatgttgttatcaaacacgcagcgttgttcacctcaacaatcatgagcaagttgctagccaggccgaacgtgaagctcttcaatgctgtggcagctgaggatttgatagtgaaagggggaagagtaggtggggtggtgaccaactgggctttagtatcaatgaaccatgatacacaatcctgcatggaccccaacgtcatggaggctaaagttgtggtgagctcttgtgggcatgatggaccatttggtgccactggtgttaagcgactgaggagtattgggatgattgagagtgtgcctgggatgaaggctttggacatgaacacagctgaggatgctattgtgaggctcacaagggagattgttcctggcatgattgtcactggaatggaagttgctgaaatcgatggatctccaagaatggggccaacattcggagcaatgatgatatcaggacagaaggcggcacacctagcactgaaggcacttggattgcctaatgcattggatggcaactatgttggaagtgttcaaccagaactcatccttgcagccgctgatgctgctgatactgtggatgcttaagcttagttggtaaatgtagttaaaataaagctagaaaatggg

SEQ ID NO: 6147 - DNA, 1839 bp, Fagus grandifolia
ctggaccttggctgtcactcagttatagagcagagtctcacagtcttacacacacagagatcatcctaaacgacctgtcgttttttattactctcattgaaaaatggcaaccatggcctccaccctcatctccaagcctcaaagacttgctctctttgacacctcctcttccttccatggcacccctcttgcaccaccttcttctctccgtgtcaaccagcccatcaagtctggacatgctatctccatgtcagcctcatcacagtacgatctgaaggaattcacgttcgaacccatcaaggaatccatcgtgtcccgcgagatgaccaggaggtacatgatggacatgataacctacgctgacactgatgtggtcgtggtgggtgctggctcagctgggctctcatgtgcctatgaactcagcaagaacccgtctgtgcaggttgctatcatcgagcagtctgtgagccctggtggcggtgcatggcttggtggacaactcttctcggctatggttgtacgcaaaccagctcatctcttccttgacgagctcaacattgactacgatgagcaagataactatgtcgtgatcaaacacgccgctctcttcacctccaccatcatgagcaagctcttggctcgccccaacgtgaagctcttcaatgcggtggcagctgaggacttgattgtgaagggagggagagttggtggggtggtgactaactgggccctggtgtccatgaaccacaacacacaatcgtgcatggaccccaatgtcatggaggctaaggtggtggtgagctcatgtgggcatgacgggccatttggggccactggtgtcaagaggctcaagagtattgggatgattgacagtgtaccagggatgaaggcactggacatgaatacagctgaggatgccattgtgaggcttaccagggagattgtgcctgggatgattgttactggaatggaagttgctgagattgatggagctccaagaatgggacccacatttggagccatgatgatatcagggcagaaagcagctcacttggccttgcagtcattgggacttcccaatgctcttgatggatcatatgttggaagcatccgccctgagctcatcctagctgctgcagatgctgctgaaattgcagatgcatagatcaaatctagagttgttaataaaatcaagaagtaccggaataatatatagttgataggaatgagttgtggtggtggtagtggatgggtggatgatgtgattatgtggtgagttttgttaagaatgtgggagtcttgtgtgtttcttcttttgttagcttttcctttatgacttgtttggaacttggaattggaaatgttagaatttaacatctagcttttgttagtcttcctggcttcgctctcctctcttaagtcttttatttggaacttctctttcatgtgctagatggtcaatgatttgtgcaagaaatcatacagttagcttcagctggaacagtacacatgatgagataatgttcattgtgtttaggtatatatataatacagtttgcttatgatcaaaaaccatgatcttctacacaaagaagaaagcaggaactcaaaatgtcatcagagtatacacttttgatgtagggaacctcataaattcgttgtaccataatgagtatatactattatgagctcaactagtcaggtacctgtacctgtagtgtcacggttgatcctaatgaactttgggaagctcacagtgccaaagctgctgggacggacatgtctgaatccatgaatatgttaactctacacttcctaatgaattatgatttatgattg

SEQ ID NO: 6148 - DNA, 1237 bp, Cirsium arvense
ttaataattaaataaattataattaagttttaacaatggcgtccatgactacaaccttctcttcatctctctccaccaaggttaagacctcctccttccatggcgttcctgttgcctctccgattcggatccaatccatcaaatccttatccaaccaaaacaagaccatgcccattactatgtcttacgatctcggatccttcacctttagacctatcaaggaagcgattgtgtctcgtgaaatgaccaggaggtacatgaccgatatgattacctatgccgataccgacgttgttgtagtcggagctggttctgctggtctctcctgcgcctatgagcttagcaaaaaccctaatgttcaggtagccatcattgagcaatctgtgagccctggtggtggagcatggcttggaggacaactgttttcagccatggttgtccgaaagcctgcacatctattccttgatgagctaaacatcgagtacgacgaacaagaagactacgttgtgataaagcacgctgctttgttcacctccaccatcatgagcaagctgttggcgaggccaaatgtgaagttgttcaacgcagtggctgcagaggacttgatcatcaaggaaggtagagtaggtggtgttgtcaccaactgggctttggtgtcaatgaaccatgacacacaatcttgcatggatccaaatgtgatggaggctaaggtggttgtaagctcatgtgggcatgatggtcccatgggtgctactggagtgaagcgattgaggagtgttggtttgatcgagagcgttcctgggatgaaggctcttgatatgaatactgctgaggatgcaattgtcagattgacaagggagattgttcctggtatgattgttaccggaatggaagttgcagagatcgacggatctccaagaatgggtccaacatttggggctatgatgatatctggacagaaagcggctcatttggcgttgaaggcattggggctcccaaacgcattggatggaaccctcaccggaagcagcatccacccggagatgatccttgctgctgcagattccggggagactgtggacgcctaagttaatatttgtttagggggttgtgttgtcttgtatgtttgaataaaaataattaatggtaatggtaatgggaagtagctttttcatcatttcattgttagtagtatgtgtatgtttgtttcaatctgaatggacatgatgatgatgat

SEQ ID NO: 6149 - DNA, 1369 bp, Lippia dulcis
ggatttgacggattgggcggcgcgtgagggagtggcagccatggccacagccctcacttcttccttatccaaaacccaattcttcgacaacaaatcgtctttccatggcactcccatcccctcacgcgccgcccaatccgtcaaatcctccccgcaaaacctctcaatcaccatgtccgccacggattcgtacaaccttagcaacttcaaattccaaccaatcaaagaatccatagtgtcccgcgagatgaccaggcgttacatgacggatatgatcacctatgccgacaccgatgttgtcgtcgtcggcgccggctccgccgggctctcctgcgcctacgagctcagcaagaaccctgacatcaacgtcgccatcatcgagcaatccgtcagccccggtggcggcgcgtggctcggtggtcaactcttctccgccatggtcgtccgcaaacccgcccacaagttcctcgacgagcttgaaatcgagtacgacgagcaagacgactacgtcgtcatcaagcacgcggcccttttcacctccaccatcatgagcaagcttttggcacggcctaatgtcaagctcttcaacgcggttgcggcggaagatttaatcgtgaagggcggaagggtcgccggagtggtgacgaactgggctttggtctcgatgaaccacgacacacagtcttgtatggatccgaacgtaatggaggccaaagtggtggtgagctcgtgcggccacgacggacccttcggcgccaccggagtgaagcggctgaggagcatcggaatgatcgacagcgtgcccggaatgaaggcccttgacatgaacgccgccgaggacgccattgttgagctcacgagggagattgttcctggaatgatcgttacaggcatggaagttgcagaaatcgatggatcaccgagaatgggcccaacatttggggcgatgatgatttcagggcagaaagcagcgcacttggcattgcaggctttggggctgccgaatgctttggaaggtgcctcagtgccagaacttattcttgcctccacagaccccgacgagaccgtagatgcgtaaatttggggagttaaaattgcaatgagtgatggaaataaagagaaataagaagatagttcagttggtagaaatgtggagatggtgtactggtttttgcttgaaaagttgatatatgccatttctcattcgtgatcttgttatatggatcggcctcttcttctgttgtaggatttatatgttaagcaattcaggaaattcttgtttttaatctgtaaaatgtttgggttgtgaaaacaaatatctgtgtgaaaacagcaggaattttctatatcaaagttgcccttcgtgatc

SEQ ID NO: 6150 - DNA, 1074 bp, Gossypium hirsutum
atggcagccatggcaacagctctcacctcactgctctttcaagccccaaaccatctttcctagaccacaacaagtcatccttcagcggcactcaaattccttctcgcttcactcccatcaagtgcctcttcacacaacatctgccatttccatgtccttaacccctccttatgacttacaatcctttgaattccaacccatcaaagaatcctatgtttctcgtgaaatgacacgccgttacatgatggacatgattacctatgctgacactgatgttatcatcgtcggcgccggttccgctggcctctcttgtgcttacgagattagcaaaaaccccaacatccgtgttgccataatcgaacaatctgttagccctggtggaggtgcatggcttggtggccaactattttcagccatggttgttcgcaaaccagctcacaggttcctcgacgagctcggcatccaatatgacgaacaagaagactacgttgtcatcaagcatgcagctttgttcacatcaacaatcatgagcaagcttttagcaaggcctaacgtgaagttgttcaatgctgtggctgctgaggatctgatagtcaaaggaaacagggttgccggtgtggtaacgaactgggctttggtgtcaatgaaccccgacacccaatcctgcatggacccgaacgtgatggagtttaaggttgtggtcagtttttgtggacatgatggcccttttggagctactggggtcaagagattgaagagcattgggatgattgacagcgtccctggaatgaaggccctggatatgaacccggcaggggatgcaattgttaggcttccaagggaaattgtgcctggcatgtttgtaacaggaatggaagttgcagagattgatggtgccccaagaatgggtccaccttttggggcaatgatgatttcagggcggaaagcagcccccttacccttgaaggcattggggcagcccaaccccgtagatgggcccttcagggaagctgaaagggtacaccctgagttttttttagctgctgctgaaacagaggggactgtggatgcttg

SEQ ID NO: 6151 - DNA, 1334 bp, Cynara scolymus
  misc_feature (1232)..(1232): n is a, c, g, or t
  misc_feature (1282)..(1282): n is a, c, g, or t
gcgggatcacaccccaccttaccttcatctcttttgattcacaatggctacaaccttcgcttcctctctctccaccaagcccaacacctgtttcttcgaccaatcatccttccatggcgttcctgttgcctctccgattcggatccaacccatcaaatcccaccacaacaagaccatgcccattaccatgtcttacgatctcggatccttcacctttcgacctatcaaggaagcgattgtgtctcgtgaaatgaccaggaggtacatgaccgacatgataacctatgccgataccgacgttgtcgtagtcggtgctggctccgctggtctctcctgcgcctatgagcttagcaaaaaccctaatgttcaggtagccatcattgagcaatctgtgagccctggtggtggagcatggcttggaggacaactgttttcagccatggttgtccggaagcctgcacatctgttccttgatgagctaaacatcgagtacgacgagcaagaagactacgttgtgataaagcacgctgctttgttcacctccaccatcatgagcaagctgttggcgcggccaaatgtgaagctgttcaacgcagtggctgcagaggacttgatcatcaaggaaggtagagtaggcggtgttgtgaccaactgggctttggtgtcgatgaaccatgacacacaatcttgcatggatccaaatgtgatggaggctaaggtggttgtgagctcatgtggtcatgatggtcccatgggtgccacaggagtgaagcgattgaggagcgttgggctgatcgagagcgttcctgggatgaaggctcttgacatgaacgcggctgaggatgcaattgtgaggttgacaagggagattgttcctggtatgattgtcacgggaatggaagttgcagagattgacggatctccaagaatgggtccaacatttggggctatgatgatatctggacagaaagcggctcatttggcgttgaaggcgttggggctcccgaacgcgttggatggaacgctgacgggcagcatccacccagagctgatccttgctgctgcggattccggtgagagcgtggacgcctaaatgaagtaaatacttgtttagggcaggggaggttggatttgaataaataatattgccaatggtacttatctcgtagctttttcatcatttctttgttagtagtatgtttgtttttatgtgatgaatctgaagaagaagnagaagaagaagaatggatgtggtgatgactgatgatgatgccttcaattngttttccctgttctgtttaatatctccaatcaaactccacttttgggtttcg

SEQ ID NO: 6152 - DNA, 1122 bp, Flaveria ramosissima
atcccacaaccaacaccttcaacctcttcatcaatggcgtccatgactaccaccttcacttcatctctctgcaacaaaaccaaaaccaaaacctccttcttcgaccaatcatccttccatggcgttccgatctcatctccgatcaggatccactcacccaaatcaaaccagaacaagaccacccccatcaccatgtccgcaaccccttacgacctcggctccttcaccttccaacccatcaaagaagccatcgtctcccgtgaaatgaccagaaggtacatgaccgacatgatcacctacgccgataccgacgtcgtcgtcgtcggtgctggctccgccggcctctcatgcgcctacgagctcagcaaaaaccccaacgttcaggtggccatcatcgagcaatccgtgagcccaggcggtggcgcgtggctgggaggacaactgttctccgccatggttgtacggaagcctgcacaccacttccttgatgagctcgagatcgagtacgacgagcaagacgagtacgtggtgatcaaacacgctgctctgttcacatccaccatcatgagcaagctgttggctagaccaaacgtgaagctcttcaacgcggtggctgcagaggatttgatcattaaagaagggagagttggtggtgtggtgaccaactgggctttggtctcgatgaaccataacacacagtcgtgcatggaccctaacgtcatggaggctaaggtggttgtgagctcgtgtggtcatgatggtcctatgggtgctactggggtgaagaggctcaggagtgttgggatgatcgaaagcgttccggggatgaaagctcttgacatgaacactgccgaagatgccatcgtcaggctcaccagagagatcgttcccggtatgatcgtcaccggaatggaagttgctgagatcgatggatctcccagaatggggccaacatttggggctatgatgatatctggacagaaagcggctcatttggcgttgaaggcgcttgggcttccgaatgcattggacgggacgagtgtgggaagtgttcaacccgagctgatccttgcggctgcggattctgctgagaccgttgtcgatgcctaaatggagtatata

SEQ ID NO: 6153 - DNA, 1266 bp, Flaveria ramosissima
gactaccaccttcacctcatctctctgcaacaaaaccaaaacctccttctttgaccaatcatccttccatggcgttccgatctcatctccgatcaggatccactcacccaaatcaaaccaaaacaagaccacccccatcaccatgtccgcagccccttacgacctcggctccttcaccttccaacccatcaaagaagccatcgtctcccgtgaaatgaccagaaggtacatgaccgacatgatcacctacgccgataccgacgtcgtcgtcgtcggtgctggctccgccggcctctcttgcgcctacgagctcagcaaaaaccccaacgttcaggtggccatcatcgagcaatccgtgagcccaggcggtggcgcgtggctcggaggacaactgttctccgccatggttgtacggaagcctgcacaccacttccttgatgagctcgagatcgagtacgacgagcaagacgactacgtggtgatcaaacacgcagctctgttcacatcaaccatcatgagcaagctgttggctagaccaaacgtgaagctcttcaacgcggtggctgcagaggatttgatcattaaagaagggagagttggtggtgtggtgaccaattgggctttggtctccatgaaccatgacacacagtcgtgcatggaccctaacgtcatggaggctaaggtggttgtgagctcgtgtggtcatgatggtcccatgggtgccactggggtgaagaggctcaggagtgttgggatgatcgaaagtgttccggggatgaaagctcttgacatgaacactgccgaagatgcgatcgtgaggctcacgagagagatcgttccgggtatgatcgtcaccggaatggaagttgctgagatcgatggatctcccagaatggggccaacatttggggctatgatgatatctggacagaaagcggctcatttggcgttgaaggcgcttgggcttccgaatgcattggacgggacgagtgtgggaagtgttcaacctgagctgatccttgcggctgctgattctggtgagaccgtggtcgatgcctaaatggagtatatatttagggcgaagtctgctttcgaataaatgaaaaaacgcggcttgtgaattatggtcgtatcgttgttagtttgttgttgagagatgatgtgtggttatgttgttgtgaatggtctgttttcttgttttgtgtcttctctgtgttgttttctagaactttagaagttaagatgggtcatgtgatgtctttggag

SEQ ID NO: 6154 - DNA, 1243 bp, Flaveria ramosissima
tctctctgcaacaaaaccaaaacctccttcttcgaccaatcatccttccatggcgttccgatctcatctccgatcaggatccactcacccaaatcaaaccaaaacaagaccacccccatcaccatgtccgcaaccccttacgacctcggctccttcaccttccaacccatcaaagaagcaatcgtctcccgtgaaatgaccagaaggtacatgaccgacatgatcacctacgccgataccgacgtcgtcgtcgtcggtgctggctccgccggcctctcttgcgcctacgagctcagcaaaaatcccaacgttcaggtggccatcatcgagcaatctgtgagcccaggcggtggcgcgtggctcggaggacaactgttctccgccatggttgtacggaagcctgcacaccacttccttgatgagcttgagatcgagtacgacgagcaagacgactatgtggtgatcaaacacgctgctcttttcacctccaccatcatgagcaagctgttggctagaccaaacgtgaagctcttcaacgcggtggctgcagaggatttgatcattaaagaagggagagttggtggtgtggtgaccaattgggctttggtctccatgaaccatgacacacagtcgtgcatggaccctaacgtcatggaggctaaggtggttgtgagctcgtgtggtcatgatggtcccatgggtgccactggggtgaagaggcttaggagtgttgggatgatcgaaagtgttccggggatgaaagctcttgacatgaacactgccgaagatgcgatcgtgaggctcacgagagagatcgttccgggtatgatcgtcaccggaatggaagttgctgagatcgatggatctcccagaatggggccaacatttggggctatgatgatatctggacagaaagcggctcatttggcgttgaaggcgcttgggcttccgaatgcattggacgggacgagtgtgggaagtgttcaacctgagctgatccttgcggctgcggattctggtgagaccgtggtcgatgcctaaatggagtatatatttagggcgaagtctgctttcgaataaatgaaaaacgcggcttgtgaattatggtcgtatcgttgttagtttgttgttgagagatgatgtgtggttatgttgttgtgaatggtctgttttcttgttttgtgtcttctctgtgttgttttctagaatttagaagttaagatgggtcatgtgatgtctttgg

SEQ ID NO: 6155 - DNA, 1567 bp, Aristolochia fimbriata
tctttcccacatttgcccgcacccctcaaaaccctagcaaaagccctagaaggtatcgacgatggcagcagcaggcatcgccaccaccttcacgtctcctctctccaccaagcccaaggctctcttctccggtggatcttcgtccttccatggcgtccccatcgcccccgcctcccagccgggagatcttcctctaacgccgccgccccttccgtttccatctccgcctccgcctccaagtacgatctccaggcactccgcttcgagccgatcaaggagtcgatcgtgtcccgggaaatgacccgccgctacatgatggacatgatcacctacgccgacaccgacgtcgtcgtcgtcggcgccggctccgcgggtctctcctgcgcctacgagctgagcaagaaccccaacgtccgcgtcgcgatcatcgagcaatcggtgagccccggcggcggtgcctggctcgggggccagctcttctccgccatggtggtcaggaagcccgcgcacctgttcctggacgagctggagatcgagtacgacgagcaggacaactacgtggtcatcaagcacgccgccctgttcacctccaccatcatgagcaagctcctcgcccgccccaacgtcaagctcttcaacgccgtcgccgcggaggacctgatcgtgaagggcggcagagtcgggggcgtggtcaccaactgggccctcgtctccatgaaccacgacacccagtcgtgcatggaccccaacgtgatggaggccaaagtggtggtgagctcttgcggacacgacgggcctttcggcgccacgggtgtgaagaggctgaagagcatcggaatgatcgacagcgtccccgggatgaaggctcttgacatgaacacggcggaggacgagatcgtgaggctgacgagggagatcgtccccgggatgatcgtcaccggaatggaagtcgcggagatcgacggttcgcccagaatgggaccgacgttcggtgcgatgatgttatcgggacagaaagccgctcacttggccttgaaagccttgggcttaccaaacgcagtggacggaacttaccaactcggaagccctcacccggagctagtccttgcatctgccgaggtcgatggagtagtggaagcttagaaaggacaaacggagcaaataacaactcaagatgagactttaaaaaaagatatatcatcatgcctgtccaggtgtaatgcctttttagtaatttagtaggggaaaaaaaaaaaaaaactcttttatctttttcttctctcgagtctcgactcctttgttcataaaggaaataaatttccagtagattttcaagtctcttacattgagaagtggacaaatgatgacagatttttttaaagccgccgatcgagtgacggcactaggaggcggcaagcagatgagtggtatcgactcaccctctttttaactcttctggcgctggcatggtgtcgtggtttagcagagttttaaaatctctttggtttgtgttttgggcgtctaagcctgtacaggagtcttcttccaacagatttttgagtttctt

SEQ ID NO: 6156 - DNA, 1040 bp, Flaveria ramosissima
cctcatctctctgcaacaacaccaaaacctccttcttcgaccaatcatccttccatggcgttccgatctcttctccgatcaggatccagtcacccaaatcgaaccacaacaagaccacgcccatcaccatgtccgcaaccccttacgacctcggctccttcaccttccaaccgatcaaagaagccatcgtctctcgcgaaatgaccagaaggtacatgaccgacatgatcacctacgccgataccgacgtcgtcgtcgtcggtgctggctccgctggcctctcatgcgcctacgagctcagcaaaaaccctaacgttcaggtcgccatcatcgagcaatccgtgagcccaggcggtggcgcgtggctcggaggacaactgttctccgccatggttgtacggaagcctgcacaccacttcctcgacgagctcgagatcgagtacgacgagcaagacgactatgtggtgatcaaacacgcagctctgttcacctccaccatcatgagcaagctgttggctagaccaaacgtgaagctcttcaacgcggtggctgcagaggatttgatcatcaaagaagggagagttggtggtgtggtgaccaattgggctttggtctcgatgaaccatgacacacagtcgtgcatggaccctaacgtcatggaggctaaggtggttgtgagctcgtgtggtcatgatggtcccatgggtgccaccggggtgaagcggctcaggagtgtggggatgattgagagtgtacctgggatgaaagctcttgacatgaacactgcggaagatgcgatcgtgaggctcacgagagagatcgttccgggtatgatcgtcaccggaatggaagttgctgagatcgatggatctcccagaatggggccaacatttggggctatgatgatatctggacagaaagcggctcatttggcgttgaaggcgcttgggcttccgaatgcattggacgggacgagtgtgggaagtgttcaacctgagctgatccttgcgctgcggattctggtgagaccgtggtcgatg

SEQ ID NO: 6157 - DNA, 1304 bp, Vaccinium corymbosum
atcccaatcgaaacatctcaattcttcttccccaaccccatcatcaatggcatccgtcaccgcaaccctcacttcttctctctccaccaaaccaaaaacctcattcctagacacccaatcgtcttcctccttccatggcttccgacccaccaaggcggcggcggccccacacaacaaccacctctccatctccatgtcctacgatctcaagtcgttcaagttcgatcccatcaaggaatcaatcgtttctcgtgaaatgacccgcaggtacatgatggatatgatcacctacgccgacactgacgtcgtcgttgtgggcgctggatctgctggcctctcctgcgcttacgagctcagcaaaaacccatctgttcaggtggcaatcattgagcaatccgtaagccctggaggcggtgcatggctcggtggacaactcttctcggccatggttgttcgtaagccagcacatcgcttcctcgatgagctcgagattgagtacgatgagcaggacacctacgtggtgatcaagcacgccgccctattcacatccaccatcatgagcaagctgttggctaggccaaatgtgaaactcttcaatgccctggcggctgaggacttgatcgtgaaggaagggagagtcggtggtgttgtgactaactgggctttggtgtcaatgaaccatgacacacagtcttgcatggaccccaatgtcatggaggccaagattgttgtgagctcatgcggacatgacgggccgtttggagcaacgggagtcaagaggcttaagagtattgggatgattgatagtgttcccgggatgaaggcacttgacatgaacactgctgaggatgcaattgtcaggcttacaagggagattgtgcccggaatgattgtgactggcatggaggttgctgagattgatggagcccctagaatgggaccgacatttggggcgatgatgatttcagggcagaaggctgctcacctggctttgaaatcgcttggactgccaaacgcgctggatggaacatatgtcggaagcgttcaccccgagctgatcctagcttcggtagatggcgctgaaactgtggatgcctaagcgtatgaaaccgggtttgtccaataaataaaacttgttagtagttgggttgagatgctggaagatccagaagtggctgagtagattcaatttttgctcaggtggaattaggccatggttttgtgattgtagacctgtccttttccttctcttttgaacttggttatgagaatggaagtcattagatccttctgttctgtctatg

SEQ ID NO: 6158 - DNA, 1386 bp, Panax ginseng
actcctttctgaaactcagtacaacccacgcagcaacttttgacttcttcttcttctctctgcctcacatcaaaataaaaagtggcgaccatggctacaacctttgcatcttctctctcctccaaacctaagaccactaatttcttggaatcatccttcaatggagtttctatttctacagcgtctcgcctccaacctatcaaatcaggccaacaaaaacaccagttcaccgtctcggctttttcatcccctccatatgatctcaaatcattcaaattcgaaccaatcaaggaatcgatcgtttctcgtgaaatgaccagaaggtacatgaccgatatgatcacttatgctgacaccgatgtcgtcgtcgttggcgctggctctgccggcctttcctgcgcctacgagctcagcaaaaacccatccgttcaggtggcaataattgagcaatctgttagccctggtggtggtgcatggcttggtgggcagctcttttcatcaatggttgttcgcaagcctgcacatcatttcctagacgagcttgagatcgagtacgatgagaaagatacttatgttgtgatcaagcatgctgctttgtttacctcaacaatcatgagcaagcttttggccagaccaaatgttaagctcttcaatgccgttgcagcagaggatttaattgtgaagggaggaagagtaagtggggtggtgaccaactgggctctggtttctatgaaccatgatacacagtcgtgcatggaccccaatgtgatggaggctaaagtggtggtgagctcttgtggacatgatggcccttttggggctactggagtgaagaggctcaagagtattgggatgatcagcagcgtgccagggatgaaggccctggacatgaacacagccgaggatgcaattgttgggcttacaagggagatagtgccagggatgattgttactggaatggaagttgcagaaattgatggagctccaagaatgggaccgacatttggagcaatgatgatatcaggacagaaggcagcacacttggcattaaaggcgctaggacaacctaatgccttggatggaacatatgttggtggtattcaggaagagcttatcctagctacagctgatgctgctgagatcgtggatgctcaagtgctgaagcagtgaataagattagttgatctggatgagtaatggtggatggacctctcttgtgatggattttagttgaatgtttggtctttgtatgtgatcttgctttcctttgttagaactcgaatgttgaaatggtagtatctttataattgctgcattttgttctagtgttttaccctccgggggatttgaaccctctgtcgacaaggttaaggccttgcattctac

SEQ ID NO: 6159 - DNA, 1376 bp, Vitis vinifera
ctcacagaaaatcctagaagaaaacggcgtcgtttcagtttccggctatggcaaccctcacctcctccatctgctccaagcctaaagcctccgttttcgatccacacaagtcctctttccatggcgtccctatcgccacccaggcccgcctgagcccggtgaaatccacgccggtgaatctcgccgttacagccgcagcgatgccctacgacctccggtcgttcaagttcgaacccatcaaggagtcgatcgtctctcgcgagatgacccgccggtacatgatggacatgatcacctacgcggacactgacgtcgttgtcgtcggcgccggctctgctgggctgtcctgcgcctacgagctcagcaagaacccctccgtacaggtggcgatcattgagcaatccgtcagccccggcggcggcgcgtggctcgggggccagctcttctcctccatggtggtccgcaagccagcacaccgctttctcgatgagcttggcctagagtacgacgagcaagacaactacgtggtgataaagcacgcggctctcttcacatccaccatcatgagcaagctcttggcgaggcccaacgtgaagctcttcaacgcggtggcagccgaggatctgattataaaggaagggaaagtcggcggggtggtgaccaactgggctctggtgtcgatgaaccacgacacacagtcgtgtatggacccgaacgtgatggaggcgaaggtggtggtgagctcatgtggacacgacgggccgttcggagccactggagtgaagaggctgaggagcgttggaatgatagacagcgttccgggaatgaaggcgctagacatgaacacggcagaggatgagatcgtgaggctcaccagggaggtggtgccgggaatgatcgtcaccggaatggaagttgcagagattgatggctccccaaggatgggaccgacattcggagcgatgatgatatcagggcagaaggcagctcacttggccttgaagtctctggggctgcccaacgctctggacggcacatacatcggaaacctccatcccgagctggtcttggccgctgccgccgatgctgctgagattgctgaggcttaatggaagcagcaaaccaaaacaaaaaaaccctgaaaataatagtcctttcaatggggaagaattccatggggattttgtgattaggtaggtgtttgttttttaataactttctccttagggtgtgtatttctccctttttcttgcttgaggatttggtcggagcttggaacttggaacttggaaattggagtgaaaatggtagtggcatttggctgttgtgacttgtgacttttttctactttgagatatcctactttaattatcgtg

SEQ ID NO: 6160 - DNA, 1381 bp, Theobroma cacao
ctcttcacctcttttctgcaatcttctcagctctaagctgcaaaggaaccccaaaaagatcaccctttcttgatttttctcaggcagtaatggcatcatccgtagctactactctcacttcctctaccaaactttacagaaacacttccctctttgagtcttccttccatggggttcccataacgccactttctttccatctcaaggcaaagtcctctccacgcaatgcatcagtttccatgtctgcagcctcatcacctccaccgtatgacctgaacaatttcaggtttgaccccatcaaggaatccatcgtgtcacgtgagatgacacgtaggtacatgatggacatgatcacccacgctgacactgatgtggtggtggttggtgcgggctccgcagggctgtcttgtgcctatgagcttagcaagaacccgtccgtacaggttgctattgttgagcaatctgttagccctggaggtggtgcctggctaggaggacagcttttctctgccatggtagtacgcaaaccagctcatcgcttccttgatgaacttgggattgagtatgatgagcaagacgactatgtggtgatcaagcatgcagccctgttcacatccaccatcatgagcaagcttctagctcgccccaatgtgaagctgttcaatgctgtggcggcagaggacttgatagtgaagggaggaagagttggtggtgttgtgacaaattgggccttggtttcaatgaaccatgacacacagtcctgcatggaccctaacgtcatggaggccaaggtggtggtgagctcttgtggtcatgatgggccatttggagccactggggtcaagaggttgaagagcattgggatgattgatagcgtgccggggatgaaggcactggatatgaatacagctgaggatgctattgtgaggctaactagggaaattgtgcctgggatgattgttactggaatggaagttgccgagattgatggatcaccaagaatgggaccaacatttggagccatgatgatatcagggcaaaaggcagcccatcttgctctgcaatcattgggattgcctaatgcacttgatggaacatatgtgggaaacattcacccagagctgatcttggctgctgcagattctgctgagactgctgatgcttagttgcatagcaattagtcgcgatgatggagattaggggtcggttttatagtcatcggtaggaacgagtggtttggttttagatggttgatgtgattatgtggtgaggtttgttaataaagagggtgtgctgtttagaccctgttggaacttaatggcacgtagcagttagttcttgctgttcttgttgccatcaataagtattgctttttcttcct

SEQ ID NO: 6161 - DNA, 2200 bp, Artemisia annua
tactccgacgggacaccttcaaaacacacacacttaaaccaaaaaaacctcaaacaaccttctaaaaccatggcatcaatgacaacaactttcacctcaccactctacaccaaaacccaatcatccttccatggagtcccagttgttagaatgatccaaccagtcaaatcatccaacaaaacaaacacacccattaccatgtcatatgatcttggatcattcacgttccaacccattaaggaagctattgtgtcacgtgagatgactaggaggtacatgactgacatgattacttatgctgatactgatgttgttgttgttggtgctggatctgctggtttgtcttgtgcttatgagcttagcaaaaaccctaacgttcaggtagctatcattgagcaatccgtgagcccaggtggtggtgcatggctaggtggacaactattctcagcaatggttgtccgcaagcctgcccaccacttccttgacgagctcgagatcgagtacgacgagcaagaagactatgtcgtcatcaagcatgccgctttgttcacatccacaatcatgagcaagcttttggctaggccaaatgtcaagctcttcaacgcggttgcagctgaggacttgatcatcaagggaggaagagtaggtggtgttgtgaccaactggtctttggtcgcacagaaccacgacacacaatcatgcatggaccctaatgttatggaggctaaggttgttgtcagctcgtgtggccatgatgggcccatgggcgctactggtgttaagaggcttaggagtgttggcttgatcgagagcgttcctgggatgaaggctctcgacatgaacactgctgaagatgcgattgtgaagctgactagagagattgttcctggtatgattgttaccgggatggaagttgctgagatcgatggatctcccaggatggggccaacttttggtgctatgatgatatcaggacagaaggcggctcatttggccttgaaggcgttgggactcccaaatgcattggatggaacattggtgggaagcctccacccagagcttatcctggctgctgccgactctagcgagactgttgacgcctaaatgtagtaaatatttaggagcaagttcggggttcgggttttaataaataagggtaagggacgaacaaggcttgtgaatcatggttagctttcggttgtttcgttgttagtttgttgttgaggactttgaagttattatgtgattgtgaatggaagttgttctgtttccaaaaaataactcacgaatgacgtttttgttaatgtggtcaaacattaagtcacataaaggtggcttttgcaccatcctgtatttgcaacatcagtttacccaaaatacagtggatacctctttgggaaaaaaacaatgtgaacttgtaaagtgagaaaatcacaaccataaacttgaaactcccagctataatatcttgtttggaagtactacaatatgaatctaaagcgttatgcgccaatagaaataacattctattttatgtgtcgaatacatatccagcttcagcaaagtgcgattttactagcgcaagagctcttccgcgatgagaaatcttgttcttttcttccttgggcatttcagcataagtttgatcataaccatcaggttggaagactggatcccatccaaagtcatttggtcctcttgcagggacgatcttccccggggtctttcccacaaacgtgatgggttcatgatttgggccaatagcaagagaaaatacacacagagcataggcagatttatcctcataagccatcaacatattgtttagaccttcatgcccaagcttctgaagaaaccacttgatgtaaggtccgggtaaacccttaagagcattaaaacaaagacatgtatcttccaccaacacgggtcctttcacctggttagcagccaatctggctttctctttagaaatatcctccgggtcaccttgcaactctggcaagtcgagttttaaggactgaaaaggaatagattgtcccaaaataactttaacttcttcaagtttctttgcatttcccgtcacaaatgtcaccggctgacctaactttacacccgccaacccacgcgccgccgctgccatttttcttcaccttttattatggttttacagttatgactgtttttttatatttgttgttgt

SEQ ID NO: 6162 - DNA, 1499 bp, Musa acuminata
atcctcctcctcctcctccggcctctcccccaactccaaacgtacacctttcgccaccctcctgcaatggcagcctccgtggccacctcctccctcctctccaaccccaagtccctcatctccgacaaccaccaccgctcgtccttcagcggcttccgcctcccggccaccgccctccgctccctccccggccgcggcagaccttccttgtccgtcaccgccgcctccgccgcccccaggtacgacctcgattccttccgcttcgagcccatcaaggagtcggtcgtttcccgcgagatgacccgccgctacatgaccgacatgatcacctacgccgacactgacgtggtggtcatcggcgccggctccgccgggctgtcctgcgcgtatgagatatccaaggatccgtcggtgcgcgtggccatcgtggagcagtccgtctcccccggcggcggtgcgtggctcggcggccagctcttctcggccatggtcgtccgcaagcccgcccacctcttcctggacgagctcggcgtggcttatgacgaagccgacagctacgtcgtgatccaccacgccgcgctcttcacctccaccatcatgagccgcctcctcgcccgccccaatgtcaagctcttcaacgcggtcgccgccgaggacctcatcgtcaaggaaggccgcgttgccggcgtggtgaccaactgggcgctggtgtcaatgaaccacgacacacagtcctgcatggaccccaacgtgatggaggccagggtggtggtcagctcctgcggccacgacgggccgttcggcgccaccggagtgaagcggctcaagggcatcgggatgatcgattccgtgccggggatgaaagccctcgacatgaacgcggcggaggacgcgatcgtccgcctcaccagggaggtcgtgcccgggatgatcgttaccggcatggaggtcgccgagattgacggtgctccaagaatggggccgaccttcggggcgatgatgatctcagggcagaaggcggcacacctggcgctcaaggcattggggcggcccaacgctatcgacggcaccatcggagctgaggcggtgcagccggagctggtactggcctcgtcggacgccggggagatcgtcgacgcctaagactgcagccaccacagcagcttttcctggaaataaaagatggtaagggggaaggggaggggtggatggtgatggacttttgttcttggtgggttggaacgataagacgcagagggggaggagtgaccgagagagattcgagacatcttcttcttcttcttcttcttcttcttcttcttcttcttcttgggttctctttaaatgctatgctgctctcttgttgttaagaaagtatcatcctattatcttctctctccgtgtggctgctgttcgttcgtttctctgtgccatacatatatggcctcgcagtttgctgccaaatttagtgctgctaaagattagtatcttaacccaac

SEQ ID NO: 6163 - DNA, 1453 bp, Lactuca sativa
cagtatttcactacctttctattgctatataagtcaagtactcaaccaccgcttaagacacacttcactcaccttcttcatacaaacctttcagctcttaaacaatggcgtccatggctaccacctttgcctcgtctctctccaccaagaccaggacctctttcctggaccaatcatcgttccatggcgttccggtggcttctccgacgcggatccaaccaatcaaatcgaaccaaagcaagaacacaccgatcaccatgtctgctaccccgtatgatctcggatcgttcacctttagtccgatcaaggaagcgatcgtgtctcgtgaaatgacgagaaggtacatgactgatatgattacctacgccgataccgatgtcgttgtagtcggcgctggctccgctggtctctcctgtgcttatgagcttagcaaaaaccctgacgttcaggtcgccatcatcgagcaatctgtgagcccaggaggtggagcatggctcggaggtcaactcttctccgccatggtcgtccgcaagcccgcacacctcttcctcgacgagcttgaaatcgagtacgacgagcaagaagactacgtagtcatcaaacacgcggctctcttcacctccaccatcatgagcaagctcttagccaggccaaacgtgaagctcttcaacgcagtagcagccgaggacttaatcatcaagggaggtagagtcagtggcgttgtaactaactgggctttagtcgcaatgaaccacgacacacaatcctgcatggacccgaatgtaatggaggctaaagtggttgtgagttcatgtggacacgatggacccatgggtgctacaggagtgaaaaggctcagaagcgttggattgattgagagtgttcctgggatgaaggctcttgacatgaacgctgctgaagatgcgattgtgaagttgactagagagattgttcctggtatgattgttacaggaatggaagttgcagagatcgatggatctccaagaatggggccgacgtttggggctatgatgatatctggacagaaggctgctcatctggctttgagggctttagggcttccgaatgctttggatgggacaagtgtgggaagtgttcatccagagatgattcttgctgctgttgattctggtgagactgtggatgcctaagtcatgaggtatataatttagggagaagtttaattagggtttgaataaataaggagagaggtttgtgaatggtactgggatgtggtggtttggttgttggtatgttgtcagagggactttggagtttggagttttttatgtgattgtgaatgaatggaagtttctatttttcttttgattcttagtttcttactcgttttgcttacaagtatacccgtcttttttttttgggagctgataaatccactgcttttttttatcgatccacatacttttgctag

SEQ ID NO: 6164 - DNA, 1457 bp, Nicotiana benthamiana
actcaaaacaatctttcattattccaattctcaaaaaagaaaaaactcatctctcaagatctcaagctttgtctatggcaaccatggcatcaaccttggcatcctctgttgttaccaagaccaatttcttggacacccacaaatcatctttctctggtgtccctcttttttcacaagctagacttaaacctgttaaatctgcccagcaaaacatgaccatttccatgtctgctgattcctctcctccaccttatgatcttaacgctttcagttttaacccaattaaggaatccatcgtttctcgcgagatgacacgtaggtacatgactgacatgatcacctatgctgacactgatgtcgtcatcgttggcgctggctctgctggtctctcttgtgcttatgagatcagcaagaaccctaacgtccaggttgccatacttgagcaatcagttagccctggtggaggtgcctggctaggaggacaactcttttcagccatggttgtgaggaagccagcacatcttttcttgaacgagctcggcatagactatgacgagcaagacaactacgtggtcatcaagcacgctgccttgttcacctcaaccatcatgagcaagcttttggccaggccaaacgtgaaactcttcaatgctgttgcaacagaggaccttattgtgaagaacggaagagttggtggtgttgtcactaactggtctttggtttctcagaaccacgacacacaatcctgcatggaccccaatgttatggaggctaagattgtggtcagctcttgtggccacgacggtcccatgggtgccactggtgttaagaggcttaagagcattggcatgatcaaccatgttcctgggatgaaagctttggacatgaacaccgctgaggacgctattgttagacttacccgagaggttgtacccggaatgatcgtcacagggatggaagtcgctgaaatcgacggagcaccaagaatgggaccaacttttggagctatgatgatatcagggcagaaggcagcccaccttgcgctaagggcattgggattgcctaatgcactcgacgggacagcagagtcaagcattcatccggagcttatcttggctgcagctgatgatgccgagacagcagatgcttaaaatctttaatgtataagatttctctaaaaaagagattagttttttcctaggtgagcgtggtttgtggttgcgagaaattggcaagggggatgaataaaagtctgcaggatgaatgtcactgtgtacctttggctgtttcatgtctattcttcttttcttttgatttacttcgacttcaaaactttcatgtgaaaaagttgtagaacgtagttttcgttaaataatcctatgggctttttggcgtcgttttggtacttaatgtgttttgggcctcatgagttatggcacatgggtgaagccatttga

SEQ ID NO: 6165 - DNA, 646 bp, Vigna unguiculata
gagtgtgaagagcgtatcagactagcagaggaggaagagatagtgaagaagaaagtgtagtggcgtggaaatgtcgaagaaaggaggaagtggcgcttcgttccaaaaggacgtgccatggcgagcgtcttcttcaaccgcgaaacccctccccaaaattcacctctctccacttcttcgcgtttcccaaacacccgtcacggattacgccgtctccgtcatgaggcatccagaccctatagggagtggattgggtgatgaggccatagtggaagcagctggtcccgactgcctcgtacctggtcagaaaatgcctctccaattacttggccttcaggtctggccaatccatgttgacctgaagttcttggaaccagttgggcgagaacttaagatgcttggaaagttcatggatgatgccgttgaactaatgaacaaatcattcatagagcgttgatgatacgtgcgttgcgaagaaatgaaatagttgcaatttgaattttttttaaggaattagaagtatagacaagcagagtgactataacatttggctgattttgtatgtaaaagaaaattgcagtgagatgtttttgttcggggtacttattcccagcctattaatgccaatcagaaactatttctcccc

SEQ ID NO: 6166 - DNA, 773 bp, Glycine max
agataatgtagaatttgtgtctatgagaggtcggtttatcagatgagatttgtgtgtgaagagaatagcgaatagcgaaggtggaaatgtcgaaaggcggttcgcttcaaaaggacgtgccatggagagcatcgtcttcttctgcgaagcccatccccaaaattcaccacagtccccttcttcgcgtatcccaaacacctgtttccgattacggtatctccgtcatgaggcatccggaccctataggtggtggattgggtcatgaggccatagtggaaccagctggccctgattgtctcgtacctggccagaaaatgcccatccaattacttggcctccaggtctggccaatccatgttgacctgaagtttttggaaccagttgggcgagaacttaagatgcttggaaagttcatggatgacgctgttgaactaatgaacaaatcattcatagagcgttgataatatgggctttgtgaagagacgaagtagccgctgtttgattctttttttatgggatgggaaatatagacaagcagagtgactgtaatgtaacatttgactcattttgtatgcaaaagagaattgcaatgcgagatagttttgttcggtactaattcccttataatgccaattagaaactgtttctgagaatccaatctttcctctctctagctatattgtactttgaaaaacacagtttgaaccgtaagttgaatatacttgtatactatgctgacttttgcagttcaaattttcttgccacactcaaac

SEQ ID NO: 6167 - DNA, 728 bp, Glycine max
atgagaggtcggtttatcagatgagatttgtgtgtgaagagaatagcgaatagcgaaggtggaaatgtcgaaaggcggttcgcttcaaaaggacgtgccatggagagcatcgtcttcttctgcgaagcccatccccaaaattcaccacagtccccttcttcgcgtatcccaaacacctgtttccgattacggtatctccgtcatgaggcatccggaccctataggtggtggattgggtcatgaggccatagtggaaccagctggccctgattgtctcgtacctggccagaaaatgcccatccaattacttggcctccaggtctggccaatccatgttgacctgaagtttttggaaccagttgggcgagaacttaagatgcttggaaagttcatggatgacgctgttgaactaatgaacaaatcattcatagagcgttgataatatgggctttgtgaagagacgaagtagccgctgtttgattctttttttatgggatgggaaatatagacaagcagagtgactgtaatgtaacatttgactcattttgtatgcaaaagagaattgcaatgcgagatagttttgttcggtactaattcccttataatgccaattagaaactgtttctgagaatccaatctttcctctctctagctatattgtactttgaaaaacacagtttgaaccgtaagttgaatatacttgtatactatgctgacttttgcagttc

SEQ ID NO: 6168 - DNA, 846 bp, Cajanus cajan
atcgaaccgtaactaacaattcgtggttgatgacctgatatggcgtttattaggttatgccaaaaaaaaaagaattaaaaagagattttaagaaaatccaatatttgtgtctctgagagcgtcatttatcgcatgtttgaagaggaggaagagaagagttaaggttgaagtagattactaatactaatgtcgaaaaaaggaggttcgtttcagaaggatgttccatggagagcatcatcttcttccttgaaacctttccccaaaattcaccactctccacttcttcgcgtttcccactcacccctatccgattacgccgtttccgttatgaggcatccggaccctattggaaatggattgggcgatgaggccatagtggaagcggctggtcctgactgcatcgtacctggccagaaggtgcccctcaaattacttggccttcaggtgtggccaatccatgttgacctgaagtttttggaacccgttgggcgagaacttaagttgcttggaaagttcatggatgacgccgtcgaactaatgaacaaatcattcatagagcgttgataatatggactgtgtagagacgaagtagccactatttgaaattttttaagggatgaaagcatagacatgcagagtgactgtaacatttggctcattttgtacgtaagagagaattgtaatgtgagatagttttgttcggtactcattcctcccccatccccctttaattccaattggaaactatttctgggaatcaaatttcttctttttagccccatgcattgctttacttagaaaaacataacatagtctacttgcatcgtatactgcgttttgcagttc

SEQ ID NO: 6169 - DNA, 793 bp, Glycine max
taaaaaagataaaattgagaagagatgagaagaaaatccaatatttgtgtctataaatgacatgagtgtgtgaagagtgcagaagagagtagagtggaaatgtcgaaagggggttcgcttcaaaaggacgtgccatggagagcatcgtcttcttctgcgaagcccatccccagaattcatcacagtccgcttcttcgcgtttctcgaacacctgtttccgattacggtatctccgtcatgaggcatccggaccctatagggggtggattgggtgacgaggccacagtggaaccagctggccctgattgcctcgtccctggccagaaaatgcccatccaattacttggccttcaggtctggccaatccatgttgacctgaagtttttggaaccggttgggcgagaacttaagatgcttggaaagttcatggatgacgctgttgaactaatgaacaaatcattcatagagcgctgataatatgggcttttatgaagagatgaagtagccgcaatttgattttttttttttaagtaatgagaagtatagacaaacatatagcgactgtaacatttgtggcgtattttgtaatgtgaaagataaatgcaacgcgcgatagttttgttcggcactcataattagttcccttccttcccctgtaatgccaattaaaaactatttctgagaatccaatgtttcttctttttggccctatgcaatgcggtagattgcattacgtaggaaggcataacatagtttgaaccgtaagtggaattcacttgtatcctatgctgtg

SEQ ID NO: 6170 - DNA, 771 bp, Glycine max
gagaagagatgagaagaaaatccaatatttgtgtctataaatgacatgagtgtgtgaagagtgcagaagagaatagagtggaaatgtcgaaagggggttcgcttcaaaaggacgtgccatggagagcatcgtcttcttctgcgaagcccatccccagaattcatcacagtccgcttcttcgcgtttctcgaacacctgtttccgattacggtatctccgtcatgaggcatccggaccctatagggggtggattgggtgacgaggccacagtggaaccagctggccctgattgcctcgtccctggccagaaaatgcccatccaattacttggccttcaggtctggccaatccatgttgacctgaagtttttggaaccggttgggcgagaacttaagatgcttggaaagttcatggatgacgctgttgaactaatgaacaaatcattcatagagcgctgataatatgggcttttatgaagagatgaagtagccgcaatttgattttttttttttaagtaatgagaagtatagacaaacatatagcgactgtaacatttgtggcgtattttgtaatgtgaaagataaatgcaacgcgcgatagttttgttcggcactcataattagttcccttccttcccctgtaatgccaattaaaaactatttctgagaatccaatgtttcttctttttggccctatgcaatgcggtagattgcattacgtaggaaggcataacatagtttgaaccgtaagtggaattcacttgtatcctat

SEQ ID NO: 6171 - DNA, 707 bp, Cyamopsis tetragonoloba
cacgagggtagcagagaaggtagttcgtgaagtttgcagcagcagcaaaagaagaacaagaacaagaaattgaaaaattagaagtttggagtaatagttgataataaacggaatataaagtagaaaaatgtcgagaaaaggaggtgcagcttcatttcaaaaagacgcgccatggagagcttcgtcttcttctgtgaagccaatccctaaaattcaccattctcctcttcttcgcgtttcgcagaatcctttttccgattacgccatctccatcatgaggcatccggatcctgtaggcagtggattgggtgatgaggcgatagtggaagcagctggtcctgaatgtatcgtacctggccagataacgccgctcaaattacttggcgtcaaggtctggcctatcaatgttgacctgagatttttggaaccagttgggcgagaacttaagttgcttgggaagttcatggacgacgctgttgagctgatgaacaaatcattcatagagcgctgatatagcatggcctttgtgaaaagacagtagccgaaatttgaaattttaagggatgagaggtctatacaagccaagtgaccttaatatttttgcatcattttgtattaagtcttgcttacattttcggaagtgtgcaatctgagatagttttgctcctttttgttgtttatattgatattaataataaagcctcgtg

SEQ ID NO: 6172 - DNA, 954 bp, Vigna unguiculata
ggaaagtccacagcttcaaaccccacacaaagaccacaaggattgggtcagcgcgcggagtgagaatttcttgcaaagtgaaagattgtccagttctggatttgggtttggatgaaaacgtgaattcatacggtcaattttcggctcctgtgaagccagagtcgaagcagagcaaagaggaagaagaagaaaagcagaattaccatgttaatgtgggatatgctattcgaactttgagggaggatttccctgatctcttctacagggaacttagctttgacatctacagggatgatattgtgtttaaggatccaatgaacacgttcattggtattgagaattacaaatccatattctgggcactacgattccatggcaagatatttttcaaagctttgtgggttgacataagtagtgtatggcagcctgtggagaacgtcatcatggttcgctggactgttcatgggatcccacgagttctatgggaaagccgtggtaggtttgatggaacttctgagtataaacttgacaagcagggcaagattttcgaacacagggttgacaacattgctaccaattcacctcatcggttcaaagtgttgagtgtagcagagttaattcaatctattggctgcccctcaacagcaagacctacctattttgaaacttcttcacatcccgagagaacgtaatgttgctcaggttcttcaaaaagttttgatgtaaattgtgtatattatgtggtaaacaaaacatggagttagatattattatcttgcttgtcacataaagctgtgagaaaaaggtcctttgccattgatttggtctcatggtgctcgatactggtgataacagttatagggtcattgttatctattgtaacaagttgagtttcaaaatccctgtatataatgcatttgctacttatgtctaatggcttacttcatctgtaga

SEQ ID NO: 6173 - DNA, 3469 bp, Phaseolus vulgaris
ttctcaagtatgaggattgccaaggaagaatcatcaagcagtgctgcacaggcaagtgattaacacttcattataacttggatccatgagactctcctatcccctattatccttctcaatggctggagtgtgaatatcttttatttattaacttgaacaggcaataagcttgatatcagcagtgaaggaattgcaagaggttactgctatggatctcaacaaattattgagagactctgaaaatttcactattcagtaccttactgaaaaaggatcaatactgaagattgatatggaaaagcttgtgggatctcttccattgcaccttagtaccctgctgatgtcagctgttagaaatgaagccttgttcagatacctgttacgtggcattcgactcttgcattccttgtgtgatttagcctcccgaaattctaaattcgagcagattatgctagatgatgtgaaaattatggaacagctgactgacttggttttctacatgctaattgttcttggtggatacagaaaggaataccatgcttttagttatatgcaccttttgcattcaactcttgtagcatgcaatttacatctattaacagggtttatatcaacacaatggcaagatattgttcatgtattgcttgcgcaccccaaggttgacatatttatggatgcagcttttggatcagttcgcatggttgttagttttcttgagaatacactggtagcatatcaagaagatgtttctgtggaatcaaatcttactgcaggacaaatagtttattatctctgccagcagtgtgaagcttctctgcagtttcttcagtcactttgccaacaaaaattgtttaaggagcgccttctcaagaataaggaattatgtgaaaagggaagcattctttttctggctcgatccatcttgaagttacacattcagccatcttttccatctagggtcatggcggctatttctaggctaaaggctaaaatactatctattctgctgagtttgtgtgaagcagaaagcatttcttatcttgatgaagtagccagctcagcacgaagtttagatttggctaaatctgttgcattagaggtttttgacttgttgaaaaaagcttttggaagagatcctgggcatctcactgctgacagaagtcatccaatggggtttgtgcagctcaatgcaatgcgtcttgctgacatcttctctgatgattcaaactttcgatcttacatgataatttgttttactaaagttctgacagcaataatttcgctctcccatggagattttttatcctgttggtgttcatctaatctgtcagagatggaggaagatgctagtcttgaatatgatatatttgctgcagttggatggattttagataatacttcaccagatgtaagaaatgctacaaatttggaattcaacctagtccctaacagcatgcctaaggcttcttatgcacatcataggacatcattgtttgtcaagttctttgcaaaccttcattgttttgttcccaacatttgcgaagagcaggagaggaacctttttgttcttaaggtcatggagtgcttgcaaatggatctttctaacttgctgcctggattttcttttgcttctgatgctcctaaagctgccattgctagcaaaaacctccgctcattattaagtcatgcagaatctttgattccaaacttcttaaacgtggaggatgtgcaacttttaagagtgttttttggtgaattacaatcactgtttacatctactggatttggggaaaatcaagtccaagatagcaaatttgaggagtcacaatcttgggataagatttctaaattcaacatcaatgaacattatcaggaggcacagagtgcagtgggatttccgccatctttaactggaaaagaacctgctgatctcaataagaagggtagtaacttcaaggaaggaatgtctgagaattctgcatttccggacatggaccaacataatagccgagctgaagagacaaatcaaggcaagggcttaaataggcaaaatcaggtggatgataaagggatacctggtaaaactgcatcaggaggagcaagagatatggacaaggatgctcagaatgttgaaacaagtggttcagatactagttctgcaaaaggaaagaatgttgttgatcatatggatattggagaactttcaaaatcaaatgagcgtcttaaacgaactgcagttgaggaaaatccagaggatgaaaagattgagctttcacaacgaagaaaacggaagcgaacaataatgaatgataaacaggtgttgttgattgagagggcactcaaagatgagcctgatatgcagcgtaatgcagtttcacttcaatcatgggcagaaaaactaagcgtgcatggttccgaggttacatcttcacagcttaaaaattggttgaacaaccgaaaagctaggcttgctcgcacagctagggatgttcgcacagcaggaggtgatgctgataatcctgtcctagaaaagcaaagagggccagtacctgggtcctatgactcacctgaaagtccaggtgatgtatcacatgttgcgagaatagcttccggtgataataaaccagagccttctctggctcgatttgttgatattggttctccagaatttggtcgttgcaatgcaggtcagtatgttgtgcttgttggtgttcgaggagatgaaattggcagaggaaaagtgtttcaggtgcatggtaagtggtatgggaagagcttggaggaattagccacctgcgttgtggatatttgtgagctcaaagctgataaaggtatgcggctaccctatccatcagaagccactgggaatacatttgcagaggctgaaacaaagttaggtgtcatgagggtgttatggggctcgaacagagtttttccattgcggtctgaaatctgaatgagtttaattatgctttcatttgctgcagcagctgctattcctctgctacctgctgcaaactgttgtcaatcttacttgtggttccctgaatgcacatattttctatttccataaacactgaagggatactagatgacttagttgagaagatcatcattacttgatagaaaagagttcagtaagggacgggtagaaagtagaagtcgataattatggagaaaactagggcgatttcgcaatgaaagatagtttagtttagggtataaacaagaggcatagcggcagaaaaaaatggttgtagggtcttgtacaaaatttgtttctcagaaagaattttccctgccgcctggcaattgaaaatatgcgcaactatggtttgagttttagatctccccaaaatttaaaacacttgtttgatttaaagggaaacaatggacgtaaactttgtttggattaacgtttgcaaatcttgttcatttcatgtaaagagcttaaggagaaaagtgtaag

SEQ ID NO: 6174 - DNA, 3664 bp, Glycine max
taatagttgtagattattaatagttacatacatgagtagatattctagaagactcgctgatactttcccatcgactaaaccctattggactaacccttcatcctcctcagtggtgctgccaccccttttctgttggtgccaaaaaacactggcagatacatacaggtcaatattcaacctttgataattatcaattttgctcttgtcactattttttcacgatcgaatttgtgaaacttcccatgattagaattgtgacctagattgtggttttattgaggctatcaaattcggaaacgctgtcttcttactaattctctagaatgaggattgctaaggaagaatcatcaagcagtgctgcacaggcaataagcttgatatcagcattgaaggaattgcaaggagttactgctctggatcttaataaattattgagggactctgaaaatttcactattcattaccttactgaaaaaggatcattgctgaagattgatatggaaaagcttgcaggatcccttccgttgcaccttactacactgctgatgtcaggtgttagagatgaagccctgttcagatacttattacgtggcattcgattattgcattccttgtgtgaattagcctcccgaaattctaaattcgagcagattttgctagatgatgtgaaaatgatggaacagctgactgacttggttttctacatgctaattgttcttggtggttacagacaggaataccgtgcttttagttatatgcaccttatgcattcaactctcgtagcatgcaatttacatctcttaacagcgtttgtttcaacacaatggcaagatattgttcatgtattgcttgcgcaccccaaggttgacatatttatggatgcagcttttggatcagttcgcatgattgttagttttcttgagaatgcactggtagcatatcatgaagatatttctgtggaatcaaatcttacagcagaacaaatggtttattatctttgtcagcagtgtgaagcttctctgcagtttcttcagtcattatgccaacaaaaaatgtttaaggagcgcctgcttaagaataaggaattatgtgaaaagggaagcattctttttctagctcaatccatcttgaagttacacattcagccatcttttccatccaggatcatggcagctatttctaggctaaaggctaaaattctatctattctgctgagtttgtgtgaagcagaaagcatttcttatcttgatgaagtagccagctcagtacgaagtttagatttggctaaatctgttgcattagaggtttttgacttgttgaagaaagcctttggaagagatcctgggcatctcactgctgacagaagtttcccaatggggtttgtacagctcaatgcaatgcgtctagctgacatcttctctgatgattcaaactttcgatcttacatgatactttgttttactaaagtcctgacagcaataatttcgctctcccatggagattttttatcctgttggtgttcatctaatctctcagagacggaggaggatgcaagtattgaatatgatatatttgctgcagttggatggattttggataatacttcaccggatgtaagaaatgctacaaatttggaattcaacctaatccctaacagcatgcctaaggcttcttatgcacatcataggacatcattatttgtcaagttctttgcaaatcttcactgttttgttcccaacatatgcgaagagcaggagaggaacctttttgttctcaaggtcatggagtgcttgcaaatggatctatctaatttgctgcctgggttttcttttgcttctgatgctcctaaagctgccattgctagcaagaacctccgatcgttgttaagtcatgcagaatctctgattcctaacttcttaaatgtggaggatgtgcaacttttaagagtgttttttggcgaattacaatcactatttacatctactggatttggggaaaatcaagtccaagatagcaaatttgatgagtcattatcttgggataagctttctaaattcaacatgaatgaacattatcaggaggcacagagtgcagggggatgcccgccatctttaactggaaaagaacatgccagtcttaataagaagggtggtaacttcaaggaaggaatgtctgagaattctgcatttccagacatggaccaacataataccagagctgaagaaacaaatcaaggcaagggcctaaataagcaaaatcaggtagatgataaaggcatacctggtaaaactgcatccggaggagctagagaaatggacaaggatgctcagaatgttgaaacaagtggttcagatagtagttctgcaaaaggaaagaatgttgttgataatatggataatggagagctttcaaaatcaaatgagcgtcttaaaagaactgcagttgaggaaaatccagaggatgaaaagattgaactttcacaaaggagaaaacgaaaacgaacaataatgaatgataaacaggtgatgctgattgagagggcactcaaagatgagcctgatatgcagcgaaatgcagcttcacttcaatcatgggctgataaattaagtgggcatggttccgaggttacatcttcacagcttaaaaattggttgaacaatcgaaaagctaggctagctcgcacagctagggatgttaaagcagcagcaggtgatgacaatcctgtcccagagaagcagagagggccagtacctgggtcctatgactcacctggcagtccaggtgatgtatcacatgttgcgagaatagcttcaggtgataataaatccgagctggctcggtttgttgatattggttctccagaatttggtcattgcaatgcaggtcaaaatgttgtgcttgttggtgtacgaggagacgaaattggcagaggaaaagtgtttcaggtgcacggtaagtggtatggtaagagcttggaggaattatctgcccatgttgtggatattagtgagctcaaagctgataaaggcatgcggctaccctatccatcagaagccactggcaacacatttgcagaggctgaaactaagttaggagtcatgagggtgttatggggttcaaacagagtttttgcattgcgacctgaatgagtttaatcatgcttcattagctgcaatctgttgtcaatcttccatgtggttccttgaatgcgcatgttctttatttccataaacattagctgaagggatagcagattggttggctgagaagaacaataccgaatagaaagagtccagtttgttagccaaggatgggtagaaactagaagaggacacttatgttgaaaacaaggttgattcagcaatggaagatggtttagtttaggatataacccaagagccataatcggcagcaaaaatgttggtagggtcttgtacaatatgtggaactgtggtaacgagtgataagatctgaatttaacttacagggaacaagtgaacgtaaattctgtttagattaaaatttgcgaatcttgctcatttcatgtcaacagttataatatcataagaaaattaaaagattagattattttgtttggagtcgtgaaaatgaaatcataacaaattgtgtaaaattgattttcgtgaaaaatatttgtctggat

SEQ ID NO: 6175 - DNA, 3434 bp, Glycine max
cttgttctaggtgcaacaaatgtctgccatcagcagatggctcttcctggtgttgttgacatgaactggcaacttctgttccaaaatgtaaaaatgaggattgctaaggaagaatcatcaagcagtgctgcacaggcaataagcttgatatcagcattgaaggaattgcaaggagttactgctctggatcttaataaattattgagggactctgaaaatttcactattcattaccttactgaaaaaggatcattgctgaagattgatatggaaaagcttgcaggatcccttccgttgcaccttactacactgctgatgtcaggtgttagagatgaagccctgttcagatacttattacgtggcattcgattattgcattccttgtgtgaattagcctcccgaaattctaaattcgagcagattttgctagatgatgtgaaaatgatggaacagctgactgacttggttttctacatgctaattgttcttggtggttacagacaggaataccgtgcttttagttatatgcaccttatgcattcaactctcgtagcatgcaatttacatctcttaacagcgtttgtttcaacacaatggcaagatattgttcatgtattgcttgcgcaccccaaggttgacatatttatggatgcagcttttggatcagttcgcatgattgttagttttcttgagaatgcactggtagcatatcatgaagatatttctgtggaatcaaatcttacagcagaacaaatggtttattatctttgtcagcagtgtgaagcttctctgcagtttcttcagtcattatgccaacaaaaaatgtttaaggagcgcctgcttaagaataaggaattatgtgaaaagggaagcattctttttctagctcaatccatcttgaagttacacattcagccatcttttccatccaggatcatggcagctatttctaggctaaaggctaaaattctatctattctgctgagtttgtgtgaagcagaaagcatttcttatcttgatgaagtagccagctcagtacgaagtttagatttggctaaatctgttgcattagaggtttttgacttgttgaagaaagcctttggaagagatcctgggcatctcactgctgacagaagtttcccaatggggtttgtacagctcaatgcaatgcgtctagctgacatcttctctgatgattcaaactttcgatcttacatgatactttgttttactaaagtcctgacagcaataatttcgctctcccatggagattttttatcctgttggtgttcatctaatctctcagagacggaggaggatgcaagtattgaatatgatatatttgctgcagttggatggattttggataatacttcaccggatgtaagaaatgctacaaatttggaattcaacctaatccctaacagcatgcctaaggcttcttatgcacatcataggacatcattatttgtcaagttctttgcaaatcttcactgttttgttcccaacatatgcgaagagcaggagaggaacctttttgttctcaaggtcatggagtgcttgcaaatggatctatctaatttgctgcctgggttttcttttgcttctgatgctcctaaagctgccattgctagcaagaacctccgatcgttgttaagtcatgcagaatctctgattcctaacttcttaaatgtggaggatgtgcaacttttaagagtgttttttggcgaattacaatcactatttacatctactggatttggggaaaatcaagtccaagatagcaaatttgatgagtcattatcttgggataagctttctaaattcaacatgaatgaacattatcaggaggcacagagtgcagggggatgcccgccatctttaactggaaaagaacatgccagtcttaataagaagggtggtaacttcaaggaaggaatgtctgagaattctgcatttccagacatggaccaacataataccagagctgaagaaacaaatcaaggcaagggcctaaataagcaaaatcaggtagatgataaaggcatacctggtaaaactgcatccggaggagctagagaaatggacaaggatgctcagaatgttgaaacaagtggttcagatagtagttctgcaaaaggaaagaatgttgttgataatatggataatggagagctttcaaaatcaaatgagcgtcttaaaagaactgcagttgaggaaaatccagaggatgaaaagattgaactttcacaaaggagaaaacgaaaacgaacaataatgaatgataaacaggtgatgctgattgagagggcactcaaagatgagcctgatatgcagcgaaatgcagcttcacttcaatcatgggctgataaattaagtgggcatggttccgaggttacatcttcacagcttaaaaattggttgaacaatcgaaaagctaggctagctcgcacagctagggatgttaaagcagcagcaggtgatgacaatcctgtcccagagaagcagagagggccagtacctgggtcctatgactcacctggcagtccaggtgatgtatcacatgttgcgagaatagcttcaggtgataataaatccgagctggctcggtttgttgatattggttctccagaatttggtcattgcaatgcaggtcaaaatgttgtgcttgttggtgtacgaggagacgaaattggcagaggaaaagtgtttcaggtgcacggtaagtggtatggtaagagcttggaggaattatctgcccatgttgtggatattagtgagctcaaagctgataaaggcatgcggctaccctatccatcagaagccactggcaacacatttgcagaggctgaaactaagttaggagtcatgagggtgttatggggttcaaacagagtttttgcattgcgacctgaatgagtttaatcatgcttcattagctgcaatctgttgtcaatcttccatgtggttccttgaatgcgcatgttctttatttccataaacattagctgaagggatagcagattggttggctgagaagaacaataccgaatagaaagagtccagtttgttagccaaggatgggtagaaactagaagaggacacttatgttgaaaacaaggttgattcagcaatggaagatggtttagtttaggatataacccaagagccataatcggcagcaaaaatgttggtagggtcttgtacaatatgtggaactgtggtaacgagtgataagatctgaatttaacttacagggaacaagtgaacgtaaattctgtttagattaaaatttgcgaatcttgctcatttcatgtcaacagttataatatcataagaaaattaaaagattagattattttgtttggagtcgtgaaaatgaaatcataacaaattgtgtaaaattgattttcgtgaaaaatatttgtctggat

SEQ ID NO: 6176 - DNA, 3406 bp, Glycine max
atgaggattgctaaggaagaatcatcaagcagtgctgcacaggcaataagcttgatatcagcagtgaaggaattgcaaggagttacagctctggatcttaataaattattgagggactctgaaaatttcactattcattaccttactgaaaaaggatcattgctgaagattgatatggaaaagcttgtgggatctcttcctttgcaccttactacactgctgatgtcagctgttagagatgaagccctgttcagatacttattatgtggcattcgattattgcactccttgtgtgaattagcctcccgaaattctaagttcgagcagattgtgctagatgatgtgaaaatgatggaacagctgactgacttggttttctacatgcaaattgttcttggtggttacagacaggaatactgtgcttttagttatatgcaccttatgcattcaactcttgtagcctgcaatttacatcttttaacagcgtttatttcaacacaatggcaagatattgttcatgtattgcttgcgcaccccaaggttaacatatttatggatgcagcttttggatcagttcgcatggttgttagttttcttgagaatacactggtagcatatcatgaagatatttctgtggaatcaaatcttacagcagaacaaatggtttattatctctgtcagcagtgtgaagcttctctgcagtttcttcagtcattatgccaacaatttttttttaaggagcgcctgcttaagaataaggaattatgtgaaaagggaagcattctttttcttgctcaatccatcttgaagttacacattcagccatcttttccatccaggatcatggcagctatttctaggctaaaggctaaaatactatctattctgctgagtttgtgtgaagtggaaagcatttcttaccttgacgaagtagccagctcagcacgaagtttagatttggctaaatctgttgcattagaggtttttgacttgttgaagaaaacttttggaagagatcctggacatctcactgctgacagaagtttcccaatggggtttgtacagctcaatgcaatgcgtctagctgacatcttctccgatgattcaaactttcgatcttacatgatactttgttttactaaagttctgacagcaataatttcgctctcccatggagattttttatcctgttggtgttcatctaatctcttaaagatggaggaggatgcaagtcttgaatatgatatatttgctgcagttggatggattttggattatacttcactggatgtaagaaatgctacaaatttggaattcaacctaatccctaacagcatgcctaaggcttcttatgcacatcataggacatcattatttgtcaagttctttgcaaatcttcattgttttgttcccaacatatgcgaagagcaggagaggaacctttttgttctcaaggtcatggagtgcttgcaaatggatttatctaacttgctgccggggttttcttttgcttctgatgctcctaaagctgccattgctagcaagaacctccactcattgttaagtcatgcagaatctctgattcctaacttcttaaatgtggaggatgtgcaacttttaagagtgttttttggtgaattacaatcactatttacgtctactggatttggggaaaatcaagtccaagatagcaaatttgaggagtcattatattgggataagctttctaaattcaacaggaatgaacattatcagaaggcacagagtgcagggggatgcccgtcatctttaactggaaaagaacatgccgatcttaataagaagggtggcaacttcaaggaaggaatgtctgagaattctgcatttccagacatggaccaacataataccagagctgaagacacaaatcaaggcaagggcctaaataggctaaatcaggtagatgataaaggcatagctggtaaaactgcatctggaggagctagagaaatggacaaggatgctcagaatgttgaaacaagtggttcagatagtagttctgcaaaaggaaagaatgttgttgataatatggataatggagagctttcaaaatcgaatgagcgtcttaaaagaactgcagttgaggaaaatccagaggatgaaaagattgaactttcacaaaggagaaaacgaaaacgaacaataatgaatgataagcaggtgatgctgattgagagggcactcaaagatgagcctgatatgcagcgaaatgcagcttcacttcaatcatgggctgataaattaagtgggcatggttccgaggttacatcttcacagcttaaaaattggttgaacaatcgaaaagctaggctagctcgcacagctagggatgttaaagcagcagcaggtgatgacaatcctgtcccagacaagcaaagagggccagtacctgggtcctatgactcacctggcagtccaggtgatgtatcacatgttgcgagaatagcttcaggtgataataaatccgagccttctctggctctggctcggtttgttgatattggttctccagaatttggtcattgcaatgcaggtcaatatgttgtgctcgttggtgtacgacaagacgaaattggcagaggaaaagtgtttcaggtgcatggtaagtggtatgggaagagcttggatgaattatccgcccatgttgtggatattagtgagctcaaagctgataaaggcatgcggctaccttatccatcagaagccactggcaacacatttgcagaagctgaaactaagttaggagtcatgagggtgttatggggttcaaacagagtttttgcattgccacctgaatgaatttaatcatgcttcattagcggcaatctgttgtcaatcttccttgtggttccctgtatgcgcatgtttttttttcccataaacattagctgaagcgataacagatgggtttgctatgaagaacaatactgaatagtaaagtctccagtttgttagccaaggatgggtagaaagtagaagaggacaattatggagaaaacaaggttgattcagcaatgaaagatagtttagtttaggatataaacaagagctgtagtcagcagcaaaaatgttggtagggtcttgtacaaaatttgtttctcagaattttccctgcagcatggcaattgacaatatgtgaaactatggtaacgagtgatgagatctgaatttaacttaaagggaaactgtgaacgtaaattctgtttagattaaaatttgcgaatcttgctcatttcatgccaagtgtaataatttcagaagaaaagtattagattattttgtttgtagtcgtgaaaatgaaatcaacaaattgtgtaaaattgattttcatgaaaaatctgtccggatatgctaatttgctttttgt

SEQ ID NO: 6177 - DNA, 3485 bp, Glycine max
gattagaattgtgacctagattgtggttttattgaggctatcaaattcggaaacgctgtcttcttactgattctctagaatgaggattgctaaggaagaatcatcaagcagtgctgcacaggcaataagcttgatatcagcagtgaaggaattgcaaggagttacagctctggatcttaataaattattgagggactctgaaaatttcactattcattaccttactgaaaaaggatcattgctgaagattgatatggaaaagcttgtgggatctcttcctttgcaccttactacactgctgatgtcagctgttagagatgaagccctgttcagatacttattatgtggcattcgattattgcactccttgtgtgaattagcctcccgaaattctaagttcgagcagattgtgctagatgatgtgaaaatgatggaacagctgactgacttggttttctacatgcaaattgttcttggtggttacagacaggaatactgtgcttttagttatatgcaccttatgcattcaactcttgtagcctgcaatttacatcttttaacagcgtttatttcaacacaatggcaagatattgttcatgtattgcttgcgcaccccaaggttaacatatttatggatgcagcttttggatcagttcgcatggttgttagttttcttgagaatacactggtagcatatcatgaagatatttctgtggaatcaaatcttacagcagaacaaatggtttattatctctgtcagcagtgtgaagcttctctgcagtttcttcagtcattatgccaacaatttttttttaaggagcgcctgcttaagaataaggaattatgtgaaaagggaagcattctttttcttgctcaatccatcttgaagttacacattcagccatcttttccatccaggatcatggcagctatttctaggctaaaggctaaaatactatctattctgctgagtttgtgtgaagtggaaagcatttcttaccttgacgaagtagccagctcagcacgaagtttagatttggctaaatctgttgcattagaggtttttgacttgttgaagaaaacttttggaagagatcctggacatctcactgctgacagaagtttcccaatggggtttgtacagctcaatgcaatgcgtctagctgacatcttctccgatgattcaaactttcgatcttacatgatactttgttttactaaagttctgacagcaataatttcgctctcccatggagattttttatcctgttggtgttcatctaatctcttaaagatggaggaggatgcaagtcttgaatatgatatatttgctgcagttggatggattttggattatacttcactggatgtaagaaatgctacaaatttggaattcaacctaatccctaacagcatgcctaaggcttcttatgcacatcataggacatcattatttgtcaagttctttgcaaatcttcattgttttgttcccaacatatgcgaagagcaggagaggaacctttttgttctcaaggtcatggagtgcttgcaaatggatttatctaacttgctgccggggttttcttttgcttctgatgctcctaaagctgccattgctagcaagaacctccactcattgttaagtcatgcagaatctctgattcctaacttcttaaatgtggaggatgtgcaacttttaagagtgttttttggtgaattacaatcactatttacgtctactggatttggggaaaatcaagtccaagatagcaaatttgaggagtcattatattgggataagctttctaaattcaacaggaatgaacattatcagaaggcacagagtgcagggggatgcccgtcatctttaactggaaaagaacatgccgatcttaataagaagggtggcaacttcaaggaaggaatgtctgagaattctgcatttccagacatggaccaacataataccagagctgaagacacaaatcaaggcaagggcctaaataggctaaatcaggtagatgataaaggcatagctggtaaaactgcatctggaggagctagagaaatggacaaggatgctcagaatgttgaaacaagtggttcagatagtagttctgcaaaaggaaagaatgttgttgataatatggataatggagagctttcaaaatcgaatgagcgtcttaaaagaactgcagttgaggaaaatccagaggatgaaaagattgaactttcacaaaggagaaaacgaaaacgaacaataatgaatgataagcaggtgatgctgattgagagggcactcaaagatgagcctgatatgcagcgaaatgcagcttcacttcaatcatgggctgataaattaagtgggcatggttccgaggttacatcttcacagcttaaaaattggttgaacaatcgaaaagctaggctagctcgcacagctagggatgttaaagcagcagcaggtgatgacaatcctgtcccagacaagcaaagagggccagtacctgggtcctatgactcacctggcagtccaggtgatgtatcacatgttgcgagaatagcttcaggtgataataaatccgagccttctctggctctggctcggtttgttgatattggttctccagaatttggtcattgcaatgcaggtcaatatgttgtgctcgttggtgtacgacaagacgaaattggcagaggaaaagtgtttcaggtgcatggtaagtggtatgggaagagcttggatgaattatccgcccatgttgtggatattagtgagctcaaagctgataaaggcatgcggctaccttatccatcagaagccactggcaacacatttgcagaagctgaaactaagttaggagtcatgagggtgttatggggttcaaacagagtttttgcattgccacctgaatgaatttaatcatgcttcattagcggcaatctgttgtcaatcttccttgtggttccctgtatgcgcatgtttttttttcccataaacattagctgaagcgataacagatgggtttgctatgaagaacaatactgaatagtaaagtctccagtttgttagccaaggatgggtagaaagtagaagaggacaattatggagaaaacaaggttgattcagcaatgaaagatagtttagtttaggatataaacaagagctgtagtcagcagcaaaaatgttggtagggtcttgtacaaaatttgtttctcagaattttccctgcagcatggcaattgacaatatgtgaaactatggtaacgagtgatgagatctgaatttaacttaaagggaaactgtgaacgtaaattctgtttagattaaaatttgcgaatcttgctcatttcatgccaagtgtaataatttcagaagaaaagtattagattattttgtttgtagtcgtgaaaatgaaatcaacaaattgtgtaaaattgattttcatgaaaaatctgtccggatatgctaatttgctttttgt

SEQ ID NO: 6178 - DNA, 3322 bp, Cajanus cajan
ctctaattatccttttcaatgactggtgtatggatgttttttaatttacctgaacaggaaataagcttaaaatcagcagtgaaggagttgcaaggggttaccgctctggatctcaataaattattgagagactctgaaaatttcaccattcactacctcactgaaaaaggatcattgctgaaggttgatatggaaaagcttgcagtatctcttccgttgcaccttacttcacagctgatgtcacctgttagagatgaagccatgttcagatacttgttatgtggcattcgactcttgcattccttgtgtgatttagcctcccgaaattctaaatttgagcagatttttctagatgatgtgaaaatggaggaacagctgattgacttggttttctacatgctaattgttctcagtggttacagacaggaataccatgcttttagttacatgcaccttatgcattcaactcttgtagcatgcaatttacatctattaacagggtttttatcaacacaatggcaagatattgttcatgtcttgcttgcgcaccccaaggttgacatatttattgatgctgcttttggatcagttcgtatggctgttagttttttagagaatacgcttgtggcatttcataaagacatttctgtggaatcaaatcttaccccagaacaaatagtttattatctctgtcagcagtgtgaagcttctctgcagtttcttcagtcattatgccaacaaaaattgtttaaggagcgcctgcttaagaataaggaattatgcggaaagggaagcatactttttctcgctcaatccattttgaagttacacattcagccatctttttcatcaagggtcatggcggctatttctaggctaaaggctaaaatactatctattctgctgagtttgtgtgaagcagaaagcatttcttatcttgatgaagtagccagctcagcacgaagtttagatttggctaaatctgttgccttggaggtttttgacttgttgaagaaagcttttggaagagatcctgagcatctcgctgctgacagacgtcacccaatggggtttgtacagctcaatgcaatgcgtctagctgacatcttctccgatgattcaaacttccgatcttacatgatactttgttttactaaagttctgacagcaataatttcactctcccatggagattttttatcgtgttggtgttcatcaaatctcccagagacagaggaggatgcaagtcttgaatatgatatattttctgcagttggatggattttggataatacttcaccggatgtaagaaatgctacaaatttggaattcaacctcatacctaacagcatgcctaaggcttcttatgcacatcataggacatcattatttgtcaagttctttgcaaatcttcattgttttgttcccaacatatgcgaagagcaggagaggaacctttttgttctcaaggtcctggagtgtttgcaaatggatctatctaacttgctgcctggattttcttttgcttctgacactcctaaagctgctattgctagcaagaatctccgttcattgttaagtcatgcagaatctttgattccaaacttcttaaatgtggaggatgtgcaacttttaagagtgttttttggcgaattacaaacactatttgcttctactggatttggagaaaatcaagtccaagatagcaaatttgaggagtcattatcttgggataagttttctaaattcaacatcaatgaacaatatcaggaggcacagagtgcaggggggtgtctatcatctttaactggaaaagaacctgcagatcttaataagaaaggtggtaatttcaaggaaggtatgtctgagaattctgcatttcctgacatagaccaacataataccagagctgaagacacaaatcagagcaagggcctaaataggcaaaatcaggtagatgataaaggcttacatggtaaaactgcacctggaggagcaagagatatggaaaaggatgctcagaatgttgaaacaagtggttcagatagtagttctgcaaaaggaaagaatgttgttgatcacatggataatggcgagctttcaaaatcaaatgagcgtcttaaaagaactgcaattgaggaaaatccagaggatgaaaagatagaactttcacaaaggagaaaacgaaagagaacaataatgaatgataaacaggtgatgctaattgagagggcactcaaggatgagcctgatatgcagcgaaatgcagcttcacttcaatcatgggctgataaattaagtttgcatggttctgaggttacatcttcacagcttaaaaattggttgaataatcgaaaagctaggctagctcgcacggctagggatgttcgagcagcagcaggtgatgctgacaatcctgtcccagacaagcaaagagggccagtacctgggtcctatgactcacctgacagtccaggtgatgtatcacatgcaaggaatgataataaacctgagccttctctggctcgatttgttgatattggttctccagaatttggtcattgcaatgcaggtcaatatgttgtccttgttggtgtacgaggagacgaaattggaagaggaaaagtgtttcaggtgcatggtaagtggcatgggaagagcttggaggaattatctacctgcgttgtggatattaatgagctcaaagctgataaaggtatgcggctaccctatccatcagaagccactggcaccacatttgcagaggctgaatcaaagttaggtgtcatgagggtgttatggggttcaaacagagtttttgcgttgcgggctgaatgagtttaatcgtgattcatttgccgcaactattcctctactacctgctgcaatatgttacaatcttgcttgtggttctcggaatgctcatgttttctatttccataagcatttgctgatgggataacagatgggttatagctgagaagaacaataccgaatagaagagtccagtttgttagctaagggacgggtagaaagtagaagaggatagttatggagaaaacaagggcgattcagcaatgaaagatagtttaggatataaacaagaaccatagtcggcagcaaaaatgttattagggtcttgtacaaaacttgtttctcagaattttccccgcatcatggcaattgacaatatgcggaactatgataatgagcagcgataagatcttattacaccaccccagagaaaagtaaaagacttaaatttaaagggaaaactggacgtaagttctgtgaagattaacatttgctattcttgctcttc

SEQ ID NO: 6179 - DNA, 3529 bp, Cajanus cajan
cgatattgttttttttttctttttttgtcagtgggttgagtgaagtttttattttgtgcggtgtgtaatggtgagtgatagttactcgaagatgatgtctgatgttgtgattcgatcgatgctgaagaacggtggtgattacggcggtgaagatttgggggttctaagggagagggaactggcgcggttgcgaagtgggtcggcgccgccgaccgtggaggggtcgttgtcggcggtgggagggttgtttgagggttcggcggcggcgggggtttttggcggtggaaggggttttgggagtgaggaggagcttcgggctgatccgaattacgcgaattattactatgcgaatgtgaatctgaacccgcggttcccgccgccgctggcctcgaaggaggactggcggttcgtgcagcggttgaggggtggttctaaggtggggggaattgaggatagggggatggtgcgtgatgatggtggaattgtaggtggtgatagttctttgttttctgtgcaccctggtgggtttggtgtgaaggaggagggtggtttgaagcaccggaagggtggccccgagtggggtggcgaggacggcttgatcggtttgccggcattgggcatggggagtaggcagaggagtattgctgaactgtttcaggatgaaataaataatgcatcatctgcctccaagcaccctcaaaatctgcctagtagtaatttatttgatgatattgttgaaaaatcagaaaaccgttttgcttatgcgcatcaagagttggatgccttgaggtctggtggaaataagcagggcatatcttcggcccaaaattttgttggttcagggcctcaaacttatgcttctgccttaggagcctccctatcaaggagtagcacccctgactctcaacttctacctagagctgctagtccttgccttccacccattggtgatggcaggtccagtactgataaaaagagttctaatggtcaaaactcactcaatgctgtctcatctaatttaaatgatcatggagatctggcatctgctttggctggtatgaatttgtccaccaatgatataatagatgatgagaaacattcccagtcatctaggcacaatgaatcagattatactctcagttttaaacagcacccttacttaaacaatcctgattccgtcccttttcagcgtcattcagctagccaaccccatttgcaagtgaataaaagcagtggttttggattggatctgaatcaatcagcagggtatacaaatgaacagctagaacttcacaaagctggtggaatttctgttaattcacatttaaaaggaccatctacaccaacttttactagcagaggtagtccgcatgctcgctatcagaatgtggatgatatctcttatcctaattatggtatgactgggtatactgttaatccttcatcaccatccatgatggcaagccatcttggaagtggtaatttgcctccattctttgaaaatgctgctgctgcatctgcactaggattgaatgctatggactccagagccctgggaagaggtgcaaatttaggacctttgttggctgcgtcagagttacaaaattcaaacaggctgggaagtcatgctgcaggtagcactcaacagttgcccctgatggaccctttgtatcttcagtatctaagatcgggggatgttgcttctgctgcacagattgctgcccttaatgaatcagcaataaatagggaatgcacagatttacttagtctccaaaaagcttatgtcgagtctttaattgccccccaaaaatcgcacttcaatgttccataccttgctaaatcacctactttgagccctaattcttatggaaatccatcatttggtatggccacgtcatatccaggaagcccactggctggttccgttttcccaaactccctctatgggtcgggtagtcccatgaaccaaagtgaacgcaatatgcgtttgtctgggatgaggaacatggctggtggtttcgtgggagcttggccttcagacaccgtgggtagcttagatgagaattttgcatcttccttgctcgatgaattcaaaagtaacaagaccaaatgttttgaactttccgaaattgctgggcatgttgtggagttcagtgctgaccagtatggaagccgttttatccaacagaaacttgagacggcctcgatggaagagaaaaacatggttttccatgaaatcatgccgcaagcactttctctaatgactgatgtctttggtaattatgtaattcagaagttttttgaacacggaacagcagcacaaataagagaactggctgatcagcttactgatcatgtgctgaccctaagtcttcaaatgtatggctgccgagttatccagaaggctattgaagttgttgatatggatcagcagactaaaatggttacagagttggatggtcatattatgcgttgtgttcgggatcaaaatggaaaccatgtcatccagaaatgtattgaatgtgtacccgaagatgcaatccaatttattgtttcaacgttttatgaccaggttgtgacattgtcaactcatccttatggttgccgggttatacagagagtcttggagtactgccatgatcccaaaacacagcaaattatgatggatgagattttgcagtctgtctgtaagttggcacaagaccaatatgggaattatgttgtgcagcatgtgctggagcatggcaagccatatgaacgttcagctataatcaaggaattaagtgggcaaatagtgcagatgagccagcagaagtttgcctctaatgttatagaaaagtgcttaacttttggaacacctacagagcgtcaaatccttgtgaatgagatgcttggctccacttatgaaaatgaacccctacaggttatgatgaaggatcagtttgcaaactatgttgtacagaaagtgctggaaacctgtgatgaccagcaacttgagctaatccttaatagaataaaggttcatctgaacgccttgaagaagtatacatatgggaagcacattgttgcccgtgtagagaaattggttgctgctggggagaggaggattagtgttctgactctgaatcctgcacagatggtatagaagatgtacagctaactgaggataatacaagcacctgctctttttttcttttgatatcattatctaatggccctgtctgtaatcaggtagtgaagtaataaatttagttgtacttgaaattgtacatttgttagtatgaggatataatacctagaaagaatcaggctaaggctcaaacttggcaatggccttgcctgattctcatgcggcagggatataatatttatgagctagttttcatgttgtaaagggaggtgttgacttgtacaaattttactaggttgcttatcagagttactacttgtattccggatccataaatcttttgacatatgaggcttttctttttgccctatgttaagccttttgcctcttgcttcaaaa

SEQ ID NO: 6180 - DNA, 2488 bp, Glycine max
ggaaaagtggtaactgtccatttaaccagtgttcaaggcacccacccacaaaccctaccctataaaccaaattcgcaatcccgtgttctctacccttcccattccaatttcgagaggaattcatttgaattagggttactctttttcttcgtttcatcatggacgctcagagagctctactcgacgaactcatgggtgcagcgcgcaacttgacggaggaagagaggaaggggtacaaggaagtgagttgggacgataaggaagtgtgtggattctacatggtgcgcttttgccctcacgatctctttgtcaacacgcgcagtgatctcggaccttgccccagaatacatgacccgaagttgaaagaaagttttgagaaatctccaagacatgatgcatatgtaccgaaatttgaagctgaactttctcaattttgtgagaaattggtgatggacttggatagaagagtaagacgtgggagagaacgtcttgctcaagaggtagagccaacaccaccaccaccactgacagccgaaaaatctgaacagctatctgtgctggaggagaaaattaagaaccttctggaacaagttgaatctcttggtgaagcggggaaagttgatgaagctgaagctcttatgagaaaggtggagacacttaatgctgagaagacagccttaacgcaacctcaaaatgataaggtgttgatgcttggtcaggagaagaagatggcactctgtgaaatatgtggttcgtttcttgtggcaaatgatgctgcagaaaggactcagtctcatgtcacaggaaagcagcatgttggttatggaatggttcgcgacttcataaatgagtttaagactgctaaggagaaagctaatgaagaggaaagattagctcgggaaagagaggcagaagaacggaggaaacagagggagaaggagtccgagagaaggagacgaagtgattcaagtgacagggataggcatcgtgataaagatcacaatagggagcgggataggtatagagatagagactcagatcgtgaaaggtctcgggagcatgatgttagaggttatcgagatggaggaaggggggtggattatagggcgagaaatggaagaaatggaggtagagacaggtaccgtgatcggagcaggtcacgctcccctggtaagcatagccacagaaggtcttcttgaagtccagtttgctcaaattagtggaatttcttgatagatgtcagaatttaattttaaaaaggtagtctttaatatcccaagacttacataaaatgtgcttttggagagttttttttgtcaccttcaagggtgaatttactcttttcccatctcagagctttgttgagactatacaatctccctttcatcaatattattaatggagaaaggggttgaggtaggtatttcactgttgtaacttttcttacaatttgttttgcaccttgatttaagtgatttatgacgattcatctctgaagcattgtgtgtagtctttcttttctcccatttctggaaatcaattgattgatttaagatgtccgacacaaaattacatgaatgattgtcattgctgctgagggggatggttttctcttgtattgaggtttaaaaaaatgctgcttattctgacatgaatttgacattgaactgcattccgaaggcaccagtttagaggatataggtaaacttactgaatttgttgttagttatctcccaaatccatggcatcatatctgttatatatttggtgtgatatcacccgatatgatcttatcctctggttagacaattattttttatttcctagtagtttcctgaatcctgatgtcattcttaacacggtttctgatgggtaaaaaagattagtatgttgtccagtataagtaagcaattgggaactgtttggaatggtaattagagaatggtgaatcatcctatgtaaaagtaatatttgatttgctgagtttgaatagaaaattgaaaggaccggcaaatacagggatttggttatctttgccgggtaatttgatagccagaatggttgacatttgcatgaaaaactttcgttgaactgggttgcagaatgtcttctcctttcatgaaccaacgccctacctttattgtctgggtggttagaggtaaatgtttctcatctgaataagagcgtttaatttggtgttcaggcacactaaaatgtccttgtgatctttgttggcttgattgtttctggaggtgatatgtgcaggaaaacaatcgtcgcctcttgttattagaagcgaggcaaaatgaaaattaagccttttcttttgatatcaggagaaagcgttgtgtttttatcattcgaaatgacagtcaaattcaaatccttgatgaactaagactggtcatacatactttgaacatgcgatccttaaagattgtaatgattcaaggaaataaaatgagcgatttttggagctttgcatgtt

SEQ ID NO: 6181 - DNA, 1963 bp, Glycine max
aaccagtgttcaaggcacccacccacaaaccctaccctataaaccaaattcgcaatcccgtgttctctacccttcccattccaatttcgagaggaattcatttgaattagggttactctttttcttcgtttcatcatggacgctcagagagctctactcgacgaactcatgggtgcagcgcgcaacttgacggaggaagagaggaaggggtacaaggaagtgagttgggacgataaggaagtgtgtggattctacatggtgcgcttttgccctcacgatctctttgtcaacacgcgcagtgatctcggaccttgccccagaatacatgacccgaagttgaaagaaagttttgagaaatctccaagacatgatgcatatgtaccgaaatttgaagctgaactttctcaattttgtgagaaattggtgatggacttggatagaagagtaagacgtgggagagaacgtcttgctcaagaggtagagccaacaccaccaccaccactgacagccgaaaaatctgaacagctatctgtgctggaggagaaaattaagaaccttctggaacaagttgaatctcttggtgaagcggggaaagttgatgaagctgaagctcttatgagaaaggtggagacacttaatgctgagaagacagccttaacgcaacctcaaaatgataaggtgttgatgcttggtcaggagaagaagatggcactctgtgaaatatgtggttcgtttcttgtggcaaatgatgctgcagaaaggactcagtctcatgtcacaggaaagcagcatgttggttatggaatggttcgcgacttcataaatgagtttaagactgctaaggagaaagctaatgaagaggaaagattagctcgggaaagagaggcagaagaacggaggaaacagagggagaaggagtccgagagaaggagacgaagtgattcaagtgacagggataggcatcgtgataaagatcacaatagggagcgggataggtatagagatagagactcagatcgtgaaaggtctcgggagcatgatgttagaggttatcgagatggaggaaggggggtggattatagggcgagaaatggaagaaatggaggtagagacaggtaccgtgatcggagcaggtcacgctcccctggtaagcatagccacagaaggtcttcttgaagtccagtttgctcaaattagtggaatttcttgatagatgtcagaatttaattttaaaaaggtagtctttaatatcccaagacttacataaaatgtgcttttggagagttttttttgtcaccttcaagggtgaatttactcttttcccatctcagagctttgttgagactatacaatctccctttcatcaatattattaatggagaaaggggttgaggtaggtatttcactgttgtaacttttcttacaatttgttttgcaccttgatttaagtgatttatgacgattcatctctgaagcattgtgtgtagtctttcttttctcccatttctggaaatcaattgattgatttaagatgtccgacacaaaattacatgaatgattgtcattgctgctgagggggatggttttctcttgtattgaggtttaaaaaaatgctgcttattctgacatgaatttgacattgaactgcattccgaaggcaccagtttagaggatataggcacactaaaatgtccttgtgatctttgttggcttgattgtttctggaggtgatatgtgcaggaaaacaatcgtcgcctcttgttattagaagcgaggcaaaatgaaaattaagccttttcttttgatatcaggagaaagcgttgtgtttttatcattcgaaatgacagtcaaattcaaatccttgatgaactaagactggtcatacatactttgaacatgcgatccttaaagattgtaatgattcaaggaaataaaatgagcgatttttggagctttgcatgtt

SEQ ID NO: 6182 - DNA, 2537 bp, Cajanus cajan
gatttaactagaagaactagtgttcacacggtaccacaaaccctaccctctataaaccaatttcccaatcctttcttctcaactctttcattccaatttcgagaggaattcatttgaattagggtttcccagcatggacgctcagagagctcttctcgacgaactcatgggtgcagcgcgcaacttgacggaggaagagagaaaggggtacaaggaagtgtcgtgggacgataaggaagtgtgtggattctacatggtgcgcttttgccctcacgatctcttcgtcaacacgcgcagtgatctcggaccttgcccgagaattcatgacccaaagttgaaagaaagttttgagaaatcaccaagacatgatgcatatgtacccaaatttgaagctgaacttgctcaattttgtgagaaattggtgatggacttggatagaagggtaagacgtgggcgggaacgtcttgctcaagaggtagagccagcaccaccaccaccactgacagctgaaaaatctgagcagttatctgttctggaggagaaaatcaagaatctgctggaacaagttgaatctcttggtgaagctgggaaggttgatgaagctgaagctcttatgagaaaggtagagacacttaatgctgagaagacagccttaacacaacctcaaaatgacaaggtgttgatccttggtcaggagaagaagatggcactctgtgaaatatgtggttcttttcttgttgcaaatgatgctgcagaaaggactcagtctcatgttacaggaaagcaacatgttggttatggcatggttcgtgacttcataaatgagtttaagactgctaaagagaaagctaacgaagaggaaagaacagctcgggaaagagaggcagaggaacggaggaaacagagggagaaggaccatgagagaaggagacgaagtgattcaagtgatagggagaggcatcgtgataaagatcacaatagggaacgggataggtatagagatagagactcagaccgtgaaaggtctcgggagcatgatgttagaggttatcgagatgggggaaggggggtggattataggatgaggaatggaagaaacggaggtagagacaggtaccgtgatcggagcaggtcacgctcccctgttaagcatggctacagaaggtcttcttgaagtccagtttgctcaaattagtggaatttcgtgatagatgtcagaatttgaatttaaaagaggtagtctttaatatcccaagacttgcataaatatgagcttttggagtcttgagtttttttttttccatcaagggtgaatttactcttttcccatctcagagctttgttgagactatacaatctccctttcatcaatattattaatggagaaaagggttgaggtaggtatttcactgttgtaacttttcttacaatttgttttgcaccttgatttaagttatttatgatgattcatctctgaagcattgtgtgtagtctttcttttccctcatttctggaaatcaattgattgatttaagatgtcagacacaaaattacatgaatgattgtcattgctgccgagggggatggtttactcttgtattgaggtaacatgtgaatcttataccttgagacaaatagattgatatttgttcagcatagaaatttttgttttcttttcccttttcttttttgtttcattacatttgtttcttaaggtggtataaaccaacacaggtttaaaaaaaatgctgcttattctgacatgaatttgacattgaactacattccgaaggcaccagtttagaagatataggtaaacttgctgaatctgttgttagttatctcccaaatccatggcatcatatttataatatatatggtgtgtgatatcatccgatatgatcatatattgaatggagaactaatttttattccctactttcctgatgccattcttaatatgggtttccgatggggaaaaagtgctcaattgggaactggtttggaatggtaattacaggatgatgacgtatcatcctctataaaaatatttgatttacataagtgttgtttgaattgaaaattcaaagggctggcaaatacaaggatttggttgtctttgccgagtgattcgattgcagaattattgacatttgtatgaaatacattcgttgaactgggatgcagaatgtctcctttcatgaacaaactttctacctttattgtctgggtgactggaggtaattggctctcatcatatcaacgtttaatttggtgttcaggaacacaaatatccttgtgatctttgatggctagattgtttggtgtgcaggaaaacaatcgcctcttgttataagaaaattttgcttattcttttgatatatggagaaagcgatgtgctttttactgttcaaaatggcactcaaatctttgatgaacatacattgaacatgcgttcttaattcttgtaaaggttcaaggaaataaaatgagcgatttttggagcaataacccagttttgcaataaataaaaaaaa

SEQ ID NO: 6183 - DNA, 2787 bp, Glycine max
aaaagtggtaactgtccatttaaccagtgttcacggcacccacaaaccctaccctataaaccaaattcgcaatcccgtgttatctacacttcccttcccattcctttcaatttggagaggaattcatttgaattagggtttctcttttcctttgtttcattatggacgctcagagggctttactcgacgaactcatgggtgcagcgcgcaacttgacggaggaagagagaaaggggtacaaggaagtgagttgggacgataaggaagtgtgtggattctacatggtgcgcttttgccctcacgatctcttcgtcaacacgcgcagtgatctcggaccttgcccgagaatacatgacccgaagttgaaagaaagtttcgagaaatctccaagacacgatgcatatgtaccgaaatttgaagctgaactttctcaattttgtgagaaattggtgatggacttggacagaagagtaagacgtgggcgagaacgtcttgctcaagaggtagagccagcaccaccaccaccgctgacagccgaaaaatctgagcagctatctgtgctggaggagaaaataaagaaccttctggaacaagttgaatctcttggcgaagcagggaaggttgatgaagctgaagctcttatgagaaaggtggagacacttaatgctgagaagacagccttaacgcaacctcaaaatgataagctgttgatgcttggtcaggagaagaagatggcactctgtgaaatatgtggttcttttcttgtggcaaatgatgctgcagaaaggactcagtctcatgtcacaggaaagcagcatgttggttatggaatggttcgcgacttcataaatgagtttaagactgctaaggagaaagctaatgaagaggaaagattagctcgggaaagagaggtggaagaacggaggaaacagagggagaaggagtctgagaggagacgaagtgattcaagtgatagggataggcatcgtgataaagatcacaatagggagagggataggtatagagatagagactcagatcgtgaaaggtctcgggagcatgatgttagaggttatcgagatgggggaagggggatggattatagggtgagaaatggaggtagagacaggtaccgtgatcggagcaggtcacgctcccctgttaagcatagccacagaaggtcttcttgaagtccaatttgctcaaattagtggaatttcttgatagatgtcagaattttattaaaaaaaaggtagtatttaatatcccaagacttacataaatgtgcttttggagagtttttttgtcatcatcaagggtgaatttactcttttcccatctcagagctttgttgagactatacaatctccctttcgtcaatattattaatggagaaaagggttgaggtaggtatttcactgttgtaatttttcttacgatttgttttgcaccttgatacaagtgatttatgacgattcatctctgaagccttgtgtgtagtctttcttttctcccatttctggaaatcaattgattgatttaagatgtccggcacaaaattacatgaatgattgtcattgctgctgagggggatggttttctcttgtattgaggtaacatgtgaatcttataccctagacaaatagattgatatttgtttgttcggcatacaaatgtttgttttgtttccccttttcttttttgtttcattgcctttgtgtcttaagttgacataaaccaacacaggtttaaaaaaatgctgcttattctgacatgaatttgacattgaactgcattccgaaagcaccggtttagaggatataggtaaacttactgaatttgttgtcagttatcttccaaatccatggcatcatatctgttatatatttggtgtgatatcatccgatatgatcttatcctggttagagaattattttttattccctagtttcctgaatcctgatgtcattcttaacacgctttctgatggggaaaaagattagtatgttgtccagtataagtaagcaattgttaactggtttggattttggaatggtaattagagaatggtgaatcatcctctataaaagtaatattttatttactgagtgtttgaatagaaaattgaaaggaccggcaaatacagggatgtagttgtctttgccggatttgatcactagaattattgacatttgcatgaaaaactttcgttgaactgggttgcagaatgtcttctttcatgaacaaacgttcctacctttattgtctgggtgattagaggtaaatgtctcatctggataaaagagcatttaatttggtgttcaggaacacaaaatgtctttgtgatctttgttggctagattgtttctggaggtgatatgtgcaggaaaacaatcgtcgcctcttgttattataagaaacgaggcaagatgaaaattaagccttttcttttgatatcaggagaaagcgttgtgcttttattattcgaaatgacagtcaaatacttgatgaactaggactgctggttatacatactttgaacatgcgatcttaaagattgtaatgattctaggaaataaaatgagctacttttggagctttggatttttattttgttttcatgttattctccactctcttcctctcctgcttaaactttttttgttttgttactattgtaagacatggaatgatttatcaaaacacatgtgaaaatgaagatagattccttttttttcatcggaattgccttgcgacaaatatggtgatagactcgatgggtttgat

SEQ ID NO: 6184 - DNA, 1901 bp, Glycine max
tgttcacggcacccacaaaccctaccctataaaccaaattcgcaatcccgtgttatctacacttcccttcccattcctttcaatttggagaggaattcatttgaattagggtttctcttttcctttgtttcattatggacgctcagagggctttactcgacgaactcatgggtgcagcgcgcaacttgacggaggaagagagaaaggggtacaaggaagtgagttgggacgataaggaagtgtgtggattctacatggtgcgcttttgccctcacgatctcttcgtcaacacgcgcagtgatctcggaccttgcccgagaatacatgacccgaagttgaaagaaagtttcgagaaatctccaagacacgatgcatatgtaccgaaatttgaagctgaactttctcaattttgtgagaaattggtgatggacttggacagaagagtaagacgtgggcgagaacgtcttgctcaagaggtagagccagcaccaccaccaccgctgacagccgaaaaatctgagcagctatctgtgctggaggagaaaataaagaaccttctggaacaagttgaatctcttggcgaagcagggaaggttgatgaagctgaagctcttatgagaaaggtggagacacttaatgctgagaagacagccttaacgcaacctcaaaatgataagctgttgatgcttggtcaggagaagaagatggcactctgtgaaatatgtggttcttttcttgtggcaaatgatgctgcagaaaggactcagtctcatgtcacaggaaagcagcatgttggttatggaatggttcgcgacttcataaatgagtttaagactgctaaggagaaagctaatgaagaggaaagattagctcgggaaagagaggtggaagaacggaggaaacagagggagaaggagtctgagaggagacgaagtgattcaagtgatagggataggcatcgtgataaagatcacaatagggagagggataggtatagagatagagactcagatcgtgaaaggtctcgggagcatgatgttagaggttatcgagatgggggaagggggatggattatagggtgagaaatggaggtagagacaggtaccgtgatcggagcaggtcacgctcccctgttaagcatagccacagaaggtcttcttgaagtccaatttgctcaaattagtggaatttcttgatagatgtcagaattttattaaaaaaaaggtagtatttaatatcccaagacttacataaatgtgcttttggagagtttttttgtcatcatcaagggtgaatttactcttttcccatctcagagctttgttgagactatacaatctccctttcgtcaatattattaatggagaaaagggttgagccttgtgtgtagtctttcttttctcccatttctggaaatcaattgattgatttaagatgtccggcacaaaattacatgaatgattgtcattgctgctgagggggatggttttctcttgtattgaggtttaaaaaaatgctgcttattctgacatgaatttgacattgaactgcattccgaaagcaccggtttagaggatatagaatgtcttctttcatgaacaaacgttcctacctttattgtctgggtgattagaggagaaagcgttgtgcttttattattcgaaatgacagtcaaatacttgatgaactaggactgctggttatacatactttgaacatgcgatcttaaagattgtaatgattctaggaaataaaatgagctacttttggagctttggatttttattttgttttcatgttattctccactctcttcctctcctgcttaaactttttttgttttgttactattgtaagacatggaatgatttatcaaaacacatgtgaaaatgaagataga

SEQ ID NO: 6185 - DNA, 1579 bp, Arachis hypogaea
ccaaccctaacaatttccccaatcggccaatctttctctgctcatctacagagagtcatccttcgtttgggattcggattagggtttcccaatcgccactttctcactcatcttgcagccatggatgctcagagagctcttcttgacgaactcatgggttcagctcgcaacttgacggaggaagagaggaaaggatacaaagaagtgacgtgggacgataaggaagtgtgtggattctacatggtgcggttttgccctcacgatctctttgtcaacactcgcagcgatcttggaccttgcccaagaatacatgatccgaagttgaaagaaagctttgagaattccccaagacatgatgcattcgtacccaaatttgaagctgaccttgctcagttctgtgagaaattggtaatggacttggatagaagagtaagacgtgggcgagaacgtcttgctcaagaggtggagccagcaccagcgcctccattgacaactgaaaagtctgaacagctatccgtgctggaggagaagataaagaatcttctggaacaagttgaatctttaggtgaagctgggaaggttgatgaagctgaagctcttatgaggaaggtggatgcactcaatgttgagaaaacggcattaacacagcctcaaaatgataaggtgttgatgcttggtcaggagaagaagatggcactatgtgagatatgtggttcttttcttgtggcaaatgatgctgcagaaaggactcagtcccatattactgggaagcaacatgttggttatggcatggttcgcgatttcatatccgaatacaaggctgccaaagagaaggctgttgaagaagaaagattagcccgggaaaaagaggcagaagagcgaaggaaacagagggagaaggatcatgagagaagacgacgaagtgattcaagtgatagggacaggcatcgggataaagatcgagatagggacagggataggtacagagatagagacctagatcgtgaaaggtctcgggagctggatggtagaggtaatcgagatgggggaaggggcatggattctaggttgaggaatggaagaaatggaggcagagacaggtaccgcaacaaaagcaggtcacgctcccccgttaggcacaactacaggcggcactcctgaaatctggtttctcaaatttggggaatttcttgatagatgtcggaatttgaattaaaaagaggtagatcttaatatcccaagacttagataaatatgtgttttggagtcctgagttttctcatcatcaagggtgaatttattttgtttcttatgtcagagctttgttgagactatacaatctcccttccatcaatattatttatggagaaaaaagggttgaggtaggtattttactgttgtaatttttcctcttgcatgactgatctctgaaagtgtagtccagtctttctttactcgcattttctagaagtcatttgatcggtttaaaatgtcagacacaaattacatgcatggttgtcattgctgctggagggggattggttttctcattgtttgaggtaacctgtgaatcttatat

SEQ ID NO: 6186 - DNA, 1834 bp, Arachis hypogaea
aaccctaacaatttccccaatcggccaatctttctctgctcatctacagagagtcatccttcgtttgggattcggattagggtttcccaatcaccacctttctcactcatcttgcagccatggatgctcagagagctcttcttgacgaactcatgggttcagctcgcaacttgacggaggaagagaggaaaggatacaaagaagtgacgtgggacgataaggaagtgtgtggattctacatggtgcggttttgccctcatgatctctttgtcaacacccgcagcgatcttggaccttgcccaagaatacatgatccgaagttgaaagaaagctttgagaattccccaagacatgatgcattcgtacccaaatttgaagctgaccttgctcagttctgtgagaaattggtaatggacttggatagaagagtaagacgtgggcgagaacgccttgctcaagaggtggagccagcaccagcgcctccattgactactgaaaagtctgaacagctatcggtgctggaggagaagataaagaatcttctggaacaagttgaatctttaggtgaagctgggaaggttgatgaagctgaagctcttatgaggaaggtggatgcactcaatgttgagaaaacggcattaacacagcctcaaaatgataaggtgttgatgcttggtcaggaaaagaagatggcactctgtgagatatgtggttcttttcttgtggcaaatgatgctgcggaaaggactcagtcccatattactgggaagcaacatgttggttatggcatggttcgcgatttcatatccgaatacaaggctgccaaagagaaggccgttgaagaagaaagattagctcgggaaaaagaggcagaagagcgaaggaaacagagggagaaggatcatgagagaagacgacgaagtgattcaagtgatagggacaggcatcgggataaagatcgagatagggacagggataggtacagagatagagacctagatcgtgaaaggtctcgggagctggatggtagaggtaatcgagatgggggaaggggcatggattctaggttgaggaatggaagaaatggaggcagagacaggtaccgcaacaaaagcaggtcacgctcccccgttaggcacaactacaggcggcactcctgaaatctggtttctcaaatttggggaatttcttgatagatgtcggaatttgaattaaaaagaggtagatcttaatatcccaagacttagataaatatgtgttttggagtcctgagttttctcatcatcaagggtgaatttattttgtttcttatgtcagagctttgttgagactatacaatctcccttccatcaatattatttatggagaaaaaagggttgaggtaggtattttactgttgtaattttttcctcttgcatgattgaactctgaaagtgtagtccagtctttcctaaatatatctgtcatggttgagagaggtatattgggtttgaaattgcagcagaaccatttgagagccctccatttcccttagctgcagagagaacaagaagaaaagaccctcttgatggcttctatcattctctacagaacaagaatctcttacttcattaaggatgcaattccattgagccagcaattggaacactacaaagaatgtcagaatatattggtggaagtagcaggacaatcaaatgcttcatcaatcatatctggtgctacacatcttgttagtgctggcaacagtgacttcattcagaattattacataaaccctctgcttaacaaggtttacactgctgatcagttctctgaaattctcatgcaacactat

SEQ ID NO: 6187 - DNA, 1806 bp, Lotus japonicus
aaagttaaagttccacgcaatagaattgtccaaactccaaagccttcacgtctgaaaccctagctacaaatttcgtaatccttgtcaattcccattcactcaccatcttctccattctcatctcatagccatggacgctcagagagctttgcttgacgaactcatgggatcagctcgtaacttgacggaggaagagaggaagggtttcaaggaagtctcctgggacgacaaggaagtgtgtggattctacatggttcggttttgccctcatgatctcttcgtcaacacccgaagtgatttgggaccttgcccgagaatacatgaccagaaattgaaagaaagttttgaaaaatccccaagacatgatgcatttgtacccaaatttgaggctgaacttgctcagttttgtgagaaattggtgatggacttggatagaaaagtaagacgtgggcgagaacgtctttctcaagaggtggagccaccaccaccaccacctctgacagctgaaaaatctgaacagctatctgtgctggaggagaaaataaagaaccttctggaacaagttgaatctcttggtgaagctgggaaagttgatgaagctgaagctctaatgagaaaggtggatacacttaatactgagaagacagccttgacacaacctcaaaatgagaagttaatgcaagcgcaggagaagaaaatggcactttgtgagatctgtggttcctttcttgtggcaaatgatgctgcagagaggactcagtctcatgtcacaggaaagcagcatgttggttatggcatggttcgcgacttcataagtgagtttcagactgctaaggagaaagctattgaagaagagagattagctcgggaaagagaggcagaagagcgaagaaaacggaaggagcaggagtatgagagaaagagacgaggtgattcaagtgatagggagaagcatcgtgataaggatcgagatagggagcgggataggtatagagatagagactcagaccgtgaaaggtctcgggagcgtgatgttagaggttatcgagatggtggaaggggggtggactctagattgggaaatagaagaaatggaggcagggacaggtaccgtgatcggagcaggtctcgctccccagttaagaacagctacagaaggtcttgaaatccagtctgctcatatagtggaatttcatgatagatatcagaatttgaatttaaaagagagctttgttgagactgtacaatctccccttggtcaatattatttatggagaaatgggttgaggtaggtatttcactgttgtaacttttcatacaatttgttttgcaccatgatttaagatatttatgatgatcatttctgaaacattttgcgtagtctttctttacttgcattttctgggaaatcatttgattgattaaagatgtcagacacaaaattacatgaatgattatcatggccgctgaggggatggttttctcttattttgaggtaacatgtgaatctcataccctgagacgaatagactgatatttattcatcatagaaatgcttgctttgtttgcccttcttttgtgttcatcccttctgtttctcaagctgatacaaaccagcacaggtttaaaaaggctgcttttctgacattcatttgacattgaactacattccaaaggcaccagtttagaagatataggtaaacatacttaatctgttcacaaatcaattgcataatattacaacatatttggtgtatgacattcaatatggtaatactgaatgcaaattcaattctttattttcta

SEQ ID NO: 6188 - DNA, 1432 bp, Lupinus angustifolius
tacatttcacactcttctcattcattccacttttatcaaattcgaaaggaattagggttttctcgtaaccgccatggacgctcagagagctcttctggatgaactcatgggtgcagctcggaacttgacggatgaagagagaaagggatacaaggaagtgaattgggatgataaggaagtgtgtggttcctacatggttcgcttttgccctcacgatctattcgtcaacacacgcagtgatctaggaccttgcccaagaatacatgatcagaagttgaaagaaagctttgagaaatccccaagacatgatgcatttgtccccaaatttgaagctgaacttgctcagttttgtgagaaattggtgatggacttggatagaagagtaaaacgtgggcgagaacgtcttgctcaagaggtggagcctgcaccaccccctccactaacagctgaaaagtctgaacagctatctgtgctggaggagaaaataaagaaccttctggaacaagttgaatctctgggtgaagcggggaaggttgatgaagctgaagcacttatgagaaaggtggagacgcttaatgctgagaagacagccttaacacaacctcaaaatgaaaagttgctgatgcttgctcaggagaagaagatggcactctgtgagatatgtggttcttttcttgtggcgaatgatgctgcagaaagaactcagtctcatataacagggaagcagcatgttggctatggcatggttcgtgacttcataaaggagtacaaggatgctaaagagaaggctactgaagaagaaagattagttcgtgaaagagaggcagaagatcgaaggaaacagaaggagaaagagtctgagagaagacggcgaagtgattcaagtgacagggaaaggctacgtgatagagatcgggagcgagataggtacagagacagacactcagaccgtgcaaggtctcgcgatcgagatgggggaagaggagcggattctagaatgaggaatggaagaaatggaggcagagacaggtaccgtgatcggagcaggtcacgctcccctgttaggcacagccacaggaggcattcatgaagtccttcaattagtggaatttcttgatatatgtcagggatttgaatttgaatgagagctttgttgagactatacaatctccttttgaccaatattattgatggagaaaaaaaggattgagacacaatttcatgcatgattgtcattgctgctgaggggatgggtttctcttgttatgagggttaaaaatgcggcttattctcacattcatttgacattgaactgcgtttggaagggtaccagtttagaagatatgggtaaattttctgaatctgttattaattttctcccaatttcatggcatggtccttatatttcgtgtatgatatcatatcagatgat

SEQ ID NO: 6189 - DNA, 1536 bp, Quercus alba
acacacagctcacttttcttttgtccctcaaatactactactctccctctccctctcacacacaaacacctaacctaacaagcccccaaacccaaacaccacaaaatccccaaattctcaagaaaaccctaaattgcaattcacatcaaaatctctcacttcagattactcccttagccatggacgctcaacgagctctgctagacgagcttatgggcgcagctcggaatttgacggaggaagagagaaaagggtacaaggaaattacttgggacgataaggaggtttgtgctttctatatggttcggttttgtccgcatgatctcttcgtcaatacgaggagcgatctgggaccatgccctagaatacatgatcagaagttgaaagaaagttttgagcagtctccaagacatgacaagtacgtgccgagatttgaagctgagctttctcagttttgtgaaaagttggtgacagacttggatagaagagttaggcgtgggcgagagcgccttgctcaggaggtggaacccactccaccacctccactatcagccgaaaaatctgaacagttatccgtagtggaagaaaaaataaagaatctactggaacaagtggagacccttggtgaagctgggaaggtggatgaagctgaagcactcatgagaaaggtggagttgcttaatgttgagaagacagccttgactcaacaaccccagactgataaagtgttaatgctagcacaggagaaaaagatggctctgtgtgagatatgtggttcttttcttgtagcaaatgatgctgctgagaggacccagtctcatgtcacagggaagcagcacattggttatggcatggtccgggatttcatagcagagtacaaggcagctagagagaaggctagggaagaggaaagattagccaaggagaaagaagcagaagaacggaagaagcaaagagagaaggaatctgaaaggaggaggagaagtgattctggtgacagggacagggacagggacaggtatcatgatcgtgatagagacagagagcgggatagacaccgagaacgtgataggtctagagactggaatgctcgaggtagtcgggatggagggagaggagtggattggaggttgaggaacggaagagaaggtggcagagataggtaccgtgatcgaagcaggtcacgttcccctgttagacatggtcactgaagggcacctagaagtccagttcgcccatattagtggattatttcgatagatgtctgaacatgtgtttgaggtagatttttatcctggaaacttttatgaacatgtgtttggagtcctgagttatttttttcatcacgggtgaaacttttttttcctatctcacagctttgttgagactataccatctccctttcatcaatattattaatggagaaaagggttgaggtaggtacaacttcattgttgtaactcttttaaatctaatttaggctttggtggaattcttttttatgcatcgtctctgaaacattgttttcagagcctc

SEQ ID NO: 6190 - DNA, 1330 bp, Castanea mollissima
tggacgctcaacgagctctgctagacgagcttatgggcgcagctcggaatttgacggaggaagaaagaaaagggtacaaggaaattacttgggacgataaggaggtttgtgctttctatatggttcggttttgtccgcatgatctcttcgtcaatacgaggagcgatctgggaccatgccctagaatacatgatcagaagttgaaagaaagttttgagcagtctccaagacatgacaagtacgtgccaagatttgaagctgagctttctcagttttgtgaaaaattggtgacggacttggatagaagagttaggcgtgggcgagagcggcttgctcaggaggtggaacccactccaccacctccactatcagccgaaaaatctgaacagttatccgtagtggaagaaaaaataaagaatctgctggaacaagtggagacccttggtgaagctgggaaggtggatgaagctgaagcactcatgagaaaggtggagttgcttaatattgagaagacagccttgactcaacaaccccagactgataaagtgttaatgctagcacaggagaaaaagatggctctgtgtgagatatgtggttcttttcttgtagcaaatgatgctgctgagaggacccagtctcatgtcacagggaagcagcacattggttatggcatggtccgggatttcatagcacagtacaaggaagctagagagaaggctagggaagaggaaagattagccaaggagaaagaagcagaagaacggaagaagcaaagagagaaggaatctgaaaggaggaggagaagtgattctggtgacagggacagggacagggacaggtatcatgatcgtgatagagacagagagagggatagacaccgagaacgtgataggtctagagactggaatgctcgaggtagtcgggatggagggagaggagtggattggaggttgaggaacggaagagaaggtggcagggataggtaccgtgatcgaagcaggtcacgctcccctattagacatggtcactgaagggcacctagaagtccagttcgcccatattagtggattgtttcgatagatgtctgaacatgtgtttgaggtagatttttatcctggaaacttttatgaacatgtgtttggagtcctgagtttttttttcatcatgggtgaaacttttttttcctatctcacagctttgttgagactataccatctccctttcatcaatattattaatggagaaaagggttgaggtaggtacaacttcattgttgtaactcttttaaatctaatttaggctttggtggaattcttttttatgcatcgtc

SEQ ID NO: 6191 - DNA, 2816 bp, Cicer arietinum
gtttttactagtttttgtttttcaggtaatagcttccttcacgcaccaaaccataccacaccacaccacaccacaccacaaaccctagacacaaaattctcaataattctctactcatccatcttccttacattaatcggaattagggttttactcctcatccaattcttccaatctcatctcgtagctatggatgctcagagagctctcctcgacgaactcatgggttcagctcggaacttgacggaggaagagagaaggggttacaaggaagtgagttgggatgataaagaagtttgtggattctatatggtgcggttttgtcctcacgatctcttcgtcaatacgcgtagtgatctcggaccatgtccaaaaatacatgacccgaagttaaaagaaagttttgagaaatctccaagacatgatgcgtacgtacccaaatttgaagctgaacttgctcaattttgtgagaaattggtgatggacttggatagaagagtaaaacgtggacgagaacgtcttaatcaagaggtagagctaccgccgccgccaccactgacagctgaaaaatctgaacagctgtctgtgctggaggagaaaataaagaaccttctggaacaagttgaatctcttggtgaagctgggaaggttgatgaagctgaggctcttatgagaaaggtggagacacttaatacagagaaggcagccttaacacaacctcaaaatgataaagtattaatgcttcaggagaagaagatggcactctgcgaggtatgtggatcttttctggtggcaaatgatgctgcagaaagaactcagtctcatgtcgcaggaaagcagcatgttggctatggcatggttcgtgacttcataaatgaatacaaggctgctaaggagaaggctattgaagaagaaagattggctcgggatagagacacagaagagggaagaaaacagagggagaaggatgatgggcgaaagagacgcagtgattcaagtgatagggagaaatatcgtgataaagatcgtgatagggaacgtgataggtacagaggtagagactctgatcgtgaaagatctcgggagtatgaagttagaggtaatcgagatcgagtaagggggatggattctaggttgaggaatggaaaaaatggaggcagagacaggtaccgcaatcggagcagatcatattcccctgttaggcataaccacagaaggtcttaaagtccagtttgctccaaatagtgaaatttctttatagatatcagaatttaaatttaaaagaggtagaccttaatatcccaagacttacataaatatgtgcttttagagtcttgagttttctcattatctagggtgaatttacccttttctcatctcagagctttgttgagactatacaatctccctttcatcaatattattaacggagaaaagggttgaggtaggtatttccctgttgtaacttttctcaaattgttttgcgtcttgatttgaagttatttattattataattcatctcaaaattgtgtagtctttctttacctgcattttctggatatcgtttgattgagtaaagatgtcagacacaaaattacatgagtgattgtcattgctgcaaaaggggatggtttactctttttttgaggtaacatgtgaaacttattaccctgagacaaatagattgatatttgtttgcccttttcttgtctgtttcattacttttgtttcttaagttgatatataaaccagcacaggtttataaatgctgcttattctgacatgcatttgacattgaactacactgaaggcaccagtttagaagatataggtaaacttactgaatttgttgttagaaatttcccaaatccattcgtatttataatataatgggttgatattttagatatgggtttccgttgggggaaatatgagtgcatgttgtccacccctgactaacaagtaagcagttttacttgagtttgtacaattgggattggtttggaatgctgactacagaatggtcaattacatcatctacgaaaatggaacttgatttacaaaatgctatttgaattgaaaattcgtagtactagcaaatacaggtatttggctgtttgccaagttattctatagcagaaatagtcatttgcttgaaaaaatgtcattgaactgcgtcttgggatgcttctttttgttttgtgaacaaatcagttattgtctggacgaggaggtaattggctctgatatttgttaaagagtgttaaatttgttgttcaggaacacaaatgtcattgtgatatttaatggctagatagcgcttctggacatgccatttgcaggaagataaccgcctcttgatgggagaaacgacacaatgaaaacttggtgtgtttggataaccttaaaattacggtgaaaaatcatggtgagtcaaaagctacacattgtagctgtagcttttaaaattcactgagatacactccaaactcaatgtgagatacacattgtagctgtagcttttaaaaatcaccgagatacactccaccactaaacaatgttacattagtcaactggcagtcaaacttttggtaaatcttagtagtggtcatatgttctcggaaattcagtcataatgattgtaaatgcagcagtggtcatatgttctcgaaaataaaaatgagcggatttgaaatggtaacctgtcgatttccttttcttgttgttgtcaagtttcctcctttggtgtttgagcccttatattttaagggagttaataagtaaaggcgtatctgaaacgacggttaaattggat

SEQ ID NO: 6192 - DNA, 1323 bp, Prunus persica
gtctttctcagattgttctagtccttccttggtgggcaaaaccctagatggcctaaaaagcaataggaccaatttcaccgcccagtcctcaccaccctcactgattcctctggtgcaaacccttctgaatttattctctccaacccacaccagtctaattgttatctttcttaatttcaaatcaccacttcgccatagtcatggacgctcagagagctctgctagatgaacttatgggcgcagctcgtaacttgacggaggaagagagaaaggggtacaaggaaattacttgggatgataaggaggtctgtggagcctatatggttcgattttgtcctcacgatctgttcatcaatacccgaagtgatctaggcccctgccctaaaattcatgacccaaagttgaaagaaagttttgaggagtccccaaggcatgatgcatatgtgcccaagtttgaagctgaactagctcagttttgtgagaaattggtgatggatttagatagaagagtaaagcgtgggcgagaacgccttgctcaggaggttgaacctgcaccggcacctccactgtcagcagaaaagtctgaacagttatctgttctggaggaaaagataaagaacttgctggaacaagttgagacccttggtgaagctggaaaggtggatgaagctgaagcactcatgagaaaggtggatatgcttaattctgagaagacagccttggctcaacaccctcagaatgataaagtgttgatgcttgcacaggagaaaaaaatggcactctgcgagatatgtggttcatttcttgtggccaatgatgctttagagaggactcagtctcatgttacagggaagcagcatattggttatggcatggtccgagattttatcactgagtacaaggaaactaaggagaaggcaagagaagaagaaaggttagcaagggagaaagaagcagaagaacggaggaaacagagggagaaggaaaatgagagtagaaggagaagtaattcaagtgatagggacaggtatcgtgatagggatcgtgacagggagcgggacagatatcgagaacgcgattcagatcgtgaaaggtctagagagtggaatggcagaggtagtcgggatggagggagaggggcggattggaggtccaggaatggaagagatgggggcagggataggtaccgtgatcgaagcaggtcacgttcccctgttagacatagtcacaggaggtcacctagaagtccagttcgcccatattaatgaattgtgtagatagatgtctgagctttgaaattttttgaggtagattttcatatct

SEQ ID NO: 6193 - DNA, 2514 bp, Trigonella foenum-graecum
ggctttctttcactcacgcaatcgcttgattaattcccatcgcaccgcatagcacaataacaaacaaaccctagatacaaaattcattagttaattctctatactcatcaaattcgatttgaattctctttgctatggacgctcagagagctctcctcgacgaactcatgggttcagctcgaaacttgacggaggaagagaggagaggttacaaagaagtgagttgggacgataaagaagtttgtggattctatatggttcgcttttgtcctcacgatctcttcgtcaatacccgcagtgatctcggagcttgccccaaaatacatgaccccaagttgaaagaaaattttgagaactccccaagacatgatgcgtatgtacccaaattcgaagccgatcttgctcaattttgtgagaaattggtgatggacttggatagaagagtaaaacgtggacgagaacgtcttaatcaagaggtggagctaccaccgccgccaccactgacagctgaaaaatctgaactgttgtctgtcctggaggagaaaataaagaaccttctggaacaagttgaatctcttggtgaagctgggaaggttgatgaagctgaagctcttatgagaaaggtggagacacttaatactgagaaggcagtcttaacacagcctcaaaatgaaaaagtgttgctgcttcaggagaagaagatggcactttgtgaggtatgtggttcttttcttgtagcaaatgatgctgcagaaagaactcagtctcatgtcgcaggaaaacagcatgttggctatggtatggttcgtgacttcataaatgaatacaagactgctaaggagaaggctaaggaagaagaaagattgactcgggaaaaagaggtagaagagcgaaggaaacagaaggagaaggataccgagagaaagagacggagtgattcaagtgatagggataaatatcgtgataaagatcgagatagggagcgtgttaggtacagagatagagactcggatcgtgaaagatctcgggaatatgaagttagaggtaatcgagatcggggaaggggggtggattctaggttgaggaacggaaacaatggaagcagagacaggtaccacaatcggagcagatcacgttcccctgttaagcataactacagaaggtcttgaagtcgtgtttgctccaagtagtggaatttctcgatagatgtcagaatttaaattcaaaagaggtagaccttaatatcccaagacttacataaatatgtgcttttggagtcttaagttttctcatcatcaagggtaaatttacctttttcccatatcagagttttcttgagagtatacaatctccctttcatcaatattattaatggagaaaaggattgaggtaggcatttcactgttgtaacttttctcataaattggtttgcgtcttaattttaagttatttatgataattcatctcaaacattgtgtgtagtctttctttacctacattttctggaaatcatttgattgagtaaagatgtcagacacaaaattacatgagtgattgtcattgccgcaaaaggggatggtttactcttgttttgaggtaacatgtgaaacttattaccttgaaacaaagattggtatttgttcatagaaagtttttgtttgcccttttcgtctgtttcattacttttgtttcttaagttgatataaacaagcacaggtttataaatgctgcgtattctgacatgcatttgacattgaactacactctgaagacaccggtttagaagatataggtaatcttactgattttgttagacatttccgaaatgcatggtgttcatatttataaattttattgggggaaaagatgagagcatgttgtgacctcacaactaagcagttttactttgagtttgtccaatcggtaactcgtgtggaatggtgattacagaatggtgagttacctcatccgtaaaaaacaaaaacttgatttgcaaaatgctgtttgaattaaacatttataggactggaaaaacaggtatttggctctttgccaagttaatttatatcagaaatattgtcatttgcatgaaatattgtctgtgtgattgaaggtaattggctctcatatcttttggagtgttaaatttggtgttcaggaacacaaatgtcgttgtgaattgtgatatttaattgctagatagcttctggacgtgatatgtgcaggtaaataacagactcgtgatgggagaaacaacacaatgaaaatttagcatattctttttacactgtgaagaaagtgatgttacattacccaactggaagtcaaacttttggtaaatcttggtatcgatcatatgcatattttggaaattcagtattaataatgattgtaaagttccacaaaaataaaaatgagcgactttgaaataattacctgcccttgcgtgatttcattttcttattatcggcaacttccattctctcttggttgataaacaagtttaactaagca

SEQ ID NO: 6194 - DNA, 2106 bp, Prunus mume
ggcccatgtcacggtcacagtgaagaaccaaattattaccagtagtaccctccacatataccaccaccaccacctccaaacttacccctttctcctctctctctctctctctctctctgtctttctcagattgttctagtccttccttggtgagcaaaaccctagatggcctaaaagcaataggaccaatttcactgcccagtcctcaccaccctcactgattcctctggtgcaaacccttctgaatttattctctccaacccaaaccagtctaattcttatctttcttaatttcaaatcaccacttcgccatagtcatggacgcacagagagctctgctagatgaacttatgggcgcagctcggaacttgacggaggaagagagaaaggggtacaaggaaattacttgggatgataaggaggtctgtggagcctatatggttcgattttgtcctcacgatctgttcataaatacccgaagtgatctaggcccctgccctaaaattcatgacccaaagttgaaagaaagttttgaggagtccccaaggcatgatgcatatgtgcccaagtttgaagctgaactagctcagttttgtgagaaattggtgatggatttagatagaagagtaaagcgtgggcgagaacgccttgctcaggaggttgaacctgcaccggcacctccactttcagcggaaaagtctgaacagttatctgttctggaggaaaagataaagaacttgctggaacaagttgagacccttggtgaagctggaaaggtggatgaagctgaagcactcatgagaaaggtggatatgcttaattctgagaagacagccttggctcaacaccctcagaatgataaagtgttaatgcttgcacaggagaaaaaaatggcactctgcgagatatgtggttcatttcttgtggccaatgatgctttagagaggactcagtctcatgttacagggaagcagcatattggttatggcatggtccgagattttatcgctgagtacaaggaaactaaggagaaggcaagagaagaagaaaggttagcaagggagaaagaagcagaagaacggaggaaacagagggagaaggaaaatgagagtagaaggagaagtaattcaagtgatagggacaggtatcgtgatagggatcgtgacagggagcgggacagatatcgagaacgtgattcagatcgtgaaaggtctagagagtggaatggcagaggtagtcgggatggagggagaggggcggattggaggtccaggaatggaagagatgtgggcagggataggtaccgtgatcgaagcaggtcacgttcccctgttagacatagtcacaggaggtcacctagaagtccagttcgcccatattaatgaattgtgtagatagatgtctgagctttgaaattttttgaggtagattttcatatctctaaggttttatgaacatgttcatttggagtcttaattaaattttcatcatgggagaaactcttttgctatctcacagccttgttgagactataccatcaatattataagcggagaaaagggttgaggtaggtattattctaatattgtaactcattttaaaattcattttagacttgaatgaggtaaatttaatttctgtatgaaacttttctgagacaattgttttcagagtctcacatccccatttgtttggaagtcattgttggctactttctgtgttgtcacatatttaagacatcagacccgaaaatgaatgcatgattgatccaccgcagctggaagatgatggtttttaatcatttttgaggtaacatatttatcatctatatgtcatcgccaaccgatacaatatttcctccctttctttcctccgtcttctatctggttttcagttttaaccactctattgcaagtggtgcttgtttgctatgtgtttaactggggagggagaagataccaatcatgagatgtggataatgtgctacatgttgctctcgaggtattttttaggggactctccatacttactagaaaatggtctgatttttcacccttgtaatggtttctaattttcaaaaggctcattagttttccctcatttcac

SEQ ID NO: 6195 - DNA, 1243 bp, Malus domestica
cttggagaacaaaaccctagaagccattgacgtgttattccgctgctcaatcctcactgattcctctgctacaagcccttctgattttcttctctctcaattccgataatcacttgacagagccatggatgctcagagagctctgctggacgaacttatgggctcagctcgtaatttgacggaggaggagagaagggggtacaaggaaattacttgggatgataaggaggtttgtggagcctatatggttcgattttgtccccacgatctcttcgttaacactcgaagcgatctaggaccttgccctaaactacatgacccaaagttgaaagaaagttttgaagagtccccgcggcatgatgcttatgtgcccaagtttgaagctgaacttgctcacttttgtgagaagttggtgatggatttagatagaagagtaaagcgtgggcgagaacgccttgctcaggaggtggaacctgcaccagcacctccactgtcagctgaaaagtccgaacagctctctgttctggaggaaaagataaagaacttactggaacaagcagaggctctaggtgaagctggaaaggtggatgaagctgaagcactgatgagaaaggtggatatgctcaattctgagaagacagcattggctcagccccagaatgataaagtgttgatgctggcacaggagaaaaaaatggcactttgtgagatctgtggttcatttctagtggccaatgatgctgtagagagaactcagtcgcatgttacggggaagcagcatattggttatggcatggttcgtgattttatcgctgagttcaaggaatccaaggagaaggcaagggaagaagaaaggttagcgagggagaaagaggcagaagaacggaggaaacagagggagaaggaagaggagaatagaaggagaagtaattcaagtgatagggacaggtaccgtgatagagatcgtgacagggagcgggacagatatcgagaacgagacttggatcgtgaaaggtcgagggagtggaatggcagaagtagtagggatggagggagaggggtggacaggaggtccaggaatggaagagatggaggcagggataggtaccatgatcgaagcaggtcacgttcccctgttaggcacagtcacaggaggtgacctagaagtcccgttcgcccgtattaatgaattgtgtagggtgatgtctgagctttgaaatttaatgaggtagtttccatatct

SEQ ID NO: 6196 - DNA, 2776 bp, Vitis vinifera
gaaaaatatttctcatcagcgaaacaggccctaattgaatcaccgcaacccgcctcgtacacacaatctctggaggctcaagtcctcgagaaccgataaaaacacataatcaccacaagtttcactgaactctccatcaattctaaaaagggtagactctagaaagaaaaagaatccccaatccataaagccctaatcttgctgcatagttagggcttgtcttctccaatactctcttttctttctcactgcttgaaaccctccatagccagcgatggacgctcagagagctcttctagacgagctcatgggtgcagcgagaaacctgacggaagaagagaaaaaagggtacaaggaggttacttgggatgataaggaggtttgtggattctatatggtgcggttttgtcctcatgatctcttcgtcaacactcgaagtgatctcggaccatgccctagaattcatgatcaaaagttgaaagaaagttttgaaaagtctccaagacatgattcatatgtgcctcgctttgaagctgagctttctcagttttgtgagaaattggttatggacttggatagaagagtgaggcgtgggcgtgaacgccttgcccaagaggtggaagcagccccacctgctccactttcactggagaaatctgagcaattatctgtgttagaggaaaaaataaagaatctgttggaacaagttgaggcccttggtgaagctggcaaggtggatgaggctgaagcactcatgaggaaggtggagatgctgaatgctgagaagacagtcttgactcaacaaccccagaatgacaaagtcctaatgcttgcacaggagaaaaagatggctctgtgtgaaacctgtggttcttttctggtagcaaatgatgctgcagagaggactcagtctcatgtcacaggaaagcagcatattggttatggcatggttcgggatttcatcactgagtacaaggaagccaaggagaaggcaagggaagaagaaagattaaagagggagaaagaagctgaagagaggagaaagcagagagagaaggaatctgagagcagaagtcgaagagctgattctggtgatagggacaggactcgtgaccgagatagagacagggagcgggatcgatacagagaacgagaacgggatcgtgaaaggcctcgagagtggaatggtagaggatacagagatggaggaagaggaacagattggaggtacagcaattccagggatggaagagatggaggcagggataggtaccgtgatcggagcaggtcacgttcccctgttaggcatagccacaggaggtcccctcaaagtccagttcggccatattagtggactgtgtagatagatatctgagctttgaaatcaagaggtagaccttcttatatctcacagttttatgaatgcgtgagttaaattgtcatcatggacacataaacttactttttgtcatctcacagctttattgagactttaccatggccctatcaccaatattgttagaggagaaagggttgaggtaggtattgtaactctttttttatgatctattgttaggctttggttgaactaaacatcttttatgagttgcttctctgaaacattgttttcagagtcttttattgggcttcttttttattgtcattgctggatacattattgtcaaatagttaagaggacagatccaaaatatatgcatcaattacagctgctgaggaggattatggtttttttctcaaatctgaggtaacacataaatctcaattatcccgacgaagcccatggattaatttccctacttatcatggactcaggttttctttctttatggcctttcagttgtcaagtgtcttcaagcaaatcgttgcttgtaaatgctgctcgatgctcttcccttaacctgcccctgtccctgcccttttttagtttatggttcttgaatgacttgagcagtgcatgtgcaatgcgcatgaattggaagttacaaaaatcaggagacatggggaatctgagggtaactaatttgccgactctatgttacttgttttacagaactggtgatagttttcaactttaaacttcatgggcagggtcaggcagtgaactatgcttcagtttgtcaagtagtacataggtaacctctctatctatgcagagggatgctcatagcttcctacccatatatctttcaaactcattttctgaagcagaaccattgtttccacatgcatgaatatctccgtggattggggtgtcgagtctcttcctgcttcaaaaaatagtaaaattgcaacagtgtggggtgcctggaggtaactaacttgatctgtagaatatgatatttctgtgtggagtttgcaggaaaggcaccaaagcaggtattttattggggcctcggtggcataaatttgtggctgataaaagtggtatttatatatatattttttatgatatgtatgaagagtgacttgtgcagggaaattaattttacaacgtaggtgctgcttggtgaattacatatgatgaacagagtagggaaattgaggaagtccttttatgtaattgaaattgacaggaacatggcatgtaatgcttgtagaaacatatgccactggtaattgaagatttttgtgcgcttctctgtctttgatctttgaattgtaacagaagtgctgattgacaatgatcctttcagcttgtataccaatctgttaggctaaagttaatgcgattgaacttaggttaattttaatcaca

SEQ ID NO: 6197 - DNA, 1687 bp, Malus domestica
tttctctctcagattctagtccttggagagcaaaaccctagaagccattgatacctatcccactgctcaatccacactggttgctccgctacaaacccttctgaatttcttctctccaaaagcccaaatcggtttctttttgttgttccccttcccaatcccaaatcatcacttgacacagccatggatgctcagagagctctgctggacgaacttatgggctcagctcgtaatttgacggaggaggagagaaaggggtacaaggaaattacttgggatgataaggaggtttgtaaagcctatatggttcgattttgtcctcacgatctcttcgttaacactcgaagcgatctaggaccttgctctaaaatacatgacccaaagttgaaagaaagttttgaagagtccccgcagcatgatgcatatgtacccaagtttgaagctgaacttgctcacttttgtgagaaattggtgatggatttggatagaagagtaaagcgtgggagagaacgccttgctcaggaggtggaacctgcgccagctcctccactgtcagctgaaaagtctgaacaactatctgttctggaggaaaagataaagaacttactggaacaagtggaggccctaggtgaagctggaaaggtcgatgaagctgaagcactcatgagaaaggtggatatgcttaattccgagaagacagccttggatcagcagccccagaatgataaagtgttgatgctggcacaggagaaaaaaatggcactctgtgagatctgtggttcatttcttgtggccaatgatgctgtagagagaactcagtctcatgttacagggaaacagcatattggttatggcatggttcgggattttatagctgagttcaaggaatctaaagagaaggcaagggaagaagaaaggttagcgagggagaaagaagcagaagaacggaggaaacagagggagaaggaacaggaggatagaaggagaagtaattcaagtgatagggacaggtatcgtgatagagatcgtgacagggagcgggacagatatcgagaacgagactcggatcatgaaaggtcgagggagtggaatggcagaggtagtcgggatggagcgagaggggtggaccataggtccagaaatggaagagatggaggaagggataggtaccgtgatcgaagcaggtcacgttcccctgttaggcacagtcacaaaagttttggagttcaaatttctgtctcggtctctgaggagccgcttttgagcagaactgttgtttccatgggcatggacatctacttcaccagactgggatgcgatataagatttgccgtcaacggtgaatggaggtaactgccaatcataactctgcagattagtgcatttcttttgaagttttgcaggaagggcaagataaaaaccggcaaacctcgacgattagatttgctacgggtcaaatatctctcatggctagcaatggtttgcggagggcgtccctgttcatcttgcagaactagtttaagagtagggagaattgagttaccaaatggaactgaaatgattgaatatgatcggtatcacttttgacattgtcgcataatcgagatcttgtaaagttgtatgatctccaaacttgtagacgccatggtcaccgatgggaaagtgaaatacaatcataatccagtaa

SEQ ID NO: 6198 - DNA, 2039 bp, Panax ginseng
cttgaataccactatcccttccctgtcatttgatcccatgggtatcctcagataatataaagaaaccctaataaaaaccagacaaaactttgacacctcgataagagtcgcttaattagcctttgatctatccgcagaagtagggtttatctaatatttcaccgctgcaacttagcaatggacgctcaaagggctttgctagatgaactcatgggtgcagctcgcaatctaactgaagaagagagaaagggatacaaggaagtaacatgggatgataaggaagtgtgcgggttttatatggttcgattttgtcctcacgatctgttcgtgaacactaggagcgatctaggaccatgcccaaaaattcatgatcagaagttgaaagacagttttgagagttctccaaggcatgagtcgtacgtgccaaagtttgaagcagacctggctcatttctgtgagaagttggtaatggacttggatagaagagtaaggcgtgggcgagaacgccttgatcaagaagttgaagttcctcctccacctccggtcccagttgaaaaatctgagcagttatctgtgctggaggagaaaataaagaacctgctggaacaagtggaggcccttggcgaagcaggcaaggtggatgaagctgaagcactaatgagaaaggttgatgtgcttaacgctgagaagacagccttgactcagcaaccccagaatgacaaagttttaatgcttgctcaggagaaaaagatggctctatgtgaaacttgtggttcttttctcgtagcaaacgatgcgattgagagaactcagtctcacgtcactggcaaacagcatattggttatggcatggtcagggatttccttgctgaatataaggaagctaaggagaaggcaagagaagaggaaaggttagcaagggagaaagaaacggaagaaaggaggaagcagagggagaaggaatatgagagtagacgtagaagaagcgattcaggtgacagggataggaaccgtgatcggatcaggaccaagagcgggaccggtaccgagagcgggaccgagatcgtgaaaggtctcgggagagaaatggtcgaggaagccgtgacgggggaagagggttggattggaagtataacaattctagaaatggaagagagggaagcagagatagataccgtgagcgtgataggagcaggtcgcgttcccctgttaagcgtggacgcaggaggtcatccagaagtccagttcgctcatattactgaattgtgtagatatatgtctgaattttgaagtcagaagagctttgttgagattaatctccctatcatcaaaatttaactagaggacaaagtgatgaggtaggtataacttcattgttgtaattctgttatgtggtctattttaggttattttttaatcatactcactgaaatattattcctggagtttttttacccattctctttggggtacttgtgggaccttaatctcaattagttaaaaagaagaaggaatcagtttatgtgcatgagtaaccttgctgctggtagagatcacggttttttctcaactgtaaggtaacttataaatctcaaacttttggtggttgcacccatggattgacttgtaataatcacaggattcagttttccttactttctgatctttcagctaacctaagcattcttgccatgtcctgcactttgacatatcgtgagcttcacaaatatggttttgctttatgatgttgattgctttagttagatcaattaacctaaatataacattataaccatgaatggtagctagagtgggaaaatttaggaaaagaagattttgctatcaactctaattatggaactcggaaagtttttcccttacgggtgcacaagtatttgtctaattaaggtgatggtaggtatgaaaaagactttaaaatgcttggaagtgatctttagctgcttttccaccctcatattgatcccttgaggctgcatgataagttgaaccgccagaaaattttgaattggaattggact

SEQ ID NO: 6199 - DNA, 1532 bp, Cucurbita pepo
aattgtgaatttcatatttctttcgcgcctctgtatgagttttttcttcgcgtggcggtgcaaaccctagcactagcaccacacaatttctctccaaaaacgttccatagagtctcaaaagctctctttaatcttgtgaacactgaagttcaggttgctgaattacggttcttcttcaagttttggtatccccgtcttccgttcatctgtaaaggatttattcagtatggacgcgcagagagctcttctggacgaactcatgggttcagcgcggaatttaactgaggaagaaaggagaggatacaaggaagtcatgtgggatgataaggaggtctgcgggttctatatggttcgcttttgcccgcatgatcttttcgtaaatactcggagcgaccttggaccttgccctaggatacatgaccagagattgaagaaagctttgaaagtcacccaggcatgatgcttatgttcccaaatttgaggcagaacttgctcagttttgcgagaaattggtaatggacttggatcggcgtgtcaggcgtgggcgagagcggcttgcccaagaggttgaacctgctccaccaactccattgtcagctgagaagtcagagcagttatctgtgctggaggaaaaataaagaatttactagaacaggtggaggcccttggtgaagcgggtaaagtggacgaagctgaagcactgatgagaaaggtggatgtgcttaatgccgagaaaacagccttgagtcaacaaacccagaatgacaaggtattaatgcttgctcaggagaaaaaaatggcactctgtgagatatgtggttcttttcttgtagcaaatgatgctgcagagagagttcagtctcatgtcacaggtaagcagcatgttggctatggtatggtcagagatttcatctccgagcacaaggaagcaaaggagaaagcaagggaggcagaaagattagctagggagaaagaggcagaagacgaaggagcagagagaggaggatgagagaaggaagagaagtgactctagtgagagggacagatatcgtgacagagagcgagataggtatcgtgaacgagaccgagatcgtgaaaggtctagaagaggtggccgagatgaagtaagaggaatggattggaggtctaggaatggaagagatggaggcagggataggtatcgtgaccgaagcaggtcaagatcccctgtaaggcatggtcacaggagatcatctagaagtccagtgcgcccataattatgaactgtgtttaaagatgtctgagctttgagactaaatgaggtagatctcttcatgttcgaagcttatgaatgtatgctttggtacctcaagttaactttgtccgtatcggtaaaacttttttgctatctcacagctgtgttgactgtatcatctccctttcatcattattattagagaaggaaaagggttgaggtaggtatttttatttgttatgactcttcttcttcaggtataatttagactttttttgacttgcacatttctttgaat

SEQ ID NO: 6200 - DNA, 1417 bp, Lupinus angustifolius
aacaaaccctagatacttggttgattctcatttgttgcaattgggaatttgaatattctcaaatccgaaaggaattaaggtttgtcagccttaattcatcgctcagatccttccccactaacagccatggatgctcagagagctctgctcgacgaactcatgggtgcagctcgaaacttgacggatgaagaaagaaaggtttacaaggaagtgaattgggacgataaagatgtgtgtggtttctacatggttcgcttttgcccccacgatctgtttgtcaacacacgcagtgatctaggaacttgcccgagaatacatgatcagaagttgaaagaaagctttgagaaatctccaagacatgatgcatttgtcccaaaatttgaagccgaacttgctcagttttgtgagaaattggtgatggagttggatagaagagtaaagcgtgggcgagagcgtcttgctcaagaggtggagcctgcaccaccacctccgctaacagctgaaaagtctgaacagctatctgtcctggaggagaaaataaagaaccttctggaacaagtcgaatctcttggtgaagctgggaaggttgatgaagctgaagcacttatgagaaaggtggagatacttaatgctgagaagacaggcttaacacagcctcaaaatgaaaaggtgttgatgcttgctcaggagaagaagatggcactctgtgagatatgtggttcttttcttgtggagaatgatgctctagaaaggactcagtctcatatcacagggaagcagcatgttggttatggcatggttcgcgacttcataaaggagtacaaggatgctaaagagaaggctactgaagaagaaagattagctcgggaaagagaggcagaagatcgaaggatacagagagagaagtctgagagaagtcgaagaggtgattctagtgatagggagaggcatcgtgatagagatagggagcgggataggcacagagataaaggctcagatcgtgaaaggtctcgggatcgaaacgggggaaggtgggtggattctaggatgaggaatggaagaaatggaggcagagatgggtaccgtgatcggagaaggtcacgttcccctgctaggcacagccagaggaggtagatcttaatatcgggatttgaatttaaatgaggtagatcttaatatcccaaggcaaataaatatgttcttttggactgttgtgttttctcattatcaagggtaaatttatttattttctcatctcagagtttgttgagactgtactatctcccttacaccaatattataaatggagaaaagtgttgaagttgatgtcagaaacaatttcttacacgattgtcattgctgcggcgggggatggttttctcttattatgaggtaacacgtgaatcttataataccc

SEQ ID NO: 6201 - DNA, 1351 bp, Medicago truncatula
gaaggagaaaaaaaaacaataaagagatagttttctgaaaataaaaagagatagagcgaaacgaggttttgagtcacgtaatcgcttgattgattcgcatagcacaagaaaccctagatacaaaattctaaattatccattgatacattctctactcatcaattcgatttgaattgtgttgtgttgttagctatggacgctcaacgagctctcctcgacgaactcatgggttcagctcgaaacatgactgaggaagaaagaaggggttacaaggaagtgagttgggacgataaggaagtttgtggtttctatatggttcgcttttgccctcacgatctcttcgtcaatacgcgcagtgatctcggagcttgcccgaaagtacatgacccgaagttgaaagaaaattttgagaattccccaaggcatgatgcgtatgtgcctaaatttgaagccgatcttgctcaattttgtgagaaattggtgatggacttggatagaagagtaaaacgtggacgagaacgtcttaatcaagaggtggagctaccaccgccgccaccactgacagctgaaaaatctgaacagttgtctgtcctggaggagaaaataaagaaccttctggaacaagttgaatctcttggtgaagctgggaaggttgatgaagctgaagctcttatgagaaaggtggagacacttaatactgagaaggcagtcttaacacaacctcaaaatgaaaaggtgttaatgcttcaggagaagaagatggcactctgtgaggtatgtggttcatttcttgtggcaaacgatgctgcagaaagaactcagtctcatgtcgcaggaaagcagcatgttggctatggtatggttcgtgacttcataaatgaacacaagattgctaaggagaaggctaaggaagaagaaagattgactcgggaaaaagaggtagaagagcgaagaaaacaaaaggagcaggatcctgagagaaagagacggagtgattcaagtgatagggagaaatatcgtgataaagatcgagataggcagcgtgataggtacagagataaagactcggaacgtgaaagatctcgggaatatgaaggtagaggtaatcgagatcggggaagggggatggtttttaggttgaggaatgaaaaaaatggaagcagagacaggtaccacaatcggagcagatcacgttcccctattaagcataactacagaaggtcttgaagttgtgtttgctccaagtagtggaatttctcgatagatgtcagaatttaaattcaaaagaggtagcccttaatatcccaagacttatataaatatgtgtttttggagtcttaagttttctcat

SEQ ID NO: 6202 - DNA, 1561 bp, Amsonia hubrichtii
taccttcttttccttctttccttcgttcccctaacctactactaccaaaccctaccaaccaacaaaaactacgaaggaaaaggggaacgttactactaaccttactttacttacttcgttttttatttacctagtgtcatttctagctttcgttcatctttcttcccggctcatcatggatgcccaagagctttgcttgatgaactcatgggtgctgctcgaaatttaactgaagaagagagaaagggatatagggaagttacgtgggacagtaaagaagtttgcagtttttatatggtacgattttgtccccatgatctgttcgttaacactcgaagtgatctaggtccgtgccccaaaattcatgatccaaagttgaaggaaagttttgaggcatcccccagacatgatgcttatgttccaaagtttgaggcagagctagctcatttctgcgagaagttggttatggacttagatagaagggttaggcgtgggcgagagcgccttgctcaggaagttgaagttcctcctccccctccaatatcagcagaaaaatctgagcagttatctgttctggaggaaaaaattaagaacctactggaacaagtggagtctcttggcgaatctggaaaagttgatgaagctgaggcgctaatgagaaaggtggaaatgcttaatgtagagaagacagttttgactcagcaacctcaacaagataaagtcttgatgatggcccaggagaaaaagatggctctatgtgaaatatgtggttcttttctagtagcaaatgatgctgctgagagaactcagtcccatatcactggcaagcagcatatgggatatggtatggtccgagatttcctctcagagtacaaggtagctaaggagaaggcaagggaagaggagagattagccagggagaaggaagcagaagagcgaaagaagcaaagggagaaagagtatgagagcagacgtagaagaagtgagtcagctgacagggacaagcatcgcagtcgggatcatgatagggaacgagacagataccgagaacgagatggtgatcgcgagagatctcgagataggaatggtagaggaagtcgagatggtggaagaggatcagattggaggcacagtagttccaggaatggaagagacagaagcagggacaggtaccgtgaacgtgagagagcagatcacgttctcccgttaggcatggtaacaggaagtcatccaggagtccagttcgcccatattgagcattgtgtagatagatgtttgaaatttgaaatctgaagagctttattcagactataccatcttcctatcatcaatatatttagagagaaaaggttagaggtaggtatgacttcattgttgtaactatttaatgatctaattgggctttgacgctttggtatgaactaattgcttataaggatcctctttaatgtgtctccttggagttttggtcctttctttggggtccgtgtggtaatcttttgtcatctagttataaaacagtatactttatgtatccatgggtagttcagctgccggaggg

SEQ ID NO: 6203 - DNA, 1350 bp, Catharanthus roseus
gtccccgttcccattattcaaagcctccacaaaatctccgggaaagggtgcttcaaagacccattactagtttgtttcttctagctgttattatcagctccatttatctctgttttcgtccgccgtctcagtcatggatgcccaacgagctttgcttgatgaactcatgggtgcagcccgtaatttgacggaagaagagagaaagggatacaaggaattacgtgggacagtaaagaagtttgcagtttctatatggttcggttttgtccgcacgatctatttgtgaacacccgaagcgacttaggtgcttgccccaaaattcacgatccaaagttgaaagaaagttttgaagcatccccaagacatgatgcttatgttcccaaatttgaagctgagctagctcatttctgcgagaagttggttatggatttagatagaagagttaggcgtggtcgagagcgtcttgctcaggaggttgaagttcctcccccacctccaatatcagcagaaaaatctgagcagttatctgttctggaggaaaagattaagaacctactggaacaagcggagtctcttggcgagtctggaaaagttgatgaagctgaagcgcttatgagaaaggtcgaaatgcttaatgcagagaagacagctttgactcagcaacctcaacaagataaagttttaatgatagcccaggagaaaaagatggctctttgtgaaatatgtggctcttttctggtagcaaatgatgctgctgagagaactcagtcccatatcactggcaagcagcatatgggatatggtatggtccgagatttcctcacagagtataaggcagctaaggagaaggcaagggaagatgagagattggccagagaaaaggaagcagaagaacggaagaagctaaaggagaaagagtctgagagcagacgtagaagaagtgattcagctgacagggacaggcatcgcagtcgtgatcatgacagggaacgagaccgataccgaaatcgagatggtgaccatgagagatctcgagataggaatgggagaggaagtcgggatggaagtgggtcagattggaggcatagtagttcaaggaatggaagacccagaagcagggatagataccgcgaacgcgaaaggagcagatcacgttctcccatcaggcatggtaacaggaggtcatccaggagtccagttcgcccatactgaggataatgtagagagatgcctgaaattttaagcgggaagaggtagacatttcgatacccatctagttcatgaatgtatgtcgtttggggtcgttcttcttctattgtcatcatggatgtaaacttgttttttgtctca

SEQ ID NO: 6204 - DNA, 1345 bp, Vitis vinifera
attgaatcaccgcaacccgcctcgtacacacaatctctggaggctcaagtcctcgagaaccgataaaaacgcataatcaccacaagtttcactgaactctccatcaattctaaaaagggtagactctagaaagaaaaagaatccccaatccataaagccctaatcttgctgcatagttagggcttgtcttctccaatactctcttttctttctcactgcttgaaaccctccatagccagcgatggacgctcagagagctcttctagacgagctcatgggtgcagcgagaaacctgacggaagaagagaaaaaagggtacaaggaggttacttgggatgataaggaggtttgtggattctatatggtgcggttttgtcctcatgatctcttcgtcaacactcgaagtgatctcggaccatgccctagaattcatgatcaaaagttgaaagaaagttttgaaaagtctccaagacatgattcatatgtgcctcgctttgaagctgagcttgctcagttttgtgagaaattggttatggacttggatagaagagtgaggcgtgggcgtgaacgccttgcccaagaggtggaagcagccccacctgctccactttcactggagaaatctgagcaattatctgtgttagaggaaaaaataaagaatctgttggaacaagttgaggcccttggtgaagctggcaaggtggatgaggctgaagcactcatgaggaaggtggagatgctgaatgctgagaagacagtcttgactcaacaaccccagaatgacaaagtcctaatgcttgcacaggagaaaaagatggctctgtgtgagacctgtggttcttttctggtagcaaatgatgctgcagagaggactcagtctcatgtcacaggaaagcagcatattggttatggcatggttcgggatttcatcactgagtacaaggaagccaaggagaaggcaagggaagaagaaagattaaagagggagaaagaagctgaagagaggagaaagcagagagagaaggaatctgagagcagaagtcgaagagctgattctggtgatagggacaggactcgtgaccgagatagagacagggagcgggatcgatacagagaacgagaacgggatcgtgaaaggcctcgagagtggaatggtagaggatacagagatggaggaagaggaacagattggaggtacagcaattccagggatggaagagatggaggcagggataggtaccgtgatcggagcaggtcacgttcccctcttgtataccaatctgttaggctaaagttaatgcgattgaacttaggttaattttaatcacaccccttgaggttcgct

SEQ ID NO: 6205 - DNA, 2191 bp, Medicago truncatula
aaaaaacaataaagagatagttttctgaaaataaaaagagatagagcgaaacgaggttttgagtcacgtaatcgcttgattgattcgcatagcacaagaaaccctagatacaaaattctaaattatccattgatacattctctactcatcaattcgatttgaattgtgttgtgttgttagctatggacgctcaacgagctctcctcgacgaactcatgggttcagctcgaaacatgactgaggaagaaagaaggggttacaaggaagtgagttgggacgataaggaagtttgtggtttctatatggttcgcttttgccctcacgatctcttcgtcaatacgcgcagtgatctcggagcttgcccgaaagtacatgacccgaagttgaaagaaaattttgagaattccccaaggcatgatgcgtatgtgcctaaatttgaagccgatcttgctcaattttgtgagaaattggtgatggacttggatagaagagtaaaacgtggacgagaacgtcttaatcaagaggtggagctaccaccgccgccaccactgacagctgaaaaatctgaacagttgtctgtcctggaggagaaaataaagaaccttctggaacaagttgaatctcttggtgaagctgggaaggttgatgaagctgaagctcttatgagaaaggtggagacacttaatactgagaaggcagtcttaacacaacctcaaaatgaaaaggtgttaatgcttcaggagaagaagatggcactctgtgaggtatgtggttcatttcttgtggcaaacgatgctgcagaaagaactcagtctcatgtcgcaggaaagcagcatgttggctatggtatggttcgtgacttcataaatgaacacaagattgctaaggagaaggctaaggaagaagaaagattgactcgggaaaaagaggtagaagagcgaagaaaacaaaaggagcaggatcctgagagaaagagacggagtgattcaagtgatagggagaaatatcgtgataaagatcgagataggcagcgtgataggtacagagataaagactcggatcgtgaaagatctcgggaatatgaaggtagaggtaatcgagatcggggaagggggatggtttctaggttgaggaatgaaaaaaatggaagcagagacaggtaccacaatcggagcagatcacgttcccctattaagcataactacagaaggtcttgaagttgtgtttgctccaagtagtggaatttctcgatagatgtcagaatttaaattcaaaagagagctttcttgagactatacaatctccctttcatcaatattattaatggagtaaagggtcgagtctttctttacatgcattttctggaaatcatttgactgagtaaagatgtcagacacaaaattacatgagtgattgtcattgccgcaaaagtggatgatttactcttgttttgaggtaacatgtgaatcttattaccttgaggcaaagattggtatttgttcatagaaatgtttctgtttgccctttttgtatgtttcattacttttgttccttaagttgatataaaccagcacaggtttataaatgctgcttattctgacatacatttgacattgaactacactctgaaggcacctgtttagaagatataggtaatcttactgaatttgttgttaggcactactcgaatccatggtactcatactcataattttattggggaaaagatgattgcatgttgtcacctcaaaactcagcagttttactttgagtttgtccaattggtaactcgtttggaatggtgaactacctcatccttaaaaaaaaaaaagtttgatgtgcaaaatactgttttaattgaacatataggactggaaaatacaggtatttagccctttgccaagttaatttatagagacatagtcatttgcaagaaaaactgtcattgaacagggccttgggatgcttcgttttttgtgaacaagcaagttattgtctgtgcgattggaggtaaataactgcttcatgatgggagaaacaacacaatgaaaatttagcttattctttttagattgtgaagaaagtgatgttacattactcaactggaagtcaaaacgttggtaaatcttggtagtacttttgaaattcagtcttaataatgattgtaaagttccacgaaaataaaaatgag

SEQ ID NO: 6206 - DNA, 2335 bp, Citrullus lanatus
gaattttgtattcctaatttttttctttctgctacgcttctgcatcatcgagttttttgttcgcgtaggcgttcaaaccctagcatcagcaccacacaacttctctctaaaaacattcccaagagtctcaaaactcctttttaatcttctgaagactgagctccaagtagctgaattagggtttttcttcaagttgtggattttcccgtttcctgtgttcctctggaaaatatttccacgacatggacgcccagagagctcttctggatgaactcatgggttcagcgcgtaatttaacggaggaagaacgaagaggatacaaggaagttatgtgggatgataaggaggtctgcgggttctatatggttcggttttgcccacatgatcttttcgtaaatactcggagcgaccttggtccttgtcctaggatacatgaccagaaattgaaagaaagctttgagaagtcacccaggcatgatgcttatgttcccaaatttgaggctgaacttgctcagttttgcgagaaattggtaatggacttggatcgtcgtgttaggcgtggacgagagcgtcttgcccaagaggttgaacctgcaccaccaactccattgtcagctgagaagtcagagcaattatctgtgctggaggaaaaaataaagaatttattggaacaggtggaggcccttggtgaagcgggtaaagttgatgaagctgaagcactgatgagaaaggtggattcacttaatactgaaaaaacatccttgactcaacaaactcaaaatgataaggtactgatgcttgctcaagagaaaaaaatggccctttgtgagatatgtggttcttttcttgtagcaaatgatgctgcagagagagttcagtctcatgtcacaggtaagcagcacgttggttatggtatggtcagagatttcatctccgagcacaaggaagcaaaggagaaagcaagggaagaagaaagattagctagggagaaagaggcagaagaacggaggaagcagagagaggagtttgagagaagaaagagaagtgactctagtgagaaggacaaatatcgtgacagagagcgagacagggatcgagataggtatcgcgaacgagaccgagatcgtgaacggtctagaagaggtggccgtgatgaaataagaggaatggattggaggtctaggaatggaagagatggaggcagggataggtatcgtgatcggagcaggtcaaaatcccctgtaagacgtggtcacaggagatcgtctagaagtccagtgcgctcataattatgaactgtgttaagaggtctaagctttgggactaatgagccaatgaggtagatctcttcatgttcgattcgaagcttatgaatgtatgctttggtacctcaagttactttgttagtattggtgaaactttttttgctatctcacagctgtgttgactgtatcatctccctttcatcattattattagaggagaaaagggttgaggtaggtattttttttttgcgactcttcttcaagtatagtttgacttttgatttgcacatttcttttataatatattcttataaaagacagttcaatgtctctcctaccttttcatattgggtgagcttgcactacttcggtgtttgtcacatgtttaataggccaggacaaaatatatgcatatttgactactgctgagagggctgacgtttattttctcatttttgaggtaacattataaatcttatctctttcttaagaccatgtgatctgttatcaaccctgtatccaaggtgtattttggtcttcaaatgatatgtatgttactagtgagtgtgcttatttattgcccatgtttttttttaaaagtatttctattatctggtgttgagtatggaatctaggaaaacgtgggtagtattagcatcatggtggaacatgccttggttctttttttagcagaatggaagtttgtattgcataaatggagctcgataatacctactgaaaggaggtataacttttattgagtacagtgctttccgcatcaaaattctggtttcgtgaaagaagtgggaagaagtatgagatagcatcatgaaatgggcaactttgtgtggtccttgaaggtaaaatttgactgctaatctgtaaaatagcatgatctttaatccatacagtttgcaggaagtgtattgggcaaacttttcgatagcctacctgtggaactaacctactcggtaaggagcgatccgtgcagggaatttattttgcaaagtagatggtatttgctgaaccatttgaatgcaccaatacagtaatttgatgaacccatttga

SEQ ID NO: 6207 - DNA, 2280 bp, Theobroma cacao
tgggattgccgttttgcctccctctttatctctctccagatcccagctaaagggccgaaccccaggtaacacttcacagttgccttaaagtccactccatctcctccttagtagaaaaccctgaacctctccccctttgacttattaggattaatattcgatttgcattttcaattgcaaaaattaggaggtctatttagggaaaaatcgtcaaaattctttaatatttctcgctattttcaactctaagccatggacgcacagcgtgctttgcttgacgaactcatgggaacagctcgtaatttaacggaggaagagaaaaagggttacagggaaattcgatgggatgataaagaggtttgtggattttatatggttcgcttttgtcctcacgacctcttcgtcaacactcgcagtgatctcggaccatgccctagagttcatgaccaaaagttgaaagaaagttttgagaagtccccaagacacgatgcttatgtgcccaaatttgaagctgaactggctcagttttgtgagaaattggtgatggacctcgacagaagggttaggcgtggacgagaacgccttgctcaagaggtggaaccagcgccacctgctccagtatctgcagaaaagtctgagcagctatctgtgttggaggaaaaaataaaaaacttgctggaacaagtggaaaaccttggtgaatccggaaaggtagatgaagctgaggcgcttatgagaaaggtggaggtgcttaatgctgagaagacagccttgactcaacaacctcaaaacgataaagtattgatgcttgcgcaggagaaaaaaatggctctatgtgaggtttgcggatcttttctagtagctaatgatgctgctgagaggactcagtcccatgttacaggaaagcaacatattggttatggaatggttcgggatttcatttctgagttcaaggcagccaaggagaaagccagggaagaggaaagattagcaagagagaaagaagttgaagaacggagaaagcagagggagaaggaatatgagagtaggaggaggagaagtgattcagatgacagggacaagtatcgtgatcgagacaaggatcgggaccgatatagggaacgtgatttggaacgtgaaaggtctcgagaatggaatggtagaggtagtagggatggagagagggattggaggtacaagaatggaagagacggaggcagagataggcacaaggaccgcagcaggtcacgttcccctggtagacatagtcacaggaggtcctcaagaagtccaggtcgacgatattagtgcattctgtacataaatgttttggctttgaaagccaatgaggtagacctcttatttttttctagtttacaaacatgtgcttttggagtcgtgctaaattttgtcatcatgggtgaaacttttttcttcgtatctcacagctttgttgagactatacccactccctttgatcaaaattactagagaagaaaagggttgaggtaggtataacattattataacattattgtaactcttttatcttgtttggactaaatttctgtgggcattgttttgagtctcttatgcctcttcctttatatgcttatttatagtcaagctgctgagaaagatgacctctttccaataatgaggtaacaaattaaatttcatttatagcatcaccatgccatacttgactaaccttcatacttatacatgtatatatttttattctttctttttgtggatgcttatttggctttttatcaattactatttgtttgcaaaggctactgttgtggaataatacagggaaaatcttagacaaattgagaaagtacatttaaacatatgtggttttgaaggttttttagtaccctaagcacgcatgttttttgtgctactgtaaatttaagcaatatacttggattagagtattctttccttttgtttaattgttttgtaaaggacaagattcagttgtggtttcctgtttttgttctttgtgatggatttgtatgatcacaaattttcaatttgtttggaaggcatcgttcttgtagtttgaaaccccttttttaaccgtcactccttttcttccttccaagttttaaagctcgggaatcacacacattgctatgaagataatggattgatccagaaaaagtacaaatggcattgtttactcgttattcaaagctgaaaggcgagaaatttacgaaatcctaaatcagtcttcttaatcagatataatgttttacaatttttatt

SEQ ID NO: 6208 - DNA, 1767 bp, Theobroma cacao
gactgggattgccgttttgcctccctctttatctctctccagatcccagctaaagggccgaaccccaggtaacacttcacagttgccttaaagtccactccatctcctccttagtagaaaaccctgaacctctccccctttgacttattaggattaatattcgatttgcattttcaattgcaaaaattaggaggtctatttagggaaaaatcgtcaaaattctttaatatttctcgctattttcaactctaagccatggacgcacagcgtgctttgcttgacgaactcatgggaacagctcgtaatttaacggaggaagagaaaaagggttacagggaaattcgatgggatgataaagaggtttgtggattttatatggttcgcttttgtcctcacgacctcttcgtcaacactcgcagtgatctcggaccatgccctagagttcatgaccaaaagttgaaagaaagttttgagaagtccccaagacacgatgcttatgtgcccaaatttgaagctgaactggctcagttttgtgagaaattggtgatggacctcgacagaagggttaggcgtggacgagaacgccttgctcaagaggtggaaccagcgccacctgctccagtatctgcagaaaagtctgagcagctatctgtgttggaggaaaaaataaaaaacttgctggaacaagtggaaaaccttggtgaatccggaaaggtagatgaagctgaggcgcttatgagaaaggtggaggtgcttaatgctgagaagacagccttgactcaacaacctcaaaacgataaagtattgatgcttgcgcaggagaaaaaaatggctctatgtgaggtttgcggatcttttctagtagctaatgatgctgctgagaggactcagtcccatgttacaggaaagcaacatattggttatggaatggttcgggatttcatttctgagttcaaggcagctaaggagaaagccagggaagaggaaagattagcaagagagaaagaagttgaagaacggagaaagcagagggagaaggaatatgagagtaggaggaggagaagtgattcagatgacagggacaagtatcgtgatcgagacaaggatcgggaccgatatagggaacgtgatttggaacgtgaaaggtctcgagaatggaatggtagaggtagtagggatggagagagggattggaggtacaagaatggaagagacggaggcagagataggcacaaggaccgcagcaggtcacgttcccctggtagacatagtcacaggaggtcctcaagaagtccaggtcaacgatattagtgcattctgtacataaatgttttggctttgaaagccaatgagctttgttgagactatacccactccctttgatcaaaattactagagaagaaaagggttgagtcaagctgctgagaaagatgacctctttccaataatgaggcagaggccgcgtgcataaggtacaagctgatagagggactgctagactttggtctgaacgtaaattttgagaaagccatgattgcagtttcattgcatttaccttggaggaaaaaaaaaaaggtgacgaatactgcgttgaagttccattgcacgtgtctagggatgaagtcccatgtgagaaacgctaatcgggaaacttgagggtaaattcgaacatcagaacaggagaaatttagaaagttggaagatcaagctggttcccagaatcagacttcaataggtcttttaactgatctctaggggttccaaagc

SEQ ID NO: 6209 - DNA, 1081 bp, Cucumis sativus
ttcatctgaaaaaatatttcatcaccatggatgcccaaagagctcttctggatgaactcatgggttcagcgcgtaatttaacggaggaagaacgaagaggatacaaggaagttatgtgggatgataaggaggtctgcgggttctatatggttcggttttgcccacacgatcttttcgtaaatactcggagcgacctaggtccttgtactaggatacatgaccagaaattgaaagaaagctttgagaagtcacccaggcatgatgcttatgttcccaaattcgaggctgaacttgctcagttctgcgagaaattggtaatggacttggatcgacgtgttaggcgtggaagagagcgtcttgctcaagaggttgaacctgcaccaccaactccattgtcagccgagaagtcagagcaattatctgtactggaggaaaaaataaagaatttattggaacaggtggaggctcttggtgaggcgggtaaagtggatgaagctgaagcgctgatgagaaaggttgatttacttaatactgagaaaacagccttgactcaacaaacccaaaatgataaggtattgatgctcgctcaagagaaaaaaatggccctttgtgagatatgtggttcttttcttgtagcaaatgatgctgcagagagagtccagtctcatgtcacgggtaagcagcatgttggttatggtatggtcagagatttcatctccgagcacaaggaagcaaaagagaaagcaagggaagaagaaagactagctagggagaaagaggcagaagaacggaagaagcagagagaggagtttgagagaagaaagagaggtgactctagcgaggacaaatatcgtgacagagagcgagacagggatcggaataggtatcgggaacgagaccgcgatcgtgaaaggtctagaagaggtggccgtgatgaaataagaggaatggattggaggtctaggaatggaagagatggaggcagggataggtatcgtgatcggagcaggtcaaaatcccccataagacgtggtcacaggagatcatctaggagtccattgcggccataattatgaactat

SEQ ID NO: 6210 - DNA, 2694 bp, Panax ginseng
cagacctccttgaataccactatcccttccatctcattagattccatgggtatcctcagataatatgaagaaaccctaataaaaaccagacaaaactttgacacctcgataagagtcgcttaattagcctttgatctatccgcagaagtagggtttatctaatatttcaccgctgcaacttagcaatggacgctcaaagggctttgctagatgaactcatgggtgcagctcgcaatctaactgaagaagagagaaagggatacaaggaagtaacatgggatgataaggaagtgtgcgggttttatatggttcgattttgtcctcacgatctgttcgtgaacactaggagcgatctaggaccatgcccaaaaattcatgatcagaagttgaaagacagttttgagagttctccaaggcatgattcgtacgtgccaaagtttgaagcagacctggctcatttctgtgagaagttggtaatggacttggatagaagagtaaggcgtgggcgagaacgccttgatcaagaagttgaagttcctcctccacctccggtcccagttgaaaaatctgagcagttatctgtgctggaggagaaaataaagaacctgctggaacaagtggaggcccttggcgaagcaggcaaggtggatgaagctgaagcactaatgagaaaggttgatgtgcttaacgctgagaagacagccttgactcagcaaccccagaatgacaaaattttaatgcttgcacaggaaaaaaagatggctctatgtgaaacttgtggttcttttctcgtagcaaacgatgcgattgagagaactcagtctcacgtcactggcaaacagcatattggttatggcatggtcagggatttccttgctgaatataaggaagctaaggagaaggcaagagaagaggaaaggttagcaagggagaaagaaacggaagaaaggaggaagcagagggagaaggaatatgagagtagacgtagaagaagcgattcaggtgacagggataggaaccgtgatcgggatcaggaccaagagcgggaccggtaccgagagcgggaccgagatcgtgaaaggtctcgggagagaaatggtcgaggaagccgtgacgggggaagagggttggattggaagtataacaattctagaaatggaagagagggaagcagagatagataccgtgagcgtgataggagcaggtcgcgttcccctgttaagcgtggacgcaggaggtcatccagaagtccagttcgctcatattactgaattgtgtagatatatgtctgaattttgaagtcagaagaggtagacatttttataatttactatgtttaatggatgtgtgcttttggagtttaaaattattttcttcatgggtgaaattcttttttgttcccacagctttgttgagattaatctccctatcatcaaaatttaactagaggacaaagtgatgaggtaggtataacttcattgttgtaattctgttatgtggtctattttaggttattttttaatcatactcactgaaatattattcctggagtttttttacccattctctttggggtacttgtgggaccttaatctcaattagttaaaaagaagaaggaatcagtttatgtgcatgagtaaccttgctgctggtagagatcacggttttttctcaactgtaaggtaacttataaatctcaaacttttggtggttgcacccatggattgacttctaataatcacaggattcaattttccttattttcttatctttcagctaacctaagcactcttgccatgtcatgcactttgacatatcacgagcttcacaaatatggttttgctttatgatgttgattgctttagttagatcaattaacctaaatataacattataaccatgaatggtagctagagtgggaaaatttaggaaaagaagattttgctatcaactctaattatggaactcggaaagtttttcccttacgggtgcacaagtatttgtctaattaaggtgatggtaggtatgaaaaagactttaaaatgcttggaagtgatctttcgctgcttttccaccctcatattgatcccttgaggctgcatgataagttgaaccgccagaaaattttgaattggaattggacttcaccacctactgggcagacattggattttgcatggtgcgagctactgcctgcctgcctgcctgccagagagactattcaaactttaatatactattttgcagggtaaggcaattctttttccagatcgcaggagaagacagtctactacaggtgaaaccttattcgtgatatactaatttgacaagggagtgatttgtgtgggtaatcatgcccgcaacactaattgtgtaatgggggctatcaaactgaaaacagatatgactaaattttcttttgggtgataattcattctttttcttttttcctttgggtttcttttttcttccagtagtttctacaataacttgtattcttcctagtagtgatataatacatagaaactttaaaaaaaaaaaaaacaaaaaagtaaggaagggaaaggaaagtatagaagtaagtttgtagaaacgccagacaacaaacctaattaatttatggttagttaagtttaagggtgggagtggtaggggagacgaaggcacacgaaggggataggccccccccccccc

SEQ ID NO: 6211 - DNA, 1759 bp, Coffea canephora
aaccctgataataaaaataattctcatcacttttcgctcctcagcaaaagtctaatctaaaaattagattagattgaaagggggctgcacattccagtttattatctaggcggcctagattaatcttgttttcttttttttttccaatctcaatcatggacgcccaaagagctttgcttgatgaactcatgggtgcagctcgtaatttgactgaagaagagaggaaggggtacaaggaaattacatgggacagtaaggaagtgtgcagctcctatatggttcgcttttgcccccacgatttgtttgtcaacacaagaagtgatctaggaccatgccctaaaattcatgatcaaaagttgaaggaaagctttgagaagtctcctaggcacgacgcatatgttccaaagtttgaggctgagctggctcatttctgtgagaaattggttatggacttagatagacgagttaggcgtggtcgagaacgtcttgctcaagagattgacgttccccctcctcctcctatcccagcagaaaagtctgagcaattagctgttttggaggaaaaaataaagaacctactggaacaagtggagtctcttggtgaagctggaaaggttgatgaagccgaagcgctaatgaggaaggtggaagtgctcaatgctgagaagacagctttaacacagcaacctcaacaagataaagtcttgatgatggcacaggagaaaaagatggctctgtgtgagatatgtggttcttttctagttgcaaatgatgctgctgagagaactcagtcgcatgtcactggaaaacagcatatgggatatggtatggtccgagattatcttgcagagtacaaggaagctaaggagaagaaaagagaggaagaaagactagcccgggaaaaagaagcagaagaaaggaggaagcaaagggagaaagagtatgaaagcagacatagaagaagtgagtcatctgagagggacaggtatcgtgatcgagatcacaatcgggaacgagatcgatacagggagcgagatggtgaccgtgaaagattctcgagaggggaatagcagagaaactcgagagggggttagaggatcagattggaagtacagcagttcccggaatggaagagatagaagcagggaaagataccgccagcgtgacagaagccggtcacgttctcctgttagatatggtaaccggagatcatccaggagtccagtccgtcaatattgaggacattggatgggtgtttgaattttaaatgagaagagctttattgagactgtatcatctccctatcatcgatatatttagagagaaaaggttgaggtaggtatgacttcgttgttgtaactattcaatgatctatctagactttggttgatctaattgatttatcaatcatctgtgatatgcctaccagagttctggttccttcttttttgggatcactctgggaatcttttctcaagtagttatagaacagatactctatatgtgcatggatattactgctgctgaaggagttaacagtttgatcaactgtgaggtaacaagtaaattttgattttcttaaccgtaaaatgacttcctaactatcaatagtttgggctttgtgttttcttgtctgctcagatgaccgattgcagattcttgtactccacttacattagctgccaatgagctaatgaataccgatctcccccccccttctctgataatttatctgatgattttgcccaaaagcccctat

SEQ ID NO: 6212 - DNA, 1857 bp, Gossypium raimondii
cgaacctcagatcaacagattgcccacagttgcctaaaacattaaaatcaagtgctctgcccctcttctttcttgcttccttaaaatctttctctctttctcattgttttgtttcacttaatatttcgatttgcttctttttttggttcttattaaaagcaataatttcaacttctctatttacgcgaagaccctcgagtttctttaatctcaaaaaccctaagcaatggatgcacagcgagctttgcttgacgaactcatgggaactgctcgtaatttaacggacgaagagaagaagggatatagggaaatccggtgggatgataaagaggtttgtgctttctacatggttcgattttgtcctcacgatctcttcgtcaacactcgcagtgatctcggaccatgccctagagttcatgaccaaaagttgaaagaaagttttgagaagtctccaagacatgatgcttacgtgcccaaatttgaagctgaactggctcagttttgtgagaaattggtgatggaccttgacagaagagttaggcgcggtcgagagcgccttgctcaagaggtggaacctgcaccacctgctccattatctgcagaaaaatccgaacaactatctgtcatggaggaaaaaataaaaaacttgctggaacaagtggagacacttggtgaagctggaaaggtggatgaagctgaggcgcttatgagaaaggtggaggcgcttaatgctgagaagacggccttggctcaacaacctcagaatgataaagtattgatgcttgcacaggagaaaaaaatggccctatgtgaggtttgtggatcttttctagtagctaatgacgctgctgagaggactcaatcacatgttacaggaaagcaacatattggttatggcatggttcgggatttcatctctgagttcaacgaagccaaggagaaagcaagggaagaggaaaaattatcaagagagaaagaagccgaagaacggagaaagcagagggagaaggaatatgagagtaggaggagaagcgattcaggtgatagggacaaatatcatgatcgagacaaggaccgagacagatattgcgaacgtgatttgtatcgcgaaaggtctcgagagtggaatgggagaggtattcatgatggagagagggattggaggtacaggaatggcagagatggaggcagggatagacaccggaaacgcagcaggtcccgttcccccagtagacatagtcgcaggaggtcctcaagaagtccagttcactgatattagtgcattctgtagttagatgttttgctttgaaatccgatgaggtagacaactttttttttcctttactttttctagtttataaacttgcgattatggagtagtgcaaatttggtcgttcacgggtggagcatttttcttggcatctcacagctttcttgatactaccccgaatcccttttgtcaacattagtagggaagaaaagggttgaggtaggtaaaacaatattatttgcaactattttttttttttttaaatcttgtctggactaaattatagtttgcagatgtggaaattgttgagtctcttatagctcctttccttgatatgctttttatccatatagtcaagcttctgagaaagattgaaatctttccagttttgaggtaacagactaaatttcatccatagcatcacgccagtttagtgacatgtcttgcatatacatctagatattactttccttgcttttgttgtatatcaattatttgagttgcagaggcttgccgttgtgaatagtacaagaatctgagataaattgttaggaaaatacctttgacttgaagtaaccttgtaaatt

SEQ ID NO: 6213 - DNA, 2513 bp, Citrus clementina
ctttaccactttgttcatcaaaacctaaaatcactcccgaaaaaatccactaaaaaatacccaattctctcaaaccctaatagccctcccattatagttatatataaatccaactaagttatcttaatttatattttttttttcctttaacacagtatcatggacgctcagcgagctctgctagacgaactcatgggcgcagctcgaaatttgaccgaagaagagaaaaaagagtacaaagaaataaaatgggacgataaggaggtttgtccattctatatggttaggttttgccctcacgatctctttgtcaacacgagaagcgatctcggaccgtgcccgagaattcatgaccagaagttgaaagaaagttttgagaagtccccgcgacatgatgcttatgtgcccaagtttgaagctgaacttgctcaattttgtgagaaattggtaatggacctggatagaagagttcggcgggggcgagaacgtctttctcaagaagtggaacctgcaccaccacctccaatatcagcagaaaagtccgaacagttatctgtgttggaggagaagataaaaaacctgctggaacaagtggagaccctgggtgaggctggcaaggtggatgaagctgaagccctcatgagaaaggtggagattcttaatgttgagaagacaaccttgactcagcagtctcagaacgataaagttttgatgatggctcaggagaaaaagatggctttatgtgagatatgtggttcctttcttgtagcaaatgatgctgctgagaggactcagtctcacatttctggaaagcagcatattggttatggcatggttcgagatttcataactgagtacaaggaagctaaggagaaggcaagggaagaagaaagactagccaaggaaaaagaggtagaagatcggaggaagcagagggagaaagaatatgagagtagaaagaggagtggttcaagtgatagggacaggtatcgtgatcgagatcgtgacagagagagagaacgatacagagaacgtgatcgtgaaaggtctagagagtgggatggtagaagtggtcgtgatggaggaaggggggctgattggagaagcagggataggcaccgtgatcgcagcagatcacgttcccctgttaggcatggtcacaggaggtcacctagaagtccagttcgccagtattagtgggttgtgtgggtagatctctgagctttgaaagtaaatgagctttgttgagactctaccatctccctttcatcaaatattattaaaggagaaaagggttgaggtaggtacaactatattgttgtagttcttgttttatcatttattttaggatttggttaaactgaatttcttttcatgctctctgaaatatatttttgagtccctttgttgggttcattgacggctactggtattaagtatattagacgacaggctcaaaaacatatgcttgaatgacactgctgctcaaggaggtgttcttttttcaatttttttgaggtaacaaataaatctaatctttttcatgacctcaccacaggttgacttccttcacgatatattcttttgtcttttttcttttctgaatattggattcggtccaattatatttgcaaattattgttaggagataaatttaagacacacattgggaaaatctgccccttttagccttcttttgcaacttttgaactttattttatattgccatctatacatgagcttagcttcaaatcacaatggtagcggtagcattgaactgtacgtaaatggttagaagtgtaaaaactcgttgacctcttccactctccttgccattaattcacaaaattgcaatgattgtattgctgcctgcattttgtgcatgaatggggtgtgtttctaggatccttagacttgaaagagtcgacgttgattaacatacaatctttacatcttatcttcatatgaaaaatatatttcttttttacagattcgggtatttttggagttaaaatttcaaaagtgggtgtcagatggttataggtaattactttgtctttgcaaagcgatatttttctagcttctcagtcgtctctttaagacaatttctttagcagacccttttcctgcacgataatcttcttcaatgaactgggtggcaaaggccgtttgcaaaatattagacttgcaaatgtttgatcctggaggtaacaaaatttataatctgcagatagcatattttaaattccaggttgcaggagtggcaggtaactttgtaaacattgatggtatataatcgccgctagtgtatctgtatcgaatgtctgggtaagcaatagtttctgcagggatttaaacttttacaaaatagttgctgctgatggaactattattagaaagaaagaagatgaaagtcaggcagccaaatttaactgaaattggctggactactcatgcttgttatgctatttgctaatggataaattggaattcgaatgaactttttctatctt

SEQ ID NO: 6214 - DNA, 2020 bp, Gossypium raimondii
cccaactattaaataaagaccgaacctcagatcaacagagtgcccacagttgcctaaaacattaaaatcaagtgctctgcccctcttctttcttgcttccttaaaatccttctctctttctcattgttttgtttcacttaatatttcgatttgcttctttttttggttcttattaaaagcaataatttcaacttctctatttacgcgaagaccctcaagtttctttaatctcaaaaaccctaagcaatggatgcacagcgagctttgcttgacgaactcatgggaactgctcgtaatttaacggacgaagagaagaagggatatagggaaatccggtgggatgataaagaggtttgtgctttctacatggttcgattttgtcctcacgatctcttcgtcaacactcgcagtgatctcggaccatgccctagagttcatgaccaaaagttgaaagaaagttttgagaagtctccaagacatgatgcttacgtgcccaaatttgaagctgaactggctcagttttgtgagaaattggttatggaccttgacagaagagttaggcgcggtcgagagcgccttgctcaagaggtggaacctgcaccacctgctccattatctgcagaaaaatccgaacaactatctgtcatggaggaaaaaataaaaaacttgctggaacaagtggagacacttggtgaagctggaaaggtggatgaagctgaggcgcttatgagaaaggtggaggcgcttaatgctgagaagacggccttggctcaacaacctcagaatgataaagtattgatgcttgcacaggagaaaaaaatggccctatgtgaggtttgtggatcttttctagtagctaatgacgctgctgagaggactcaatcacatgttacaggaaagcaacatattggttatggcatggttcgggatttcatctctgagttcaaggaagccaaggagaaagcaagggaagaggaaaaattatcaagagagaaagaagccgaagaacggagaaagcagagggagaaggaatatgagagtaggaggagaagcgattcaggtgatagggacaaatatcatgatcgagacaaggaccgagacagatattgcgaacgtgatttggatcgcgaaaggtctcgagagcggaatgggagaggtattcgtgatggagagagggattggaggtacaggaatggcagagatggaggcagggatagacaccggaaacgcagcaggtcccattcccccagtagacatagtcgcaggaggtcctcaagaagtccagttcaccgatattagtgcattctgtaggtagatgttttgctttgaaatccaatgaggtagacaactttttttttcctttactttttctagtttataaacttgcgattatggagtagtgcaaatttggtcgttcacgggtggagcatttttcttggcatctcacagctttctcgagactaccccgaatcccttttgtcaacattagtagggaagaaaagggttgaggtaggtaaaacaatattatttgcaactattttttttttttttaaatcttgtgtaaactaaattatagtttgcagatgtggaaattgttgagtctcttatagctccttcccttgatatgctttttatccatatagtcaagcttctgagaaagattgaaatctttccagttttgaggtaacagactaaatttcatccatagcatcacgccagtttagtgacatgtcttgcatatacatctagatattactttccttgcttttgttgtatatcaattatttgagttgcaaaggcttgccgttgtgaatagtacaagaatctgagataaattgttaggaaaatacctttgacttgaagtaaccttgtaaattgatgaaacagattgttctttactttttgtttggtttaagatataaataactagactgggtaatcaaaactccattgtatcatacgcaaataaagacggtttcataatatataaatattaaattgtgatggaatgccacaagga

SEQ ID NO: 6215 - DNA, 2525 bp, Citrus sinensis
gctgctttacgcctttaccactttgttcatcaaaacctaaaatcactcccgaaaaaatccactaaaaaatacccaattctctcaaaccctaatagccctcccattatagttatatataaatccaactaagttatcttaatttatttattttttttcctttaacacagtatcatggacgctcagcgagctctgctagacgaactcatgggcgcagctcgaaatttgaccgaagaagagaaaaaagagtacaaagaaataaaatgggacgataaggaggtttgtccattctatatggttaggttttgccctcacgatctctttgtcaacacgagaagcgatctcggaccgtgcccgagaattcatgaccagaagttgaaagaaagttttgagaagtccccgcgacacgatgcttatgtgcccaagtttgaagctgaacttgctcaattttgtgagaaattggtcatggacctggatagaagagttcggcgggggcgagaacgtctttctcaagaagtggaacctgcaccaccacctccaatatcagcagaaaagtctgaacagttatctgtgttggaggagaagataaaaaacctgctggaacaagtggagaccctgggtgaggctggcaaggtggatgaagctgaagccctcatgagaaaggtggagattcttaatgttgagaagacaaccttgactcagcagtctcagaacgataaagttttgatgatggctcaggagaaaaagatggctttatgtgagatatgtggttcctttcttgtagcaaatgatgctgctgagaggactcagtctcacatttctggaaagcagcatattggttatggcatggttcgagatttcataactgagtacaaggaagctaaggagaaggcaagggaagaagaaagactagccaaggaaaaagaggtagaagatcggaggaagcagagggagaaagaatatgagagtagaaagaggagtggttcaagtgatagggacaggtatcgtgatcgagatcgtgacagagagagagaacgatacagagaacgtgatcgtgaaaggtctagagagtgggatggtagaagtggtcgtgatggaggaaggggggctgattggagaagcagggataggcaccgtgatcgcagcagatcacgttcccctgttaggcatggtcacaggaggtcacctagaagtccagttcgccagtattagtgggttgtgtgggtagatctctgagctttgaaagtaaatgagctttgttgagactctaccatctccctttcatcaaatattattaaaggagaaaagggttgaggtaggtacaactatattgttgtagttcttgttttatcatttattttaggatttggttaaactgaatttcttttcatgctctctgaaatatatttttgagtccctttgttgggttcattgacggctactggtattaagtatattagacgacaggctcaaaaacatatgcttgaatgacactgctgctcaaggaggtgttcttttttcaatttttttgaggtaacaaataaatctaatctttttcatgacctcaccacaggttgacttccttcatgatatattcttttgtcttttttcttttctgaatattggattcggtccaattatatttgcaaattattgttaggagataaatttaagacacccattgggaaaatatgccccttttagccttcttttgcaacttttgaactttattttatattgccatctatacatgagcttagcttcaaatcacaatggtagcggtagcattgaactgtacgtaaatggttagaagtgtaaaaactcgttgacctcttccactctccttgccattaattcacaaaattgcaatgattgtattgctgcctgcattttgtgcatgaatggggtgtgtttctaggatccttagacttgaaagagtcgacgttgattaacatacaatctttacatcttatcttcatatgaaaaatatatttcttttttacagattcgggtatttttggagttaaaatttcaaaagtgggtgtcagatggttataggtaattactttgtctttgcaaagcgatatttttctagcttctcagtcgtctctttaagacaatttctttagcagacccttttcctgcacgataatcttcttcaatgaactgggtggcaaaggccgtttgcaaaatattagacttgcaaatgtttgatcctggaggtaacaaaattcataatctgcagatagcatattttaaattccaggttgcaggagtggcaggtaactttgtaaacattgatggtatataatctccgctagtgtatctgtatcaaatgtctgggtaagcaatagtttctgcaggcatttaaacttttacaaaatagttgctgctgacggaactattattagaaagaaagaagatgaaagtcaggcagccaaatttaactgaaattggctggactactcatgcttgttatgctatttgctaatggataaattggaatttgaatgaactttttctagctt

SEQ ID NO: 6216 - DNA, 2201 bp, Fragaria vesca
tctctctctctctctctctctgatgcttctactcctctagagcaaaccctaggctccctaaaagcatcgcacctacccaaattggtctaaacccttctcaatctctcctctccaatcagaattcacatagtcttcttctcgatttcaaatcctcctcacttcgatctgccatggatgctcagcgagctctgctggacgagcttatgggcgcagctcggaatttgacggaggaagagaggaaagggtataaggaggtcacttgggactccaaggaggtttgcggagcttatatggttcgattttgccctcatgatctctttgtcaacacccgaagcgatctagggccgtgtcctaaaatacatgactccaagttgaaagagagttttgagaagtctccaaggcatgatgcatatgtgccgaggtttgaagctgatcttgctcagttttgtgacaaattggtgatggatttggacagaagagttaagcgtgggcgagaacgcctctctcaggaggtggaacctccaccaccaccacctctgtcagctgaaaaggccgaacagttatctgttctagaggaaaaaataaagaacttattggaacaagtggaggaacttggagcatctgggaaggtggatgaagctgaagcattgatgagaaaggtggatgtgcttaatgttgagaagacagtcttggctctacagcctccaaatgctcaagcattaatggttccacaggagaaaaaaatggcactctgtgagatctgtggttcatttcttgtggccaatgatgctttagagaggactcagtctcatgtcactgggaagcagcatattggttatggcatggtccgggattttatttcagagtacaaggcagcgaaggagaaagcaagggaagaagaaaagttagctagggagaaagaagcagaagaacgcaggaaacagcaggagaaggaaagtgagagtagaaggagaagtggttcaagtgatagggacaggtatcgtgatcatgacagatatcgagaacgtgacttggatcgtgaaaggtccagagagtggaatggtagaggtggtcaggatggtggaagaggggtggattggaggtccaggaatgggagagatggaggcagggataggtaccgtaatcgaagcaggtcacgttcccctattagacgttcccacaggaggtcaccaaggagtccagttcgcccgtattaatgagttgtgtagatagatgtctgagctttgaaatttattgaggtagatttcatatctctaaggtttatgatgaacatgtgcatttggagttttgaactattttgtcatcatgggtgaaacgtttctttgccatctcacagcttttgttgagactatatcaactccatttcatcaatattattagcgcagaaaagggttgaggtaggtaatatttactattgtaactcatttataatttatttgaattgggatgagataatttttcttgtttctgtatgaaatttatcaaggaattgttttcagagtctcgtatccatttttgatgggtaagttgttgttggctacttctttgttatcacatacttaagacttcagacccaaattgtatgcatgattgacacggcagctgggagaggaaatgctatttaatcattgatgaggtaacatatatacatatatcctatattttcttcctcaagaaaacttagctgatttcctccctcttctttctggtattgagttttaaccactttattgcaaattgcaaattgcaaatgctgctcatgtggtatatggtttaactgggacggatacggaagatgccaatcatacaatgtgatgctttgctacctctttttaaggacatggaaatctaatcatgaagcgggtgctggttcaagcattcgttttcagtcctagacagttggatgaatagaccaacgacaaaatgaatggtaaatatgtgaattacattatcatgtgaattaggtagctttggagttcaagttctggatcacaattctgtctatctggtgggactttctcaaggccttttgatagtggatgtaaaatggtatcggtgaatggagggtaaaatgagtcgcctaatgcaattgaaatttcactggtagaaacagaagccattttctgagtgatatactctacgttcttatggtattcacctttgtcaatacagtctgtaat

SEQ ID NO: 6217 - DNA, 1509 bp, Cannabis sativa
taaaattttgttcggtgaacatcagtagcattagcttccttgtcgctctccgcaagtctattgtccacagagagaagctcagtgctacagaccaaaccctaggaaagcctaactaggaaaacctaggattttatgattacactttcacaattctagtactatcccattccattcccccaaccttctccattttcttagggtttcattatttgttttccccttttgattcgtactcaccgtagccatggacgctcagagagctctgcttgacgaactcatgggcgcagctcgtaatatgacggacgaagagagaaaagggttcaaagaagttacttgggatgataaggaggtttgcggtgcgtacatggttcggttttgtccccacgatctcttcgtcaatactcggagcgatttaggaccatgcccaagaatacacgacccgaagttgaaagaaagttttgagaagtctccaaggcatgacgcatttgtaccaaaatttgaaactgagctagctcagttttgtgaaaaattggttatggacttggacagaagagtaaggcgtggacgggaacgacttgctcaagaggtggaacctgcacctgctcagccattgtcatctgaaaaagctgaacagttatctcagctagaggataagataaagaacttgctggaacaagtggaatctctcggtgaagctgggaaggtggatgaagctgaagcactcatgagaaaggtagacacgcttaatactgagaaggcagctttgactcagcagaccctgcctgataaagtattgctgcttgcacaagagaagaagatggccctttgtgagatttgtggttcttttctcgtagccaatgatgctgtggagaggactcaatcccatatcactgggaaacagcatattggttatggcatggttcgagatttcatttctgagtacaagttggctaaggagaagggaagggaagaagaaaggttagcaagggagaaagaaacagaagagcggaggaaacaaagagagaaggaacttgatagtagaaggagaagtgtttcaggtgatagagacaggcatcgtgatcgtgagcgagagagggacagatatcgagatcgggacttggatcgtgaaaggtctcgagattggaatggtagaggtaatcgagatggaggaagaagtggggaatggagatccagaaatggaagagatggagctagggacaggaaccgtgatcgaagcaggtcacgctcacctgttaggcatggacacaggaggtcacctagaagtccagttcacccatattagtgaaattgtagatagatgtctgagctttgatatttaatgaggtagatttttatcccaaaacttttacaaacacgtgcttttggagccctgacttattgtcttcatgggtgaaacttttttgtttcctatctcacagctttgtagactgacactatatcatcttcctttcatcaatattgttaaaaggagaaaaaggttgaggtagg

SEQ ID NO: 6218 - DNA, 1628 bp, Panax ginseng
gttggataacaaacaaaccagaccgaccttcctgaataccataaaactgtacaccaccacatcgattcgcatcgatctaaattagggtttttctactctttcataccactgcaatatttgccatggatgctcaaagagctttgctagatgaactcatgggtgcagctcgcaatctgactgaagaagagagaaagggatacaaggaagtaacatgggatgataaggaagtgtgtggattttatatggttcgattttgtcctcacgatctgtttgtgaacacacggagtgatctaggaccatgtccaaagattcatgatcagaagttgaaagaaagttttgagagttctccgagacatgcttcgtatgtgccaaagtttgaagcagatctagtccatttctgtgagaagttggtaatggacttggatagaagagtaaggcgtgggcgagaacgtcttgatcaagaggttgaagttcctcctgaaactccggttacagttgaaaaatctgagcagttatctgtgctggaggagaaataagaacctgctggaacaagtggagtcacttggtgaagcgggcaaggtggatgaagccgaagcactaatgagaaaggtggatgtgcttaatgccgagaagacggccatgactcagcaaccccagaatgaccaaagttttaatgcttgctcaggagaaaaagatggctctatgtgaaacttgtggttcatttctaatagcaaacgatgcaatcgagagaactcagtctcatgtcactggcaagcagcatattggttatggcatggtccgggatttccttgctgaatataaggaagctaaggagaaggctagagaagaggaaaggctagcaagggagaaagaagcagaagaaaggaggaagcagagggacaaggaatatgagagtagacgtagaagaagtgattcaggtgacaggaacaagaaccgtgacagggatcaagacagggagtgggaccggtacagagagcgagaccgagaccgagattgtgaaaggtctcgagagagacatggtagaggaagccgtgatgggggaagagggttggattggaagtacagcagttcaagaaatgggagagagggaagcagagatagataccgtgagcgtgataggagcaggtcacgaacccctgttaggcatggtcgcaggaggtcacctaaaagtccagttcgctcatattattgaagtgtggattaataatatctttactttgaagtaagaaaaggtagacatttttataatttagcacgtttaatgaaatgttgagcttttcgagtttaaaattatattgtcaatgggtgaattcttttttgtttgtttgtttgttcccacagctatgttgaaactaatctccctatctccaatataactaaagaaagaaagaaaagtagaatagaggtaaggtaataacttacattgttagtaactctgttatggtctatttaggctaattattttaagctatactttactaaaaaggtaaaaaaaaaaaaaaaaaaaaaagaaaaaaaaaaaaaaaagaaaaaaaaaaaaaagaaaaaaaaaaaataaaaaaaaataaaaagtaaaagtaaaaggaaagaaagaaagaacaagaacg

SEQ ID NO: 6219 - DNA, 1371 bp, Cannabis sativa
taaaattttgttcggtgaacatcagtagcattagcttccttgtcgctctccgcaagtctattgtccacagagagaagctcagtgctacagaccaaaccctaggaaagcctaactaggaaaacctaggattttatgattacactttcacaattctagtactatcccattccattcccccaaccttctccattttcttagggtttcattatttgttttccccttttgattcgtactcaccgtagccatggacgctcagagagctctgcttgacgaactcatgggcgcagctcgtaatatgacggacgaagagagaaaagggttcaaagaagttacttgggatgataaggaggtttgcggtgcgtacatggttcggttttgtccccacgatctcttcgtcaatactcggagcgatttaggaccatgcccaagaatacacgacccgaagttgaaagaaagttttgagaagtctccaaggcatgacgtatttgtgccaaaatttgaaactgagctagctcagttttgtgagaaattggttatggacttggacagaagagtaaggcgtggacgggaacgacttgctcaagaggtggaacctgcacctgctcagccattgtcatctgaaaaagctgaacagttatctcagctagaggataagataaagaacttgctggaacaagtggaatctctcggtgaagctgggaaggtggatgaagctgaagcactcatgagaaaggtagacacgcttaatactgagaaggcagctttgactcagcagaccctgcctgataaagtattgctgcttgcacaagagaagaagatggccctttgtgagatttgtggttcttttctcgtagccaatgatgctgtggagaggactcaatcccatatcactgggaaacagcatattggttatggcatggttcgagatttcatttctgagtacaagttggctaaggaaaagggaagggaagaagaaaggttagcaagggagaaagaaacagaagagcggaggaaacaaagagagaaggaacttgatagtagaaggagaagtgtttcaggtgatagagacaggcatcgtgatcgtgagcgagagagggacagatatcgagatcgggacttggatcgtgaaaggtctcgagattggaatggtagaggtaatcgagatggaggaagaagtggggaatggagatccagaaatggaagagatggagctagggacaggaaccgtgatcgaagcaggtcacgctcacctgttaggcatggacacaggaggtcacctagaagtccaattcacccatattagtgaaattgtagatagatgtctgagctttgatatttaatgagctttgtagactgacactatatcattat

SEQ ID NO: 6220 - DNA, 1985 bp, Gossypium hirsutum
ggttcacagttagctttaaattaaaacaaaattaataagattctactgcgcctctccctgtgcaaaccctaaatctctttcctttccatttgctttaaaaggaaaaggattctatttacgagaacatcctcaaattctttaaccttttctcacaatttcgattccaagtcatggatgcacaacgagctctgcttgatgaacttatgggaacggctcgtaatttaacggaggaagagaaaaagggatacagggaacttcgatgggatgacaaagaggtttgtgcattttatatggttcgcttttgtcctcacgacctcttcgtcaacactcggagtgatctcggacaatgccctagagttcatgatccaaaattgaaagaaagttttgagaagtcctccagacacgatgcttatgtgcccaaatttgaagctgaactggctaagttctgtgagaaattggtgatggaccttgacagaagagttaggcgaggacgagaacgccttgctcaagaggtggagccagcaccacctgctccactatctgcagaaaagtctgaacagttatctgtcttggaggaaaaaataaaaaatctgctggagcaagtggagagtcttggcgaagctggaaaggtggatgaagctgaggcacttatgagaaaggtggaggcacttaatgctgagaagacagtgttgactcagcaacctcagaatgataaagtattgatgcttgcgcaggagaaaaaaatggctctgtgtgaggtttgtggatcttttctagttgctaatgatgctgctgagagaactcagtcccatgttacaggaaagcaacatattggttatggaatggttcgggatttcatctctgagttcaaggaagcaaaggagaaagcaagggaagaggaaaaattagctagagaaaaagaagctgaagaacggagaaagcagaaggagaaggaatatgagagtaggaggagcagaagtgattcaggggatagagacaaatatcgcgaccgagacaaggattctgacagataccgggatcgtgatttggatcgtgaaaggtctcaagagtggagcgggagaggtagtagggatggagagagagaatggaggtacaagaatggtagagatggaggcagggataggcaccataatcgcagcaggtcccgttcccctggtagacatagtcacaggaggtcctcgagaagtcctgttcgccgatattagtgccattctgtacaatagatgttttggctttgaaagccaatgaggtagacctcttattttatttctagtttataaacgtgtgcttttggagtagtgctaaattttgtcatcatggatgaaacttttttcttggtaactcacagctttgttgggactataccaactccctttcatcaaaattactagagaggaaaagggttgaggtaggtataacaatattattgttaactcctttttatcttgtttggactaaatttataacatgcatccgtgggctttgttttgagtctcttctttatcccctcttccttcatatgcttatatctatagtcaagctgctgagagatgatgatcttccaaatttgaggtaacagattaaatttcggttacagcaccacaatgctttagttgtcttccttactctgttattgcctttgtggatgcttttgtatcaattatttgtttgaaacggcttgctgttgtggaataatacagggaaaatctgggatggtttgaacctagaagtaacctttgatgcgtttcttatgttttttaaaacccttgcaatagatttatgtaaagagtactgtttcctttagtcctgtaaatggctaggctcagctattggattgttggttgcatttgttctttctgatgggtttgtatgattacgaatttactatgtgtttccataacattgttctttgtagcttgaattctgattttggtaagttggaataaaattaaatgagttggtcc

SEQ ID NO: 6221 - DNA, 1625 bp, Gossypium hirsutum
gcccacagttgcctaaaacattaaaatcaagtgctctgcccctcttctttcttgcttccataaaatccttctttctcattgttttgtttcacttaatatttcgatttgcttcttcttttggttcttactaaaagcaataatttcaacttctctatttacgcgaagaccctcaagtttctttaatctcaaaaaccctaagcaatggatgcacagcgagctttgcttgacgaactcatgggaactgctcgtaatttaacggacgaagagaagaagggatatagggaaatccggtgggatgataaagaggtttgtgctttctacatggttcgattttgtcctcacgatctcttcgtcaacactcgcagtgatctcggaccatgccctagagttcatgaccaaaagttgaaagaaagttttgagaagtctccaagacatgatgcttacgtgcccaaatttgaagctgaactggctcagttttgtgagaaattggttatggaccttgacagaagagttaggcgcggtcgagagcgccttgctcaagaggtggaacctgcaccacctgctccattatctgcagaaaaatccgaacaactatctgtcatggaggaaaaaataaaaaacttgctggaacaagtagagactcttggtgaagctggaaaggtggatgaagctgaggcgcttatgagaaaggtggaggcgcttaatgctgagaagacggccttggctcaacaacctcagaatgataaagtattgatgctggcacaggagaaaaaaatggccctatgtgaggtttgtggatcttttctagtagctaatgacgctgctgagaggactcaatcacatgttacaggaaagcaacatattggttatggcctggttcgggatttcatctctgagttcaaggaagccaaggagaaagcaagggaagaggaaaagttatcaagagagaaagaagccgaagaacggagaaagcagagggagaaggaatatgagagtaggaggagaagcgattcaggtgatagggacaaatatcatgatcgagagaaggaccgagacagatattgggaacgtgatttggatcgcgaaaggtctcgagagcggaatgggagaggtattcgtgatggagagagggattggaggtacaggaatggcagagatggaggcagggatagacaccggaaacgcagcaggtcccattcccccagtagacatagtcgcaggaggtcctcaagaagtccagttcaccgatattagtgcattctgtaggtagatgttttgctttgaaatccaatgaggtagacaacttttttttactttactttttctagtttataaacttgcgattatggagtagtgcaaatttggtcgttcacgggtggagcatttttcttggcatctcacagctttctcgagactaccccgaatcccttttgtcaacattagtagggaagaaaagggttgaggtaggtaaaacaatattatttgcaactattttttttttttaaatcttgtgtaaactaaattatagtttgcagatgtggaaattgttgagtctcttatagctccttcccttgatatgctttttatccatatagtcaagcttcttgtaagtaaaaaaaaaaaaa

SEQ ID NO: 6222 - DNA, 2032 bp, Gossypium raimondii
gctcaaagcggtaacacttgttcaagccagggttcacataaaacaaaaataataaggttctactgcgcctctccctgtgcaaaaccctaaatctctttcctttccatttgctttaaaaggaaaaggattctatttacgagaacatcctcaaattctttaaccttttctcacaatttcgattccaagtcatggatgcacaacgagctctgcttgatgaactcatgggaacggctcgtaatttaacggaggaagagaaaaagggatacagggaacttcgatgggatgacaaagaggtttgtgcattttatatggttcgcttttgtcctcacgacctcttcgtcaacactcggagtgatctcggacaatgccctagagttcatgatccaaaattgaaagaaagttttgagaagtcctccagacacgatgcttatgtgcccaaatttgaagctgaactggctaagttctgtgagaaattggtgatggaccttgacagaagagttaggcgaggacgagaacgccttgctcaagaggtggagccagcaccacctgctccactatctgcagaaaagtctgaacagttatctgtcttggaggaaaaaataaaaaatctgctggagcaagtggagagtcttggcgaagctggaaaggtggatgaagctgaggcacttatgagaaaggtggaggcacttaatgctgagaagacagtgttgactcagcaacctcagaatgataaagtattgatgcttgcgcaggagaagaaaatggctctgtgtgaggtttgtggatcttttctagttgctaatgatgctgctgagagaactcagtcccatgttacaggaaagcaacatattggttatggaatggttcgggatttcatctctgagttcaaggaagcaaaggagaaagcaagggaagaggaaaaattagctagagaaaaagaagctgaagaacggagaaagcagaaggagaaggaatatgagagtaggaggagcagaagtgattcaggggatagagacaaatatcgcgaccgagacaaggattctgacagataccgggatcgtgatttggatcgtgaaaggtctcaagagtggagcgggagaggtagtagggatggagagagggaatggaggtacaagaatggtagagatggaggcagggataggcaccataatcgcagcaggtcccgttcccctggtagacatagtcacaggaggtcctcgagaagtcctgttcgccgatattagtgccattctgtacaatagatgttttggctttgaaagccaatgaggtagacctcttattttatttctagtttataaacgtgtgcttttggagtagtgctaaattttgtcatcatggatgaaacttttttcttggtaactcacagctttgttgggactataccaactccctttcatcaaaattactagagaggaaaagggttgaggtaggtataacaatattattgttaactcctttttatcttgtttggactaaatttataacatgcatccgtgggctttgttttgagtctcttctttatcccctcttccttcatatgcttatatctatagtcaagctgctgagagatgatgatcttccaaatttgaggtaacagattaaatttcggttacagcaccacaatgctttagttgtcttccttactctgttattgcctttgtggatgcttttgtatcaattatttgtttgaaacggcttgctgttgtggaataatacagggaaaatctgggatggtttgaacgtagaagtaacctttgatgcgtttcttatgttttttaaaacccttgcaatagatttatgtaaagagtactgttcctttagtcctgtaaatggctaggctcagctattggattgttggttgcatttgttctttctgatgggtttgtatgattacgaatttactatgtgtttccataacattgttctttgtagcttgaattctgattttggaagttggaataaaattaatgagttggtccatgaacaagccatatagcattgcttcatttat

SEQ ID NO: 6223 - DNA, 2273 bp, Panax ginseng
ccctaataaaaaccagacaaaactttgacacctcgataagagtcactcaattagcctttgatctatccgcagaagtagggtttatctaatatttcaccgctgcaacttagcaatggacgctcaaagggctttgctagatgaactcatgggtgcagctcgcaatctaactgaagaagagagaaagggatacaaggaagtaacatgggatgataaggaagtgtgcgggttttatatggttcgattttgtcctcacgatctgttcgtgaacactaggagcgatctaggaccatgcccaaaaattcatgatcagaagttgaaagacagttttgagagttctccaaggcatgagtcgtacgtgccaaagtttgaagcagacctggctcatttctgtgagaagttggtaatggacttggatagaagagtaaggcgtgggcgagaacgccttgatcaagaagttgaagttcctcctccacctccggtcccagttgaaaaatctgagcagttatctgtgctggaggagaaaataaagaacctgctggaacaagtggaggcccttggcgaagcaggcaaggtggatgaagctgaagcactaatgagaaaggttgatgtgcttaacgctgagaagacagccttgactcagcaaccccagaatgacaaaattttaatgcttgcacaggaaaaaaagatggctctatgtgaaacttgtggttcttttctcgtagcaaacgatgcgattgagagaactcagtctcacgtcactggcaaacagcatattggttatggcatggtcagggatttccttgctgaatataaggaagctaaggagaaggcaagagaagaggaaaggttagcaagggagaaagaaacggaagaaaggaggaagcagagggagaaggaatatgagagtagacgtagaagaagcgattcaggtgacagggataggaaccgtgatcgggatcaggaccaagagcgggaccggtaccgagagcgggaaaggtctcgggagagaaatggtcgaggaagccgtgatgggggaagagggttggattggaagtataacaattctagaaatggaagagagggaagcagagatagataccgtgagcgtgataggagcaggtcgtgttcccctgttaggcgtggacgcaggaggtcatccagaagtccagttcgctcatattactgaattgtgtagataaatgtctgaactttgaagtcagaagagctttgttgagattaatctccctatcatcaaaatttaactagagggcaaagtgatgaggtaggtataacttcattgttgtaattctgttatgtggtctattttaggttatttcttagcatactcacttgaaatattattcctggagttttttacccattctctttgggggacttgtgggaccttaatctcaaatagttaaaaagaagaaggaatcagtttatgtgcatgagtaaccttgctgctggtagagatcacggttttttctcaactgtgaggtaacttataaatctcaaacttttggtggttgcacccatggattgacttgtaataatcacaggattcagttttccttactttctgatctttcagctaacctaagcattcttgccatgtcctgcactttgacatatcgtgagcttcacaaatatggttttgctttatgctgttgattgctctagttaagataaattaacctaaatataacattataaccatgaatggtagcagctagagtgggaaaatttaggaaacgaagttaagcctcggaatctagaggaattttgcaatcaactctaattaatggaactttggaaagttttttccttacgggtgcacaagtatgtctaattaaggtgatggtaggtatgaaatagactttaaaatggttggaagtgatttttagctacttttccaccctcatattgatcccttgagctgcatgataagttcaaccgccagaaaattttgaattggaattggacttcacgtattgggcagacattggattttgcatggtgcgagctactgcctgcctgccagagagactattcaaactttaatatactattttgcagggcaagacaattctttttccagatcgcaggagaagacagtcttctacaggtgaaaccttattcgtgatatactaatttgacaaagattatttacaagggagtgatttgtgtgggtaatcatgcccgcaagattaattatgtaatgggggctatcaaactgaaaacagatatggctaaattttcttttggatgac

SEQ ID NO: 6224 - DNA, 2271 bp, Panax ginseng
cgaccttcctgaataccataacactgtacaccaccacatcgattcgcatcgatctaaattaggggttttctactctttcacaccactgcaatattagccatggacgctcaaagggctttgctagatgaactcatgggtgcagctcgcaatctaactgaagaagagagaaagggatacaaggaagtaacgtgggatgataaggaagtgtgtggattttatatggttcgattttgtcctcacgatctgtttgtgaacactaggagcgatctaggaccatgcccaaaaattcatgatcagaagttgaaagacagttttgagaattctccgaggcatgattcgtacgtgccaaagtttgaagcagacctggctcatttctgtgagaagttggtaatggacttggatagaagagtaaggcgtgggcgagaacgccttgatcaagaagttgaagttccccctccacctccggtcccagttgaaaaatctgagcagttatctgtgctggaggagaaaataaagaacctgttggaacaagtggaggcccttggtgaagcgggcaaggtggatgaagctgaagcactaatgagaaaggttgatgtgcttaacgctgagaagacagccttgactcagcaaccccagaatgacaaaattttaatgcttgcacaggaaaaaaagatggctttatgtgaaacttgtggttcttttctggtagcaaacgatgcaattgagagaactcagtctcacgtcactggcaaacagcatattggttatggcatggtcagggatttccttgctgaatataaggaagctaaggagaaggcaagagaagaggaaaggttagcaagggagaaagaaacggaagaaaggaggaagcagagggagaaggaatatgagagtagacgtagaaggagcgattcaggtgacagggataggaaccgtgatcgggatcaggaccaagagcgggaccggtaccgagagcaggaaaggtctcgggagagaaatggtcgaggaagccgtgatgggggaagagggttggattggaagtataacaattctagaaatggaagagagggaagcagagatagataccgtgagcgtgataggagcaggtcgtgttcccctgttaggcgtggacgcaggaggtcatccagaagtccagttcgctcatattactgaattgtgtagataaatgtctgaactttgaagtcagaagaggtagacatttttataatttactatgtttaatggatgtgtgcttttggagtttaaaattattttcttcatgggtgaaattcttttttgttcccacagctttgttgagattaatctccctatcatcaaaatttaactagagggcaaagtgatgaggtaggtataacttcattgttgtaattctgttatgtggtctattttaggttatttcttagcatactcacttgaaatattattcctggagttttttacccattctctttgggggacttgtgggaccttaatctcaaatagttaaaagaagaaggaatcagtttatgtgcatgagtaaccttgctgctggtagagatcacggttttttctcaactgtaaggtaacttataaatctcaaacttttggtggttgcacccatggattgacttctaataatcacaggattcaattttccttattttcttatctttcagctaacctaagcactcttgccatgtcatgcactttgacatatcacgagcttcacaaatatggttttgctttatgctgttgattgctctagttaagataaattaacctaaatataacattataaccatgaatggtagctagagtgggaaaatttaggaaaagaagattttgctatcaactctaattatggaactcggaaagtttttcccttacgggtgcacaagtatttgtctaattaaggtgatggtaggtatgaaaaagactttaaaatgcttggaagtgatctttagctgcttttccaccctcatattgatcccttgaggctgcatgataagttgaaccgccagaaaattttgaattggaattggacttcaccacctactgggcagacattggattttgcatggtgcgagctactgcctgcctgcctgttccatctaagacgaagatgtgaaggtctcggcgggagattctgcgatcttcaccttcacaacagagattgggccagtttttgcgggaaagcgaagagtgaacctctttctgttcttgtttttctgtttttcaggccccatgtactctgcgttgataccactgctt

SEQ ID NO: 6225 - DNA, 1992 bp, Gossypium raimondii
cttgttcaagccagggttcacataaaacaaaaataataaggttctactgcgcctctccctgtgcaaaaccctaaatctctttcctttccatttgctttaaaaggaaaaggattctatttacgagaacatcctcaaatactttaaccttttctcacaatttcgattccaagtcatggatgcacagcgagctctgcttgatgaactcatgggaacggctcgtaatttaacggaggaagagaaaaagggatacagggaacttcgatgggatgataaagaggtttgtgcattttatatggttcgcttttgtcctcacgacctcttcgtcaacactcggagtgatctcggactatgccctagagttcatgatccaaaattgaaagaaagttttgagaagtcctccagacacgatgcttatgtgcccaaatttgaagctgaactggctaagttctgtgagaaattggtgatggaccttgacagaagagttaggcgaggacgagaacgccttgctcaagaggtggagccagcaccacctgctccactatctgcagaaaagtctgaacagttatctgtcttggaggaaaaaataaaaaatctgctggagcaagtggagagtcttggcgaagctggaaaggtggatgaagctgaggcacttatgagaaaggtggaggcacttaatgctgagaagacagtgttgactcagcaacctcagaatgataaagtattgatgcttgcgcaggagaagaaaatggctctgtgtgaggtttgtggatcttttctagttgctaatgatgctgctgagagaactcagtcccatgttacaggaaagcaacatattggttatggaatggttcgggatttcatctctgagttcaaggaagcaaaggagaaagcaagggaagaggaaaaattagctagagaaaaagaagctgaagaacggagaaagcagaaggagaaggaatatgagagtaggaggagcagaagtgattcaggggatagagacaaatatcgcgaccgagacaaggattctgacagataccgggatcgtgatttggatcgtgaaaggtctcaagagtggagcgggagaggtagtagggatggagagagggaatggaggtacaagaatggtagagatggaggcagggggaggcaccataatcgcagcaggtcccgttcccctggtagacatagtcacaggaggtcctcgagaagtccagttcgccgatattagtgccattctgtacaataggtgttttggctttgaaagccaatgaggtagacctcttattttatttctagtttataaacgtgtgcttttggagtagtgctaaattttgtcatcatggatgaaacttttttcttggtaactcacagctttgttgggactataccaactccctttcatcaaaattactagagaggaaaagggttgaggtaggtataacaatattattgttaactcctttttatcttgtttggactaaatttataacatgcatccgtgggctttgttttgagtctcttctttatcccctcttccttcatatgcttatatctatagtcaagctgctgagagatgatgatcttccaaatttgaggtaacagattaaatttcggttacagcaccacaatgctttagttgtcttccttactctgttattgcctttgtggatgcttttgtatcaattatttgtttgaaacggcttgctgttgtggaataatacagggaaaatctgggatggtttgaacgtagaagtaacctttgatgcgtttcttatgttttttaaaacccttgcaatagatttatgtaaagagtactctcctttagtcctgtgaatggctaggctcagctattggattgctggttgcatttgttctttctgatggatttgtatgattacgaatttacaatgggtttccataacattgttctttgtagcttgaaccctgattttgaaagttggaataaagttaatgagttggtccatgaacaag

SEQ ID NO: 6226 - DNA, 2370 bp, Tropaeolum majus
taccgatcctggatgcccctcattaattcaagctagggttctttgttccacttcgaatcctcatctaccttacttttatcagccatggacgctcagcgagctctgcttgacgagcttatgggctcagctcggaatttgacggaggaagagagaaaaggatataaggaaattagatgggatgacaaggaggtttgtgtgttctatatggtccggttctgtcctcatgacctttttgtcaacactcgcagcgatctaggaccatgccctcggattcatgacctgaagctgaaagaaagttttgagaactctccaagacatgactcttatgtgccaaaattcgaagctgagcttgcccagttctgtgagaaattggtgatggatctggatagaagagttaggcgcgggcgtgaacgcctggctcaagaggtagagcctgcacctcctgctccactatcagctgaaaaggttgaacaactatctgtgctggaggagaaaataaagaacctgctggaacaagtggagactcttggtgaagctggcaaagtcgatgaagccgaagctctaatgaggaaggttgaagcccttaatgtcgagaagaccttgattcaacaaccccagaatgataaggtactgatgcttgcacaggaaaaaaagatggctttgtgtgagatctgtggttcatttcttgtagcaaatgatgctgcagaaaggactcagtctcatgtcactgggaagcagcatgttggttatggcctggttcgagactatattgctgaatacaaagaagccaaagaaaagacaagggaagaggaaagattagcaagagagaaagaagcagaagaaaggagaaagcagagggagaaagaatacgagagtaggagtaattcacgtgatcgagatcaagactcagaccggtaccgagaacgtgacaggaatcgcgaaacgtcaagggattggaacagcaggtctaatcgagatggaggaagggattggaggtccaggaatggacgagattcaggcagggataggtaccgtaatcgcagtaagtcacgttcccccggtaggcatggtcacaggaggatgtcaagaagtccagttcgccagtattagggtgttgataaattgtctgagctatgaaagcgataaggtagacgtttttatatcctctagtttacgaacatgtgcttttggtgttgtgtcaaattatcatcagggtgaaaattttcttttgctatttcacagctttgttgagactatgtcatccctctttcatcgaatataaaattagaggagaaaagggttgaggtaggtatattacattgttgtaactctttatgctggcatgggctgaactgaatttctttatgtgctccctcgtaacattattctcaaagtctgtctctgtccctcattcttttgagataaatggtggtggctatcctgtttgagaaaacggaaagtgtagacttcaattacaccggtgccaaagatttgtgattttctttcaattatgaggtaacatgtcacaaagctcagttctctgttgtcgttgtaatatcttcacataccttcttccttgcaacttgcttcctcattgtgaatgtatgcattatgaggaagtacagatatgatgatttgctggactggtgatcagctatatcttatctatctccctttgaaatatattttcatgtttacggaatcaggtattctgggaacgatcaatattctactgctctaggtaaccattttgtccctgctgaccaatttttacgtatatgaaacaaatctataaaaaaaacgtggtttctctggcagaagttaatcactcatgtctaaaagatgatttacggttatgtaaatcttctttgcaaacgttggacttgcaatagccagaggcggcccaattggagccgatatttatacgtgcatatgctatggtggtgtggaatatagttcatacgattggtttagtttgtggttcacacgttgaacaagttgtcgaggttcatgacctaggttgtgttggaacatcttccaaactggtagggggtgaaaaaggctattggcattttttgtgctgttttttgtttagatactgaggaatggtatacaagtaatcaaacatttgtaagttcgagacgaaatataataaccttaagaatattgagttgatgagctttggagatatatctattagacatcaatgtaaggtgcaaagaaacaccatcgaggctaataggcctagaagggccgttttgcgaatcttatcacatttggtttttttgatggtttttttgagatcatcgaaagctggttggggtggtctttcatcatttttccgtaagctcgtagggatggactttcata

SEQ ID NO: 6227 - DNA, 1459 bp, Vigna unguiculata
tctttcttttgctaacagctgaaaaattttctcagaagcaacagaaggcatgcatagaagtgttgttcagagctcaccagtgcaacaaatgatggctggaaaccctaactggtggaacatcaatatcaacaccatgcctccacaacaaccttctcctttcttctcctctccttcaaactttcccatcccttatgctgctccttcttctcttccctttccttcttggaacgaaaatcaagaccttcctgaatcatggagccagttactcatgagtggagtggtggatgaacaaggaaaagttgggatgggacagtttcagacgaagaagatggagaactgggaggatcaaatgctaggtcaagctcaaaacgcttctctggttgatgttaaacaagaaaattcggttaacagttatgtatatggccatggaaacgaagagcttcagtcatcaaaaccatcttggtctccgaaatcatcatgtgccacaagtttcagtagcaacatgttagatttctctaacagtaacacagatgcaagacatcctccaccagatcgatcttctgagtgcaatagcagtgcaggtggtggggcactgaagaaagctagggttcaaccctctgctacaacacaggctacattcaaggttaggaaggagaagctaggtgacagaattacagctcttcatcaactcgtttccccatttgggaagactgacacagcctctgtcttgttagaagctattgggtatatcagattccttcagagtcaaattgaggcccttagcttaccatacttgagcggtggaccagggagtgggaggcagcagaattctgttcaaggagagaagaattgtatattccctgaagaccctggtcagctgctgaataatgagaacagcttgaaaaggaaagcagctggagaaccggaaactgaagaagaacaaaagaaggggctgaggagtagagggttgtgtctggttccagtgtcatgcacactgcaagttgggagtgacaatggagcagactattgggcacctgccctcggagggggctttcgttaggacaagtttacaattagggcagcatatacatatataaaaatatatggtagcatgcaaagaggtaaattcatggaaatgatataacatcatgagcagtcaatctgctaaaaaaaaatctaaggctgattgctcatgatgctatacttcattcctgaataaaatgtgtgctagctagctctcacaatagtatttgctagcccttaattattagaagacttcataattcatggaaaatcaagcttagttttctttattttcgttaattagcttaattaagatggtggcacgtactaatgctctatgtttcgatgtatatgcaatatttgtatgattaatcatttgaatatgctacttttttagcagcattaattgaactgatccatgaccattattattata

SEQ ID NO: 6228 - DNA, 1799 bp, Glycine max
agcaaaagcaagcgggggaatagaaaagcaaggaaataaaagaaataagacaaaaggaagaaagaaagggaaaataaaagcaataaaaaaggaaagaaaagagcgtaaacaaagacaaaggttctcaaaactccataattattattcaaattctttcaaaacgggtccaagcccctacttaatcaacccaaggaggacctctcaaattttctacaaaggcagtgtttgggttgggacatcaagctaagaaagggaaagagaaagatcacagaaagagaattcatctttctttgcgaacagctaaaaacctcaaagggaaagaaggcatgaatagaggtgttcttcagagctcaccagtgcaacaaatgatgactggaaaccctaactggtggaacatcaatatcaatagcatggctccacaagctcctcctttcttgtccactcctaacaactttcctatcccttgtgctcccacttctcttccctttccttcttggcatgagaatcaagatcttccagagtcatggagccagctacttatgagtggagtggtggatgaacaaggtaaggctgggatgggtcagtttattcagactaagaagttggagagctgggaggatcaaatgctaggtcaggctccaaacgcttctcttgttgatgttaaacaagaaaacttggttaacagctatgcatatgggcatggaagcgaagaacttcagtcatcaaagccatcttggtctccaaaatcatgtgtgacaacaagtttcagtagcaacatgttagatttctctaacaataagacagatgcaaggcatccaccaccagatctatcttctgagtgcaacagcactgcagctggtggggcactcaagaaagctagggttcaaccctctgctacaacgcagactacgttcaaggttaggaaggaaaagctaggtgagagaattacggcccttcatcagctcgtttccccatttgggaagactgacacggcctctgtcttgttagaagctattgggtatatcagattccttcagagtcaaattgaggctcttagcttaccatacttgagcggtggatcagggaacacgaggcagcaacattctgttcaaggagagaagacttgtatattccctgaagaccccggtcagctgctggatgaaaactgcttgaagaggaaagcagctggagagccggatactcaagaagaaccaaagaaggggctgaggagtagagggttgtgtctggtgccagtgtcatgcacactgcaagttggaagtgacaatggagcagattattgggctccagccctaggagggggctttcgttaggagttttttacaaatggggcagcatatacatataaatatggtagcatgcatagaggtaaattcatggaaatgatataacatcatgagcagtcaatctgctaaaaaaaatctaaggctgattgctcatgatgctatacttcattattcctgaataaaatgtgtgctagctagccgtgacagtatttgcaagcccttgaagacttcataattcatggaaatcaagcttaattagttttctttattctcatttagcttaattaattaagatgatggtactaattaatgcgctatatttcgatgtatatgcaacatttgtgtgattaatcatttgaatgctacttttttagcagcattaattgaactgattaccattatgctcactagcttatatgttgttattactgtttcaagttagcaaagtattctgtctctttgggtaaacttggtaaagataaaaagtcatgaacg

SEQ ID NO: 6229 - DNA, 1647 bp, Glycine max
agaaaagagagtaaacaaagacaaaggttctcaaaactccataattattattcaaattctttcaaaacgggtccaagcccctacttaatcaacccaaggaggacctctcaaattttctacaaaggcagtgtttgggttgggacatcaagctaagaaagggaaagagaaagatcacagaaagagaattcatctttctttgcgaacagctaaaaacctcaaagggaaagaaggcatgaatagaggtgttcttcagagctcaccagtgcaacaaatgatgactggaaaccctaactggtggaacatcaatatcaatagcatggctccacaagctcctcctttcttgtccactcctaacaactttcctatcccttgtgctcccacttctcttccctttccttcttggcatgagaatcaagatcttccagagtcatggagccagctacttatgagtggagtggtggatgaacaaggtaaggctgggatgggtcagtttattcagactaagaagttggagagctgggaggatcaaatgctaggtcaggctccaaacgcttctcttgttgatgttaaacaagaaaacttggttaacagctatgcatatgggcatggaagcgaagaacttcagtcatcaaagccatcttggtctccaaaatcatgtgtgacaacaagtttcagtagcaacatgttagatttctctaacaataagacagatgcaaggcatccaccaccagatctatcttctgagtgcaacagcactgcagctggtggggcactcaagaaagctagggttcaaccctctgctacaacgcagactacgttcaaggttaggaaggaaaagctaggtgagagaattacggcccttcatcagctcgtttccccatttgggaagactgacacggcctctgtcttgttagaagctattgggtatatcagattccttcagagtcaaattgaggctcttagcttaccatacttgagcggtggatcagggaacacgaggcagcaacattctgttcaaggagagaagacttgtatattccctgaagaccccggtcagctgctggatgaaaactgcttgaagaggaaagcagctggagagccggatactcaagaagaaccaaagaaggggctgaggagtagagggttgtgtctggtgccagtgtcatgcacactgcaagttggaagtgacaatggagcagattattgggctccagccctaggagggggctttcgttaggagttttttacaaatggggcagcatatacatataaatatggtagcatgcatagaggtaaattcatggaaatgatataacatcatgagcagtcaatctgctaaaaaaaatctaaggctgattgctcatgatgctatacttcattattcctgaataaaatgtgtgctagctagccgtgacagtatttgcaagcccttgaagacttcataattcatggaaatcaagcttaattagttttctttattctcatttagcttaattaattaagatgatggtactaattaatgcgctatatttcgatgtatatgcaacatttgtgtgattaatcatttgaatgctacttttttagcagcattaattgaactgattaccattatgctcactagcttatatgttgttattactgtttcaa

SEQ ID NO: 6230 - DNA, 1731 bp, Cajanus cajan
cacgaaaggaagaaagaaaagaaaagcaataaagaaagggaagaaaagagagtaagcaaagacaaaggttctcaaaactccataattattattcaaattctttcaaaacgggtccaacaagtggagttccccctcttaacaacccaaagagaggacctctcaaattttctacaaagacagtgtttggtgtggaacatatattcaagccaagaaagggaaagagaaagagaaagagaaagatcaagaaagagaactcatctttctttgtgaacagccaaaaatctcaatcgtaagaggaggcatgaatagaggtgttcttcagagctcaccagtgcaacaaatgatgactggaaaccctaacttgtggaacatcaatatcaataacatgcctccacaagctcctcctttcttgtccactccttccaactttcctatcccttatgcccccacttcttcttcttttccctttccttggcatgagaatcaagaacttcctgagtcatggagccaactactcatgagtggtatggtggatgcagaagataaggctgtgatgggccagtttcatactaagaagttggagaactgggaggatcaaatgctaataagtcaggcttcaaatgcttctcttattgaagtgaaacaagaagactcggttaacagctatgtatatggccatcgaaacgaggaacttcagtcatcaacgccatcttggtctccaaaatcctgtgtgacaagttacagtagcaacatgttggatttctctaacaataagacagatgcaagacatccaccaccagatcgatcttatgagtgcaacagcagcggagctggtggggctctcaagaaagctagggttcaaccctctgctacaacacagtctacattcaaggttaggaaggagaagttaggtgacagaattacagcccttcatcagctcgtttccccatttgggaagactgacacggcctctgtcttgtttgaagctattgcgtatatcggattccttcatagtcaaattgaggtccttagctcaccatacttgaggggtggatcaggaaacacggggcaacaacaacattctgttcaaggagagaagaattgtatattccctgaagaccctggtcagctgctgaatgaaaactgcttgaagagaaaagcagctggagaaccggatactcaagaagaaccagagaatagcttgaggagtagagggttgtgtctggtgccagtgtcatgcacactgcaagtggggcgtgaaaatggagcagactattgggctcctcccctaggaggtggctttcgttaggtcaagttcataattagggcagcatatacatatatatacatacatggtagcatgcaaattaagaggtaaattcatggaaatgatataacatcatgagcagtcaatctgttaaaaacatctaaggctgattgctcatgatgctatacttcattcctgaataaaaatgtgtgccatagctatccctgacaagtatttgctagcccttgaagacttcataattcatggaaattaattaagcctagttttctttattttcattattagcttaattaagatggtggtactaatgctctatattttattgtatatgcaatatttgtatgattaatcatttgaatgctacttttttagcagcattaatcgatcaactaatgaccattatgctcacttatatatttttagttgtatttcttcaagttacc

SEQ ID NO: 6231 - DNA, 951 bp, Vigna unguiculata
aaagcgggtcctgtgttgggtcgaatataacaaacacatgatggatacagacggtgacgtaacttgaacttgtcagtgatttgcggtggttgttgagaatggatgcgaacggagagagtgagagaggaaaaggaagtgtgagcttagagggagagaaggtgatattggtcccttacatggaggcacacgtccccaaatatcaccaatggatgaaggacccttctctccttcaggccactgcctccgaccctctcacccttcagcaggagtaccaaatgcagctctcatggatccaagaccctttcaaggagaccttcattgtactggacaaggacttggttgttggacaattctcgcacggggaaccccacctcgaagccatggttggtgatgtaaatctgttcatgaatgatttggatgatcctcacgtggcagaggttgaaataatgattgcagaaccaaagagccgtaggaagggacttggaaaggagtctgttctgatgatgatgacctttgctatcgagaagttaggaattaatacctttcggactaaaattggggactcaaatggagcatcccttgacatgttcaaaaaattggggtttgtgcaaacctcatatagcagcatcttcaaagaggtcactttggagttgcaaatgacacagcccaagaaagaggatatgcttggtttaatgaaaatggtaatcaagcatacataaacgtagcgatatcacttccagtttatttgttggtaatagaatgatctcttcggttgctattcttgttttgtgatgtccggttaaagtgtaactatgctaaattcttgacattattcatacaactataacctcgtctaagtgtaataatctggaacaatattaacggcggagatgtttagcgtgtttatatttttcatttttaaatgagaagaacagacccgatgcggaggag

SEQ ID NO: 6232 - DNA, 1011 bp, Glycine max
cattttcatgatgaattaaagtaaaaaaaaaagtgctaataggaaaaaaagaagtgtcaataacaaagctctctacataacggaaggggacaggggagtggggtttgattgcttttgtttgtgtgaggcaattacagagtgagaatcgatgggggagaaagggtgtgtgagcttagaaggaaagaaggtgatattggtcccttacatggaggcccacgtgcccaaatatcacgaatggatgaaggacccttctctccttcaagccactggctcagagcctctcaccctccaacaggagtacaccatgcaactctcctggtcccaagaccctaacaaagagacctttattgtattggacaaggacttggttgttggcgatttctctcacggggaaccccaccctgaagccatggttggagatgtaaatattttcatgaatgatttggatgatcctcacgtggcagagattgaaataatgatagctgaaccaaagagccgtaggaaaggacttgcgaaggagtctgttctgatgatgatgacctttgcaattgagaagttaggaattaatatctttcgggttaaaattggggaatcaaatggagcatccctcgacctgttccaaaaattggggtttgtgcaaacttcatatagcagcatcttcaaggaggtcaccttggagttgcaaataacacagcccaagaaagaggcgatgcttggtttaattggtactgtaatcaaacatacctaaacctagcaatatctcacttcgagttatttagtggtaatagaatgatcttatctgtttttattccttgtttttatgacgtgcggctaaaagctggcctaattatacaaaattctgacatcattcatctaactattattatctcttctaagtgtaataatttgaaattaaaagtaatagatctgtatttgtaataccttttttgctatgatcctatttcctctatccatattgatgagatgaattataaacgaaataaattatga

SEQ ID NO: 6233 - DNA, 1125 bp, Cajanus cajan
atggtaaaacactgttaaccggaggggagtggcgtagcgtattgcgttgaagtgagagagtggatgggggagagaaggaacggaaaaggtagcgtgagcttagagggagagaaggtgatattggtcccttacatggaggcccacgtgcccaaatatcacgaatggatgaaggacccttctctccttcaagccactgcctccgagcccctcacgctccaacaggagtaccacatgcaactctcctggtcccaagaccctaacaaggagaccttcattgtgctggacaaggacttggttcttggcgatttctcccacggggaaccccaccttgaagcaatggttggtgatgtaaatatatttatgaatgatttggataatcctcatgtggcagaggttgaaattatgatagctgaaccaaagagccgtaggaaaggacttgcaaaggagtctgttctgatgatgatgacctttgctatcaagaagttaggaattactagctttcaagttaaaattggagactccaatggagcatcacttgacctgttccaaaaattggggtttgtggaaacttcatatagcagcatcttcaaggaggtcactttggagttgcaaataacacagcccaagaaggaggagatgcttggtttaatgggtactgtgatcaaacatacataaacctagcaatatctcacttccaagttatatattggtaataggatgatctctttgtttttccaagttatatattggtaactattattaccttagtgtaacaatttgaaatttcaagtaaaagattcgtatttgtaatacctgttttgctatgacccttttttacctatttgtctctctcatctggagtatgagttagttgcgtagtgttatagtttcactagggttctaaaatgtgactgttgattgcaagggaatctcaagtctcttagattagtatgaagtcaattgcaattgtcatggagtgaagtggttgtggtccataaacaaatatcgttgatttcctcataagtgcttgcttaatgcttatgatagcttcacaatggtatatatgttgttagtgatgaaaactgattcagaaaatgggctagtactgttagaatgaatagaaat

SEQ ID NO: 6234 - DNA, 2346 bp, Glycine max
agatgtaaaaataatcactatggcaatggcataggaggcacagtgttgagttgagtgtctccctctccctctccgctactgcaactctctctctgcttttccaattttactctgcaccgcaataatcataaacgacgccgtttgaatttccacgaaacccagatttcgtgggagcttatggcttccattcacgccaatctcgtccccaacttgtcctttaatcacttccagacaccaccatcatcgtaccttgttggtgctggtattgtgcaacgtggagttagtttgcgcaattgtagaaggaaggttccttgcataataaagtgtgaaaagaaagatgatgaagttgaacacattcagaatgtttcagttgagcgtccaccctattacagttacttggactccacctccggccagctcgagccggcctccggtgcccgagcgagtattccgggccaagagtattggcccgagggaactgctagtcgtgtgagggctgcaagggcacctgctccaactgctgaatcatcaacctctccatcttatggaaccaagcctggaagtaggaggaagaattacaagacaactgttcctgctgctgctgcttcgtctcaacccattgttgaatcaaatggcactggttctggaggttcttctgaggttttgattgaatccttggaagagtctcaggatgacgtgtctgactttgttgtttatcagtcggaacctgaggaggaagagttgagtgaatacgagttcgataagaaacttggacttcctcatccgtttattgatccaaaggttaataagccgatagaggggacactttcgaatgacgagctgtggtggaattggagacagccggagaaagaacaatggtccaggtggcagaggaggaaaccggatgttgaaacggttttcctgaatgctatggcagaaaccgggcaaataaagcttcacggtgaacacccaacattaacagaaactgccctttaccgagcaaggcgtgaaatttataaagaagaaagacttcaggccgagcaagagagactggaaagagatggtccaattgcatactattcagaatgggtgaaagcatggaaaagggacacatctcgcgaagctattcaaaagcattttgaagagaccggagaagatgaaactactcaactaattgaaatgttttgccaccaaactgaccgagagtatcgcataatgatggggactgatgttcgaatccaaagggatcctttagcaatgcgaatgagggaggatcagataaagcaaatatggggtggagatccagtttacccaactgtgaactatattcaagatccaaatgaagtgattgactacagggggccagattttcatgaaccaacaccaaatatggtgtcttatctgaaggagaaaggaaaacttatttcaagggaggaatttgacaagattatggccaaggaaaagactgaacaaattgagtcgacggagatggatgaagctatggccaaagctgttgacattggagaaaatgatgatgaagaggatagtgatgttgacggagaggaagagggagaagaagagaagcttagtgattattggagtgtgttgaaaagtactcctgagcttcgccagtcaaagccaaaaccaaagaaagaaggtcctttgtcactggacgaggttatagaagagtcagagaacttgactgatttcctgatggactttgaagaagaagaataatggcatgcctccttgtgaagcattccatgtcaagtggtgtattgcattgtgtagacagaatagaaggtttggttgttagtcttcattgtcaatttcctgaactatcagtaacttcttttaggcattgctacagtggatcgggtggtcaaggcaataaacattggagtgagattctgaatactacttcaagggttctagaaacattatcccaaagtacttgtatccacacctgtctacatatacaattttgatatctcagtcttcatacggagcttagcagataaattaactaggagagtgaccattccaatatgttaaatatattgctgcatattgttattttggtgcaaacttgaatctaatatattaagtcacatatcttctttctcaagtagttcaagtaacgatgtcctcgtttattgtgatttacaacctcccgcagattttgccaaggcatgtacaagacttcaaatacaatacaatggtaaactttcgtttgtgaaagtaaatgatttgtatgcacacaatcacttttgtaagtataaatatgaactgaatattgtgtggattgtgaagtttacaaaggggaattgtagtgtaagtaatcaa

SEQ ID NO: 6235 - DNA, 2273 bp, Glycine max
agatgtaaaaataatcactatggcaatggcataggaggcacagtgttgagttgagtgtctccctctccctctccgctactgcaactctctctctgcttttccaattttactctgcaccgcaataatcataaacgacgccgtttgaatttccacgaaacccagatttcgtgggagcttatggcttccattcacgccaatctcgtccccaacttgtcctttaatcacttccagacaccaccatcatcgtaccttgttggtgctggtattgtgcaacgtggagttagtttgcgcaattgtagaaggaaggttccttgcataataaagtgtgaaaagaaagatgatgaagttgaacacattcagaatgtttcagttgagcgtccaccctattacagttacttggactccacctccggccagctcgagccggcctccggtgcccgagcgagtattccgggccaagagtattggcccgagggaactgctagtcgtgtgagggctgcaagggcacctgctccaactgctgaatcatcaacctctccatcttatggaaccaagcctggaagtaggaggaagaattacaagacaactgttcctgctgctgctgcttcgtctcaacccattgttgaatcaaatggcactggttctggaggttcttctgaggttttgattgaatccttggaagagtctcaggatgacgtgtctgactttgttgtttatcagtcggaacctgaggaggaagagttgagtgaatacgagttcgataagaaacttggacttcctcatccgtttattgatccaaaggttaataagccgatagaggggacactttcgaatgacgagctgtggtggaattggagacagccggagaaagaacaatggtccaggtggcagaggaggaaaccggatgttgaaacggttttcctgaatgctatggcagaaaccgggcaaataaagcttcacggtgaacacccaacattaacagaaactgccctttaccgagcaaggcgtgaaatttataaagaagaaagacttcaggccgagcaagagagactggaaagagatggtccaattgcatactattcagaatgggtgaaagcatggaaaagggacacatctcgcgaagctattcaaaagcattttgaagagaccggagaagatgaaactactcaactaattgaaatgttttgccaccaaactgaccgagagtatcgcataatgatggggactgatgttcgaatccaaagggatcctttagcaatgcgaatgagggaggatcagataaagcaaatatggggtggagatccagtttacccaactgtgaactatattcaagatccaaatgaagtgattgactacagggggccagattttcatgaaccaacaccaaatatggtgtcttatctgaaggagaaaggaaaacttatttcaagggaggaatttgacaagattatggccaaggaaaagactgaacaaattgagtcgacggagatggatgaagctatggccaaagctgttgacattggagaaaatgatgatgaagaggatagtgatgttgacggagaggaagagggagaagaagagaagcttagtgattattggagtgtgttgaaaagtactcctgagcttcgccagtcaaagccaaaaccaaagaaagaaggtcctttgtcactggacgaggttatagaagagtcagagaacttgactgatttcctgatggactttgaagaagaagaataatggcatgcctccttgtgaagcattccatgtcaagtggtgtattgcattgtgtagacagaatagaaggtttggttgttagtcttcattgtcaatttcctgaactatcagtaacttcttttaggcattgctacagtggatcgggtggtcaaggcaataaacattggagtgagattctgaatactacttcaagggttctagaaacattatcccaaagtacttgtatccacacctgtctacatatacaattttgatatctcagtcttcatacggagcttagcagataaattaactaggagagtgaccattccaatatgttaaatatattgctgcatattgttattttggtgcaaacttgaatctaatatattaagtcacatatcttctttctcaagtagttcaagtaacgatgtcctcgtttattgtgatttacaacctcccgcagattttgccaaggcatgtacaagacttcaaatacaatacaatggtaaactttcgtttgtgaaagtaaatgatttgtatgcacacaatcacttttg

SEQ ID NO: 6236 - DNA, 2240 bp, Cajanus cajan
acgtgatacgacggaagacgaggaaaaatgataaggaactcgatcactatgacagtgtcagtggtagcataagcgagacactgtctcagttctgttttcccaattttattcttatcattacgacgccgtttgaatttggtcgaaacccagatttcggtgggagattatggcttccattcactccaatttcctccccaacttgtccttcaatcacttccagacaccatcatcatatctggttggtgctggtattttgcaacgtggagttagtttgagcagttgtagaaagagggttccttcatatagctgcataaagtgtgaaaagaaagatgatgaacacattgagcatgtatcagttgagcgtccaccctattacagttacatggactccacctccgggcagctggagccggcttccggcgcccgagcgagtattcctagtcaggagtattggcctgagggaactgctagccgtgtgagggctgctagggcacctgctccaactgctgaatcatcaacctctccatcttatggagccaagcctggaagtaggaggaagaattacaagacatcagttcatgctgctgctgctgctgcttcctctcagccagttgttgaatccactgcctccggttccactgaggttttggttgactctgtggaagactctcaggatgatttgtctgactttgttgtttatcagtctgaacctgaggaggaagtgttgagtgaatatgagatggataagagacttggacttcctcatccctttgttgatccaaaggttaataagccgatagagggaacgctttcgaatgacgagctgtggtggaattggagacagccggagaaagaacaatggtccaggtggcagaggaggaaaccggatgttgaaacggttttcctgaaagctatggcagaaactgggcaaataaagcttcacggtgaacacccaacattagctgaaactgctctttacagagcaaggcgtgaaatttataaagaagaaaggcttcaggctgagcaagatagactggaaagagatggtccaattgcatactattcagaatgggtgaaagcatggaaaagggacacatctcgtgaagctattcagaagtattttgaagagacaggggaagatgaaaatgctcaactaattgaaatgttttgccatcaaactgatcgggagtatcgtataatgatggggactgatcttcgtatccaaagggatcctttagcaatgcgaatgagggaggatcagataaagcaaatatggggtggagatccagtttacccaactgtgaactatattcaagatccaaatgaagtgattgactacaggggggcagattttcatgaaccaacgccaaatatggtggcttatctgaaggagcaaggaaaactcatttcaagggaggaatttgacaagattatggctaaggaaaagactgaacaaattgagatgacagacatggatgatgctatggccaaagctgttgatattggagaaaatgacgatgaagaggacagtgatcttgatgagggagaggaagaggtagaggaagaaaagctttctgattattggagtgtgttgaaaagtactcctgagcttcgcaagtcaaagccaaaaccaaagaaagacggttctctgtcactggatgatgccatagaagattcagagaacttgactgatttcctcatggactttgaagaagaagaatgacatgtcgccttgtgaagcattccatgtcaagtgatgtattgcattgtagacagaagaatagaaggtttcgttgttagtcttccttatcaaatttcttgaactctcagtaacttcttttggcattttcctcgatggatggggtggtcaagggttctattatattaacttagttaaggttccacatgagctattccctttaatactcagttaagtagttgtttccaacacctgtctacataaacaattttgatatctcagtcttcaaacggagcttagaagataaactaactaggagagtgaccattccaatatgtaatatattggtgcatattgtaatcttggtgtaaactagaatttactatattatgtcacgtatcttctttctcaagtcgttcaagtaacgatgtcctcgtttattgtgatttacaaactcccgcagattttgcttaaggcatgtggaagactttagatgcaattgttaactttagtttggaaaaatggatcagttgttgttgta

SEQ ID NO: 6237 - DNA, 910 bp, Ambrosia trifida
acaaatgtaaggctataaactctccatgtcatgacccttatcataaaccttccataattatataatccacttaatatctccccctctactcatcttattattattcacaagcagaaaaacacacactgacctaaaaccatggctaagaaagagatggaagttgtaaagggtgtagacttaaaacgatacatgggccgatggtacgaaatagcttctttccctcctttttctacccaaaaacgggaatgaacacaagggctacatactcgttgaacgaagatggcactgtccatgtcttgaatgagacttggaatgatggcaagagatcttccattgaagggagtgcttataaagctgaccctaacagtgatgaagccaaactaaaggtcaagttttacgtgcctccgtttttacccatcattcctgttgtgggaaattattgggtattgtatctggatgatgattatcagtatgctctcattggtgagcctacccggaagaatctatggatactttgcaggaatacacatattgatgaggaggtgtacaatcagctgattgagaaggcgaaggaagaagggtatgatgtgagcaaactgaagaaaacaactcaaacagacccaccgccggagagtgaagatggacctaaagatactaaagggatttggtggattaaatcgattttcgggaaatagaggggagtgttggtgtcgcttagcgtggagtggagtgtgtattttgtgtgaatacgaagtagaacttgaatttagttcgtatgcatggcaataattaatgatgtgtatgtatgtatgttattgtatttgtgttaattaaaaggggtttggaactaagacttggcttgtgtactagctagtagggtttatgataaggttgtggggtcgatgggtga

SEQ ID NO: 6238 - DNA, 1121 bp, Humulus lupulus
ttacggccgggccagagtaatacaccaccctactattgctttcataacctaaacccatctccattttcttatcaacaacggaccaaagaaaaaaagaagattgaattgaaaagtccctcattctctcagatctcgaaaacccttcagatggcgaacaaagaaatggaagtggtaaagggtcttgacatagagaggtacatgggaaggtggtatgagatagcttcattcccgtcattttttcagcccaggagtggggttgacactagggctacctacactctgaatgaagatgggacagtgcatgtgttgaatgagacttggagtgatggtaaaagagggtccatagaggggactgcttacaaggctgacccaaagagtgatgaggcaaagctcaaagtgaaattctatgtgcctccattcttgcccatcatccctgtgaccggtgattactgggttttgtatattgatgaagattaccaagttgctctcattggccagcccaccaggaagtacctttggatattggccaggaagacacatatagatgatgagatatacaatcagctggttgagaaagccaaagcagagggatatgatgtgagcaaactccacaagactccacagagtgattctccaccagaaggagacgaaggccccaaggacaccaagggcatttggtggatcaaatccctctttggaaaatagagattactatgtagcttattatgatctcaatgcacaaataatgaagtcttttgcagcatctgaacaaggaaaatgggattttctttttcacgtttttctcgagtctttctactgtgtgaatagcagttatttaatccagagttcaatgtttaatatttttataggctttaaaaattttacttgtagcttttctgtatttgtaatgatgtccagactaaaaggccaatagtatgttttttatattaatgttgagattgatattttttagaagaaacaaagcattttactagctcaggaggtaaaaacatggaatccatatccattaatgaggataactggataagaatccactttgataccttatcttggagattttaatattcaatttatgcacaaataaatgagatgttagcaac

SEQ ID NO: 6239 - DNA, 1016 bp, Cajanus cajan
aattaagtttgcaggataattcaagaattggtgtacaagcttttcatcttgatagacacctatctatatatatccactttggaaaccttatgagaaacactaatttagaaaccttggcaaagaaatctttgtttctctgagtgtcgtgtaatttccttccccccttcaatggccgagaatgagttgaaagttgtgaggggtttggacttgcaaaggtacacggggaggtggtacgagatagcctcattcccttcattttttcagccaaggaacggtgagaacaccagagccacatacactcttaatgaagatgggactgtgcacgtgctcaacgagacttggagtaatggcaagagagtttccatagagggatctgcatacaaagctgaccccaagagtgatgaagccaagctcaaggtcaagttctatgttcctcctttcttgcccattattcctgttgttggcaactactgggtcttgtacgtggatgatgattatcagtatgctttgattggtgaaccaaccaggaaatacctttggatattatgcaggaaaacccatttggaggatgaaatctacaaccagcttcttgagaaagccacgacagagaaatatgacgtgagcaaactccacaagacccctcagagcgatcctccaccagagggagatgaaggccccaaagacaacaaaggcatttggtggatcaaatccttgtttgggaaataggcctccatgatgatatgtaatttattatgttgaaaaggtatttcattaaatgtaatgagtatctattaagaatccttagttgagcaattttaagtttgaatcccccaaagggatatatgtattggcttgctttgtaaatttatgcgaacttttgtgtggtgtggctgttgttgatgtactcatgtcacactggttttgctcatcacaattaagggttgtataattcatcaaagtaaaactttggtatgtatattataataatattaatttacttattaaatctgccaaaa

SEQ ID NO: 6240 - DNA, 911 bp, Platanus occidentalis
ctatctgtctactgtgaaacaatggcgaagaaagagatggaagtcgtgaagggtatagacttgcagaagtacatgggtaggtggtacgagattgcttcattcccttccatgtttcaacccaaaaacggtattaacacaagggctacatataccttgagagaagatggtactgttcatgtccttaatgagacttggagtgatggaaagagagggtccatagaggggacggctaataaggctaacccttctagcgacgaagccaagcttaaagtcaagttttatgttcctcctttcttgcctataattcctgttgttggagattactgggttttgtatcttgatgatgattatcagtatgctctcgtggggcagcctagcaggaaatatctctggatcttatgcaggcaaacacatctggatgaagagatctacaatcagctcgttcagaaggctacagaggagggctatgatgtgaagaaactccacaaaacaccacagaccgaccctccaccagagggagaagaaggccccaaggacaccaaaggcatatggtggatcaaatccatattcgggaaataaataaatgataatatgaataaaggaacatgatccaaatgaggaagcccgtagattttagctgctactgtgtcatgcttctctcttttcttccttgtttttttttgtggtaccgacctctagggtctacattagtatcttctctattttccttccttgtaaagaaaagtttgtatggttgtatagtccggacaaaaaaatctgagcctctgttcatttgggttctgttaatttgctttgtgctttgtgttgtagccttaggttattgttgtggtattatcagtttggataaaccttttgagttggaagagcttgcttctctattaagtcttttt

SEQ ID NO: 6241 - DNA, 1062 bp, Cannabis sativa
aaacataaggaaaatatatcaacaatgaataaaaacaagaatcccagtcccaccagaacttgctcgtagcttcaaccttcttgaccgtacacgtgtcaggacaagaatggtgcacatatataaaaagccataaccccatctccattttcttatcaatagagaaaaagattgaaactttgtgtgattttgtgaaaccccaaatggcgaataataaagaaatgagagtggtaaagggtcttgacgtagagaggtacatgggaaggtggtatgagatagcttcattcccatcattttttcagcccagagatggagctaatacaagggctacttacactcttaaggaagataaggcaacagttcatgtattgaatgagacttggagtggtggtaagagagattccatagagggtattgcttacaaggctgacccaaaaagtgatgaggctaagctcaaagtcaaattctatgtgcctccattcttgcccataatccctgttgttggtaattattgggttctctatgttgatcctgattaccaagttgctctcgttggcgaacccaccaggaagtctctttggatattggcgagaaagacacatatagatgatgagatatacaatttagttgttgagaaagccaaagaagaaggatatgatgtgaccaaacttcacaagactccacagagtgatcctccaccagaaggagaaggacccaatgacaacaagggtatttggtggatcaaatccctctttggaaaatagtcattattaattaatatacacattacacgtattatggtctccaatccacgcactattactattattattattattaaagagcatgaaattaggattttatttttcatgcatgcatgtttttcttcagtcttttctactgtgaatagcagttaatttatgcaaattttaatcttattgttgtatttttatttataggcttcaataaaagtactttagttgtagtttttctatgtatttttgttgtagtgatgcagttaaattagttactcaatcctaaaatattatattaagtgatgtaggt

SEQ ID NO: 6242 - DNA, 1056 bp, Carpinus betulus
actccacgtggcattttcgtgtcacatctttgcaaacacatgcctccagccccctcgatccatacatctatgaaaggctagcaagaacccttaaacccaagaaaaccaagcttctcaaagactctctctttctctcccttattgcgctgtgaagcaaatccatggcgaacaaagagatggaagtggtgaagggtgtggatctaaagaggtacatgggtcggtggtatgagatagcctcatttccatcgaggttccagcccaaaaatggtgaaaacacaagggctacgtacaccttgagagatgatgggattgtgaatgtgctcaatgagacctggaatgatgggaaaagagggtacatagaaggcactgcatacaaggctgacccaaacagtgatgaagccaagctcaaagtgaaattctatgtgcctccctttctgcccatcatccctgtcgttggggactactgggttttgttccttgatgatgattatcagtatgccttgattggcgagcctagcaggaagtatctttgggtcttgtgcaggcaaacccatctagatgatgagatctacaatcagctggttgaaagggccaaagaaaagggctatgatgtgagcaagctgcacaagacgccacagagtgatcctccaccagagggagaagaagggcctaaggacaccaaaggcatctggtggattaaatcccttctggggaagtagggataatcacaaaggtgtactggggcttcactgttcaagtacatatgaaataaagaatgaaaaccccgattgcagcatccagattagggatatttctgtgttgatttgcttttgtagttttgttgtacagcaggaaatggcgtataactagtgtgtgtttattgagttttgacgaccaaactgtgaagttttaagttatgaactatttacctaaatctcatctgggtctgttcagtttgctttgatgtgaaagcttgatataatatctcagtggtgatttcagaattacttcctgagaaatgctgtgtaccaaatcagccatgattatatatatatt

SEQ ID NO: 6243 - DNA, 774 bp, Amsonia hubrichtii
cagaagaaatcatatacttttgtcccaatctctcaatctgagacagaaatggcgtccaataaagagatggaagtcgtgaaaggtctggacttgcagaggtacatgggaagatggtatgaaattgcttcatttccctcaagatttcagccaagaaatggtaccaacaccagggccacatacactttgaacccagacgggaccgtgcatgttctgaatgaaacttggtctgatggaaaaagggggtccattgaaggcagtgcttataaggctgatgctaacagtgatgaggccaagctgaaagtcaagttctatgtccctcctttcttgcctatcattcctgttgttggggactattgggttttgtatattgataatgattatcagtatgcattggttggtcagcctgcaaggaagtacctatggatattaagcaggtcacccatcatggatgaagaaacctacaaccagcttgttgagagggctaaaagtgaaggttatgatgtgagcaagctccacaaaacaccacagcctgatcctcctccagaagatgcccctaaggataccaaaggagtttggtggatcaaatctcttctagggaaatgaaagagtactactgtaccaggatatctggatcaatgagataatactggtaggacacagttataatgtattcaaataaacaagtgcgttccctaccgaaacagttctcttcttccctagatcatcttgtataatatgaaaatggtttgtggttgttatgtatatacatgtact

SEQ ID NO: 6244 - DNA, 899 bp, Centaurea maculosa
ggttatcgcttctccatctcacacccttatcaacaatattatatgtaccctattacccctccctccaatccattatatataaaatctctcattaattaattaattctatactctcattcaatatcaatatcataatatcatggctgacaaagagatggaagctgacaaagagatggaagttgtgaagaatgtggatctagaaagatacatggggagatggtacgaaatagcttcatttccgagcttctttcagcccagaaatggcaccaacaccagggctacttacaagttgaacgaagatggcatcactgtccatgttctaaacgagacttggagtgatggaaagagaagttttattgaaggcagtgcttacaaggccgatcccaagagtgatgaggccaaattgaaagtcaaattctatgttcctccctttcttccaatcatacctgttactggtaattactggattttgtatcttgatgatgattatcagtatgctttagtcggtgagccctccaggaaaagtctctggatactaagcaggcaaaaccatattgatgagaagatatacaatcagctgctggagaaggccaaggaagaagggtacgatgttagtaaactgaagaagacgatgcaaacagacccaccgccggagagcgacagtgcacctgccgataccaaaggaatgtggtggtttaaatcattgttcggcaaataattaaacaattaagaagaagttttattgaatttggtgttcttggtgttgtaaaattaattgtggttatggttagctgttattattatagtaatgcgaatgtaaaatgaatggatttgatatgatcctgtgttgtaaatatgtgatatgcttcaaatatgtaatgtgttcaatagcacaagtt

SEQ ID NO: 6245 - DNA, 920 bp, Centaurea maculosa
  misc_feature (874)..(874): n is a, c, g, or t
tgtgaggttatcgcttctccatctcacacccttatcaacaatattatatgtaccctattacccctccctccaatccattatatataaaatctctcattaattaattaattctatactctcattcaatatcatatcataatatcatggctgacaaagagatggaagctgacaaagagatggaagttgtgaagaatgtggatctagaaagatacatggggagatggtacgaaatagcttcatttccgagcttctttcagcccagaaatggcaccaacaccagggctacttacaagttgaacgaagatggcatcactgtccatgttctaaacgagacttggagtgatggaaagagaagttttattgaaggcagtgcttacaaggccgatcccaagagtgatgaggccaaattgaaagtcaaattctatgttcctccctttcttccaatcatacctgttactggtaattactggattttgtatcttgatgatgattatcagtatgctttagtcggtgagccctccaggaaaagtctctggatactaagcaggcaaaaccatattgatgagaagatatacaatcagctgctggagaaggccaaggaagaagggtacgatgttagtaaactgaagaagacgatgcaaacagacccaccgccggagagcgacagtgcacctgccgataccaaaggaatgtggtggtttaaatcattgttcggcaaataattaaacaattaagaagaagttttattgaatttggtgttcttggtgttgtaaaattaattgtggttatggttagctgttattattatagtaatgcgaatgtaaaatgaatggattgatatgatcctgtgttgtaaatatgtgatatgcttcanatatgtaatgtgttcaatagcacaagtttacaacaatagccaataa

SEQ ID NO: 6246 - DNA, 1107 bp, Carpinus betulus
ttacagtactccacgtggcattttcgtgtcacatctttgcaaacgcatgcctccagccccctcgatccatacatctaatgaaaggctagcaagtaccccttaaacccagaaaaccaagcttctcaaagactctctctttctctcccttattgcactgtgaagcaaatccatggcgaacaaagagatggaagtggtgaagggtgtggatctaaagaggtacatgggtcggtggtatgagatagcctcatttccatcgaggttccagcccaaaaatggtgaaaacacaagggctacgtacaccttgagagatgatgggattgtgaatgtgctcaatgagacctggaatgatgggaaaagagggtacatagaaggcactgcatacaaggctgaccccaatagtgatgaagccaagctcaaagtgaaattctatgtgcctccctttctgcccatcatccctgtcgttggggactactgggttttgttccttgatgatgattatcagtatgccttgattggccagcctagcaggaagtatctttgggtattgtgcaggcaaacccatctagatgatgagatctacaatcagctggttgaaagggccaaagaaaagggctatgatgtgagcaagctgcacaagacgccacagagtgatcctccaccagagggagaagaagggcctaaggacaccaaaggcatctggtggattaaatcccttctggggaagtagggataatcacaaaggtgtactggggcttcactgttcaagtacatatgaaataaagaatgaaaaccccgattgcagcatccagattagggatatttctgtgttgatttgcttttgtagttttgttgtacagcaggaaatggcgtataactagtgtgtgtttactgagttttgacgcccaaactgtgaagttttaagttatgaactatttacctaaatctcatctgggtctgttcagtttgctttgatgtgaaagcttgatataatatctcagtggtgatttcagaattacttcttgagaaatgctgtataccaaatcagccatggattatatatatatttaatggctactggatattataatatttgtgaaatattgatgt

SEQ ID NO: 6247 - DNA, 1014 bp, Carpinus betulus
tagggagtctatcaaaggctagcgagaacccttaaacccaagaaaaccaagcttctcaaaggctctctctttctctcccttattgcactgtgaagcaaatccatggcgaacaaagagatggaagtggtgaagggtgtggatctaaagaggtacatgggtcggtggtatgagatagcctcatttccatcgaggttccagcccaaaaatggtgaaaacacaagggctacgtacaccttgagagatgatgggattgtgaatgtgctcaatgagacctggaatggtgggaaaagagggtacatagaaggcactgcatacaaggctgaccccaacagtgatgaagccaagctcaaagtgaaattctatgtgcctccctttctgcccatcatccctgtcgttggggactactgggttttgttccttgatgatgattatcagtatgccttgattggcgagcctagcaggaagtatctttgggtattgtgcaggcaaacccatctagatgatgagatctacaatcagctggttgaaagggccaaagaaaagggctatgatgtgagcaagctgcacaagacgccacagagtgatcctccaccagagggagaagaagggcctaaggacaccaaaggcatctggtggattaaatcccttctggggaaatagggataatcacaatggtgtatttgggcttcactgttcgagtacatatgaaataaagaatgaaaaccctgattgcagcatccagattagggatatttctgtgttgatttgcttttgtagttttgttgtacagcaggaaatggcgtataactagcgggtgtgtttattgagttttcacgcccaaactgtgaagttttaagttgtgaactatgtacctaaatctcatctgggtatgttcagttttctttgatgtgaaagcttgatataatatctcagtggtgatttcagaattacttcctgagaaatgctgtgtaccaaatcagccgtggattatatatatttaatggctactggata

SEQ ID NO: 6248 - DNA, 729 bp, Parthenium argentatum
caacacataccgacccttaaacaatggcgaagaaagatatggatgttgtaaagggcgtagacttaaaacgatacatgggccgatggtacgaaattgcttcttttccttcgttttttcagcccaaaaacggtaacaacacaagggctacatacacgttgagagatgatggcactgttcatgttttgaatgagacttttagtgatggcaagagagattccattgaaggaactgcttataaagctgaccccaaaagtgatgaagctaaactgaaggtcaagttttatttgcctccatttttgcccatcatacctgttacaggaaattactggatattgtttcttgatgatgattatcagtatgctctcattggtgagcctacccggaagtatctatggatactgtgcaggcaaacccatttggatgaggatgtgtacaaccagctcgttgagaaggcgaaggaagaagggtatgatgtgagcaaactgaagaagacatctcaaacagacccaccgcctgctgataatggatctaccgacaccaaagggatttggtggattaaatcacttttcgggaaatagttgggagtgttggtgttgcatagtgtggagtggagtgtgtgttttgtgtaaatagtaaatagaacttgtattaagtttgtatgcatggcaatgatgttgtatgtgtttacatatgtatgtatgtcgtatttgtgttaaaaggggtttggac

SEQ ID NO: 6249 - DNA, 1556 bp, Cicer arietinum
gaggtgattgggatttaggatgtggcttatctggacgtcgtcgtagctgatcaaaaccctaaaaccctcaccgatattcagaacacgatgctcttcttcgtcttcaattgaaaccctatacaaactgaaacaaaacatggaaacaattacggccatggatgtcgaggaacaaccttcgcccactcccaacaacgttaatcacttcgctcttaaaaattctattcaaactaatttcggcgacgactatgttttccaaatcatcgcaaaggatgattggagtgcaatggcagtgtcactatcaacaaattcagtgaaattgtattcaccagtggtgggtcaatattatggagagtgtaagggtcacactgcaaccatcaatcagattttgttttcaggtcattccaatcccaatattctaagttcttgttcttcagatggtactattagagcttgggattcaagaacatttcagcaggtttctactatcaatgctggtccttctcaagaagttttcagcttctcaattggagggtctagtggaaatttaattgccgccggttgtgattcacagatactcttatgggattggagaaataataagcaaattgcatgccttgaagattctcatgttgatgatgttactcaggttcattttgtccctgatgaaccaggcaagctcatttctgcttcagtagatgggttgatctgcatatttgataccaccggagatatcaatgaagatgatcatctagaatcggtgattaatgtgggaacttcaattgcaaaggttggattttttggagagagttatcagaagctttggtgtttaacacatattgaaaccctaggtatctgggactggaaagatgctagaaatgaagtaaacttctcagacgcgcgtgctttagcttctgaaagctggactttggataatgttgactattttattgattgtcactactccagagaagctgaaaaattatgggtgattggcggcacaaacgcgggtactttgggctactttccagtaagttacagtggaatggcaacaattggagctgcagaagcaattcttgaaggtggccatacaagtgttgtaagaagtgttctacccatgtccagaattcatagtggacttggtagtagtgctagtagtagtatttatagctcagacatttttggatggacaggaggggaagatggtagactgtgttgttggctgtctgatgattcacctcaaaaaaatcaatcttggatttcaagtacattgattatgaaaccagaaagaacttgcaagaaaaatcgtcatcacccctactagtattagtagcccaatgccataattacttacacagttccatgacaaaagggctattttttgttcatttagttagtttcttttttcactgaactagggttgggatgtgatggatttttttgtatgtactgtgtgtaatatttaacagtagccctgtttttaatattaaaaaggaaattcagatcatttgattcattatgcaatatattatattttagtaatttaaatgttaaattat

SEQ ID NO: 6250 - DNA, 1273 bp, Vigna unguiculata
gatatacccaacttcgaaaatggctactttagaatctgccctcaccctgttcgcaccccaacgattttcggataattatcgttcgtctgcaaaaccacctcactccattaagctcaatgcttccacttcccttttcttcccttccaaggtctctttcaaatctgcaagactctgcttccacctatgctctgctctgcaagagctacccacaacagagaaaacacctgacccaacccaaccaactaacaacctcaccaagctttacgtcgctaacttgccttggactctgtcgccggccgatatcaagaacctttttgcccaatgcggaaccgtaactgacgtcgagataataaggaacaaaaaagggaggcacatgggatatgccttcgttactatggattccggagaagaggctcaggctgctcttgataaatttgatacatatgaattatcggaacggataataagggtagagtttgcaaagcaattgaataaacctcctccttctcctcctccacctcctccaggtcgtcgtaatcctagagagacacgacatgtactttatgtatccaacctaacatggaaagcaagatctacccatctgagggaagtcttcactgaaaatttcaagacaccagtttcagccagagttgtctttgacagccctgctaaacgatcagctgggtacggatttgtttcttttcttactaaggaggatgcagaggctgccatttctgctgtggacgggaaggagttaatgggacgaccccttcgcctaaaattcagtgaaaagaaggataaggaagctggaggtggaaaagaggaagatcaaattaaagatgctggaagtgaagatgaagatcaaagttctgatgctcaaccagaagagtcataaattttagatattcatttactggtctttggtcgtgataagggattctacgagctgaaattacaccttatgtgtaaaagaactatgatagatgaatttttgcatccacaatatttttcactaaggtcgagtttatattattcctctaaaatttgggtgaaaactaaagaaactcttcgattataaatctaggttctgatttttttcactcccgtttttaagggtactttaagggttgataaaacttcaaaatcatgtcatataaaacctctgcaaaatgtatcataagactaagttcaattcatcatattggaaccgtagatctcctccatcctggcatcttgtattctatgattccataatttggaccctttttcttat

SEQ ID NO: 6251 - DNA, 3504 bp, Glycine max
gcgattttttatttcttcctttatatggtggcaaagttacgtgtttcattttagtttcttcacagaccaaacagcaccaccgaagtgagtaactactctccatggaggtctcagacgacgtcgacgacgaacacgttatcctgctttgcactaacactgatccgatcgaaacaacggaaaccctaaacgacgagattctcgtgtccgccaccgatgtcctcgcttgggatctccctacgactctcacttttccgactattaaagttcagacacatcgcaataggctcattgaacgatctctgtattttcgtggtcttctcagcaggagcttcagtgaatcatgcttgggctctgtcaccatcaattggaatgtgagggaatttatgcaaattcttaagcatatgtatggctgcgtattggatattacgctggataatttccttcctctttatgagggtgcgctttattttggagtggagacacttctcttgaagtgtgagacgtggctttctgagttactctcacccaaaaggtttcaatctactcaaatacaaatggaggacttgatccaaatttgggaatttggctctgattgtgctagtgactttatcctgcacttatgtatgggctatctagcaagaaattttatgtgggcaaagcatagcaagtcttttgggaaacttccatatgacctgctattatctttagtaaagcatcctcatttgactgttgacagtgagttgcatctttctgatgcacttcttctctggcttgaaagtaacactgaaaatttggagaggccaagcaaatccgaagagaactgctatgaagttttgaaacaaattcgtgtaggccttttgcctttgtggtttgctctaggaaaaagaaactctttctattttagacagctggctgaggaaagccttgattcaattttccgactcctaaatattgctcctatgggttcaatagatacttttgagtatagcgacttgcatcatctcaggattaggctgacagaatattcaaagaaagtggacctttctggttgcccgcaaatagcatctacagtacttcttctgtcactcatccctcaatcatatttaacagatcccatggaaaagaatattataaaacagttctttattaattgtggacatcctataagagataaatctgtgttcccactagaactgtcagaaacctttacctttgaagcagttcaggaggtggatatctctaagtgtcgaaatttgattattgagcatgctgttgattgcttctgcaagttctttccttctttaagaatattgaaagcagcacatcttttgaacattgggacaatcagtttccttcaattattggagaaatgtacaatggtctgcgaaattgacttaactgttgatattaccccactgataccagcagttactgttgcatcttctagtcgtgctatgataccactggtaccagagaagagctctagtgttaaccatatagcagtgcaaatcatgccatataatgaatttggacctcctctttctaatgttacaaaactcacatttgaaggaagaactgatgtcagtgatttgggtctccagtacatctccaaattatgtgtttcattgcgtcacctgaatattaaaggatgcatttctgtcactgatattggcatatcagatctcatatccacgtgtaaaaaacttaattcaattgtggtttgcgatactttatttgggatctattcagttcaagctctttgctcagctatttctggtagtggcaacttcccctctctacattctagagataagcgtttgaaatctgtggtgtctaattttgaaatgctgcatatgggtggctgcaggggtattagtgagtcatctctactagagcttatgtctcaagcacaagttttgaagagtttatgcctgagatggactgacctggttgaccaggcactgtacaattttgtaggttcttccttggagatgcttgatgtttctgataccaagatttctggagctgcattagctcatattattcatggaaatccaagtttaaagtgtctgagagcaagaggctgtcaaaatttgtttccaggaaacaattgtatagaaaagagaaaatctagctttccctctttgcatgaaaaactgcatgctgagttaggaaaaatgtgtagattggaagaaattgaatttggatggggattttcttccttctctttgagtgctctggaacctttactgatgtcattaaagaccatcaatataggtttaggtggaacgctaggtgaagatgctttgaaacaattacctgcaatctgtcccttgctagaaacaataatccttcattttcaggtaatatctgatatgattgtgatgaactttgtcacatccttgaaatacttgcaagtattagctctgtgctattgttttggtgatatatccatgtcaagcttcaaattccctatgcaaaatctaagaaagttgaggcttgaaagaataaccccatggatgacaaatgatgacttggtggttctagctcaaaactgcagaaatttgttagagctttcattgctagggtgtcctcttctcgacccagattctctacagataattacatgtggatggccaggcttggtctctatccatttagaggactgtggagaagtaacggctaatggggcttctgctcttcttgactgcaaagctcttgaagatatcctgctgcgtcataatggccctgggctacccagaaacttcatttgttatgctgcttcagagatgccattgcttcgaaaattgtcactggatatatgcgatgcaagtgaaggtgattttgacattccaaatcagtatgcagacaaatactttttgagtaccttgaagatagctagatgcaaatctcaaagatgtgcttttaatctcccagcccctgccccaggggttcatagaagatctgtgcatgttgaaactctggtgcttgtgtggaacagcagagatctcatcagaacagtggtgaaggaaaggctttagtaaatgtatgtctgagcattcatcatccttctcacatgttgatgagttagttttacaagtgatttggtggcagtaagtaaaacgcttagtgattaagatgatcatttgtttgttaagtagtaaacatctgacaaaacgatgtcaagttgattgagaatccagccgttgcactttgataacagtccttgtttatgttgttcacgcttttttcttctttattctttttagcaaggcgtcttcaaaatgaattgcttgcaatttttttttattgattcgaggagagaaaaaacatgtatttttcaatagattttcattaagcttttaattatctgttttgaacataaaaccagcaaattcaaacatgcgctgttagtttgaatctttgagtgactggtacaagttcatcttttaatactaattatatgtagcattatatgtgaaattacgaatcgatattgatgag

SEQ ID NO: 6252 - DNA, 3029 bp, Phaseolus vulgaris
ctatacaatcaagttctccttccattgttttttcattcttccttagtaaatcattcttcctcttcttccatcaccaaccacaaacacattatctaagcacagatcaaaatctgcaggcacgtctatgctgtaatggcagacagtgtaatgccagacagtgtagttacttttgttttggatcacttatcccagcttgtggcacacgaagctaacttgctgtatggcgtggaggacagagtccagtcccttcagaacgagcttcaaatgatcaacgaccttctcaatacctcaaagagaaagaagggaattgaaaatacagtggtgaaccaaatcagagatgtggcccacctagccgaggatgtcatcgacactttcgtagctaaagtttccatttacaagaggagaaccatgttggggaggatgctccgtggctttgcccaagcaaggttgcttcaccaagtagccgacaaaatagacaagatcaaaaccactctcaacgaaatacgcgaaaacaagatcaaatatgacactttcaaagaaatcaataatcaatctgcagcagaagaggaggaggagaaggaaagggcgcaatcattacacaagctaagaagagatgtagaggaagaaaatgtggttggctttgtcgatgactccaaggatatcatcaaacgactcttggaaggtggttcaaatcgtaaagttgtctctatcattggcatggggggattgggcaagaccacccttgcccggaaggtctataacaacagcgaggtgaagcaacacttcgagtgtcgagcatgggtttatgtgtcaaacgagtgcagagttagggagcttttgcttggccttcttaagcatttgatgccaaattttgaacaacaatgcagaggcaagaagaaaggaaagaaaagcactcaagacaatagtagcttgagtgaggaggagctgaagaaactggtgcgaaacagcttggagagtagaacatatcttgtggtggtagatgacctgtggaaaaggcaagattgggacgaggtgcaagatgtttttccggacaacaacagaggcagcagagtattgatcactagtcgtttgaaagaggtggcactgcatacttcccatgatcttccttaccatctccagttcctggatgaaaaagaaagttgggagttgttttgcagaaaagtgtttagaggtgaagactacccttctgatttggagactcttggaaagcaaatggttcaaagttgtcgtggtttgccgctctccatcattgtcttagcaggacttctagcctacaaggaaaaatctcatagagaatggtcaaaagtggtgggtcatgttaattggtatctcactcgagatgagacccaggtgaaggatatagttctcaaactcagctatgacaacttgccaaggagattaaaaccatgctttctctatcttgggatatttcctgaagactttcaaatccctgttacgccattattgcaaaaatgggttgcggagggttttatacaagatacagggaatagagacccagatgaagttgctgaagactacttgtatgagctcatcgatcgtagtttggtccaaaaagcaaaagggaagactaatagaaatgttcacgttcatgatcttcttcgagacctctgcatatcagagagcaaagaggacaaagtttttgaaatttgcacagacaataacactctaatcccgacaaaacctcgtagactatccattcactgtaaggtgggtcattacatttcttcgagcaacaatgatcattcatgtatccgatccctgttcttatttggccaagatgactttggtactgggaagcagtggaaatggctttcaaaagacttcaaattggttcgagtgttggagcttggaccaacccgccttaccaccctttctaattttgggaactttatccacttaaggtacttgagaattgaagcaacacctgattttacatttgttccatcttcaatacttcacctttggaatctacaaatcatagacctaagttattggaggtatgtgactgaaatttctttcccagtcgaaatgtggaaacttaaacatttaaggcatttgaatgcacaagggcgtatcaagctacgaggcagttgttcaggatcagatgagaagatgtggaatcttcaaaccatctctggcttcgtagtcaacagacaagcaacatctctgataaagaaaggaacattccccaatcttaagatgataaggttgtatgtgacttctgaatacagagatggtgaattaaccaaattgttgcaaagcctacaacaatcaagtcatttgagtcagttagagattgtcctctggtatgagtatgacaaaggttgcaagccgcaagaactattgcaaagcctagggcagttcaattgtctaacttccttaatgattaactatgttttttaccttctgacctatgcactcacatttcctccaaacgttatggagttagagttgttagagattggttgcattagtgatgaggggatgaatggtttgggaaatctcaccaaactcaaaattttgagacttacgggagatagatgttatgagggggattcctttaacctgaattgtgtggaaggcagcttctcacaattggaagtgtttaaaatgaaaagattgaaacttgagaaatggaaattaggcaatggtggaatgttaaggcttcaaagcctggtcatccaggattgtgaaatcttagaagaactcccaaatgaactttggtctttgagtgacttgagaaaagtaaaggtaaggacatgctcagaatcactgtatggcaggctactgtatttaaaaccaaacaatggggttgaactcatcctagaggaaatttgaggttgttattttatatatatatatatatatatatatatatatttatttatttattgtgaacgaatttgttatttattttattttgatattttatacttggagtaaaatattctatatgtcgaatagaatattaaatttgttgagtttcg

SEQ ID NO: 6253 - DNA, 2970 bp, Phaseolus vulgaris
ctcttcttccatcaccaaccacaaacacattatctaagcacagatcaaaatctgcaggcacgtctatgctgtaatggcagacagtgtaatgccagacagtgtagttacttttgttttggatcacttatcccagcttgtggcacacgaagctaacttgctgtatggcgtggaggacagagtccagtcccttcagaacgagcttcaaatgatcaacgaccttctcaatacctcaaagagaaagaagggaattgaaaatacagtggtgaaccaaatcagagatgtggcccacctagccgaggatgtcatcgacactttcgtagctaaagtttccatttacaagaggagaaccatgttggggaggatgctccgtggctttgcccaagcaaggttgcttcaccaagtagccgacaaaatagacaagatcaaaaccactctcaacgaaatacgcgaaaacaagatcaaatatgacactttcaaagaaatcaataatcaatctgcagcagaagaggaggaggagaaggaaagggcgcaatcattacacaagctaagaagagatgtagaggaagaaaatgtggttggctttgtcgatgaatccaaggatatcatcaaacgactcttggaaggtggttcaaatcgtaaagttgtccctatcattggcatggggggattgggcaagaccacccttgcccggaaggtctataacaacagcgaggtgaagcaacacttcaagtgtcgagcatgggtttatgtgtcaaacgagtgcagagttagggagtttttgcttggccttcttaagcatttgatgccaaattttgaacaacaatgcagaggcaagaagaaaggaaagaaaagcactcaagacaatagtagcttgagtgaggaggagctgaagaaactggtgcgaaacagcttggagagtagaacatatcttgtggtggtagatgacctgtggaaaaggcaagattgggacgaggtgcaagatgtttttccggacaacaacagaggcagcagagtattgatcactagtcgtttgaaagaggtggcactgcatacttcccatgatcttccttaccatctccagttcctggatgaaaaagaaagttgggagttgttttgcagaaaagtgtttagaggtgaagactacccttctgatttggagactcttggaaagcaaatggttcaaagttgtcgtggtttgccgctctccatcattgtcttagcaggacttctagcctacaaggaaaaatctcatagagaatggtcaaaagtggtgggtcatgttaattggtatctcactcgagatgagacccaggtgaaggatatagttctcaaactcagctatgacaacttgccaaggagattaaaaccatgctttctctatcttgggatatttcctgaagactttcaaatccctgttacgccattattgcaaaaatgggttgcggagggttttatacaagatacagggaatagagacccagatgaagttgctgaagactacttgtatgagctcatcgatcgtagtttggtccaaaaagcaaaagggaagactaatagaaatgttcacgttcatgatcttcttcgagacctctgcatatcagagagcaaagaggacaaagtttttgaaatttgcacagacaataacactctaatcccgacaaaacctcgtagactatccattcactgtaaggtgggtcattacatttcttcgagcaacaatgatcattcatgtatccgatccctgttcttatttggccaagatgactttggtactgggaagcagtggaaatggctttcaaaagacttcaaattggttcgagtgttggagcttggaccaacccgccttaccaccctttctaattttgggaactttatccacttaaggtacttgagaattgaagcaacacctgattttacatttgttccatcttcaatacttcacctttggaatctacaaatcatagacctaagttattggaggtatgtgactgaaatttctttcccagtcgaaatgtggaaacttaaacatttaaggcatttgaatgcacaagggcgtatcaagctacgaggcagttgttcaggatcagatgagaagatgtggaatcttcaaaccatctctggcttcgtagtcaacagacaagcaacatctctgataaagaaaggaacattccccaatcttaagatgataaggttgtatgtgacttctgaatacagagatggtgaattaaccaaattgttgcaaagcctacaacaatcaagtcatttgagtcagttagagattgtcctctggtatgagtatgacaaaggttgcaagccgcaagaactattgcaaagcctagggcagttcaattgtctaacttccttaatgattaactatgttttttaccttctgacctatgcactcacatttcctccaaacgttatggagttagagttgttagagattggttgcattagtgatgaggggatgaatggtttgggaaatctcaccaaactcaaaattttgagacttacgggagatagatgttatgagggggattcctttaacctgaattgtgtggaaggcagcttctcacaattggaagtgtttaaaatgaaaagattgaaacttgagaaatggaaattaggcaatggtggaatgttaaggcttcaaagcctggtcatccaggattgtgaaatcttagaagaactcccaaatgaactttggtctttgagtgacttgagaaaagtaaaggtaaggacatgctcagaatcactgtatggcaggctactgtatttaaaaccaaacaatggggttgaactcatcctagaggaaatttgaggttgttattttatatatatatatatatatatatatatatatttatttatttattgtgaacgaatttgttatttattttattttgatattttatacttggagtaaaatattctatatgtcgaatagaatattaaatttgttgagtttcg

SEQ ID NO: 6254 - DNA, 1128 bp, Medicago truncatula
ttctgatacaatacaagacagtgtttggtttgggtggacatagtcacttacttacgtatcatcatccaaaatgctaaccctcaatctcaattccctttcttcaactcttccctttcatctcaattatccactctttactcaaacgcaactattacttcctgctaatcttaattacccttttgctaatacaccttccagaaagttgaggatttttcagctcaaggctggattttgggagtcaattaaatctgggttgatgaagaataacaccacacaggtcatcgatccagagttaacagaagaagaagacgaagaacctctacctcaagagtttgtgcttgttgaaaagactgaacctgatggaacaattgagaaaatattattctcttcgggtggagatcttgatgtttatgatcttcaagccctctgtgacaaggtagggtggcctcgtaggccattatcgaaattagctgctgctttgaaaaatagctatatggtggcctctctgtattctataagaaagtcaccagggtcagaggggaatgaacaaaagatattaattggcatggcccgtgctacatcagaccatgccttcaatgccacaatttgggatgtcctagttgatccaggctaccagggccaaggtcttggtaaagctcttgtagagaaactcattcgagctcttctgcaaagggacattggtaatattactttgttcgcagatagtaaagtcgtggaattttatcgcaatttagggtttgaggctgacccagagggcataaaaggcatgttctggtacccaaattgataaggaagttttcttttatgcttttttacattttgtaacactgcaacctgaagtatacaaggttatagctgtgacaagtttgtagtatgaaagtataaagattggacatcatgctgtaattactatgttaggttgtagcaaaatattctttccccccaaagttttattactttttcaaacagataatggtgaggctttggttaaagaaccagtgttattttctactcttttttttttaataaaatttttgtcatcttggatgaatggttgtataagtgtgtaagaggagtataggtttatcaagtatcctgaaatgagcg

SEQ ID NO: 6255 - DNA, 1050 bp, Medicago truncatula
atcaagtgaagtgaagtgaagtggtatttctgatacaatacaagacagtgtttggtttgggtggacatagtcacttacttacgtatcatcatccaaaatgctaaccctcaatctcaattccctttcttcaactcttccctttcatctcaattatccactctttactcaaacgcaactattacttcctgctaatcttaattacccttttgctaatacaccttccagaaagttgaggatttttcagctcaaggctggattttgggagtcaattaaatctgggttgatgaagaataacaccacacaggtcatcgatccagagttaacagaagaagaagacgaagaacctctacctcaagagtttgtgcttgttgaaaagactgaacctgatggaacaattgagaaaatattattctcttcgggtggagatcttgatgtttatgatcttcaagccctctgtgacaaggtagggtggcctcgtaggccattatcgaaattagctgctgctttgaaaaatagctatatggtggcctctctgtattctataagaaagtcaccagggtcagaggggaatgaacaaaagatattaattggcatggcccgtgctacatcagaccatgccttcaatgccacaatttgggatgtcctagttgatccaggctaccagggccaaggtcttggtaaagctcttgtagagaaactcattcgagctcttctgcaaagggacattggtaatattactttgttcgcagatagtaaagtcgtggaattttatcgcaatttagggtttgaggctgacccagagggcataaaaggcatgttctggtacccaaattgataaggaagttttcttttatgcttttttacattttgtaacactgcaacctgaagtatacaaggttatagctgtgacaagtttgtagtatgaaagtataaagattggacatcatgctgtaattactatgttaggttgtagcaaaatattctttccccccaaagttttattactttttcaaacagataatggtgaggctttggttaaagaaccagtgt

SEQ ID NO: 6256 - DNA, 1119 bp, Arachis hypogaea
ggggatgaataatgatattatggtttccatatcgtgtgagtaataatccttaatcagtttatgggttgtgttgggttgggtggctcaaaacaatgctaaccctcaacctcactcctcttccttcctcgttctctgttgcaaattgcccactgtttattcagaaaacacagttattgattccttccaatcttagttactccttttctgctacagaaaccagaaagttgaagacttttcagctcaaggctggattttgggagtcaattaaatctgggttgattaagaacaacactacacaagttgttgatccacccaacgtagatgaagaagatgaagaacctttgcctcaagagtttgtccttgttgaaaagactgaacctgatggaacaattgagcaaataatattttcttcaggtggagatattgatgtttatgaccttcaagctctctgtgacaaggtagggtggccacggaggccattgtcgaaattagctgctgctttaaaaaatagctatattgtagcctcattgcattctgtaagaaagtctccggggtcagaggggaatgaacaaaagagattaatcggcatggctcgtgctacttcagaccatgccttcaatgccacaatttgggatgtcctagttgatcctggttaccagggccaaggtcttggtaaagctcttgtagagaaactgattcgagctcttttgcaaaaggacatcggcaatataactctgtttgcagatagtaaagttgtggatttctaccggaatttaggttttgaagctgaccctgaaggcataaaaggcatgttttggtacccaaattactaattgcaaccattgattaactttgcaaccaatgtgtatgcaagtttatcttttgattttataatatgaaattacacagaattgacatcaatttgtaattattattattgcgttaggcgctagtatttttcctttttatatccaaattatttgattaaagaattagattcacatataaaaagttgagtatttactttgtacttgaaaaaacatgtgacaatgttggttatctcttggtgcctattagtatttggtttgggagtaaaagagggtgaaaatttcattaatc

SEQ ID NO: 6257 - DNA, 3983 bp, Glycine max
tcataacaatataaacttattaaacaaggactgaattattattgccagaacgagaactgcaatttataattttccaatacataggcttagaaactttggtcccgggaagggaatcttcaccatatgccactcacgttatcttttcatcacaccttcaccttcgatccttcctatgtccaattaattgtttaaggagagaccaactcataaagtcacaaagaatattactataaacatttggatttaggtggtggtggtggtggtggtgtatttcaaattccagctgttactattgttgttttatcgaaaacccaaattcccaaaggaatcgaaattgaaatcgaagtgggaacagagcaacacagagcgtgatttgttccaatcggtcggtgggctatggagagtgtgaatgatctgatccaagaggccaagctccgcactctctggtgggccctctgtatattcgtcgtttcctatttcctaactcatactagtaaatcaatgtggatgaatgtacccatgtcgatcctatttgttgtggggctgcgcattcttttcaatagggtggagttccgttggaaggttccacagcctagactgcagacctatctatctcatttggagaaaaagcagttgtctctgaatgatccacgcctcactagtttgcctccccctgcgaaatggaagaggaaaattgattctcctgctgtggaggctgcaatgagtgatttcattgataagattttgaaggattttgtggttgatttgtggtactcagagattactccagataaggagtttccggaacagatacgggcaataatcatggatgttctagctgaaatatcaggaagggttaaagagataaacctggttgacttgctgacaagggatttagtagatttaataggtgttcacatagaacttttcagaagaaatcaagctactattggtgttgatgttatgaaaacattatcttctgaggagcgggatgacagattaaaattccatctgttgaattctaaggagcttcatccagcactaatatctcctgagagtgagtgcaaggttcttcagcggctaatgagtgctgttttagctacagtactaagacaacgagaagctcagtgtcctgtgattcgttctatatctcgggaattattaacttgcttggtaatgcaacctattatgaatttggcaagccctgggtatattaatgaactgattgaatctcttctacttctctttaatgatgatggtacgcaagggatgggcagtgatcagtcaactaatgtagcaagtcaccatcatggtcattctgttgccagtgagggtggacacaacaatctcacagcctctaataagcatccatctttaaatcaaggaactggtatgatattggctaaaacgagtgatcagggagggacattgttacaagatagcattctccatcaagattcttcacaagtcaggcctgctgattgggcacgaatgttggaggttgtaaatcagaggagaactgaaattcttatgcctgagaatcttgagaacatgtggacaaagggaaggaattacaaaaggaaagagaacaaaattatcaaaactggctctcaggatcttcctgcaaagagtccatctacagacagttcactgcctcatagaaaattggctcaggaaacatcagcaagtaaacgtggaaagtatgaagttgcagaggggaagtcttctctgccaccattgcctgtcatgggttcagctcccctgcaaaatgttggagatgcaaaaagtttagaatcttctaaaaaccctgacaaagaattatctattgtgggagatcttgcttctgatggttataaaagcccgctgaagaggtcgagtagtgcttcttccttaggaatcctatctaataaagaagactccataatttcagaatttttcaacccggaatttgagaggcacagtgaaggatttcggggaaagagttcttctgatatgattgttaggaaagaagggccattagttcctaagctccggtgccgggttgtgggagcatattttgagaaaattgggtccacatgttttgctgtttattcaattgcagtgactgatgcacaaaataaaacttggtttgtaaaaagaagatacaggaattttgagcggttgcatcggcatcttaaagatattcccaattacacattgcatttgcctcctaaaaggatattttcctcaagcacagatgatgcctttgtacatcaacgttgcattcaacttgataaatatctccaggatctcctgtcaatagctaacgtagccgaacaacatgaagtatgggatttcttcagtgtttcctcaaagaactactcatttgggaaatctccttcggtgatgaagaccttggcagtcaatgtagatgatgctatggatgatattgtacgccagtttaaaggggtttcagatggtttaaggcgaaaagttgttggttcatcatccctcatcaatgagggatctgctacatctaataccacatggaatttgtcctggaatgcagatgaaattgacaaaagcattccgaggcaaagtactgcagaaagtgtgtttagctctgataatgaggaaggtgaaaagaacaattttgaccgtgacaatattgatagagcagtagcacaagatagtgggttgcattctgacaatgcattgatctcaaagggcaactcatcacgaataaacaattgtgatgaagagtccagcaacttggaatttgatagaaagcatgatatggtggttgaagctagggttggcaatgatattcctgctacaaatttcattctggttcatggtaatttggaggatccagttggagtgccacctgagtgggccccgcctaatgttagtgtccccattttggatttggttgacaacatatttcagcttaataaaagaggctggataagaaggcaggtctattggatttcaaaacagatattacagttggtgatggaagatgcaattgatgattggcttctgagacagattcattggctccggagagaggaaactgtttcccaagggattcggtgggtccaagatgtcctgtggcccggtggtacattttttttaagagtagggactccccagataattagtgacagtgataaaaaaccttctccaacaatgagcagatctggtggaaacaacatcacgaaatctgagtcaggatcttttgagcaagagctcgaggctgctcgtagagcaagtgacatcaagaaactgctatttgatggagctccaacaactctagtcagcttaatcggccataagcagtacagacattgcgcccgggatatatactactttagtcagtctaatatatgtgtgaagcaacttgcttatgcaattttggaacttgcacttgtctccatctttcctgagattcggaatgttgtggagagtattcaccaacctgtatagagttcttctatatgacatgtggtatggccagcatatatgaatgaaattgggaagaacacgttttggtattcaccaacacaagcatcgaccaatggttttgtaactatgtcccaactgtataaaacataggtttagggcgtgtacagaaacaattgttttgtgggattcattatgctttgtcaagtcaaggcataccccattgtctcggggattttgtatattgttacagactcgagaaatgcatctagtgagtattcttttatttgttcatcgttgggatacgactcatacgaggatttttttttatttggttaactttttgcttcctcaatagataccattatgggataaatacttattttaagttagggttggccagggacaacttgcacctgaagtttactgtagtgacactgttcataagcctctcttttttttcgttttcatttcttatttaatcttttcttttaattgtacaaatacaatgaaaatagattgcaatttttcgaaagata

SEQ ID NO: 6258 - DNA, 3983 bp, Glycine max
tcataacaatataaacttattaaacaaggactgaattattattgccagaacgagaactgcaatttataattttccaatacataggcttagaaactttggtcccgggaagggaatcttcaccatatgccactcacgttatcttttcatcacaccttcaccttcgatccttcctatgtccaattaattgtttaaggagagaccaactcataaagtcacaaagaatattactataaacatttggatttaggtggtggtggtggtggtggtgtatttcaaattccagctgttactattgttgttttatcgaaaacccaaattcccaaaggaatcgaaattgaaatcgaagtgggaacagagcaacacagagcgtgatttgttccaatcggtcggtgggctatggagagtgtgaatgatctgatccaagaggccaagctccgcactctctggtgggccctctgtatattcgtcgtttcctatttcctaactcatactagtaaatcaatgtggatgaatgtacccatgtcgatcctatttgttgtggggctgcgcattcttttcaatagggtggagttccgttggaaggttccacagcctagactgcagacctatctatctcatttggagaaaaagcagttgtctctgaatgatccacgcctcactagtttgcctccccctgcgaaatggaagaggaaaattgattctcctgctgtggaggctgcaatgagtgatttcattgataagattttgaaggattttgtggttgatttgtggtactcagagattactccagataaggagtttccagaacagatacgggcaataatcatggatgttctagctgaaatatcaggaagggttaaagagataaacctggttgacttgctgacaagggatttagtagatttaataggtgttcacatagaacttttcagaagaaatcaagctactattggtgttgatgttatgaaaacattatcttctgaggagcgggatgacagattaaaattccatctgttgaattctaaggagcttcatccagcactaatatctcctgagagtgagtgcaaggttcttcagcggctaatgagtgctgttttagctacagtactaagacaacgagaagctcagtgtcctgtgattcgttctatatctcgggaattattaacttgcttggtaatgcaacctattatgaatttggcaagccctgggtatattaatgaactgattgaatctcttctacttctctttaatgatgatggtacgcaagggatgggcagtgatcagtcaactaatgtagcaagtcaccatcatggtcattctgttgccagtgagggtggacacaacaatctcacagcctctaataagcatccatctttaaatcaaggaactggtatgatattggctaaaacgagtgatcagggagggacattgttacaagatagcattctccatcaagattcttcacaagtcaggcctgctgattgggcacgaatgttggaggttgtaaatcagaggagaactgaaattcttatgcctgagaatcttgagaacatgtggacaaagggaaggaattacaaaaggaaagagaacaaaattatcaaaactggctctcaggatcttcctgcaaagagtccatctacagacagttcactgcctcatagaaaattggctcaggaaacatcagcaagtaaatgtggaaagtatgaagttgcagaggggaagtcttctctgccaccattgcctgtcatgggttcagctcccctgcaaaatgttggagatgcaaaaagtttagaatcttctaaaaaccctgacaaggaattatctattgtgggagatcttgcttctgatggttataaaagcccgctgaagaggtcgagtagtgcttcttccttaggaatcctatctaataaagaagactccataatttcagaatttttcaacccggaatttgagaggcacagtgaaggatttcggggaaagagttcttctgatatgattgttaggaaagaagggccattagttcctaagctccggtgccgggttgtgggagcatattttgagaaaattgggtccacatgttttgctgtttattcaattgcagtgactgatgcacaaaataaaacttggtttgtaaaaagaagatacaggaattttgagcggttgcatcggcatcttaaagatattcccaattacacattgcatttgcctcctaaaaggatattttcctcaagcacagatgatgcctttgtacatcaacgttgcattcaacttgataaatatctccaggatctcctgtcaatagctaatgtagccgaacaacatgaagtatgggatttcttcagtgtttcctcaaagaactactcatttgggaaatctccttcggtgatgaagaccttggcagtcaatgtagatgatgctatggatgatattgtacgccagtttaaaggggtttcagatggtttaaggcgaaaagttgttggttcatcatccctcatcaatgagggatctgctacatctaataccacatggaatttgtcctggaatgcagatgaaattgacaaaagcattccgaggcaaagtactgcagaaagtgtgtttagctctgataatgaggaaggtgaaaagaacaattttgaccgtgacaatattgatagagcagtagcacaagatagtgggttgcattctgacaatgcattgatctcaaagggcaactcatcacgaataaacatttgtgatgaagagtccagcaacttggaatttgatagaaagcatgatatggtggttgaagctagggttggcaatgatattcctgctacaaatttcattctggttcatggtaatttggaggatccagttggagtgccacctgagtgggccccgcctaatgttagtgtccccattttggatttggttgacaacatatttcagcttaataaaagaggctggataagaaggcaggtctattggatttcaaaacagatattacagttggtgatggaagatgcaattgatgattggcttctgagacagattcattggctccggagagaggaaactgtttcccaagggattcggtgggtccaagatgtcctgtggcccggtggtacattttttttaagagtagggactccccagataattagtgacagtgataaaaaaccttctccaacaatgagcagatctggtggaaacaacatcacgaaatctgagtcaggatcttttgagcaagagctcgaggctgctcgtagagcaagtgacatcaagaaactgctatttgatggagctccaacaactctagtcagcttaatcggccataagcagtacagacattgcgcccgggatatatactactttagtcagtctaatatatgtgtgaagcaacttgcttatgcaattttggaacttgcacttgtctccatctttcctgagattcggaatgttgtggagagtattcaccaacctgtatagagttcttctatatgacatgtggtatggccagcatatatgaatgaaattgggaagaacacgttttggtattcaccaacacaagcatcgaccaatggttttgtaactatgtcccaactgtataaaacataggtttagggcgtgtacagaaacaattgttttgtgggattcattatgctttgtcaagtcaaggcataccccattgtctcggggattttgtatattgttacagactcgagaaatgcatctagtgagtattcttttatttgttcatcgttgggatacgactcatacgaggatttttttttatttggttaactttttgcttcctcaatagataccattatgggataaatacttattttaagttagggttggccagggacaacttgcacctgaagtttactgtagtgacactgttcataagcctctcttttttttcgttttcatttcttatttaatcttttcttttaattgtacaaatacaatgaaaatagattgcaatttttcgaaagata

SEQ ID NO: 6259 - DNA, 3432 bp, Cajanus cajan
gttccaatcgctgttgtcgtggccatggagagtgtgaatgatctgatccaagaggccaagctccgcactctctggtgggccctctgtatattcgccgtttcctattttctaactcatacaagtaaatcaatgtggatgaatgtacccatgtctatcctttttgtttccggcttgcgctttctatttaataaggtggagttccgttggaaggttcaacaacctagaaagcagacctatctatctcatttggagaaaaagcaattgtctctgaatgatccacgtctttctagtttgcctccccctgcgaaatggaagaggaaaattgattctgctcctgtggaggctgcaatgagcgatttcattgataagattttgaaggattttgtggttgatttgtggtactcagaaattactccagatagggagtttccagagcagatacatgcaataattatggatgttctagctgaaatatccgggagggttaaagagataaacttggttgacttgctgacgagggatttagtagatttagtaggtgatcacttagaattattcagaagaaatcaagctgatataggcgttgatgttatgaaaacattatcttctaaggagagggatgatagattaaaattcaatctgttgaattctaaggagcttcatccagcactaatatctcctgagagtgagtacaaggttcttcagcggctaatgagtgctgttatagctacagtactaagacaacgagaagctcagtgtcctgtgattcgttctatagctcgggaacttttaacttgcttggtaatgcagcctattatgaatttggcaagccctgggtatattaatgaactgattgaatctcttctgcttctctttaatgatgatggcacgaaagggatgggcagtgatcagtcaactaatgtagcaagtcactatcatagacattctgttgccagtgagggtggacaccacaatctcacagcctctaataagcattcatctttaaatcaaggaacggatatggtattggccaaaatgagtgatcagggtgggaaaccattgcaatataactctcttaatcaagaatcttcacaggttaggcctgctgattgggcacaaatgttggaggttgcaactcagaggagaactgaaattcttatgcctgagaaccttgagaacatgtggacaaagggaaggaattacaaaaggaaagagaacaaaattatcaaaactggctttcaggatcttcctgcaaagaatccctctacagacagttcactgcctcagagaaaattgactcaagaaacatcagcaagtaatcgaggaaagtatgaagttgcagaggggaaatcttctctaccgccaatgcaggccatgggttcagatcccctacaaaatgttggaagtgcaaaaatttcagagtcttctcaaaaccctgacaaggaattagcttttgcgggagaccttggagttgataaaatgaaaagtattaaggatcttgcttctgatggttataaaagtccgttaaagaggtcaaatagtgcttcttcattaggaatcctacttaataaagaaggaggctccataatttctgagttttacaaccctgaatttgagaggcacagtgatggatttcgaggaaagagttcttctgacatgattgttaggaaagaagggccattagttccaaagctccggtgccgggttgtgggagcatattttgagaaacttgggtccacatgttttgctgtttattcaattgcagtgactgatgcacaaaataaaacttggtttgtaaaaagaagatacaggaactttgagcgattgcatcggcatcttaaagatattccaaattacacattgcatcttcctcctaaaaggatattttcctcaaacacagatgatgcctttgtacatcaacgttgcattcaacttgataaatatctccaggatctcctgtcaatagctaatgttgccgaacaacatgaagtatgggatttctttagcgtttcctcaaagaactactcattcgggaaatctccttcagtgatgaagaccttggcagtcaatgtagatgatgctatggatgatattgtacgtcagtttaaaggggtatcagatggtttaaggcgaagagttgttggttcatcatcactcatcaacgagggatctgctacatctaccacttggaatttgtcctggaatgcagatgaaattgacaaaagctttaccacgaaaggtacctcagaaagtgtgttaagctctgataacgaggaaggtgaaaagaacagcaattttgaccaagagaacattcatagcgatgtagcacaagttagtggattgtattctgacaatgcattgatctcaaagagttacccatcaccaataaacaaacgtgatgaagagtccagcaacttgaattttgatagaaagcatgatatggtggtggaagctagggttggcaatgatgttccttctacaaatttcattctgattaatgataatttggaagatccagtcggagtgccaccagagtgggccccaccaaatgttagtgtccccattttgaatttagttgacaagatatttcagcttaagaaaagaggctggataagaagacaagtctattggatatcaaaacagattttacagttggtgatggaagatgcaattgatgattggctcctgagacagattcattggctccggagagaggaaactgttgcccaagggattcggtgggtccaaaatgtcctctggcctgatggtacgtttttcttaagagtagagactccccggataataagtagtgacagtgatcaaaagccttttcaaacaatgagcagatctggtggaagcaacatcacaaaatctgagtccgggtcttttgagcaagagcttgaggctgctcgtagagcaagtgacatcaagaaactgctgtttgatagtgctccatcaactttagtcagcttaatcggccataagcagtacagacattgcgccagggatatatattactttagtcagtctaacacatgtgtgaagcaacttgcttatgcaattttggaactagcacttgtcaccatcttccctgagatgcggaatgttgtgttgagtattcaccaacccgtatagagttctatatgacatgaggtatatgggcagcatatgtggaacttgaaattgggaagaacacgttttggtggtgtggtgccatgtaacctgcaagatgattgatttgggaactcggcatttggttttgtatctatgtccaattgtataaaacatagataggtttagggcgtgtacagaaacaattgttttgtgggattcatgatgctttgtcaaggcatgccccagtttcatggggattttgtattgctacagactcgagaaatccatctagtgaatattctttattcttcatccttg

SEQ ID NO: 6260 - DNA, 3919 bp, Glycine max
aaaaaaaaactatcaactgaaattaaaattagcctgataaaagaaacacgaaaaagaaaaacaataattaataaacaataacaatacatggaataagcgaggactgaattattattgccagaacgagaactgcaatttataatttggaatttccaattcataatcatagggtgagaaattttggtcccgggaatcttcaccataggccactcacgttatcttttttcatcacttcttcttcaccttcgatccttcctatgtccaattaattgtttaaggagaggaccaactcataacgtcacaaacaatattattattaacatttagatttaggtggtggtggatttcaaattccagctattactattgttgttgttgttgtttttttttatcgaaaacccccaatcctaaggaatcgaaattgaaattgaaacagagcaacacagagcctgatttgttccaatcggtgtgggctatggagagtgtgaatgatctgatccaagaggccaagctccgcactctctggtgggcactctgtatattcgccgtttcctatttcctaactcatactagtaaatcaatgtggatgaatgtacccatgtcgatcctatttgttgtggggctgcgcattcttttcaatagggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcgggttgtgggagcatattttgagaaaattgggtccacatgttttgctgtttattcaattgcagtgactgacgcacaaaataaaacttggtttgtaaaaagaagatacaggaattttgagcgattgcaccggcatcttaaagatattcccaattacacattgcaattgcctcctaaaaggatattttcctcaagcacagatgatgcctttgtacatcaacgctgcattcaacttgataaatatcttcaggatctcctgtcaatagctaatgtagccgaacaacatgaagtatgggatttcttcagtgtttcctcaaagaactactcatttgggaaatctccttcagtgatgaagaccttggcagtcaatgtagatgatgctatggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataagaagacaggtctattggatttcaaaacagatattacagttggtgatggaagatgcaatcgatgattggctcctgagacagattcattggctccggagagaggaaactgtttcccaagggattcggtgggtccaagatgtcctatggcctggtggtacattttttttaagagttgggactccccagataattagtgacagtgataaaaaatcttctccaacaatgagcagatctggtggaagcaacatcacgaaatctgagtcagggtcttttgagcaagagctcgaggctgctcgtagagcaagtgacatcaagaaactgctgtttgatggagctccaacaactttagtcagcttaatcggccataagcagtacagacgttgcgcccgggatatatactactttagtcagtctaatgtatgtgtgaagcaacttgcttatgcaattttggaacttgcacttgtctccatcttccccgagattcggaatgttgtgaagagtattcaccaacctgtatagagcttttccatcatgacatatggtatggccagcatatgtgggacatgaaattgggaagaacacgtttgatggctttgctgtccggtaacatgcaagatgattgatttgggaactaggccaattgttttgtaactatgtccatctgtataaaaagatagatttagtgcgtgtacagaaacaattgttttgtgggattcattatgctttgtcaagtcaaggcatacccccttgtcatggggattttgtattgttacagactcgagaagtcaaatgcatctagtgaatgaatattctttatttgttcatcgttgggatacgaggattttttgtttatatctaaaaataagtgaatcaggttgacttttacagaaaacg

SEQ ID NO: 6261 - DNA, 3790 bp, Glycine max
ctgcaatttataatttggaatttccaattcataatcatagggtgagaaattttggtcccgggaatcttcaccataggccactcacgttatcttttttcatcacttcttcttcaccttcgatccttcctatgtccaattaattgtttaaggagaggaccaactcataacgtcacaaacaatattattattaacatttagatttaggtggtggtggatttcaaattccagctattactattgttgttgttgttgtttttttttatcgaaaacccccaatcctaaggaatcgaaattgaaattgaaacagagcaacacagagcctgatttgttccaatcggtgtgggctatggagagtgtgaatgatctgatccaagaggccaagctccgcactctctggtgggcactctgtatattcgccgtttcctatttcctaactcatactagtaaatcaatgtggatgaatgtacccatgtcgatcctatttgttgtggggctgcgcattcttttcaatagggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcgggttgtgggagcatattttgagaaaattgggtccacatgttttgctgtttattcaattgcagtgactgacgcacaaaataaaacttggtttgtaaaaagaagatacaggaattttgagcgattgcaccggcatcttaaagatattcccaattacacattgcaattgcctcctaaaaggatattttcctcaagcacagatgatgcctttgtacatcaacgctgcattcaacttgataaatatcttcaggatctcctgtcaatagctaatgtagccgaacaacatgaagtatgggatttcttcagtgtttcctcaaagaactactcatttgggaaatctccttcagtgatgaagaccttggcagtcaatgtagatgatgctatggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataagaagacaggtctattggatttcaaaacagatattacagttggtgatggaagatgcaatcgatgattggctcctgagacagattcattggctccggagagaggaaactgtttcccaagggattcggtgggtccaagatgtcctatggcctggtggtacattttttttaagagttgggactccccagataattagtgacagtgataaaaaatcttctccaacaatgagcagatctggtggaagcaacatcacgaaatctgagtcagggtcttttgagcaagagctcgaggctgctcgtagagcaagtgacatcaagaaactgctgtttgatggagctccaacaactttagtcagcttaatcggccataagcagtacagacgttgcgcccgggatatatactactttagtcagtctaatgtatgtgtgaagcaacttgcttatgcaattttggaacttgcacttgtctccatcttccccgagattcggaatgttgtgaagagtattcaccaacctgtatagagcttttccatcatgacatatggtatggccagcatatgtgggacatgaaattgggaagaacacgtttgatggctttgctgtccggtaacatgcaagatgattgatttgggaactaggccaattgttttgtaactatgtccatctgtataaaaagatagatttagtgcgtgtacagaaacaattgttttgtgggattcattatgctttgtcaagtcaaggcatacccccttgtcatggggattttgtattgttacagactcgagaagtcaaatgcatctagtgaatgaatattctttatttgttcatcgttgggatacgaggattttttgtttatatctaaaaataagtgaatcaggttgacttttacagaaaacg

SEQ ID NO: 6262 - DNA, 1563 bp, Glycine max
gaaagagtcatggatgcgcgtcactgctcgcgttcattataatggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcataggttaggtcttaattttgtgctattcctgtctatatgtattttaatatttttttttactaattaaatttcataattgaatgaaatcatatgtatattgtttcagtaaagtggaatttactgaaaatatttgtaatagcaacttcaacaaaaatcgatttgtaggagaaatttcttccctggaaattgttctattttaaatcttgttgctcataagatattatgacttcattcaactaataattcatgtcgtttaggaaaagtagttagttatattaaatttgtcaattaattgtattgttactccaaattattcttttatttttctattcacttaattttttttattaatgtttggaga

SEQ ID NO: 6263 - DNA, 1513 bp, Glycine max
gaaagagtcatggatgcgcgtcactgctcgcgttcattataatggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcataggttaggtcttaattttgtgctattcctgtctatatgtattttaatatttttttttactaattaaatttcataattgaatgaaatcatatgtatattgtttcagtaaagtggaatttactgaaaatatttgtaatagcaacttcaacaaaaatcgatttgtaggagaaatttcttccctggaaattgttctattttaaatcttgttgctcataagatattatgacttcattcaactaataattcatgtcgtttaggaaaagtagttagttatattaaatttgtcaattaattgtattgttactccaaat

SEQ ID NO: 6264 - DNA, 1949 bp, Cicer arietinum
gttttatcacgtacactatattgacaccttattcaaatattcgaatattcaatgataaataataactgtgttgacggccgccatggctgtgcgtcactgtatccgtaagcattcgctgtaactccacgattctatagtataaataactttggcgcactattacagcatagaaaatgtcaatattgccattattgtcagaaattaaaagctgatttatttatccccgcgtgtaatttaatgctcttataagtttcaattttgtcgtgttttctgattgcgtgctacgcaatctacctatcatatttatcatcatccagtcaatttattagaagcagataatcgaatttacggtaacgtcggtgattcatatttcttgaaaatggcggaagagattagcaaaaacggcctcggttcatcttccaaatctagaagcttctggtctgcacttcgttggattcctacttctaccgatcacatcatcgctgccgagaaacgccttctctccattatcaagactgggtatgttcaagagcatgttaatataggctccggtcctcctgggtccaaagtaagatggttccgttcatccagcgatgagccacggtttatcaacactgttacatttgacagtaaacctgattctcctacgcttgtcatggttcatggatatgctgcttcacagggtttcttctttcgcaattttgatgctcttgcctctcgtttccgaatcattgctgttgatcaacttggttggggaggatcaagcaggcctgatttcacatgcagaagtactgaagaaactgaggcatggttcattgattcttttgaggaatggagaaaagccaaaaacctaagcaatttcatactacttggacattcttttggcggttatgttgcttccaagtatgcgctcaagcaccccgagcatgtacaacacttaattttggtgggacccgctgggttttcttcagaatcagatgcgaagtctgagtttattacaaagtttcgagcaacatggaagggagcagttctgaaccatctatgggaatctaattttacacctcaaaaacttgtcagaggtttaggtccttggggtcctaatatggtccgcaaatatacaagtgctaggtttggtacacattcaactgggcaaacactgactgaagaggaatcaagtttactaacagattatgtttatcatactttggcggccaaagctagtggggagttgtgtttaaaatatatttttgcatttggagcatttgctaggatgccccttcttcacagtgctccagagtggaaggtgcccactactttcatatatggttaccaagattggatgaattatcaaggtgcccaagaagctcgcaagcaaatgaaggttccatgtgaaattatcagggtccctcaggccggacattttgtgttcatcgacaacccaagtggcttccattcagctgtgttttatgcttgtcgaaggtttctttcaccagatccggacaatgaatctcttcctgaaggactatcatctgcataggatatagttttgcagctatactgtgtatatatttttttgtttattcactaatcaaattttatagttgaatgaagcccgtgcttcacattaaaggggtatttcctggaaatatatttaattgtaatttcaataaaaaaatgatttgtaggcgaacctgaactttcattacagtaacatattctgttaaaatctggtgggcatgggacaaacttatgctgtcaaatatgaacgagtcatttgtaatattagaacaaatattgtttacgagaaagatatcttctaatgtatacccataatcacagtccccacggaatttgtcctggttattaagtcacagctttttaccaattttccctactgtttttgctttcgagaattgcacgaacgagtaaaacgatggagtgaaaaaagg

SEQ ID NO: 6265 - DNA, 1497 bp, Lupinus angustifolius
atctaccgttgttttataatgccattaaattatgaggaatcaaatatatgttagattgttgtcagtaaatgaaggcaattgggttatattggtcggcgagaatggctcaagagattcgcaaaaacgacgtcggattatcatcgagtagtagtagtagcagcagacgattatggccttctgttctccgttggattccaacttccaccgatcacatcatcgcttccgagaagcgccttctttctattctcaagactccttatgttcaagaacatgttaatataggttctggtcctcctggctcaaaagtcagatggttccgatcattgagcaacaaaccgcggtttattaacactgttacatttgacagtaaagatgattctcccacacttgtaatggttcatggatatggtgcttcccagggtttcttttttcgcaatttcgatgctcttgccagtcgtttcagagttattgctgttgaccaattaggttggggtggatcaagcaggcctgattttacatgcagaagcactgaagaaacggaggaatggttcattgattcttttgaggagtggagaaaagcccaaaacctgagcaaatttatactacttggacattcatttggtggttatgttgctgcaaaatatgccctcaagcaccctgagcatgtacaacacttgattttggtgggatctgctggattttcatcagaatcagatgctaatcagtctgagtggtttacaaagtttcgaacaacatggaaaggatcagttatgaaccatctatgggaatctaatttcacacctcaaaaactcgtcaggggtttaggtccttggggtcctgatattgtccgcaagtatacaagtgctaggtttggtacacattcaactggggaggtactgaccgaagaggaatcaagattgcttacagattatgtttaccatacgttagcggccaaagctagtggggagctgtgcttaaagtatatattttcgtttggagcatttactaagtcgcctcttgttggcagtgcctcggagtggaaggtgccgacgacattcatatatggtttccaagattggatgaaatatgaaggcgcccaagaagctcgcaagcatatgaaggttccatgtgaaatcatcagggtccccaagggtggccactttgtgttcattgacaatccaaatgctttccattcttctgtgttttatgcttgtagaaagtttcttacacctgatccagataatgaaccccttcctcaagggctaaccttagcttaacctataattttgtgccaatcctgtctgtattatattatttatctgatacaaattaaatctcaatattcatacacacaaaatattgccatttgatgaagccatgtcttgttacagtgaagtacaatttacaggaaatatatgtaatagcaatactcaggaaacacaatgtaaagaactcatcatattgctagatcaataaaattattcttttaactatcta

SEQ ID NO: 6266 - DNA, 1521 bp, Medicago truncatula
ggttggctcatagttccttttacctgttgaaaacaaaacatatggagtaacattttagtcagaaattcaaagctacgcacttgattaaactaattatcgaaaaatggcggaagaaattagacaaaaggacgacgtcgattcatcttcgaaatctaaaagcttctggtcttcactccgttggattcccacttctaccgatcatatcatcgccgctgagaaacgccttctttccattatcaagactgggtatgctcaagagcatgttaatataggttctggtcctcctggctctaaagttagatggttccgttcaaccagtaacgagccacgctttctcaacactgttacatttgatagtaaacccgattctcctacacttgttatggttcatggatacgctgcttctcagggtttcttctttcgcaattttgatgctctcgcctctcgtttcagaatcattgctgttgatcaacttggttggggaggatcaagcagacctgatttcacatgcaaaagtaccgaagaaactgaggcatggttcattgattctttcgaggaatggagaaaagccaaaaatcttaccaatttcatactgcttggacattcttttggtggttatgttgcttccaaatacgcgctcaagcaccctcagcacgtacaacacttaattttggtgggacctgccgggtttacagaagaaacagatccaaagactgagtttgttactaagtttcgagcaacatggaagggagcagttctgaaccatctatgggaatctaattttacacctcagaaaattgtcagaggtttaggtccttggggtcctaacatggtccgcaaatatacaagtgctaggtttggtacacattcaaccgggcaaaaactgattgacgaggaatcaagtctgctgactgattatgtttatcatacattggcggccaaagctagtggggagctgtgtttaaaatatatttttgcatttggagcatttgctaggatgccccttcttcaaagtgctcaagagtggaaggtgcccaccacattcatatatggttacgaagattggatgaattatgaaggtgcccaagaagctcgcaagcatatgaaggttccatgtgaaattatcagggtccctaaggccggccattttgtgttcattgacaacccaagtggcttccattcagctgtgttttatgcttgtcgaaggtttcttaccccaaattcggacaatgaatctcttcccgaagggctatcgtctgcttaggatttaattttgcatcaatccagtgtatattaatatggttattaatttttttttacttcataactgaatgaagccgtgtcttgtttctcagtgaagtggaatataatggaaatatatgtaattgtaataacaataatattgatttgttggggaactttgaggacaaaaacatattctggtaaaattttgttgcacatgcgacaaacatatgctgtgaaatgcgaatgtgtcatataacataagatcaaatatttttc

SEQ ID NO: 6267 - DNA, 2490 bp, Vitis vinifera
acaagtttcccaacaaaaaaaaatggaaatgtcttggtgcacaagtaattggcttgttgggttggagagactgagaggcggatgcgactagaatttggacctggaatcctggtgtattttcctgtcatccgcgtgcgtcacagcgaacgtaacaaaaccgtgtgtaaaaagaaaacaatacataatggtgaggccgccgttgaccgcgtaacgggtttatatgtgtataaaggcaggcgcaggctgcgcagcaactataggccgttggaaaggcttttgacactacaatctatcttcatcaccctaaaaacttggcaattacggtgtatgagctatcgtttcgttcggtggtcgaggatggcggaagagatgactaaggcggagcttggatcctcctcctcaactactaaatccagatctttgtggccttctcttttccgttggatccctacctctaccgatcatatcatcgacgccgaaaagcgtcttctctccttagtcaagactccttatgttcaagaacaggttaatatagggtctgggccacctgggtccaaagtcaggtggtttcggtctgccagcaatgaaccaaggtttatcaacacagttacttttgacagcaaagatgattctcctactcttgtaatggttcatggatatggtgcttctcaaggtttctttttccggaattttgatgctcttgctagacgattcagggtcatcgccattgatcaactaggttggggtggatcaagcaggcctgacttcacttgcaaaagtaccgaagagactgaggcttggttcattgattcctttgaggagtggcgtaaagccaaaaaccttagcaactttatattgcttgggcactctgtcgggggctatgttgcagctaaatatgctctcaagcatcctgagcacattcagcacttgattttggtgggacctgctggattttcattggaatcagatggtaagtcagagtggcttacacggttcagagcaacatggaaaggagctgttctgaaccatttgtgggaatctaattttactcctcagaagcttgtcagaggtattggcccttggggtccagatcttgtacgcaagtatacaagtgctagatttagttcatattcaactggtgatttgttaactgaagaggagtccaagttactcacagattatgtgtaccatactgtagcagccaaagctagtggagagctgtgcttgaaatacatattttcatttggagcatttgctcggttgccccttctgcacagcgcatcagaatggaaagtgccaaccacttttatatatggctttgaagattggatgaactaccaaggagcccaagaagctcgcaagcaaatgaaggtcccatgtgaaattattagggtcccccaggctgggcattttgtattcatagacaatccctctgggttccactcggctgtattgtatgcttgccgcagatttctcttgcctgaccctgatagtcaatcccttcctgaaggcttgacatctgcctaaaaatagagtaggctataaattgtaaattgatagcctatgtattaaaaaaaaaaaaaacattctttctgcgaagtttgttgattcatacattcttctgtagttgatgacttcataagaaaattccattgttcctcagagaagctatattctgaacgcatgcataatttaattcagttgttatgagcggttgaatttgccaccagatcttcaacaaatttcttaaatgctatttatgagtaaatctgaatttgagggtaccttgtacatgcactgtgactgaagtaaaattcgggttgcccttccttgtacctctgcatgagagccatgaagagattttataattttggtttatgcccttcattgtagaaaagttcactgttggtataattaatgccgccctcacttgcagctctgcatagtcatgagggaggaggtatttacatttttggttcttccgcttgtatatcatagaaagcttcactgtacttagtttctgatgtatttccaaataaggtaccagttccttggcctatttttgccagggtgcctcactattgatatattctgactgatgattaaggtgtgtgcgagcccagggaaaacaagaacaggcttgagcctttacttgttgggaacccatttctcaccttagttgaacaggattggggccccacataagaatgctttgttgctgcttaatgtgctgagatggagaaacactgggttcgtcttgtttcaaccttttaaggacggatgaagcaaaagtttatcagaaatgaaggcattctacaacagagtcccatgctttgcgggcgtcgagccctgagcggcaccatcaccacttttaatgttcactgctttgtgccttttttggcattgctttcaatctaattataaagaatctggcatagaactaaatgtggtatgattaaaatctgaccctttacccattttcccttgaga

SEQ ID NO: 6268 - DNA, 2282 bp, Vitis vinifera
acaagtttcccaacaaaaaaaaatggaaatgtcttggtgcacaagtaattggcttgttgggttggagagactgagaggcggatgcgactagaatttggacctggaatcctggtgtattttcctgtcatccgcgtgcgtcacagcgaacgtaacaaaaccgtgtgtaaaaagaaaacaatacataatggtgaggccgccgttgaccgcgtaacgggtttatatgtgtataaaggcaggcgcaggctgcgcagcaactataggccgttggaaaggcttttgacactacaatctatcttcatcaccctaaaaacttggcaattacggtgtatgagctatcgtttcgttcggtggtcgaggatggcggaagagatgactaaggcggagcttggatcctcctcctcaactactaaatccagatctttgtggccttctcttttccgttggatccctacctctaccgatcatatcatcgacgccgaaaagcgtcttctctccttagtcaagactccttatgttcaagaacaggttaatatagggtctgggccacctgggtccaaagtcaggtggtttcggtctgccagcaatgaaccaaggtttatcaacacagttacttttgacagcaaagatgattctcctactcttgtaatggttcatggatatggtgcttctcaaggtttctttttccggaattttgatgctcttgctagacgattcagggtcatcgccattgatcaactaggttggggtggatcaagcaggcctgacttcacttgcaaaagtaccgaagagactgaggcttggttcattgattcctttgaggagtggcgtaaagccaaaaaccttagcaactttatattgcttgggcactctgtcgggggctatgttgcagctaaatatgctctcaagcatcctgagcacattcagcacttgattttggtgggacctgctggattttcattggaatcagatggtaagtcagagtggcttacacggttcagagcaacatggaaaggagctgttctgaaccatttgtgggaatctaattttactcctcagaagcttgtcagaggtattggcccttggggtccagatcttgtacgcaagtatacaagtgctagatttagttcatattcaactggtgatttgttaactgaagaggagtccaagttactcacagattatgtgtaccatactgtagcagccaaagctagtggagagctgtgcttgaaatacatattttcatttggagcatttgctcggttgccccttctgcacagcgcatcagaatggaaagtgccaaccacttttatatatggctttgaagattggatgaactaccaaggagcccaagaagctcgcaagcaaatgaaggtcccatgtgaaattattagggtcccccaggctgggcattttgtattcatagacaatccctctgggttccactcggctgtattgtatgcttgccgcagatttctcttgcctgaccctgatagtcaatcccttcctgaaggcttgacatctgcctaaaaatagagtaggctataaattgtaaattgatagcctatgtattaaaaaaaaaaaaaacattctttctgcgaagtttgttgattcatacattcttctgtagttgatgacttcataagaaaattccattgttcctcagagaagctatattctgaacgcatgcataatttaattcagttgttatgagcggttgaatttgccaccagatcttcaacaaatttcttaaatgctatttatgagtaaatctgaatttgagggtaccttgtacatgcactgtgactgaagtaaaattcgggttgcccttccttgtacctctgcatgagagccatgaagagattttataattttggtttatgcccttcattgtagaaaagttcactgttggtataattaatgccgccctcacttgcagctctgcatagtcatgagggaggaggtatttacatttttggttcttccgcttgtatatcatagaaagcttcactgtacttagtttctgatgtatttccaaataaggtaccagttccttggcctatttttgccagggtgcctcactattgatatattctgactgatgattaaggtgtgtgcgagcccagggaaaacaagaacaggcttgagcctttacttgttgggaacccatttctcaccttagttgaacaggattggggccccacataagaatgctttgttgctgcttaatgtgctgagatggagaaacactgggttcgtcttgtttcaaccttttaaggacggat

SEQ ID NO: 6269 - DNA, 1257 bp, Cannabis sativa
ctactacttctacaccgtctatgtcaaagtccagatccttttggccctctgtacttcgatggattcccacctccaccgatcacatcatcgcttctgaaaagcgtcttctttctatagtcaagactccttatgttcaagaacaggtgaatattggttcaggtccgccgggttcgaaaattaggtggtttcgttcttcgagcaatgagccaaggtttattaacactgtttcgtttgatagtaaaagtgattctccaactcttgtaatggtgcatggatatggtgcttctcaaggctttttcttcagaaattttgatgctcttgctagtcgtttcaaagtcattgctattgatcagcttggttggggtggatcaagcagacctgactttacatgcaaaagtactgaagaaaccgaggcatggttcattgattcccttgaagaatggagaaaagccaagaaccttagcaactttattttacttggacattcatttggaggatatgttgctgctaagtatgctctcaagcatccagagcacgttaagcacttgattttggtaggatctgctggcttttcctctgaggcagatggcatgtctgagcggcttactcgtttcagagcaacatggaaaggagctctcttaaaccatttgtgggaatctaattttacccctcaaaagattatcagaggcttaggtccgtggggtccaaatcttgtgcagaaatacacaactgctagattcagttcgtactctacagggaatgtgctgactgaagaggagtctaaactgctaactgattatgtataccatactttagcagccaaagctagtggggagctgtgcttgaaatatattttttcttttggagcatttgcaaggatgcccctacttcacagtgcctcagagtggaaggtgccaactacattcatatacggatatgaagactggatgaactatcaaggagcccaagaagctcgcaagaatatgaaggtcccctgtgagatcatcagggttcctcaggcggggcactttgtgttcatagacaaccctaacgacttccattcagctgttttttacgcttgccgaagatttctctctcccaactccgataaagaatcccttccggagggtttgatacctgcctgaccagagtctggtataatttttttactaccattttttcttcatttcatttctatgtataacaattacttaagtcaatcacacaaatagtgactcgtgaatataaatatcattc

SEQ ID NO: 6270 - DNA, 1196 bp, Lotus japonicus
gtgattgattcctaatggcggcggcggaagagatcagcaaaaacgacaacgccggattatcatcttccaaaaccaaaagcttctggtcatggccttcttctctccgttggattccaacttccactgatcttgtcatcgctgccgagaagcgccttctttccattatcaagactgggtatgttcaagagcgtgttaatataggttctggtcctccggggtctaaagttagatggttcggttcatcgagcaatgagccgcggtttattaacacatttacatttgatagtaaacctgatgctcccacgcttgtaatggttcatggatatgctgcttctcagggattcttttttcgtaatttcgatgcgcttgctgctcgtttcagagtcattgctgttgatcaactcgggtggggtggatcaagcaggcctgattttacatgcaaaagcactgaagaaactgaggcatggttcattgattcttttgaggaatggagaaaagcaaaaaacctgaccaatttcatactacttggacattcttttggtgggtatgttgctgccaaatatgcgctcaagcacccagagcatgtacaacacttaattttggtagggcctgctggatttactacagaatcagataaagccaccgagtttattacaaagtttcgaaaaacatggaagggagcagtaatgaaccatctatgggaatctaattttacaccattaaaaattgtcagaggtattggtcctttgggtcctaccatggttcgcaagtatacgagtgctaggtttggtacacattcaaccggggaggtactgactgaagaggaatcaaaattgctgacagattatgtttaccatacattagcggccaaagctagtggggagctgtgcttaaaatatattttttcatttggagcatttgctaggatgccccttcttctcagtgcctcagagtggaaggtgcccaccactttcatatatggtttccaagactggatgaattatgagggtgcccaagaaactcgcaagaatatgacggttccatgtgaaatcatcagggtacctcaggctgggcactttgtgttcattgataacccatctggcttccattcatctgtgttttatgcatgtagaaggttttttacaccagatccagacagtgaatctcttcctgaagggctaacctctgcatagcaa

SEQ ID NO: 6271 - DNA, 1797 bp, Aquilegia formosa
cagtattaattgaaaaagaagggcattttgcaaattcaatcatcaatcttgggggcaatcgcaataaataaacccttttaatcgctaataatgcgtaagcgcgaacgtaatcattttcttcagaagaaagtcgaagagagagagagagaaagtaaagcagtcaaacaattcaattgagtttcttccttccttcctctttcttcttcttcgtgccattctctctcttgcggtgcaagttagcgaagattgtatatatatagtgtatataaaccagttcaataatacttcaattgtatgaatgtgaatgataagacggtggtcgaactcagtaattttgaagaacaagaagaagatgtctgaacaaatcaacaacacaacaactactaaagctaaagctgctgttgctgccgctgcgaatgttgaagctgttacatcatcatcatcatcgacaacaagttctacatctcgaggtattgggatttggccgtcaattcttcgatggatacctacttctactgatcatatcattgattctgaaaaacgtcttctctctttagtcaagactccatatgttcaagagatggttaatataggatcaggaccacctggttctaatgttcgttggtttcggtccacaagtgatcagccgagatttatcaatactgtcacatttgatagtaaggagggttctcccactcttgtcatggttcatgggtatgctgcttctcaaggattcttttttcggaactttgatgctctggctagtcgttttaaagtcattgctatcgatcaacttggttggggtggatcaagcagaccagatttcacatgcaaaagcaccgaagagactgaggcatggttcattgattctttcgaggaatggcgcaaatccaaaaatctcagcaattttatcttgctgggtcattcatttggaggatatgttgcagccaagtatgctctcaagcatcctgaacatgttcaacatttgattttggtggggcctgccggtttctcgtcagattcagacgcttccaagtctgagtggctaactcgattcagagcaacatggaaaggagccattgcaaatcatctttgggaaagcaacttcactccccagaaagttatccgaggtttaggtccttggggtccaaatcttgtccggagatataccagtgctagatttggtgcatattcaaccggtgaattattaactgaagaagagtccagattgcttgcagactacacttaccatactttagctgccaaagctagtggagaattgtgcttaaagtacatattttctttcggagcatttgcacgactgcccctcttacacagcgcatcagaatggaaagtaccaactacttttatctatggttttcatgattggatgaactaccaaggggctcaagaggctcgaaaggatatgaaggtcccatgtgaaatactccgggttcctcaggccggtcactttgcattcattgataacccaaatggattccattcggctgtattccatgcttgccgtagatttctctcatctgactccagcaatgagtccctcccagaaggcttaacatcagcataatggaagtaactgtacaattgtcccttttacgggtgtagtagcttcattttttttcctcattgtattatgtataccgtcactgtattaagtacgtcatgaactgatcatccatctattgttgtattggggatcagttatatatatcagatgctaatgtacagtttttaaattttaatttaaacatctgtgtcgaagtttatattactcct

SEQ ID NO: 6272 - DNA, 1448 bp, Manihot esculenta
tcattttacatcaaaaagcgataaaatcgtttacatgaacttgcttcgcctgcgggtaactagctcaatttcgaaaatggccgaagagctaggatcatctgctgctgctaccaccgcaacatcaacctcatcaacatcatcgtcatgggccaaaacaagatctctgtggccatctattcttcgttggattcccacttccaccgatcgcatcattgctgccgagaaacgcctcctctctcttgtcaagactccttatgttcaagaacaagttaatataggttcaggtcctccggggtccaaagtgaggtggtttcgttctgcgagtaatgagccccggttcattaacacggttaccttcgacagcaaagaggactcgcccacactcgtaatggtccatggatatgcagcttctcaaggctttttctttcggaattttgatgctctcgctagtcgtttcaaggtcattgctgttgatcagcttggctggggtggatcaagtagacctgattttacatgcaaaagcactgaagaaactgaggcatggttcattgactcctttgaggaatggcgaaaagcaaaaggcctcaacaacttcatattacttgggcattcttttggagggtatgttgcagctaaatatgcactcaagcatccagagcacgttcagcatttgattttagtgggatctgctggattttcatcagaatcagaagctaagtctgagtggcttactcgattcagagcaacatggaaaggagcaattttaaatcatttgtgggagtcaaattttactcctcagaaggttattcgaggcttaggtccttggggtccaggccttgtgcataggtacacaactgctagatttggtgcatattcaagtggagaggtattaactgaagaggaggcgaaattgctaacagactatgtgtatcacactttagcagccaaagctagtggggagctatgcttgaaatatatattttcttttggagcattcgctcggatgccccttctacagagtgcatcagagtggaaagtgccaactactttcatatatggttttcaagattggatgaactatcaaggggcccaggaagctcgcaagcacatgaatgtcccttgtgaaatcattagggttccccagggtgggcactttgtcttcatagataatccaaacgggtttcattcagctgtattatacgcttgccggaggtttctctcacctaatcctcacagtgaatctcttcctgagggtctggtatctgcgtaggaagaaagttataattttttttaagcccatttgtgtatagtttatattagggtttccaatacaacacaatcagaaattttacgtaaattttgcattaagaaaacattctttccatgtgtacatgtacttttaatatttgttgaacgtcaatagaagtagtttatggcctcacattaaa

SEQ ID NO: 6273 - DNA, 1557 bp, Trigonella foenum-graecum
cggccgggcagaacaaaactcgtcttccataactgttactgcaaaaaacaataaatcaaataaattagtcagaaattcaaagctacgccactgattaaactatttaattaaccacggttggtcttcttcttcttcttcttatttaagtttcgatttcatcagcgcgttttagtataacgtggtacgcaatctatcctatccttcacacaaatggctgaagaaattagccaaaacgacgtcgcttcatcatcatcatcatcatcttccaaatctacaaaaagcttctggtctgcactccgttggattcccacttctaccgatcatatcatcgccgccgagaaacgccttctctccattatcaagactgggtatgttcaagagcgtgttaatataggttctggtcctcctgggtctaaagtaagatggttccgttcagcgagtgacgagccgcggtttctcaacactgttacatttgacagtaaacctgattctcctacccttgttatggttcatggatacgctgcttcccagggtttcttctttcgcaactttgatgctctcgcctctcgattcagaatcattgctgttgatcaacttggttggggtggatcaagcagacctgatttcacatgcaaaagtactgaagaaactgaggcatggttcattgattcttttgaggagtggagaaaagccaaaaatctgagcaatttcatactactgggacattcttttggtggttatgttgcttccaaatacgctctcaagcaccctgagcatgtacaacacttaattttggtgggacctgccgggtttacatcagaagaaacagatccaattgttcctaagcttagggcaacatggaagggagcagttctgaaccacctctgggaatctaattttacacctcaaaaaattgttagaggtttaggtccttggggtcctaacatggtccgcaaatatacaagtgctaggtttggtacacattcaaccgggcaaaaactgattgaagtggaatcaagtttgctaacagattatgtttatcatacattggcggccaaagctagtggggagctgtgtttaaaatatatttttgcatttggagcatttgctaggatgccccttcttcaaagtgctccagagtggaaggtacccaccacattcatatatggttacgaagattggatgaattatgaaggtgcccaagaagctcgcaagcatatgaaggttccatgtgaaattatcagggtccctaaggccgggcattttgtgttcattgacaacccaagtggcttccattcagctgtgtttcatgcttgtcgaaggtttcttaccccaaattcagacaatgaatctcttcctgaagggctatcctctgcttaggatataattttgcatcaatcctgtgtatattattattgaatgaagccgtgtattgtttctcagtaaagtggaatatatgtaattgtaatttcaataatattgatttgtttggggggggactaagtttttccatcatgagaaactttttttgaccaatagattaaagaggactatata

SEQ ID NO: 6274 - DNA, 1387 bp, Cucurbita pepo
tcgattgcggatttcgagctaaattgctaaaatggcggaagaaatcagtcgggccgacctcggaacttccacttctatcgcagacagcgcgaaatcgagatctttttggccctctagtctccgttggattcccacttctaccgatcatatcatcgccgccgagaagcggcttctctctcttgtcaagactccgtatgtccaagaacgagttaacattggttctggtccaccaggatcgaaagttagatggtttcgttctgcgagtaacgagcctaggtttatcaacaccgtgacattcgacagcaaagctgattctccgacacttgtaatgatccatggttatgctgcttctcaaggattcttcttccggaattttgatgctcttgccagtcgcttccggtcatcgccatcgatcaactagggtggggaggatctagcaggcctgattttacctgcaaaagcacagaggaaactgaagcatggtttatagactcttttgaggaatggcgaaaatcaaaaaccatcagcaatttatcttacttgggcactcatttggtggatacgttgcggctaaatatgctctcaagcatcctgagcacatcaaacacctgattttagtaggacctgctggattttcttcggagtcagatgctaagtctgatgagacgattacccggtttagagctacttggaaaggagcgattttgagtcatttgtgggagtcaaattttactccacagaagcttgtgagaggtttgggcccctggggtcctaatcttgttcacaaatatacaagtgctagattcgggacatactcaattggggacatattgaatgatgaagaatccagattgttatcagattatgtctaccacacgttagcagccaaggctagtggagaattgtgcttgaaatacatatttgcttttggtgcatttgctcggatgcctcttttacaaagtgcatcggaatggaaagttcctacaacatttatatacggttatgaagattggatgaaatatcaaggtgctcaagaagctcgcaagaatatgaagacaccgtgcgaaatattacgggtccctcaggctgggcactttgtgttcatagacaaccctaccagttttcactcgacagtgttctacgcatgccggagattcctctcccctgaccctgataaagactccttgcctgaaggtataatatctgcctgaactcttcaccatacattttgcacacaaaattcagttatgcatgtattgtttgtagttgtctatggtcatttacataatgggtatatatatcaaatgtaatattttctgttcacatccttatgtataccaagaatatttaatgtttggttcgtcgaaattttgtctattaaattttt

SEQ ID NO: 6275 - DNA, 1412 bp, Euphorbia peplus
atccaaaatgaccgaccatctcggatccaccgccgccgccgccgacacctccgccgccacatcaacctcaccaaattcaaaatcctcctgggccaaaaccagatctctctggccctccgttctccgatggatccctacctccaccgatcacatcatcgacgccgaaaaacgcctcctctccgccgtcaagacgccgtatgttcaggagcaggttaatatagggtcggggccgccggggtctaaagttaggtggttccgatcggagagcaatgagccccggtttctgaatacggtcacgtttgatagcaaagaggatgcgcctgtgcttgttatggttcatggatatgctgcttctcaggggtttttctttcggaatttcgatgttcttgctagccgctttaaggtcattgctgtcgatcagctcggctggggtggatcaagtaggccggattttacatgcaaaagcaccgaagagacagaggcatggttcatcgattcatttgaggagtggcgaaaagcaaaaaacctcactaacttcatattacttggccattcttttggaggatacgttgcatccaaatatgctcttaagcatccagagcacgttcagcatttgatattagtgggacctgctggtttctcatcagaatccgaggccaagtctgagtggcttactcggtttagagcttcgtggaaaggagcagttctgaatcatttatgggaatctaattttacacctcagaaggttattagaggctttggcccctggggtccaaatcttgtgcgcaggtatacaaatgctagatttggggtacattcgaatggagaggttttaactgaggaggagtccgcattgctaacagactatgtgtatcatactttagcagcgaaagctagtggagaactttgcttgaaatacatattctcttttggagcatttgctcgaatgcctcttctacaaagtgcatcagagtggaaagtcccaacaacattcatatatgggtatcaagattggatgaactatcaaggtgcccaagaagctcgcaaacaaatgaaggtcccgtgtgaaatcattagggttccccagggagggcattttgtgtttatagacaatccaaatttgtttcactcggctgtgttttatgcttgtcggaagttcatctcgtcggatccggataatcaatcccttcctggaggtttgacctctgtctagaaatatgtacgacttttgttactccagttctccattgatgtataattgtttcagtagaatgtaatcagaaatataggaacattactgtgaaaagagaacaatttttctcgtgtatatttgtattatattaaaccgctacccgaattaagaaatatgtgcacgtacagtttgcttagtgctacatttctacttgattgcc

SEQ ID NO: 6276 - DNA, 1670 bp, Panax ginseng
ggattgcgagatttatttattggactcctcctttgcttcttgccgctgtttattccattcgattccctttcccttctcttcttttctgaatcgcatgaaccttcgcctgaggccttgggattccaaattgaaatctaacttcaaattattggcgtcgatgacggaagaaattagctccgttcctcctcctgctgcggcaattgcaacaaaaacaggggaaaaaaaatcgtcgctttggccgtccgttctccgatggatccctacatccaccgaccacatcatcgccgccgagaagcgccttctttctcttgtcaagactccttatactcaggaaaaggttaatatagggtctggacccccgggatctaaagtcaggtggtttcgttcggtgagcgatgaaccaaggttcatcaacacggttacttttgacagcaaagaaggtaaccccactcttgtaatgattcatggatatggtgcttctcagggtttcttcttccgaaactttgattttcttgccaaccattttaaagtcatcgctattgatcagctcggttggggtggatcaagcaggcccgactttacttgcaaaagcactgaagaaactgaggcatggtttattgattccttcgaggaatggcgtaaatccaaaaaccttagcaactttattttactgggacattcatttggaggttatgttgctgctaaatatgctctcaagcatcctgagcacatacaacacttgattttagtggggtctgctgggttttcatcagagtcggatcataaatctgagtggctcatcaggttcagggcaacttggaagggggctattttgaatcatttatgggagtctaattttactcctcagaaggttgtcagaggttttggcccatggggtcctgatctggttcgtaagtatacaacagctagatttggtgcatattcaaccggggatgttttgactgaagaggagtccaaattattgacagattatgtgtaccatactctcgctgccaaagctagtggagagctgtgcttaaaatatatattctcctttggagcatttgcccggagtcctctcttacacagtgcctcggaatggaaagtgccaaccagctttatatatgggtttgatgattggatgaattaccaaggtgcacaagaagctcgcaaaaatatgaatgtcccgtgtgatatcattagagttcctcagggtggccattttgtatttgtggacaatccaagtggtttccactcggctgtcttgtatgcttgtcgcaggttcctctcatcagacccagataattaccccttcccagaaggtttgacatctgcatgaacgaaaagagcttctattgtactattatttaagtgtagaataatgggacatttatcttatattaggtagcagttaatttcaaattaatcgaacattcttcttctgtatcgaaggtattagtctatatatagtagcaatctgtgacccagatggttgggctccatattactatgtacagaaacctatatttattcatataaactccagagtaaaaatacgcaagtaaaagaaaagtgattataatgtgtgcataaacacttctcttttcacttcttctggtgcattgatttgctataaatcagctcggtaccgaactagcactgaagggagc

SEQ ID NO: 6277 - DNA, 1461 bp, Panax ginseng
cttctcttctcttctgaatcgcatgaaccttcgcctgaggccttgggattccaaattgaaatctaacttcaaattattggcgtcgatgacggaagaaattagctccgttcctcctcctgctgccgcaattgcaacaaaaacagggaaaaagaaatcgtcgctttggccgtccgttctccgatggatccctacttccaccgaccacatcatctccgccgagaagcgccttctttctcttgtcaagacaccatatactcaggaaaaggttaatatagggtctggacccccgggatctaaagtcaggtggtttcgttcggtgagcgatgaaccacggttcatcaacacggttacttttgacagcaaagaaggtaaccccactcttgtaatgattcatggatatggtgcttctcagggtttcttcttccgaaactttgattttcttgccaaccattttaaagtcatcgctattgatcagctcggttggggtggatcaagcaggcccgactttacttgcaaaagcactgaagaaactgaggcatggtttattgattccttcgaggaatggcgtaaatccaaaaaccttagtaactttattttactgggacattcatttggaggttatgttgctgctaaatatgctctcaagcatcctgagcacatacaacacttgattttagtggggtctgctgggttttcatcagagtcggatcataaatctgagtggctcaccaggttcagggcaacttggaagggggctattttgaatcatttatgggagtctaattttactcctcagaaggttgtcagaggttttggcccatggggtcctgatctggttcgtaagtatacaacagctagatttggtgcatattcaaccggggatgttttgactgaagaggagtccaaattattgacagattatgtgtaccatactctcgctgccaaagctagtggagagctgtgcttaaaatatatattctcctttggagcatttgcccggagtcctctcttacacagtgcctcggaatggaaagtgccaaccagctttatatatgggtttgatgattggatgaattaccaaggtgcacaagaagctcgcaaaaatatgaatgtcccgtgtgatatcattagagttcctcagggtggccattttgtatttgtggacaatccaagtggtttccactcggctgtcttgtatgcttgtcgcaggttcatctcatcagacccagataattaccccttcccagaaggtttgacatctgcatgaacggaaagagcttctattgtactactatttaagtgtagaataatgggacatttatcttatattaggtagcagttaatttcaaattaatcgaacattctttcttctgtatcgaaggtcttagtctatatatagtagcaatctgtgacccatatggttgggctccatattactatgtacagaaacctatatttatt

SEQ ID NO: 6278 - DNA, 1516 bp, Panax ginseng
ggattgcgagatttatttattggactcctcctttgcttcttgccgctgtttattccattcgattccctttcccttctcttcttttctgaatcgcatgaaccttcgcctgaggccttgggattccaaattgaaatctaacttcaaattattggcgtcgatgacggaagaaattagctccgttcctcctcctgctgcggcaattgcaacaaaaacaggggaaaaaaatcgtcgctttggccgtccgttctccgatggatccctacatccaccgaccacatcatcgccgccgagaagcgccttctttctcttgtcaagactccttatactcaggaaaaggttaatatagggtctggacccccgggatctaaagtcaggtggtttcgttcggtgagcgatgaaccaaggttcatcaacacggttacttttgacagcaaagaaggtaaccccactcttgtaatgattcatggatatggtgcttctcagggtttcttcttccgaaactttgattttcttgccaaccattttaaagtcatcgctattgatcagctcggttggggtggatcaagcaggcccgactttacttgcaaaagcactgaagaaactgaggcatggtttattgattccttcgaggaatggcgtaaatccaaaaaccttagcaactttattttactgggacattcatttggaggttatgttgctgctaaatatgctctcaagcatcctgagcacatacaacacttgattttagtggggtctgctgggttttcatcagagtcggatcataaatctgagtggctcatcaggttcagggcaacttggaagggggctattttgaatcatttatgggagtctaattttactcctcagaaggttgtcagaggttttggcccatggggtcctgatctggttcgtaagtatacaacagctagatttggtgcatattcaaccggggatgttttgactgaagaggagtccaaattattgacagattatgtgtaccatactctcgctgccaaagctagtggagagctgtgcttaaaatatatattctcctttggagcatttgcccggagtcctctcttacacagtgcctcggaatggaaagtgccaaccagctttatatagtgggtttgatgattggatgaattaccaaggtgcacaagaagctcgcaaaaatatgaatgtcccgtgtgatatcattagagttcctcagggtggccattttgtatttgtggacaatccaagtggtttccactcggctgtcttgtatgcttgtcgcaggttcatctcatcagacccagataattaccccttcccagaaggtttgacatctgcatgaacggaaagagcttctattgtactactatttaagtgtagaataatgggacatttatcttatattaatcgaacattctttcttctgtatcgaaggtcttagtctatatatagtagcaatctgtgacccatatggttgggctccatattactatgtacagaaacctatatttattcaaat

SEQ ID NO: 6279 - DNA, 1583 bp, Cucumis melo
atggttgaatcttcatttgttgatgaccataaatcgtttgcggatttcaagttcctttgcgaaaatggcggaagagatcagtaaggccggactcgggacttccacttctgcctctgagaccgccaaatccagatctctttggccctctcttctccgttggattcctacctccaccgatcatatcatcgccgccgaaaagcgactgctctctctcgtcaagactccatatgtccaagaacgggttaatattggttctggcccgccaggatccaaagttaggtggtttcgctcttcgagtgatgagcctaggtttatcaacaccgtgacattcgaaagcaaacctgagtctccgacccttgtaatgattcatggttatgctgcttctcaaggattcttcttccgcaattttgatgctcttgccagtcgcttccgggtcattgccgtcgatcaacttgggtggggaggatctagcaggcctgattttacgtgcaaaagtacagaagaaactgaagcatggtttatagattcatttgaagagtggcgaaaagcaaaaaacatcagtaattttattctacttggacactcatttggtggatacgttgcggctaaatatgctcttaagcatcctgagcacatcaaccacctaattttagtgggacctgctggattttcttcagagttagatgccaagtctgagtggattacaaagtttagagctacttggaaaggagcggttttgagtcatttgtgggagtcaaattttactccacagaagcttgttaggggtctgggcccttggggaccagatcttgttcgcagatatacaagctctaggtttgggacatactcaatcggggacatattgaatgatgaagaatccacattgttatcagattatgtatatcacacgttagcagccaaggcaagtggagaattgtgcttgaaatacatatttgcatttggtgcatttgctcggatgccacttctacagagtgcatctgaatggaaagttcctacaacatttatatacggttttcaagattggatgaactatcaaggcgcacaagaagctcgcaagagtatgaagacaccgtgcgaaatattacgggttcctcaggctggtcactttgtgttcatagacaaccctagtagttttcactcgaccgtcttctacgcgtgtcgcagattcctctcctccgaacccgataaagaatctttaccagaaggtataatatctgcctgattgtcttcaccaaacgttatggatacacaatcaaaagagagaccaatttatggtttctacatcaattttttaaaaattaatgtattatatttgtgaaagttatgtagcttttatagttgtagttgaacataccacttttcagtacggaaaaaatccaatgaatgcttacctctaaatgaaatgtggccccccaacttccaaatgttctcacagaagtgtttttgtttagttctgtaaaatactgtcgcatgattggattggctcaaaagctctaaaaaattagttgatttgatattaattctggagtttttgatgattgaccctaaaaagttgggttgtg

SEQ ID NO: 6280 - DNA, 1591 bp, Citrullus lanatus
atatatttttttttttttataattaatttgcttcctcgtcaagtcggcgaagtcaaatggcgggctggtggccgaagatggttcaatatttataagacccaaacttgaatcgctgaagaatggttgaatcttcattcgttgatgaccataaatcgtttgcggatttcaagttcctttgcgaaaatggcggaagagatcagtaaggccggactcggaactgccacttccgccgctgagaaggccaaatcaagatctctttggccctctgttctccgttggattcccacgtccaccgatcatatcatcgccgccgagaagcgacttctctctcttgtcaagactccctatgtccaagaacgggttaatattggttctggcccgccaggatcgaaagttaggtggtttcgttcttcaagtgatgagcctagatttatcaacaccgtgacattcgacagcaaacctgaatctccgactcttgtaatgattcatggttatgctgcttctcaaggattcttcttccggaattttgatgctcttgccagtcgcttccgggttattgccgtcgatcaacttgggtggggaggatctagcaggcccgattttacgtgcaaaagcacagaagaaactgaagcatggtttatagattcttttgaggagtggcgaaaagcaaaaaacatcagcaattttattttacttggacactcgtttggtggatacgttgcggctaaatatgctctcaagcatcctgagaacatcaaacacctaattttagtgggacctgctggattttcttcagagtcggatgccaagtctgagacgattacacggtttagagctacctggaaaggagcgattttgagtcatttgtgggagtcaaattttactccacagaagcttgttaggggtttgggcccttggggaccagatcttgttcgcaaatacacaagttctaggttcgggacatactcaattggggacgtattgaatgatgaagaatccagattgctatcagattatgtatatcacacgttagcagccaaggcgagtggagaattgtgcttgaaatacatatttgcatttggtgcatttgctcggatgccacttctacagagtgcatctgaatggaaagttcctacaacatttatatacggttttcaagattggatgaactaccaaggtgctcaagaagctcgcaagagtatgaagacgccttgcgaaatattacgggttcctcaggctggtcactttgtgttcatagacaaccctagtagttttcactcgaccgtcttctacgcgtgccgaagattcctctcttccgaacctgataaagaatctttaccagaaggtataatatctgcctgatgtcttcaccgaacattatggatagaaattcataagagagaaccaatttatggaataaattggtttctacatcaatttttttaattaatggttcatatttatgaaggttatgtagttttgttcttgttgtagttgaatatacgactttgcagtacaggaatttgaatgttctaaaaaaaattccgatgaatgtttccctctcattgaaatgtggccacccaactcccaa

SEQ ID NO: 6281 - DNA, 1175 bp, Phaseolus vulgaris
gtcttaggttcccttacgttttcgccagcaaatatcgcagtccttcaaattcgtcgcgaaatctgaacccttttaccgtctctgcgaaattgctcccaaacatttgactcaaatttcgtttactggtcaaaagggaaaagcaaggagccaaaatccatggaaacgcagtatgaggaactcgcgacagaagactctattctcgacagttcctcagaagatgttgaggaggaggagatagagaaggagttagctgatgtaacgtttgaggagctgcagaaagcacgatcgaatggggcacatgcttttttccagaaacccaaagaagacaaaaagttaaaaagggctaacaagaataggcctatggaggccagtagcaagaagccagtttctgcttttagagaggccatccaagctccaaagaaggttgtacgtgatccacgatttgaatctctttgtggtacacttgaccctgaagggtttaggaagaggtataatttcttatatgaaaacgatcttcctgctgaaagacaggctctgaagaaggaattgaaaaagtataaagatccgaagcgcataagtgaaatagaagaacatatatcatggattgataaacaaatgaaatctgattcaaggaagaatattgatacgcaaatattggctaggcataaaaagaaagagagagaagcagcaaaggaggggaaacgtcctttttatataaaaaaatctgaaatacggaagcaaagactgtttgagaaatataataatctcaagtcatctggcaaacttgaagcatttgttgagaaacggaggagaaggaatgctgccaaggaccacagatacatgccgtatcgtagatctggtgatgtggaataaattttgtacctttaagactctttcttaagctataaatataatggaatgtagcaccaaaaagaaaaataatgtatgtttttggctgccagttttggggatgaaatattgacgtttgttgatgatatttgttgtgtgactcttgaagatttactaattagggattgaattgctggcactaggctacaaggaagtcttttgattctgtgttatgtactcatggaaggaatgtcttttccgttatcattaagtctaagtcgtttgttttaggaaccgtttgtttaagattttgactcaaaagaaaa

SEQ ID NO: 6282 - DNA, 1269 bp, Phaseolus vulgaris
gcaagaaggaggtgcaggtaggaagactggggtgcagaagtaattgtcttcactttttcatcgtcacaaaccaaccgttgtcgtttgatctgatgtcttaggttcccttacgttttcgccagcaaatatcgcagtccttcaaattcgtcgcgaaatctgaacccttttaccgtctctgcgaaattgctcccaaacatttgactcaaatttcgtttactggtcaaaagggaaaagcaaggagccaaaatccatggaaacgcagtatgaggaactcgcgacagaagactctattctcgacagttcctcagaagatgttgaggaggaggagatagagaaggagttagctgatgtaacgtttgaggagctgcagaaagcacgatcgaatggggcacatgcttttttccagaaacccaaagaagacaaaaagttaaaaagggctaacaagaataggcctatggaggccagtagcaagaagccagtttctgcttttagagaggccatccaagctccaaagaaggttgtacgtgatccacgatttgaatctctttgtggtacacttgaccctgaagggtttaggaagaggtataatttcttatatgaaaacgatcttcctgctgaaagacaggctctgaagaaggaattgaaaaagtataaagatccgaagcgcataagtgaaatagaagaacatatatcatggattgataaacaaatgaaatctgattcaaggaagaatattgatacgcaaatattggctaggcataaaaagaaagagagagaagcagcaaaggaggggaaacgtcctttttatataaaaaaatctgaaatacggaagcaaagactgtttgagaaatataataatctcaagtcatctggcaaacttgaagcatttgttgagaaacggaggagaaggaatgctgccaaggaccacagatacatgccgtatcgtagatctggtgatgtggaataaattttgtacctttaagactctttcttaagctataaatataatggaatgtagcaccaaaaagaaaaataatgtatgtttttggctgccagttttggggatgaaatattgacgtttgttgatgatatttgttgtgtgactcttgaagatttactaattagggattgaattgctggcactaggctacaaggaagtcttttgattctgtgttatgtactcatggaaggaatgtcttttccgttatcattaagtctaagtcgtttgttttaggaaccgtttgtttaagattttgactcaaaagaaaa

SEQ ID NO: 6283 - DNA, 1119 bp, Vigna unguiculata
gtcaaattcagattttcatttctgagaaaaatcttaaacaaacggtgcctaaaacaagtgacctaatgataatggaaaaggcatccctcccacaagtacataacacagaatcaaaaagactgcctagtagcctagtgtcaccaatccattccctaataattaataaatgccatcaacaaacgacaatattcaatccccaaagctgggcagccaaaacacatagatacttttctttttggtgctatattccagtatataattatagcttaagaaagaatgttaaagctacaaaatttattccgcatcaccagatctacgatacggcatgtatctgtggtccttggcagcattccttctcctccttttctccacaaatgcttcaagtttgccagatgacttgagctgattatatttctcaatcagcctttgtttccgtatttcagatttcttcagataaaagggacgtttcccctgctttgttgcttctctctctttctttttatgattggccaatatttctgtatcaatattcttcgttgaatcagacttcatttgtttatcaatccatgatatacgttcttctatttcacttatgcgcttcggatctttatactttttcaattgcttcttcagaccctgtctttcagcagggagatcgttttcatataagaaattatacctcttcttaaacccatcagggtcaagtgtaccacagagagattcaaatcgtggatcacgtacaaccttctttggagcttggatgacctctctaaaagcagaaactggcttcttgctactggcctccatcggcctattcttgttggccctttttaactttttgtcatctttgggtttctgaaaaaaagcatgtgccccgttcgagcgtgctttctgcaattcctcaaacgttacatctgctaactccttctctatctcctcctcctcatcttctgaggaactgtcggtaatagagtcttctctctcgagtttttcatactgcgtttccatggattctgggactgtggctccttgcttttccctgaatcaagtattttagggccaatgtcgaacaagacggttaacgggttcagagaagaaaataaaaagactggtatttgg

SEQ ID NO: 6284 - DNA, 1138 bp, Glycine max
tcataaccgtgttagggttctttcaatattctctgattgcgtcaaatcacaaacaacccaccaattataagttgccgtttcccttctcacttgctcgcggaattggaggaacccttcgcttcctgtctcgcggcattgaaccctgaacacatgactcagaagcaaagagacagagtcccagattccatggaaacccagtacgaggagagtgagaaagacgagtcttcttctgcttatagttcctcagaagatgaagaggaggaagagatagagaaggagctggctgatgtaacatttgaggagttgcagaaagctcgctcgaatgggacacatgcatttttccagaaacccaaagaagacaaaaaattaaaaagggccaacaagaataggccaatggaggctagtagcaagaagccagtttctgggtttagagaggtcatccaagctccaaagaaggttgtacgtgatccacgatttgaatctctttgcggtaaacttgaccctgaagggtttaggaagagatataatttcttgtatgaaaatgatcttcctgctgaaagacaggctcttaaaaaggaattgaaaaaatataaagacccgaagcgcataaatgaaatagaagaacgtgtatcatggattgataaacaattgaagtctgattcagcgaagcatattgatgcagaaatattggccaagcacaaaaagaaagagagagaagcaacaaagcagggaaaacgtcccttttatctcaagaaatctgaaatacggaagcaaaggcttattgaaaaatataaccatctaaagtcatctggcaaacttgaagcatttgttgagaaaaggaggaggaggaatgctgcaaaggaccatagatacatgccatatcgtagatctggtgatgtggaataggttttgtagctttaagattctttcgtaggctacaattatactggaacataacaccaaaaagaaaaatagtttatgcatttggtctgccatctttggggattaaatgttgaaccctttttgatgactatcatggtatttgttctgtgactgacttgtatttatctaattcttgaatatttactaattggggtatggagaggtgccactaggctataaggcaatcttttgattc

SEQ ID NO: 6285 - DNA, 1274 bp, Glycine max
cccacctcgacctacgatgggtgacctacagtgggtcgggctgacctaggggcctaaacccatattgaggcttgcaaccttctaaattccctcctcacacccttctaagtttcataaccgtgttagggttctttcaatattctctgattgcgtcaaatcacaaacaacccaccaattataagttgccgtttcccttctcacttgctcgcggaattggaggaacccttcgcttcctgtctcgcggcattgaaccctgaacacatgactcagaagcaaagagacagagtcccagattccatggaaacccagtacgaggagagtgagaaagacgagtcttcttctgcttatagttcctcagaagatgaagaggaggaagagatagagaaggagctggctgatgtaacatttgaggagttgcagaaagctcgctcgaatgggacacatgcatttttccagaaacccaaagaagacaaaaaattaaaaagggccaacaagaataggccaatggaggctagtagcaagaagccagtttctgggtttagagaggtcatccaagctccaaagaaggttgtacgtgatccacgatttgaatctctttgcggtaaacttgaccctgaagggtttaggaagagatataatttcttgtatgaaaatgatcttcctgctgaaagacaggctcttaaaaaggaattgaaaaaatataaagacccgaagcgcataaatgaaatagaagaacgtgtatcatggattgataaacaattgaagtctgattcagcgaagcatattgatgcagaaatattggccaagcacaaaaagaaagagagagaagcaacaaagcagggaaaacgtcccttttatctcaagaaatctgaaatacggaagcaaaggcttattgaaaaatataaccatctaaagtcatctggcaaacttgaagcatttgttgagaaaaggaggaggaggaatgctgcaaaggaccatagatacatgccatatcgtagatctggtgatgtggaataggttttgtagctttaagattctttcgtaggctacaattatactggaacataacaccaaaaagaaaaatagtttatgcatttggtctgccatctttggggattaaatgttgaaccctttttgatgactatcatggtatttgttctgtgactgacttgtatttatctaattcttgaatatttactaattggggtatggagaggtgccactaggctataaggcaatcttttgattctgttttgttcttgtgagagaagtgt

SEQ ID NO: 6286 - DNA, 1434 bp, Glycine max
gctattttgattggtagattggcgtatttttattatgattgataaatgataactaattgtgatttgtaattggttttagccttaactgattggcagattactattattaagtattaagaaattgtatctgtttgattcttaaatataacggataggatattttaataattgtatatagaattgtctaaaaccttctcagttccctcttcacaaaccctcggatcacagtgttagggttcttcaattttctccgattgccatcaaacatcacacaccacccaccaactatacgtcagcattgaaccctaaaatacatgactcagaagcagagaaccagaatcccagattccatggaaacccagtacgaggagagtgagaaagacgagtcttcctcttcttatagttcctcagaagacgaggaggaagagatagagaaggagctggctgatgtaacgtttgaggagttgcagaaagcacgctcgaatggggcacatgcatttttccagaaacccaaagaagacataaaattaaaaagggctaacaagaataggccaatggaagctagtagcaagaagccagttactgggtttagagaggtcatccaagctccaaagaaggttgtacgtgatccacgatttgaatctctttgtggtaaacttgaccctgatgggtttaggaagagatataatttcttatacgaaaatgatcttcctgctgaaagacaggctcttaagaaggaattgaaaaaatataaagacccgaagcgtgtaaatgaaatagaagaacgtatatcatggattgataaacaagtgaagtctgattcagcgaagcatattgatgcagaaatattggctaagcacaaaaagaaagagagagaagcagcaaagcagggaaaacgtcctttttatctcaagaaatctgaaatacggaagcaaaggcttattgaaaaatataaccatctcaagtcatctggcaaactggaagcatttgttgagaaaaggaggaggaggaatgctgcaaaggaccatagatacatgccatatcgtagatctggtgatgtggaataggttttgtagctttaagattcttttgtaggctaaaattatactggaatatagcaccaaaaagaaaagtagtgtatttattcggtctgccatctttggggattaaatatgaactcttgttgatgactatcatggtatttgttctgtgactggtatttatctattcttgaagatttactaattggggaatggagaggcgcctctaggctataaggcaatcttttgattctctgctatgttcttgtgggagaacttcctttcgccattatcgttaggtcccttgttttagaacccatgtgtaatctgttcaagctttttcttagaaaaaaaattcattgataaacaatcagaatctgaaaaagaatgagat

SEQ ID NO: 6287 - DNA, 1434 bp, Glycine max
gctattttgattggtagattggcgtatttttattatgattgataaatgataactaattgtgatttgtaattggttttagccttaactgattggcagattactattattaagtattaagaaattgtatctgtttgattcttaaatataacggataggatattttaataattgtatatagaattgtctaaaaccttctcagttccctcttcacaaaccctcggatcacagtgttagggttcttcaattttctccgattgccatcaaacatcacacaccacccaccaactatacgtcagcattgaaccctaaaatacatgactcagaagcagagaaccagaatcccagattccatggaaacccagtacgaggagagtgagaaagacgagtcttcctcttcttatagttcctcagaagatgaggaggaagagatagagaaggagctggctgatgtaacgtttgaggagttgcagaaagcacgctcgaatggggcacatgcatttttccagaaacccaaagaagacataaaattaaaaagggctaacaagaataggccaatggaagctagtagcaagaagccggttactgggtttagagaggtcatccaagctccaaagaaggttgtacgtgatccacgatttgaatctctttgtggtaaacttgaccctgatgggtttaggaagagatataatttcttatacgaaaatgatcttcctgctgaaagacaggctcttaagaaggaattgaaaaaatataaagacccgaagcgcgtaaatgaaatagaagaacgtatatcatggattgataaacaagtgaagtctgattcagcgaagcatattgatgcagaaatattggctaagcacaaaaagaaagagagagaagcagcaaagcagggaaaacgtcctttttatctcaagaaatctgaaatacggaagcaaaggcttattgaaaaatataaccatctcaagtcatctggcaaactggaagcatttgttgagaaaaggaggaggaggaatgctgcaaaggaccatagatacatgccatatcgtagatctggtgatgtggaataggttttgtagctttaagattcttttgtaggctaaaattatactggaatatagcaccaaaaagaaaagtagtgtatttattcggtctgccatctttggggattaaatatgaactcttgttgatgactatcatggtatttgttctgtgactggtatttatctattcttgaagatttactaattggggaatggagaggcgcctctaggctataaggcaatcttttgattctctgctatgttcttgtgggagaacttcctttcgccattatcgttaggtcccttgttttagaacccatgtgtaatctgttcaagctttttcttagaaaaaaaattcattgataaacaatcagaatctgaaaaagaatgagat

SEQ ID NO: 6288 - DNA, 1183 bp, Lupinus angustifolius
gttgaaaccgggtcaacccggaaaactcttcaatcgcagtgaacgcacaaaaatcggcattgtgttttggttttgcacagtcgcaattccatatcaattattctcacaattcgcataaaattatctccaatttcttatcactacttccttcagtaacttgtgcaatcgaagtttttcaaaatgaagaaatacttcaacagcggaatcgaaggttccagcgaaacccagtacgaggatagtgagattgaagattcttcttcttcttcttctagttcctcagaagatgaggaggaggagatagggaaggagctggcggatgtaacctttgaagagttgcagaaagcacgctcaaatggtgcacatgcattttttcagaaacccaaagaagaccaaaagttgaaaagggccaacaagaacaggcctatggaggctagcagcaagaagccagttgctgcctttagagaggtcatacaagctcccaagaaggttgtacgtgatccacgatttgaatctctttgtggcacacttgatactgatgggtttaggaagagatataattttttatttgaaagtgatcttcctgctgaaaaagaggctctcaagaaggatttgagaaaatataaagatccagagcgcatccatgaaatagaagaacgtttatcatggattgataagcagttgaagtctggttcctcaaagcatattgatgctaagatattggctaatcacaagaagaaagagagagaagcagcaaagcaaggaaaacgtcccttttatattaaaaaatctgaaatccggaagcaaaggcttgttgaaaaatataatcatctcaagtcatctggcaaacttgaatcatttgttgagaaaaggaggaagaggaatgctgcaaaggaccatagatacatgccatatcgtagatctggtgacaacatggaataaggttgttatatttaaggttcttttctatgctaatagcactggtagatagggaccaaaaaagaacatacgaaactgatgtatgtaccttttgtctaccatatgtaccgtttttgaatatcaaaatgatagtccttagttagaaaaaagaaaaagtaccgaactgtcgactctagtccgttagattacgtggcccgctccggtctggagacctggacccaaggccaaccgagacggggtatacggg

SEQ ID NO: 6289 - DNA, 1261 bp, Trigonella foenum-graecum
ccccgctgccgtccgacgagccatcgaaaccagcaaggagcgttgttttcttatttcaaaatcgatttgattcatttctcaatatgaacaagcacggtagaaaaatcccaaattccactgatgaaacccagtacgaggatagtgagactgacgagtcactctcttcttctagctctccgaagatgaggaagaagatgagatagagaaagagctagctgatgtaacgtttgaggagttgcagaaagctagatcaaatggggcacatgtgtttttcaagaaacctggtgaagataagaagttaaaaagggccaacaagaataggccaatggaagctagtagcaagaagccagttcctgcttttagagatgtcatccaagctcctaagaaggttgtacgtgatccacgatttgaatctctgtgtggtacacttgacactgacaggtttagaaagagatataattttttatatgaaaatgatcttcctgctgaaagacaggctcttaaaaaggacttgaaaaaatataaagatccagagcatagaagtgaaatagaagaacgcatatcatgggttgataaaatgttgaaatctgattcaacaaagaatattgagacagagattttagctaagcacaagaagaaagagagagaagcagcaaagcagggaaaacgtcctttctatctcaagaaatccgaaatccggaagcaaaggcttgttgaaaaatataacaatctcaagtcgtctggaaatcttgaatcatatattgagaaaaagaggaagaggaatgctgcaaaggaccatagattcatgccatatcggagatctggtgacaacgtggagtgaggctgttgcgcccaaaaatattgttatatttgtatcctgtctttgggttttgatgatgatgccttgttgaactctccaaataatggcttttgtggtaagtgtgtagtgttgtatattctgcaaaatttaccaacaaccacttttttggggctaaggtaggataacttggaaatggagaggttacaccaggctacaaagcaatctgctaattctgtattctgtggcaaaggtctttgcaattatcacaggtcccttgtttttgtgattctaacattatggatatattttaatttcagagtatatttagaagaattatgaattatcacaggtctttgtcattcacatattaggatttttaatgatggagattatctttatgtaatttgtgacatgttaaatatgtttagtcttcttttcttc

SEQ ID NO: 6290 - DNA, 1293 bp, Medicago truncatula
taacaccccccactccactgaaatctttggccgcggcaccaagtgagcaccgcctctaactatcaaatttatttgtttttcaattcatttctcaaaatgaacaagcacggtagcagaatcccaaattccaataatgaaacccactacgaggagaatgaaaccgaagactcactttcttcttcttcctcatcagaagatgaggaagaagaagagatagagaaagagctagctgatgtaacatttgaggaactgcagaaagcacgatcgaatggggcgcatgcatttttcaagaaacctgcagaagataagaagttgaaaagggctaataagaataggccaatggaagctagtagcaagaagccggttcctgcttttagagatgtcattcaagctcctaagaaggttgtacgtgatccacgatttgagtctctttgcggtacatttgacaatgatgggtttagaaagagatataattttttatatgaaaatgatcttcctgctgaaagacaggctcttaaaaggcaattgagaaaatataaagatccagagcgtagaagtgaaatagaagagcgcatagcatgggttgataaacagttgaaatctgattcaacaaagaatattgagacacagattttggctaagcacaagaagaaagagagagaagcagcaaagcagggaaaacgtcccttttatctcaagaaatccgaaatccggaagcaaaggcttgttgataaatataaccatctcaagtcgtctggaaatcttgaatcatatattgagaaaaagaggaagagaaatgctgcaaaggaccatagattcatgccatatcgtagatctggtgaaaacgtggagtaaggctgttgttaaccttgtaatggaatatagtacccagaaatattgtcatataccatatttggggtttgatgatgatgccttgttgaacattccccaaatcatggcttttatggtatgtgtgtagcgttatatactctgcaagatttaccaacaaccactttttttggggctatgttaggagatttttatgggactaaggttacctcaggctacaaagcaatctgctgattctttgtattctgtggcgaagttctttgcaattatcataggtcccttgtttttgcgattctaacattacggatatgttttaatttcataaaggagtatttttagaattatgaattatcataggtttttgtcgttcacatattaggaattttgatgatggagattatctttatgtaatttatgacatgttaaatatgttttgttcttgat

SEQ ID NO: 6291 - DNA, 1421 bp, Medicago truncatula
ctagtctacaaatcctagctcaaattatttgtttgtcaaaacttaccctaacaccccccactccactgaaatctttggccgcggcaccaagtgagcaccgcctctaactatcaaatttatttgtttttcaattcatttctcaaaatgaacaagcacggtagcagaatcccaaattccaataatgaaacccactacgaggagaatgaaaccgaagactcactttcttcttcttcctcatcagaagatgaggaagaagaagagatagagaaagagctagctgatgtaacatttgaggaactgcagaaagcacgatcgaatggggcgcatgcatttttcaagaaacctgcagaagataagaagttgaaaagggctaataagaataggccaatggaagctagtagcaagaagccggttcctgcttttagagatgtcattcaagctcctaagaaggttgtacgtgatccacgatttgagtctctttgcggtacatttgacaatgatgggtttagaaagagatataattttttatatgaaaatgatcttcctgctgaaagacaggctcttaaaaggcaattgagaaaatataaagatccagagcgtagaagtgaaatagaagagcgcatagcatgggttgataaacagttgaaatctgattcaacaaagaatattgagacacagattttggctaagcacaagaagaaagagagagaagcagcaaagcagggaaaacgtcccttttatctcaagaaatccgaaatccggaagcaaaggcttgttgataaatataaccatctcaagtcgtctggaaatcttgaatcatatattgagaaaaagaggaagagaaatgctgcaaaggaccatagattcatgccatatcgtagatctggtgaaaacgtggagtaaggctgttgttaaccttgtaatggaatatagtacccagaaatattgtcatataccatatttggggtttgatgatgatgccttgttgaacattccccaaatcatggcttttatggtatgtgtgtagcgttatatactctgcaagatttaccaacaaccactttttttggggctatgttaggagatttttatgggactaaggttacctcaggctacaaagcaatctgctgattctttgtattctgtggcgaagttctttgcaattatcataggtcccttgtttttgcgattctaacattacggatatgttttaatttcataaaggagtatttttagaattatgaattatcataggtttttgtcgttcacatattaggaattttgatgatggagattatctttatgtaatttatgacatgttaaatatgttttgttcttgatcctttgaaacaatgtaatgttcctttttagtctctaaaagtagttcttatgtcccatgattttcaaaatgtgtactcgat

SEQ ID NO: 6292 - DNA, 1496 bp, Cicer arietinum
caagtattgggctgggcacccgtttttgaaccaaacccaattaattagcctcaccactaaatctgaaagcagcgcttcaccgaaaccttttttattttcattctaattcttgtcactggaatgggcgacgaagattagaatcgaataaataaaatttctgtgataaatcctcttctttttttttttcttccgaaatagacgatagttagattgaaagaaaaaaggggaaagaatcaaggtcttcagtgaacacggaagcaaaatgaagaagcacgaaactcgaatgccaagttccactgaaacccagtacgaagagagtgagactgatgagtcactgtcttcttcaagtttatcggaagacgaggatgaagaagagataaagaaggagctggcagatgtaacatttgaggagttgcagaaagctcgatcagatggggcacatgcgtttattaagaaacgaggagaagacaacaagttaaaaagggccaataagaataggccaatggaggctagtagcaagaagccagttcctgcttttagagatgtcatccaagctcctaagaaggttgtacgtgatccacgttttgagtctctttgtggtacacttaacaatgatgggtttaaaaagagatacaattttttatatgaaaatgatcttcctgctgaaagacaggctcttaaaaaggaattgaaaaaatgtaaagattccgagcgcataagtgaaatagaaggacacatatcatggattgataaacaattgaaatctgattcaacaaagaatattgagacacagattttggctaagcacaagaagaaagagagggaagcagcaaagcagggaaaacgtcccttttatctcaagaaatccgaaatccgaaagcaaaggcttattgaaaattataatcacctcaagtcgtctggaaaacttgaatcgtatattgagaaaaagaggaagaagaatgctgcaaaggaccatagatttatgccataccgtagacctggtgacaatctggaataaggttgttatccttgtactggaattttgctgccgaaaaaaaatgttttatacattttgtctaacatctttgggttttggagacaatctcttgtagaacatcccacagattctggcttttgtggtaagtttgtagtcttgtatattctgtaagatttaccaacaaccaattattttggggctaagaatggggacctttatgaggtatcccttggttacaaagcaatcggctgatatagaaattaactgaaacaatgtacttttgactttctactttgttaatggtatgattttgactccatagttttaatcgggtgaatttgttcccatagttttcccatttctgatttcatagcagtgcattcagattttcatcaaacattgactaaagtggtgctgacattgatataataatagaatgcatgatgttgcaacagatataaaatcaacctattaaataaacacagatgtagtatttagc

SEQ ID NO: 6293 - DNA, 1046 bp, Lupinus angustifolius
aaatgacgaaatacaacaaaagtggaatcgcaggttccagcgaaccccagtacgagcagagtgagatggacagctcttcttctagttcctcagaagatgaggaagaggagatagagaaagagctagctgatgtaacctttgaggagttgcagaaagcacgctcaaatggggcacatgcattttccaagaaacctagagaagaccaaaagttgaaaagggccaacaagaataggccaatggaggctagcagcaagaagccagtacctgcctttagagaggtcgtacaagctcctaagaaggttgtacgtgacccacgcttcgaatctctttgtggtacacttgacactgatgggtttaggaagagatataattttttattgaaagtgatcttcctgctgaaaaagagactcttaagaaggaattgagaagatataaagatccagagcgcgtccatgaaatagaagaacgtttatcatggattgataaacaactaaaatctggctcagcaaagcatattgatgctaagatattggctgatcataagaagaaagagagagaagcagcaaagcagggaaaacgtcctttttatattaaaaaatctgaaatcaggaagcaaaggcttattgaaaaatataagcatctcaagtcatctggtaaacttgaatcatttgttgagaaaaagaggaggaggaatgctgcaaaggaccatagatacatgccatatcgtagatctgatgacaacattgaataaggtttttagctttatggttcttttgtatgcttataatagagggagattgcatcaaagaaaaggaacagaaaaaactggtatatgcatttgtcttccatataatcccttttcgaaaaccttaagtgtttgttttgtttggaagttagattttgaagagaaagggagagataatgaaagtttcagaaccatgaaatacatacacttttgggatgattatgaagtcttatctttaaggtttcaaaaacctatagaaatacatttgtagggatgacttagtagaaaaaaagaaaaagta

SEQ ID NO: 6294 - DNA, 1463 bp, Lupinus angustifolius
cttcaggccatagttgtaagcccatatcaagtctagaagtttttgaccactgcccatgctaacaactaccttgccctcttcttggtccatcctgtttgggtttgcacagttgcagtcctctttcaactttctcatttcttctctcaattcacacaaaataatcttcaaatgaagaaagacaacaaaagtggaattgcaggttccagtgaaccccagtacaagctgagtgagatggacgagtcttcttctagttcctcagaagatgaggaagaggagatagagaaggagctagctgatgtaacctttgaagagttgcagaaagcacgctcaaatggggcacatgcattttccaagaaacctagagaagaccaaaagttgaaaagggccaacaagaataggccaatggaggctagtagcaagaaaccagtaccttcctttagagaggtcgtacatgctcctaagaaggttgtacgtgatccgcgtttcgaatctctttgtggtacacttgacactgatgggtttaggaagagatataattttttattcgaaagtgatcttcctgctgaaaaagaggctcttaagaaggaattgagaagatataaagatccagagcgcatccatgaaatagaagaacgtttatcatggattgataaacagctgaaatctggttcagcaaagcatattgatgctaagatattggctaatcataagaagaaagagagagaagcagcaaagcagggaaaacgtcctttttatataaaaaaatctgaaatccggaagcaaaggcttattgaaaaatataagcatctcaagtcatctggtaaacttgaatcatttgttgagaaaaagaggagaaggaatgctgcaaaggaccatagatacatgccatatcgtagatctggtgacaacatggaataaggtttgttagcttttccttttgtatgctaataatagaggtagattgcatcaaagaaaaagaacacaaaaaagctagtatatgcatctttgtctaccatatattccttttcgaataccctaatgttcgtttgcaagttagattttgaagggaaagaaagagaaaaagaaggtttcagaactatgaaatacacttctaagatgattctgaaacgttctcttcccatttcctcccttcaaaactcatcttacaaacagaccctagataataggcccgacaagattatatgcaacattttattcccatattgataagataatacgtaactttgtctattttgggagatttgataagtacttgcatggaaatggctaacgtcccaatatttggagttaagaacaggtcctccaacatttcagtgaaacaaagataatattaacaggtcaatattgtgattaagcaaaataaatacaaatttatgctcttttttcaattcagtcataggaatacccagaaaacaagttcaaagcaaatcgccaataatcgg

SEQ ID NO: 6295 - DNA, 2997 bp, Cajanus cajan
gaaataagaattttctggaaaagaaatcaatcccccccaaaagaaatgccaaagtgtgggagaaagggaattaaaagataagtgtcaaacctcagttgtatactcaaatatcaaattttgctttttacctctttatggcctaaaatctccctcagtaagaccaaaaggaataaaaaaaaaagtgtgagagagagaaggggaaaaaaagataagattagttagtaagcatatcttggtgttgttgttgaggctgagtggtcaaaggaaaggaaggatagagatctggtatatggttaacagagaggttgtgtgtgtgtgtgtgaatagagtacttttgtggagatgtcaggtggtggatgcagcatagtgtggttcaggagagatctgagggtggaggataaccctgcactggctgcaggagtgagagcaggtgcagtggttgctgttttcatatgggctcctgaagaagagggtcaatactaccctggtagggtctctaggtggtggctcaaacaaagcttggctcaccttgattcctctttgagaagccttggcactcctcttatcaccaaacgttccactaatagtgtttcttctttgttggaggttattaagtccactggggctactcaactctttttcaaccatttatatgatccgttgtcacttgtgagggatcacagagcaaaggaggttctgactgctcaaggaattgtcgtacgttccttcaactcggacttattgtatgaaccatgggatgtgaatgacgctcatggccaaccattcacaactttttctgctttttgggaaagatgccttagcatgccttatgacccacaagcacctcttctcccacctaaaagaattattccaggtgatgtgtcaaggtgccctggtgacacattggtgtttgaagacgaattagagaaagcaagcaatgcgcttcttgcgcgagcatggtcaccggggtggagcaatgctgacaaggcattaacaacattcataaatggtcctctgatcgagtactcaaagaatcgcaggaaggctgacagtgccacaacctcatttctctcgccacatttgcactttggtgaggtgagtgtgaagaaagtgttccacctcgtccgcatcaagcaagtgttttgggccaacgaaggaaacaaggctggtgaagagagtgtgaacttgtttctcaagtccattggtcttagagagtattcaaggtacattagtttcaaccacccttatagtcacgaaaggcctcttctaggacaccttaagtttttcccttgggtggtgaatgaagggtactttaaggcttggagacaaggcagaacagggtaccctttggtggatgctggaatgagagagttgtgggcaactggttggttgcatgatcggatacgtgttgtggtttctagtttctttgtgaaggttctgcagcttccttggagatgggggatgaagtatttttgggatacccttttggatgcagatcttgagagtgatgctcttggttggcaatacatatctggtactcttcctgatggtcgcgaatttgaccgaatagataatccacagttcgagggttacaaatgtgacccaaatggagaatatgtaagacgctggcttcctgaacttgctagattaccaactcaatggatacaccatccatggaatgcgcctgagtcagtactccaagctgctggaattgaacttggatcaaactaccctcttcccattgtgggaatagatgcagcaaaagtaagactgcaagaagcacttatacaaatgtggcaacaagaagcagcttctagagctgcaatggaaaatggaactgaggaagggcttggagactcatctgaatcagcccctattgcttttcctcaagacattcaaatggaggaaagacttgaacctgttaggaacaacccacctcacggcacacggcgctatgaggatcagatggtgccaagtatcacttcttcacatgtgcgagtggaagaggaagaaacatcttcagaccttcgaaactcggctgcagacagcagagctgaagtgcctataaatgtgaacacacaaccggatgcaagagggacagtgaatcaaggagcgttgcagaatgtaaatagaaacacaagagtacagaataatgctaatgctacaatgtggttgagaaatgcggctgaagattccacagcagagtcttcaagtagtactaggagagaaagggatgggggtgaagttccagtgtggtctcccccagcttctaacttctcagaacagtttgtagatgatgaaaatggtataggagccagttcatcttacttgcagaggcagcatcctcagtctcatcaattgatgaactggacacggctacctcagactgggtaattcacatctagaacatgctgtttagtatccgggagatggaaaatgcactacccccttcatttgggaaacgtgggatggcgaacctcgctatggacatacatgtgatcatttcatacatcctttccgacatccttaaacctgtcttgacacatgattaacggctgacctccaatccaatgtgcatgaaaatttcagtccatacgggtagtttcatctgcagtgccttttgctctcttgtacaaaatttgtaggcctactgtatagtataatttgtgttgtggaggagaaagagccactattggatttggacctttggtccagggttatgcttatcatttaaggtagttatttacatgttctgtcccataatcatgtacatttattttgactgctgtaaagtgcactcatcaaggtgctcacatctccaaaacttctctatatggcaaactaaaagacagtgccaagacactttttgattttatttttccctgtctctgtaatgcttattcctgaaattcccgttggttgagtggagatatgcaaataattgcatcaatttagtaactcaacagttttgctttagccataaatacattttagaaa

SEQ ID NO: 6296 - DNA, 3178 bp, Glycine max
gtggctgcggttcgcctatcaattcattgtgtatccccactcagttggccaatcctcttcacttgttctctctctctctctctctcctcagtatctcttctctctggttgcaacttggtgtgggtgtgtgaaagcaccaaaaatacgaattttctgcaaaagaaatcaatccttctctcccaaaagaaatgctatagtgtgggagaaaagggtattaaaaaagataagtgccaaacctcaaagttgtgcgttttacctccctcagttaaagagaaaacaaagaccaaaaggaataaaaaaaaaaaaaaggtatagagagaaggtattaaggtaagagttaagaccagttagcatttcttagtgttgttgtttgttcttgaggctcagtggtcaaagggaaaggaaagaaggaaggacggaaagagatctatctatctggtatatggttaacaaagaggttgtatgtgtatgcgtgaataataataacaacaataacaataatagactagctcttgaggttgtggtgttggtgaaattttttttgtggagagatgtccggtggtggatgcagcatagtgtggttcaggagagatctgagggtggaggataaccctgcactggctgcaggagtgagagcaggtgctgtgatttctgtcttcatttgggctcctgaggaagaaggtcaatactaccctggaagggtctctaggtggtggctcaaacaaagcttggctcaccttgattcctctctgagaaaccttggctcccctttaatcaccaaacgttccactaatagtatttcttctctcttggaggttgttaagtccactggggctacccaactctttttcaaccatttatatgatccattgtcacttgtgagggatcacagagcaaaggaggttctgacggctcaaggcattaccgtacgttccttcaactcggacttgttgtatgagccatgggatgtgaatgatgctcatggccaaccattcacaactttttctgctttttgggaaagatgccttagcatgccttatgacccacaagcacctcttctcccacctaaaaggattattccaggtgatgtatcaaggtgtccttctgatacattggtgtttgaagacgaattggagaaggcaagcaatgcgcttcttgctcgagcatggtcaccggggtggagcaatgcagacaaggcattgacagcattcgtaaacggtgctttgatcgaatactcgaagaatcgcaggaaggcagacagtgccacaacctcatttctctcaccacatttgcactttggtgaggtgagtgtgaagaaagttttccaccttgtccgcatcaagcaagtgttttgggccaatgaaggaaacaaggctggtgaagagagtgtgaacttgtttctcaagtctattggcctcagagagtattcgagatacattagtttcaaccacccttatagtcatgagaggccccttctagcccaccttaagtttttcccttgggtggtgaatgaaggatactttaaggcttggagacaaggcagaacagggtaccctttggtggatgctggaatgagagagttgtgggcaactggttggttgcatgatcggatacgcgttgtggtttcaagtttcttcgtgaaggtgctgcagcttccttggagatggggaatgaagtatttctgggacacccttttggatgcagatcttgagagtgatgctcttggttggcagtacatatctggcactctccctgatggtcgtgaacttgaccgaatagataatccacagtttgaggggtacaaatgtgacccaaatggagaatatgtgcgacgatggcttcctgaacttgctagattaccaactgaatggatacaccatccatggaatgcaccggagtctgtactccaagctgctggaattgaacttggttcaaattatcctcttcccattgtgggaatagatgcagcagaagtaagacttcaagaagcacttattcaaatgtggcaacaagaagcagcttcaagagctgcaatggaaaatggaaccgaggaagggcttggagactcagctgaatcagcccctattgcctttcctcaagacatacaaatggaggaaaggcctgaacctgttaggaacaacctgcctcatggtactcggcgctaccaggatcagatggtcccaagtatcacatcttcccatgtgagagttgaagaggaagaaacatcttcagaccttcgaaactcggctgcagacagcagggccgaagtgcctataaatgtgaccacacaacaaattgcaagagagacagtgaatcaaggggtgttactgaatgcaaacagaaacactcgagtacagaataatgctactacgtggctgagaaatgcagctgaagattccacagcagaatcttcaagtagtactaggagagaaagggatgggggtgtagttccagtatggtctcccccagcttctaacttctcagaacaatttgtagatgatgaaaatggtataggagccggttcatcttacttgcaaaggcagcatcctcagtctcatcaattgatgaactggacacggctacctcagacagggtaatttacgtctagaacatgccgattaatatcagggggaaggaaaatgcactctcccctcttcttctgggaatcgtgggatggtgaaccgcattggacatacatgtgatcatttcctacatccttaaacctgtcttgacacatgattaacggctgacctccaatgtgtatgaaattttcagttcaagcgggtagtagtttcatctgcggtgccttttgctctcttgtacaaaatttgtaggcctactgtatagtataaatttgtattgtggaggagaaatagccactatttaatttggacctttggtcctctcttaaaactcagggttgtgcttatcatttaaggtagttatttacatttcctgtcccgtaatcctgtacatttattttgactactgtaaagtgcactcatctcagtgctcacatctccaaaacttctctatatggcaaactaaaaagacagtgccaaaaactttgtttttgtttgccctgtctttgtaatgcttatgcctgaaatttcctatggttgagtaaagatatgcaaataattgcaacaatttagtaacttaactgttttgctttagc

SEQ ID NO: 6297 - DNA, 3158 bp, Glycine max
gtggctgcggttcgcctatcaattcattgtgtatccccactcagttggccaatcctcttcacttgttctctctctctctctctctcctcagtatctcttctctctggttgcaacttggtgtgggtgtgtgaaagcaccaaaaatacgaattttctgcaaaagaaatcaatccttctctcccaaaagaaatgctatagtgtgggagaaaagggtattaaaaaagataagtgccaaacctcaaagttgtgcgttttacctccctcagttaaagagaaaacaaagaccaaaaggaataaaaaaaaaaaaaaggtatagagagaaggtattaaggtaagagttaagaccagttagcatttcttagtgttgttgtttgttcttgaggctcagtggtcaaagggaaaggaaagaaggaaggacggaaagagatctatctatctggtatatggttaacaaagaggttgtatgtgtatgcgtgaataataataacaacaataacaataatagactagctcttgaggttgtggtgttggtgaaattttttttgtggagagatgtccggtggtggatgcagcatagtgtggttcaggagagatctgagggtggaggataaccctgcactggctgcaggagtgagagcaggtgctgtgatttctgtcttcatttgggctcctgaggaagaaggtcaatactaccctggaagggtctctaggtggtggctcaaacaaagcttggctcaccttgattcctctctgagaaaccttggctcccctttaatcaccaaacgttccactaatagtatttcttctctcttggaggttgttaagtccactggggctacccaactctttttcaaccatttatatgatccattgtcacttgtgagggatcacagagcaaaggaggttctgacggctcaaggcattaccgtacgttccttcaactcggacttgttgtatgagccatgggatgtgaatgatgctcatggccaaccattcacaactttttctgctttttgggaaagatgccttagcatgccttatgacccacaagcacctcttctcccacctaaaaggattattccaggtgatgtatcaaggtgtccttctgatacattggtgtttgaagacgaattggagaaggcaagcaatgcgcttcttgctcgagcatggtcaccggggtggagcaatgcagacaaggcattgacagcattcgtaaacggtgctttgatcgaatactcgaagaatcgcaggaaggcagacagtgccacaacctcatttctctcaccacatttgcactttggtgaggtgagtgtgaagaaagttttccaccttgtccgcatcaagcaagtgttttgggccaatgaaggaaacaaggctggtgaagagagtgtgaacttgtttctcaagtctattggcctcagagagtattcgagatacattagtttcaaccacccttatagtcatgagaggccccttctagcccaccttaagtttttcccttgggtggtgaatgaaggatactttaaggcttggagacaaggcagaacagggtaccctttggtggatgctggaatgagagagttgtgggcaactggttggttgcatgatcggatacgcgttgtggtttcaagtttcttcgtgaaggtgctgcagcttccttggagatggggaatgaagtatttctgggacacccttttggatgcagatcttgagagtgatgctcttggttggcagtacatatctggcactctccctgatggtcgtgaacttgaccgaatagataatccacagtttgaggggtacaaatgtgacccaaatggagaatatgtgcgacgatggcttcctgaacttgctagattaccaactgaatggatacaccatccatggaatgcaccggagtctgtactccaagctgctggaattgaacttggttcaaattatcctcttcccattgtgggaatagatgcagcagaagtaagacttcaagaagcacttattcaaatgtggcaacaagaagcagcttcaagagctgcaatggaaaatggaaccgaggaagggcttggagactcagctgaatcagcccctattgcctttcctcaagacatacaaatggaggaaaggcctgaacctgttaggaacaacctgcctcatggtactcggcgctaccaggatcagatggtcccaagtatcacatcttcccatgtgagagttgaagaggaagaaacatcttcagaccttcgaaactcggctgcagacagcagggccgaagtgcctataaatgtgaccacacaacaaattgcaagagagacagtgaatcaaggggtgttactgaatgcaaacagaaacactcgagtacagaataatgctactacgtggctgagaaatgcagctgaagattccacagcagaatcttcaagtagtactaggagagaaagggatgggggtgtagttccagtatggtctcccccagcttctaacttctcagaacaatttgtagatgatgaaaatggtataggagccggttcatcttacttgcaaaggcagcatcctcagtctcatcaattgatgaactggacacggctacctcagacagggtaatttacgtctagaacatgccgattaatatcagggggaaggaaaatgcactctcccctcttcttctgggaatcgtgggatggtgaaccgcattggacatacatgtgatcatttcctacatccttaaacctgtcttgacacatgattaacggctgacctccaatgtgtatgaaattttcagttcaagcgggtagtagtttcatctgcggtgccttttgctctcttgtacaaaatttgtaggcctactgtatagtataaatttgtattgtggaggagaaatagccactatttaatttggacctttggtcctctcttaaaactcagggttgtgcttatcatttaaggtagttatttacatttcctgtcccgtaatcctgtacatttattttgactactgtaaagtgcactcatctcagtgctcacatctccaaaacttctctatatggcaaactaaaaagacagtgccaaaaactttgtttttgtttgccctgtctttgtaatgcttatgcctgaaatttcctatggttgagtaaagatatgcaaataattgcaacaatttagtaa

SEQ ID NO: 6298 - DNA, 3187 bp, Glycine max
aggtgtggctgtggtttgcctatcaattcattgtgtatccccattcagttggccaatcctcttcacttgttctctctctctctcctcagtgtctcttctctctggttgcaacttggtctgtgtgtgtgaaagcaccaaaaataagaattttctgcaaaagaaatcaatcccctctctcccaaaagaaatgctaaagtgtgggagaaaagggtattaaaaaagataagtgccaaacctcaaagttgtgctttttacctccctcagttaaagaaaaaaccaagaccaaaaggaataaaaaataaggtagagagagaaggcattaaggtaagagttaagactagttagcatttcttggtggttgtggtgttcttgaggtgaaagggaaaggaaggaaagaaagagatctatctggtggttaacagagaggttgtatgtgtttgtgtgtttgaataataataataacaacaagatcaacaacaatagactagttcttgaggttgtggtgttggtgaaatttttgtgtggagatgtcaggtggtggatgcagcatagtgtggttcaggagagatctgagggtggaggataaccctgcactggctgcaggagtgagagcaggtgctgtggtttgtgtcttcatttgggctcctgaggaagagggtcaatactaccctggaagggtctctaggtggtggctcaaacaaagcttggctcaccttgattcctatctgagaaaccttggctcccctctaatcaccaaacgttccactaatagtatttcttctctcttggaggttgttaagtccaccggggctacccaactctttttcaaccatttatatgatccgttgtcacttgtgagggatcacaaagcaaaggaggttctgacggctcaaggcattaccgtacgttccttcaactcggacttgttgtatgagccatgggatgtgaatgatgctcatggccaaccattcacaactttttctgctttttgggaaagatgccttagcatgccttatgacccacaagcacctcttctcccacctaaaaggattattccaggtgatgtatcaaggtgcccttctgatacattggtgtttgaagacgaatcggaaaaggcaagcaatgcgcttcttgctcgagcatggtcacccgggtggagcaatgctgataaggcattggcagcatttgtaaacggtgctctaatcgagtactcgaagaatcgcaggaaggctgacagtgccacaacctcatttctctcaccacatttgcactttggtgaggtgagtgtgaagaaagtgttccaccttgtccgcatcaagcaagtgttttgggccaatgaaggaaacaaggctggtgaagagagtgtgaacttgtttctcaagtctattggtcttagagagtattcaaggtacattagtttcaaccacccttatagtcatgagaggccccttctaggccaccttaagtttttcccttgggtggtgaatgaagggtactttaaggcttggagacaaggcagaacaggttaccctttggtagatgctggcatgagagagttgtgggcaactggttggttgcatgatcgaatacgtgttgtggtttcaagtttctttgtgaaggtgctgcagcttccttggagatggggaatgaagtatttctgggacacccttttggatgcagatcttgagagtgatgctcttggttggcagtacatatctggcactctccctgatggtcgcgaatttgaccgaatagataatccacagtttgtgggctacaaatgtgacccaaatggagaatatgtgcgacgctggcttcctgaacttgctagattaccaactgaatggatacaccatccatggaatgcaccagagtctgtactccaagctgctggaattgaacttggttcaaattatcctcttcccattgtgggaatagatgcagcagaagtaagactgcaagaagcacttattcaaatgtggcgacaagaagcagcttcaagagctgcaatggaaaatggaaccgaggaagggcttggagactcatctgaatcagcccctattgcctttcctcaagacatacaaatggaggaaaggcctgaacctgttaggaacaacccacctcacggtactcggcgctaccaggatcagatggtcccaagtattacttcttcccatgtgagagtggaagaggaagaaacatcttcagaccttcgaaactcggctgcagacagcagagccgaagtgcctataaatgtaaccacacaacaaaatgcaagagagacagtgaatcaaggggtgttactgaatacaaatagaaacactcgagtacagaataatcctacaacgtggctgagaaatgcagctgaagattccacagcagaatcttcaagtagtactaggagagaaagggatgggggtgtagttccagtatggtcccccccagcttctaatttctcagaacaatttgtagatgatgaaaatggtataggaaccggttcatcttacttgcaaaggcagcatcctcagtctcatcaattgatgaactggacacggctacctcagactgggtaaattacgtctagaacatgccgattaatatcagggagatggaaaatgcactctcccctcttcttttgggaaacatgggatgggcattagacatacatgtgatcatttcctacatccttaaacctgtcttgacacatgattaacggctgacctccaatgtgcatgaaaatttcagttcatgcaggcggtagtttcatctgcggtgccttttgctctcttgtacaaaatttgtaggcctactgtatagtataaatttgtattgtggtggagaaagagccactattcgatttggacctttggtcctgtcttaaaactcagggttgtgcttatcattcaaggtagttatttacatttcctgtcccgttatcctgtacatttattttgactactgtaaagtgcactcatctcagtgctcacatctccgaaacttctctatgtggcaaactaaaagacagtgccaaagacactttttgttttttgtttgccctgtcttagtaatgcttattcctgaaatttcctatggttgagtaaagatatgcaaataattcctgcaagttagtaacttactcaactgttttactttagccagaataaactacattttagaaagataaaga

SEQ ID NO: 6299 - DNA, 3097 bp, Glycine max
cccattcagttggccaatcctcttcacttgttctctctctctctcctcagtgtctcttctctctggttgcaacttggtctgtgtgtgtgaaagcaccaaaaataagaattttctgcaaaagaaatcaatcccctctctcccaaaagaaatgctaaagtgtgggagaaaagggtattaaaaaagataagtgccaaacctcaaagttgtgctttttacctccctcagttaaagaaaaaaccaagaccaaaaggaataaaaaataaggtagagagagaaggcattaaggtaagagttaagactagttagcatttcttggtggttgtggtgttcttgaggtgaaagggaaaggaaggaaagaaagagatctatctggtggttaacagagaggttgtatgtgtttgtgtgtttgaataataataataacaacaagatcaacaacaatagactagttcttgaggttgtggtgttggtgaaatttttgtgtggagatgtcaggtggtggatgcagcatagtgtggttcaggagagatctgagggtggaggataaccctgcactggctgcaggagtgagagcaggtgctgtggtttgtgtcttcatttgggctcctgaggaagagggtcaatactaccctggaagggtctctaggtggtggctcaaacaaagcttggctcaccttgattcctatctgagaaaccttggctcccctctaatcaccaaacgttccactaatagtatttcttctctcttggaggttgttaagtccaccggggctacccaactctttttcaaccatttatatgatccgttgtcacttgtgagggatcacaaagcaaaggaggttctgacggctcaaggcattaccgtacgttccttcaactcggacttgttgtatgagccatgggatgtgaatgatgctcatggccaaccattcacaactttttctgctttttgggaaagatgccttagcatgccttatgacccacaagcacctcttctcccacctaaaaggattattccaggtgatgtatcaaggtgcccttctgatacattggtgtttgaagacgaatcggaaaaggcaagcaatgcgcttcttgctcgagcatggtcacccgggtggagcaatgctgataaggcattggcagcatttgtaaacggtgctctaatcgagtactcgaagaatcgcaggaaggctgacagtgccacaacctcatttctctcaccacatttgcactttggtgaggtgagtgtgaagaaagtgttccaccttgtccgcatcaagcaagtgttttgggccaatgaaggaaacaaggctggtgaagagagtgtgaacttgtttctcaagtctattggtcttagagagtattcaaggtacattagtttcaaccacccttatagtcatgagaggccccttctaggccaccttaagtttttcccttgggtggtgaatgaagggtactttaaggcttggagacaaggcagaacaggttaccctttggtagatgctggcatgagagagttgtgggcaactggttggttgcatgatcgaatacgtgttgtggtttcaagtttctttgtgaaggtgctgcagcttccttggagatggggaatgaagtatttctgggacacccttttggatgcagatcttgagagtgatgctcttggttggcagtacatatctggcactctccctgatggtcgcgaatttgaccgaatagataatccacagtttgtgggctacaaatgtgacccaaatggagaatatgtgcgacgctggcttcctgaacttgctagattaccaactgaatggatacaccatccatggaatgcaccagagtctgtactccaagctgctggaattgaacttggttcaaattatcctcttcccattgtgggaatagatgcagcagaagtaagactgcaagaagcacttattcaaatgtggcgacaagaagcagcttcaagagctgcaatggaaaatggaaccgaggaagggcttggagactcatctgaatcagcccctattgcctttcctcaagacatacaaatggaggaaaggcctgaacctgttaggaacaacccacctcacggtactcggcgctaccaggatcagatggtcccaagtattacttcttcccatgtgagagtggaagaggaagaaacatcttcagaccttcgaaactcggctgcagacagcagagccgaagtgcctataaatgtaaccacacaacaaaatgcaagagagacagtgaatcaaggggtgttactgaatacaaatagaaacactcgagtacagaataatcctacaacgtggctgagaaatgcagctgaagattccacagcagaatcttcaagtagtactaggagagaaagggatgggggtgtagttccagtatggtcccccccagcttctaatttctcagaacaatttgtagatgatgaaaatggtataggaaccggttcatcttacttgcaaaggcagcatcctcagtctcatcaattgatgaactggacacggctacctcagactgggtaaattacgtctagaacatgccgattaatatcagggagatggaaaatgcactctcccctcttcttttgggaaacatgggatgggcattagacatacatgtgatcatttcctacatccttaaacctgtcttgacacatgattaacggctgacctccaatgtgcatgaaaatttcagttcatgcaggcggtagtttcatctgcggtgccttttgctctcttgtacaaaatttgtaggcctactgtatagtataaatttgtattgtggtggagaaagagccactattcgatttggacctttggtcctgtcttaaaactcagggttgtgcttatcattcaaggtagttatttacatttcctgtcccgttatcctgtacatttattttgactactgtaaagtgcactcatctcagtgctcacatctccgaaacttctctatgtggcaaactaaaagacagtgccaaagacactttttgttttttgtttgccctgtcttagtaatgcttattcctgaaatttcctatggttgagtaaagatatgcaaataattcctgcaagttagtaactta

SEQ ID NO: 6300 - DNA, 2613 bp, Lotus japonicus
tataatcagcatttcttggttttctgtggcttcgtcactcaaataaaggaacaaaagagatctggtagatggttattaacagagaggttgcatgtgaacatttgtggagatgtcaggtggaggagcatgcagcatagtttggttcaggagggatctgagggttgaggataatccagcacttgcagcaggagtcagagcaggagctgtggttgctgttttcatctgggcacctgaagaagagggtcagtactaccctggaagggtctcaaggtggtggctcaagaacagtttggctacccttgattcttctttgagaagccttggcacccctcttataactaagagatcaactgatagtgtttcttctttgttggaggttgttaagtccactggagccactcaaatctttttcaaccatttatatgatccattgtcactagttagggatcacagagcaaaggaggttctgactgctcaaggcatcaccgtacgttccttcaattcagatttattgtatgagccatgggatgtgaatgatgctaatggccaaccattcacaacttttgatgctttttgggaaagatgccttaccatgccttatgacccacaagcacctcttcttccacctaaaaggattattccaggtgatgcatcaaggtgcccttctgatacattggtgtttgaagatgaatcagagaaagcaagcaatgcgcttcttgctcgagcatggtcacccgggtggagcaatgcagacaaggctttgacagcatttataaacggtcccctaattgagtactcgaagaatcgcaggaaggctgacagtgccacaacctcattcctctccccgcatttgcattttggcgaggtgagcgtcaagaaagttttccatcttgtccgaattaagcaagtcctttgggccaacgaaggaaacatagctggtgaagaaagtgtgaacttgtttctcaagtctattggccttagagagtattcaaggtacatcagtttcaaccacccttatagtcatgaaaggcctcttctaggacaccttaagtttttcccttgggtagtgaatgaaggctatttcaaggcttggagacaaggcagaacaggttaccctttggtggatgctggaatgagagagttgtgggctactggttggttgcatgatcggatacgcgtggtggtttctagtttctttgtgaaggttctgcagcttccttggagatggggaatgaagtatttctgggatacccttttggatgcggatcttgagagtgatgctcttggttggcaatatatatctggcactatacctgatggccgtgaacttgaccgaatagataatccacagtttgaggggtacaaatgtgatccaaatggcgaatatgtacgacgctggctacctgaactttcaagactaccaactgaatggatacatcatccatggaatgcaccagagtctgtattgcaagccgccggaattgaacttgggtcaaactaccctcttccaattgttggaatagatgcagcaaaagcaagattgcaggaagcactgttacaaatgtggcaacaagaagcagcttcaagagctgcaatggaaaacggaaccgaggaagggcttggagactcctctgaatcagcccctattgcttttcctcaagacatgataatggaggaggaaagacatgaacctgttaggaacaatccccctcatggtactcgacgctaccaggatcagatggtgccaagcatcacttcttcccatgtgagagtggaagaggaagaaattgcttcagatcttcgaaactcagcacaagacaacagagctgaagtgccaatgaatgtaaacacacagcaaaatgcaagagaggcagtgaaccaaggagtgttgcagactataaatagaaacaacactcaactacagcacaataacacagtgtggctgagaaatgcggccgaagattctaccgcagaatcttcaagtagtactaggagagaaagagatgggggtgttgtcccggtgtggtctcccccagcttctagtttctcagagcaatttgtagatgatgaaaatggtataggagctagttcatcctacttgcagaggcatcctcagtctcaccaaatgatgaattggactaggctacctcaaactgggtaattcacatctgaaacatgccaacgagaagcaggagcaaattcaacctcaccacttctgttggcaaaatgggatggagaacctgcaatagacatgcatgttttcattctctactccttgtactgatgttgacaaatgattaactgctgacctccaatgtgcatgaaaaatatcagttcattcggatagtgtcatctgcaaacacttttgcctttcttgtacaaaatgtgtaggcctattgtatagtgtattttgtgtagtgagggagagaaagaaactattggatcgttggtctactgataaactcaggtttgtgcttattatttaaggcaggatatatttcttttaatcatcctgctttatttacatttaggatgcatctgaaaaagcttataagtttatctgataacttaagcatgcgtttgaagtggttaagcttatgaaaataacttatg

SEQ ID NO: 6301 - DNA, 2979 bp, Arachis hypogaea
gctgcagtttgtctatcaattccattcattgtatccccactcagttaaccaatcctcttcaattgctcttcattctattttatctctctctctctctctccttggacctttctcagtgtctctcatcatcttccccatgttgcaacttgggtaaaagaaccccaaagataattggagaatttttcttccaaagattgtccaccccccaaagtgttggagagaaacaagtaaagaaagaagataagtggcaaggctcaaatatcaaactctgctttttcttttacctctttttgcttagaaaggaactaaataaaaggaagcagaaagagagagaaaaaagctaaacagcatttatttctcggtaattggcatggttaagagatctggtacatatatagtataggacaggatagcatatagtatagtgtgtatagtggtaggggtaatttaggaaattatgtcagggggtggtggttgcagcatagtgtggttcaggagagatctgagggtagaggataacccagcactagctgcaggtgttagagctggagcagtagttgctgtgttcgtatatgcccctgaggaagaaggacaatactaccccggaagggtatcaaggtggtggttaaagaacagcttggctcaccttgattcttctcttagaagccttggtacccctctcatcactaaaagatccactgatagtgtttcttctcttttggatgttgttaagtccactggagctactcaactcttctttaaccatttatatgatccattgtcacttatcagggatcacagagcaaaggaggttctgactgcacaaggcataaccgttcgttccttcaattccgatttgttatatgagccgtgggatgtcaatgattccaatggccaaccattcacaactttttctgctttttgggaaagatgccttagcatgccttatgacccacaagcacctcttctcccacctaaaaggattattccaggagatgtatcaaggtgtcagggtgatacactggtgtttgaagatgaatccgagaaagcaagcaatgcacttcttgcacgagcatggtcaccagggtggagcaatgctgataaggccttaacagcatttataaacggtcccctgattgagtatgcaaagaatcgcaggaaggccgatagtgccacaacctcattcctctccccacatttgcattttggcgaggtgagtgtcaagaaagttttccatctcgtccgaatcaagcaagtcctttgggccaatgaaggaaaccaggctggtgaagaaagtgtgaatttgtttcttaagtctattggtcttagagaatattcaaggtacatcagtttcaaccacccttatagtcatgaaaggcctcttcttggtcaccttaagttctttccttgggttataaacgagagccatttcaaggcatggcgacaaggcaggacaggctatcctttggtggatgctggcatgcgagagctatgggccactggctggctgcatgatcgaattcgtgtcgtggtttccagtttctttgtgaaggttctgcagcttccttggagatggggaatgaaatatttttgggatacgctcttggatgcagatcttgagagcgatgctcttggttggcagtacatatctggtactcttcctgatggccgtgaattcgaccgaatagataatccacagtttgagggatacaagtttgatccaaatggagaatatgttcggcgctggcttcctgaactttctagattgccaactgaatggatacatcatccatggaatgcacctgaatctgtactccaagctgctggaatcgaacttggttctaactaccctcttccaattgtaggaatagatgcagcaaaagcaagacttcaagaagcacttatacaaatgtggcaactagaagcagcttcaagagcagcaatcgaaaatggagttgaggaagggcttggagactccaccgaattggcccccattgctttccctgaagatatacagatggaggaaagccatgaacctgttaggaacaatcccccggttggtcctaggcgttacgaggatcagatggtccccagtatgacttcttccctggtgagggtggaagaggaagaggcttcctcagttcttcgaaacttggcagaagaaagcagagctgaagtgccaactaatgcaactgcacaacaaaatgcaagagagacggtgaaccaaggagtgttgcagaatgttaatagaaacacacaagtacagcataataatactacagcgtggctgagaaatgcggctgaagattcgacagcagaatcttcaagtagtactaggagagaaagggatggaggagtagttccagtatggtctcccccgtcttctagttatgcagagccatttgtagatgatgagagtggaataggagccagttcatcatacttgcagaatcatcctcagtcgcacagattaatgaattggacacggctacctcaaactgggtaatctgcatccaaatcaagcagattagaaccccgcaggtgacaaatgcattcacaaatcttctttaccagaaaagtagggacgacgaactcaatccatgttcatttccactggaaacaaactctgctgctcatttcctacatcataatccagtctcgacatatgtttagcgactgaccttcaatttgtatggaaaatttcgattcatacacagtgcagcttcgtctgcggtccctcttgcttttcgtgtacaatatttgtaggctcctatcctacttgtatagtaatatatattttgtgcagtgagggagaaagagtcgatgtaataggatctctggctctcaaataaactcaagtttgctcttatataaaagttaagccagatatattatacttttatgatccctcctttggttacatattatggcctgtataacacttttcagcactactggaaattgcagttattttggtgc

SEQ ID NO: 6302 - DNA, 3050 bp, Cicer arietinum
gtgatttgttttgttttgttgctaaaataggataataggaaaatttgaaaaatctacatagcataaaaaagttgtggctacaatttctctatcaattttctctgtatccccccactcatttaaccaatcctcttcacttgttctctctctctccccttggactctttctttagtgtctcttttttctcgttgcaacttgagtgtgtgaaaaaagaaccaaaataagaattttttggaaaagaaatcctccccaaaagtaatcctatttttttggagaaagataatttaaagataaataccaaaaactcaaacttgtcaactcaaatctaaaaaaatcatttttttttaactctttatggcctaaaatctctcccaatatagaaaacaaaaaaacaaggtagtggaaaagcaataagaaaaagataagactaatcagcatttcttggtatttttcagctattagaagaaaggaagagaaagagatctggtatatggttaaaaaaagaggtttatttgtgtgtgtgaattgtggagatgacaagtggtggatgcagcatagtttggttcagaagagatctgagagtagaagataaccctgcacttgcagcaggtgttagagcaggtgctgttgttgctgtttttatatgggcacctgaagaagaaggtcaatattatcctggtagagtttcaagatggtggcttaaaaacagtttgtctcaacttgattcatctttgagaagtcttggtactcctcttatcactaaaagatcaactgatagtgtttcttctttacttgaagttgttaagaacactggagccactcaaatctttttcaatcatttatatgatccattatcacttgtgagggatcacaaagcaaaggaggttctaacaactcaaggcattaccgtacgttcatttaactcagatttattgtatgaaccatgggatgtgaatgatgaacatgaccaaccattcacaacttttgattctttttgggaaagatgccttagcatgccttatgacccacaggcacctcttctcccacctaaaagaattattccaggtgatgtatcaaggtgtccttctgatacattggtgtttgaagatgaatcagagaaagcaagtaatgcacttcttgctcgagcatggtcaccagggtggagcaatgcaaacaaggcattgacaacgttcataaacggtccactgattgagtatgcgaaaaatcgcaggaaagctgacagtgctacaacctcatttctctccccgcatttgcatttcggagaagttagcgtcaagaaagtattccatcttgtccgaattaagcaagtcttttgggccaatgaaggaaaccaagccggcgaagaaagtgtaaacttgtttctcaaatcgattggtcttagagagtattcaaggtacattagtttcaaccacccttatagtcatgaaaggcctcttcttggacaccttaagtttttcccttgggtggtgaatgaaggatattttaaggcatggagacaaggaaggacagggtaccctttggtggatgctggaatgagagagttgtgggctactggttggcttcatgatcgaatacgtgttgttgtttcaagtttctttgtgaaggtcttgcagcttccttggagatgggggatgaaatatttttgggatacccttttggatgctgatcttgagagtgatgctcttggttggcagtatatatcgggtactctccctgatggtcgtgaattcgacagaattgataatccacagtttgagggatacaaatgcgatccaaatggagaatacgtgcgacgctggcttcctgaacttgcaagattgccaaccgaatggatacatcatccatggaatgccccagaatcagtactacaagctgctggtattgaacttggctcaaactaccctcttccaattgtggaaatagatgcagcaacagtgagactagaggaagcacttatacaaatgtggcaactagaagcagcttcaagagctgcagcggaaaatggaaccgaggaaggtcttggagactcatctgaatcaacccctattgcttttccacaagacatacaaatggaagaaatacatgaacctgttaggaacaatccacctcacggtactcggcgctacgaggatcaaatggtaccgagtatcacttcttctagggtgagaatggaagaagaagaaacttcttcggttcgaaactcgggagaagacagcagagctgaagtgccaacaaatgcaaatggacagcaaaatacaagagagacggagagccaaggagtgctgcagaatgtaaatagaaacactagacaacggaataatactccaactacattttggctgagaaatgctcctgaagattcgacagctgaatcttcaagtagtactagaagagagagagatggaggtgtagttcctgagtggtcgccaccgacttctaacttctcagatcaatttgtagatgatgaaaatggtataggatccagttcaccttacttgcagaggcatccacagtctcaccaattgatgagttggacgcggctacctcaaactggataattcatatttaaaacacgcagacttgaagcagggatgtgggaaatgcatgcaatctcaccaagtgggatggagaacatggcaatggagatacatttgctcattttctgcaatgtatctccaatgttttgatgaatgattaactgatgaaatccaattgtttggaaatttcagttcatcgggacagtttcatctgcattcttcccttttgcttcttgtacaaaatgtgtagtcctactattgtaaagtatataatatatagtattttgtgtagtagtgagggagaaacagtaacttttgaatctttggttcactcttaaactcgagtttgtgcttgtgatttaaagcagatatatttcttttattatccttccttatttagattttcttccctttaatgtaatactagcaaggtaactcacacgacactttagtttttaacaacgttcataaataatgtttctcggtcggca

SEQ ID NO: 6303 - DNA, 2519 bp, Medicago truncatula
aaaacaaataaagggtaggaagaaaaactccttttttgtgtgaagatgtcatcaagtggtggtggatgcagtatagtttggttcagaagagatctgagggtagaggataaccctgcactagcagcaggtgttagagcaggtgctgtagttggtgtttttatatgggcacctgaagaagaaggacaatattatcctggtagggtttcaagatggtggcttaagaatagtttggctcatcttgattcatctttgagaaatcttggtactcctcttgttaccaaaagatcaactgatagtgtttcttctttgttggaagttgttaaatccactggagccactcaaatcttcttcaaccatttatatgatccattgtcacttgtaagggatcatagagcaaaggaaattctaacggctcaagggattaccgtacgttcgttcaactcagatttattgtatgaaccatgggatgtgaacgatgaaaatggccaaccgttcacaacttttgattctttttgggaaagatgccttagcatgccttatgacccacaagcacctcttctcccacctaaaagaattattccaggtgatgtatcaaagtgtccttctgatacattggtttttgaagacgatttagagaaagcgagcaacgcacttcttgctcgagcatggtcaccagggtggagtaatgcaaacaaggcattaacaaccttcataaacggtccactgatcgagtactctaagaatcgaaggaaagcagacagtgccacaacctcatttctctctccacatttgcatttcggagaagttagtgtcaaaaaagtattccatcttgtccgaatcaaacaagtcttttgggcgaatgaaggaaatgaagccggcgaagaaagtgttaacttgtttctcaagtcaattggtcttagagagtattcaaggtacattagtttcaaccacccttatagtcatgaaaggcctctacttggacaccttaagtttttcccttgggtggtgaatgaaggatattttaaggcatggagacaaggaaggaccggttaccctttggtggacgctggaatgagagagttgtgggcaactggttggctacacgatcggatccgtgttgtcgtttctagtttctttgtcaaggttttgcagcttccttggagatgggggatgaaatatttttgggatacccttttggatgctgatctcgagagtgatgctcttggttggcagtatatatctggtactctacctgatggtcgtgaattcgacagaatcgataatccacagtttgagggatacaagtgtgatccgaatggagaatatgtgcgacgttggcttcctgaacttgcaagattaccaaccgaatggatacatcatccatggaatgcaccagaatcagtactccaagctgctggtattgaacttggctcaaactaccctcttccaattgtggaaatagatgcagcaacagtgaggctcgaggaagcacttatacagatgtggcaactagaagcagcttcaagagctgcagcagaaaacggaaccgaagaaggtcttggagactcagctgaatcaacacctattgcttttcctcaggacatacaaatggaggaaagacatgaacctattaggaacaatgcacctcacggtactcggcgctaccaggatcaaatggtaccaagtatgacttcttctagagtgagagtcgaagaagaagaaacttcttcggttcgaaactcggctggagacagcagagctgaagtgccaacaaatgcaaatgcaagagaggcgatgaaccaaggagcgttgcagaatgggaatagaaacactagacaaaggcataatcctacaactacattttggctgagaaatgcagctgaagattccacagcagaatcttcaagtagtactaggagagaaagagatggaggtgttgttccagagtggtcgccgcaggcttctaacttctctgatcaatatgtagatgatgaaaatggtataggagctacttctccttacttgcagaggcatccacagtctcaccaattgatgagttggacacgcctacctcaaactggataatacacatatataccatgcagacttgaagcaagggatgtggaaatgcaatctcaccaagtgggatgaagaccatcggattggagatacatgtactcattttgggaaagtattgacgaatgattaaattgctgatttccaatgtgtttggaaatttcagtacattgggggcagtttcatatctgcattcccatttgcttcttgtacaaaatgtgtaggtgtccgtcctattgtaaagtatatattttgtgtagtgatcagggagaaacaccgacttttgaatctttgcttcactcttaaacttgggtttgtgatgatgatttaaggcagatatacttcttttatatgatccctccttaactacattttctgtcatttaatgtaatatcagtaaggtaatattgcacgagtaacttttgtttttatgcttaaacgcg

SEQ ID NO: 6304 - DNA, 3000 bp, Medicago truncatula
atttgttttgttttgttgcatgttataagataatagaaatattgaaaaatctacatagcataaaaaagttgtggctgcaaattctctacaaattttcatgtatcccccactcaaccaatcctcgtcatttgttctaatctctctctccttggacctttgtctcagtgtcactattttctcattgcaacttgagtgaaaaatcaaaaaacaaccaaatttagaatttcttggaaaacaaaactactcttaaagttatgctatatttttggaaaaggataatttattaaactctgcatttttttttttcattgtatttcatctctttatggcctaaaatcttcatcaatatagaaaacaaataaagggtaggaagaaaaactccttttttgtgtgaagatgtcatcaagtggtggtggatgcagtatagtttggttcagaagagatctgagggtagaggataaccctgcactagcagcaggtgttagagcaggtgctgtagttggtgtttttatatgggcacctgaagaagaaggacaatattatcctggtagggtttcaagatggtggcttaagaatagtttggctcatcttgattcatctttgagaaatcttggtactcctcttgttaccaaaagatcaactgatagtgtttcttctttgttggaagttgttaaatccactggagccactcaaatcttcttcaaccatttatatgatccattgtcacttgtaagggatcatagagcaaaggaaattctaacggctcaagggattaccgtacgttcgttcaactcagatttattgtatgaaccatgggatgtgaacgatgaaaatggccaaccgttcacaacttttgattctttttgggaaagatgccttagcatgccttatgacccacaagcacctcttctcccacctaaaagaattattccaggtgatgtatcaaagtgtccttctgatacattggtttttgaagacgatttagagaaagcgagcaacgcacttcttgctcgagcatggtcaccagggtggagtaatgcaaacaaggcattaacaaccttcataaacggtccactgatcgagtactctaagaatcgaaggaaagcagacagtgccacaacctcatttctctctccacatttgcatttcggagaagttagtgtcaaaaaagtattccatcttgtccgaatcaaacaagtcttttgggcgaatgaaggaaatgaagccggcgaagaaagtgttaacttgtttctcaagtcaattggtcttagagagtattcaaggtacattagtttcaaccacccttatagtcatgaaaggcctctacttggacaccttaagtttttcccttgggtggtgaatgaaggatattttaaggcatggagacaaggaaggaccggttaccctttggtggacgctggaatgagagagttgtgggcaactggttggctacacgatcggatccgtgttgtcgtttctagtttctttgtcaaggttttgcagcttccttggagatgggggatgaaatatttttgggatacccttttggatgctgatctcgagagtgatgctcttggttggcagtatatatctggtactctacctgatggtcgtgaattcgacagaatcgataatccacagtttgagggatacaagtgtgatccgaatggagaatatgtgcgacgttggcttcctgaacttgcaagattaccaaccgaatggatacatcatccatggaatgcaccagaatcagtactccaagctgctggtattgaacttggctcaaactaccctcttccaattgtggaaatagatgcagcaacagtgaggctcgaggaagcacttatacagatgtggcaactagaagcagcttcaagagctgcagcagaaaacggaaccgaagaaggtcttggagactcagctgaatcaacacctattgcttttcctcaggacatacaaatggaggaaagacatgaacctattaggaacaatgcacctcacggtactcggcgctaccaggatcaaatggtaccaagtatgacttcttctagagtgagagtcgaagaagaagaaacttcttcggttcgaaactcggctggagacagcagagctgaagtgccaacaaatgcaaatgcaagagaggcgatgaaccaaggagcgttgcagaatgggaatagaaacactagacaaaggcataatcctacaactacattttggctgagaaatgcagctgaagattccacagcagaatcttcaagtagtactaggagagaaagagatggaggtgttgttccagagtggtcgccgcaggcttctaacttctctgatcaatatgtagatgatgaaaatggtataggagctacttctccttacttgcagaggcatccacagtctcaccaattgatgagttggacacgcctacctcaaactggataatacacatatataccatgcagacttgaagcaagggatgtggaaatgcaatctcaccaagtgggatgaagaccatcggattggagatacatgtactcattttgggaaagtattgacgaatgattaaattgctgatttccaatgtgtttggaaatttcagtacattgggggcagtttcatatctgcattcccatttgcttcttgtacaaaatgtgtaggtgtccgtcctattgtaaagtatatattttgtgtagtgatcagggagaaacaccgacttttgaatctttgcttcactcttaaacttgggtttgtgatgatgatttaaggcagatatacttcttttatatgatccctccttaactacattttctgtcatttaatgtaatatcagtaaggtaatattgcacgagtaacttttgtttttatgcttaaacgcggcattcataaattacttgttccgttgacatctaagattgttagtatctattatgtgtacatgtataaattttgtgcttaactgctgattgatgactatgggaacatattcagtatctttagtgcgccaaa

SEQ ID NO: 6305 - DNA, 2436 bp, Pisum sativum
aaaggaaaaaaaacccttatttttcttcttgtgtggagaagatgtcaagtggtggatgcagcatagtttggttcagaagagatctgagggtagaggataaccctgcacttgcagcaggtgttagagcaggtgctgtggttggtgttttcatatgggcacctgaagaagaaggacagtattatcctggtagagtttcaagatggtggcttaagaacagtttgtctcagcttgattcatctttgaggaatcttggtactcctcttgttaccaaaagatcaactgatagtatttcttctttgcttgaagttgtcaagtccactggagctactcaaatctttttcaaccatttatatgatccgttgtcactcgtgagggatcatagagcaaaggaaattctaacggctcaaggaattacggtacgatcgtacaactcggatttgttgtatgaaccatgggatgtgaatgatgaacacggccaaccattcacaacttttgattctttttgggaaagatgccttagcatgccttatgacccacaagcacctcttctcccacctaaaagaattattccaggtgatgtatcaagatgtccttctgatacattggtgtttgaagatgaattagagaaatcaagcaacgcgcttcttgctcgagcatggtcaccagggtggagcaatgcgaacaaggcattaactacatttataaacggtccactgatcgagtactccgtgaatcgcaggaaagcagacagcgccacaacctcgtttctctccccacatttgcatttcggagaagttagtgtcaagaaagtattccatctcgtccgaattaagcaagtgttttgggcgaacgaaggaaacaaagccggcgaagaaagtgttaacttgtttctcaagtcaattggtcttagagagtattcaaggtacatcagtttcaaccacccttatagtcacgaaaggcctctccttggacaccttaagtttttcccttgggtggtggatgaaggatattttaaggcttggagacaaggaaggacaggttaccctttggtggatgctggaatgagagagttgtgggctactggttggcttcatgatcgaatacgtgttgtcgtttcgagtttctttgttaaggttttgcagcttccttggagatgggggatgaagtatttttgggatacccttttggatgctgatcttgaaagtgatgctcttggttggcagtatatatctggtactttacccgacggtcgtgagttcgacagaattgataatccacagtttgagggatacaaatgtgatccaaacggagaatatgtgcgacgctggctaccggaacttgcaagactaccgactgaatggatacatcatccttggaatgcaccagaatcagttctccaagctgcaggtattgaactaggctcaaactaccctcttccgattgtggaaatagatgcagcaacagtgagactagaagaagcacttattcaaatgtggcaactagaagcagcttcaagaactgcagccgaaaacggaaccgaagaaggtctcggagactcgactgaatccgcccctattgcgtttcctcaagacatacaaatggaggaaagacacgaaccggttaggaacaatccacctcatggtactcggcgctaccaggatcaaatggtacctagtatgacttattctagagtgagagtggaagatgaagaaacttcttcggttcgaaactcggcaggagacagccgagctgaagtaccaacaaatgcaaatacacagcaaaatggacgggaaccaatggaccaaggaatgttgcagaatgtaaatagaaacactagacaacgacgtaataacactacaactacattttggctgagaaatgcagcggaagattcaacagcagaatcttcgagtagtacaaggagagaaagagatggaggtgtagttccggagtggtcgccacaggcttctaacttctcagatcaatttgtagatgacgaaaatggtataggagccacttcaccttacttgcagaggcatccgcagactcaccaaatgatgagttggacacgcctacctcaaactggataaactcacattatatacaatgcagacttgaagcatgggatgtggaaaatgctatctcaccaagtgggatggagaacatggaattcgagattattacatgaaagctcattttgggaaagtgttgacaattattaactgctgatgttcaatgtttttggaaatttcagttcattcggggcagtttcatatctgcattcccttttgcttcttgtacaaaaatgtgtagcagtcctattgtaaagtatatatattttgtgtagtgaccagaaaaaaacaccaacttttgaatctttgcttcactcttaaactcgggtttgttcttatgattaaaacagatatatttttgttg

SEQ ID NO: 6306 - DNA, 2929 bp, Lupinus angustifolius
tccttttctctctcctctctccttggaccctctctctctctttctttactatcaacttgggtgaaagaaccaaaataagaatttgctggaaacaattccttcacccaaagaaatgctaaagtgtgaggcaaggacaagtaaaagataagaggcaatacccaattgcaaaattgtgtttttgttatctctttatgtcttcaacatcttcattattaatgaaaaacccaaaatcgagataggatcattaagagttattagcattagttggtgagattcagtgctataaaagaaggtaagagatctggtatatggttaagagtgtgtttgtgtgaataaggttggtggatatgtcaagtggtggatgcagcatagtttggtttagaagggatctgagggttgaggataaccctgcactgatggcaggagtgagagcaggatctgttgttgctgttttcatttgggcacctgaagaagaaggtcaataccaacctggaagggtttcaaggtggtggcttaagcatagtttggcttaccttgattcatctttgagaaatcttggaactcctcttattaccaagagatccactgatagtgtttctgctctattagaggttgttaagtccactggtgctactcaacttttctttaaccacttatatgatccattgtcacttatcagggatcaccgaacaaaggaggttctgactgctcatggcataaccgtgcgctcctttaattcggacttattgtatgaaccgtgggatgtcaatgatgaccatggccaaccattcacaactttcgatgctttttgggaaagatgccttaacatgccttatgacccacaatcaccttctctcccacctaaaaggattattccaggagatacatcaaggtgcccgagtgatacattggtgtttgaagatgaatcagagaagtcgagcaatgcacttcttgctcgagcatggtcacccgggtggagtaatgcagacaaggctttgacaacatttataaatggtccactgatcgagtactcagaaaatcgccggaaggctgacagtgccacaacctcatttctgtcccctcatttgcattttggtgaggtgagtgtcaagaaagttttccatcttgttcggatcaagcaagtgctttgggccaatgaaggaaataaggctggtgaagaaagtgttaacttgtttctcaagtctattgggcttagagagtattcaaggtatatcagtttcaaccatccatatagtcatgaaaggcctcttctaggccacctcaagttttttccttggatggtgaatgaaggctattttaaggcgtggagacaaggaagaacaggttacccattggtggatgctggcatgagagagttgtgggccactggttggcttcatgatcggatacgtgttgtagtttctagtttctttgtaaaggttctacagcttccttggagatggggaatgaagtatttctgggataccctgttggatgctgatcttgagagtgatgctcttggttggcagtacataactggtactctacctgatggtcgcgaatttgaccgaattgataatccgcagttcgagggatacagatttgaccccaacggagaatatgtaagacgctggcttcctgagctttccagattaccaactcaatggatacatcatccatggaatgcgccagaatctgtaatccaagctgctggtattgaacttggatcaaactaccctcttccaattgtgggaatagatgaagcaaaagcaagactgcaacaagcacttctacaaatgtggcaacaagaagcagcttatagagctgcaactgaaaatgggaccgaggaagggcttggagattcctttgagtcaacccctattgcttttcccgatgacatacaaatggaggaaagacatgaacctgttaggaacaatcctcctgctgctgcagctactcggcgctacgaggatcagatggtcccgagcatcacttcttccttggtgagagtggaagaggaagaaacttctttggatgttcaaaactcggcagaagagagcagagctgaagttccagtaaatgtgattgcacaacaaaatgcaagagagacagtgttgcgcactgctaccaggaacactcaactaccgcataacaatactacaatgtggttgagaaatgcagccgaagattctactgcagaatcttcaagtagtactaggagagaaaggggtggaggagaagttccggtgtggtctcccacagcttctagttacccagagccatttgtagatgatgaaaatggtataggacccagttcatcttacttgcagaggcatcctcagtctcaccaattgatgaattggacaaggttacctcagactgggtaattcacttctaaaacaagcagactagagaagcaggtaggtggaaagtgcattctcctcttcttccggaaagtgagacggagaacctcgcatcgggcatgcatatacttgtgttcatttcctacttcttaaaccagtcatgacatttattaatggctgacttccaaatgtgtatgaaaaattcaattcatacaggcagtttcatctgcagtctcttttgttttcttttacaatatgtgtaggcctacagtatagtatattttgtgcagtgaggaagaaggaaccactagtggatctttactcctctaataaactcatgtttgtgattatcatttcaggtagatatatcacttttataatctctgccttcttcacttaagtttaatagtgtaaagtttctttacattgtcatgaaaaatgttggactttctagataattgttgtgacagtcaagctttttaaatgatctagcaatataatattaggtgatagtgttttttggtgtgcattaaagttaaatcatgtatatattttctttcctgtgt

SEQ ID NO: 6307 - DNA, 3292 bp, Glycine max
cacaacttgtgtagaaatgcaagaaaggagagacgtggaagatggatttgttttatttatcgcatagtgcacaggataagagaaaaaacctaaaaatctagagaacaaaaaagttgtggctgcaatttgcctatcaattctttgtatcttcccctccgttaactaatcctattcacttcctctcttccttccttgttccttctaacctatccttctcatagtgtgtccattctgtcaaagcctttgggctttttcgtacaactaggtagtgaaagcaacaatatacgaatttttgatggaaaatactaataatttccaccaaaaacaccaatattgggagaaagaaatacaaccaaaacttaaaaagtcatcaactcaataatcacgctgtgctttcacctatttatggcttaaaatctcctgttaaacaagttagaaagaaaagccaagacaagaaagaaagaaagaaaaaggtagagaaggagagagagagagagagaaagaaaactgaaaaaaaaaaaaaaaagataagactaattaactacatttttggtttggtttttcttcatctcgcaggagacacgaagagacaagttacatcacatggttaaaacttgtttaaagagttttgtgtttgtgtgtgtgaaagtagtttaaggttgtgggggtggttgaagtttttagctttagctttgcagagatgtcaggtggtggatgcagcagcatagtgtggttcagaagagatctgaggatagaagacaatccagcactgacagcaggagtgagagctggtgctgttgttgcagttttcatatgggcacctgaagaagaaggacaatactaccctggcagggtctctagatggtggctcaagaacagtttggctcaccttgattcctctctcaggaatcttggcactcctctcatcactaagcgatccactgatactctttcttctctatttgaggttgttaagtccactggagccactcaactcttttttaatcatttatatgatcctctgtcacttgtcagggatcaccgagcaaaggaggttctgactgctcagggcataacagtacgttccttcaacgcggacttattatatgaaccatgggatgtgaatgatgcacatggccgaccattcacaacttttgctgctttttgggaaagatgtcttagcatgccttatgaccctgagtcacctcttctcccacctaaaaggataattccaggtgatgcatcgaggtgccctagtgatacattgctgtttgaagatgaattagagaaggcaagcaatgcacttcttgctcgagcgtggtcacccgggtggagcaatgctaacaaggcattgacaacattcataaatggtccactgattgagtactcaaaaaaccgcaggaaagcagacagtgccactacctcacttctctcaccccatttgcactttggtgagttgagtgtcaagaaggtcttccatctagtccgcatcaaacaagttttgtgggccaacgaaggaaacaaagctggtgaagagagcgtgaacttgttcctcaaatctataggtcttagagaatattcaaggtacattagtttcaaccatccctacagtcatgaaaggcctcttctaggccaccttaagttctttccttgggttgtaaatgaaggatattttaaggcatggagacaaggaagaactgggtaccctttggtggatgctgggatgagggagttgtgggccactggttggctgcatgatcgaatacgtgttgtagtttctagtttctttgtgaaggttctgcagcttccttggagatggggaatgaagtatttctgggatacccttttggatgccgatcttgagagtgatgctcttggttggcagtacatatctggtagtctccctgatggtcgtgaaattgaccgaatagataatccacagtttgagggctacaaattcgacccaaatggagaatacgtgcgacgctggcttccagaactttcaagattacccactgagtggatacatcatccttggaatgcaccagagtcagtgctacaagctgctggaattgagctaggatcgaactatcctcttccaattgtgggaatagatgcagcaaaaaacagattactagaagcactatcaaaaatgtggcaacaagaggcagcttcaagagctgcaatggaaaatggaacggaggaaggacttggagactcttctgaatcagttcctgctgcttttcctcaagacacgcgaatggaggaaactcatgaacctgttaggaacaatccccttcccattgctcggcgctaccaagatcagatggttccaagcatcacttcttccttgttgagagtggaagaggaagaaacgtcttctgatcttcgaaactcagcagaagagagcagcagagctgaagtgccagtaactgcaaatgcacaacaaaatgcaggagttgcattgaacgaacggatgttgcagaccactaataggaatacacaaacccaatacaatactacgatggacctgagaaatgtagctgatgattctgcagtagaatcttcaagtggtaccaggagagaaagggatggaggtttagttccagtatggtctccaccagcttccagttactcagaacaatttgtaggagatgaaaatggtataacaagcagttcatcttacttgcaaaggcatcctcaatctcaccaaatgctgaattggaagcagctacctcaaactgggtaattcatatataaagcaattagactagatggagggaggtggaagttacgataccactcttctgttgagacttgagagaaagtggggtgttgaagccacattggacacacatgttttaatttcctactcttttatcagtagctgacctccaatgtgtatggaaatttcaattcatacggaagttcatctgcagtccctattgctttcttgtacaatatttgcaacttgctgtatagtatagtttgtgtagtgagggagaaagagccaccataggatctttggtctgctaataaactcagatttgtgctttcacttaaggcggatatattaattatgatccgagctttatttacatttcctgtgctctacatctctgttgatcactgtaaaatgcacctcatcttgttgctctcatttctgaaactcctgcagcatattgatctacactgctaaaagacctcatcttgttgattttttttcagctatgataactgctgttaaagaatgtggactactagacttcataactgctaatttttagaaaca

SEQ ID NO: 6308 - DNA, 2784 bp, Populus trichocarpa
tggagctgtatttagcaatgataaaaagataacaagagataatagattctctctcctctcatagtatcgaaaaagtataacccagaagcagaagggataatatcattaacagcaaattgttggtgagtttctaaagaaggcagcaagacaggaaaagtcgatatggcatacagtaactgatatagcaaagagaaagagaaagtgactatccttcttttttctctttctcttagagagagatgtcaggtggtggctgtagtatagtttggtttaggagagatctaagggtagaagataacccagcacttgcagctggtgtaagagcaggtgcggttgttgcagtgtttgtatgggcacctgaagaggaaggccattattatcctggtagggtctcaaggtggtggcttaaacaaagtttggctcatcttgactcttctttaaggagtcttggtacttctcttgttactaagagatcaaccgatagtgtttctactcttcttgaggttatcaaatctactggggctactcagctcttcttcaaccacttatatgatcccctgtcgctggttagggatcatcgggcaaaggaggttttgactgctcaaggtattgctgtaagatcttttaatgcagatttactttatgaaccatgggatgttaatgatgcccaaggccgtcccttcacaacctttgctactttctgggatagatgcctcagcatgccttttgatccagaggctccacttctcccgcctaagaggattatttcgggtggtgcatctagatgcccttcagagatgctggtatttgaagatgaattggagaaaggaagcaatgcacttcttgccagagcatggtcacctggatggagcaatgctgatagggctctgaccactttcattaatggaccattaattgagtactctaagaatcgtaggaaggctgatagcgctacaacctcatttctctctccgcacttgcattttggggaggtgagtgtgagaaaagtcttccatcttgttcgcataaagcaggttctgtgggcaaatgaagggaacaaggctggcgaagagagtgtaaacttgtttctcaagtcaattggtcttagggaatattcaagatacttgagtttcaaccatccttacagtcatgaaaggcctcttcttgggcaccttaagttcttcccttgggtcgtggacgaaggctattttaaggcatggagacaaggtagaacaggttatccattagttgatgctgggatgagagaattgtgggccaccggttggctgcatgatcgtatacgtgtggttgttgctagtttctttgtgaaggttctacaacttccgtggagatggggaatgaagtatttttgggataccctattggatgcagatttagagagtgatgctcttggttggcaatacataaccggcactctcccagatggccgggagtttgatcgcatagataatccacagtttgagggttacaaatttgacccaaatggagaatacgtacgccggtggcttcctgaacttgctaggctaccaactgaatggatacaccacccatggaatgcacctgaatctgtacttcaagctgctggtattgagctgggatcaaattatcctctccctattgtagggatagatgcagcaaaggtcaggttggaagaagcactttcagaaatgtggcagcaagaagctgcttcaagagctgcaattgagaatggaactgaggaagggcttggagactcttctgaatcagctccaattgccttccctcaagacataaatatggaggaaaaccatgagcctgtgagaaacaatcctcctgctacaaatcgccgctatgaggatcagatggtcccaagcatgacctcttcttttctgagaattgaagacgaagaaacttcttcagatgttcgcaattctacaggagatggcagagcagaggtaccaagagatgtaaatgtaaatcaacaaccaagaagagacactttgaaccaggggtttgtgcaaagtgttcataatgacaacagtttgccaccatttaacgttttgagaggtccggcaaatgttgaagactcaacagcagaatcttcgagcagtagtaggagagagagggatggaggtatagttccagtttggtcccctccagcttctagttactcagagcagtttgttggtgatgaaaatggaattggggcaacttcttcttacttgccgaggcatccacaatctcaccagatactcaattggaggcggctaccccaaaccgggtaaacatatattcatggtgagagcggggaggtggagacccaatgatgctcaatttcttacgagtcaatgtgttgataaaccagagtcccttgtttatctttatccacgtatgttctcgccattctaatatgattagtagttggacatccaatctgtatgatacaccaaaatgattcaggcatctcatctgctatcccctttttctgtacttggctgttccatatatgtagatacgctgtatagtatttataaacgaaggatgagagtgctggtaggggcatgtagttatctaataaacccatgtttgtgctttcttacttgactaggaagatgattttctgtaattcaagcttgttatctttactttccatttcctttgaaagatgctccttcctgggctccgattgttttctgttgtgaaatgttggccagcttagctttttgtgttgaaatcattgctagggtcaaaatatagctcgagtgagatgttatactcttctgc

SEQ ID NO: 6309 - DNA, 2928 bp, Lupinus angustifolius
gcagtttctctatcaattcaattatttctatccccccactagttaaccaatcttcttcacttcctcttcctttcaccatttttctctcttctctctctttggaccccgtttctcttttcgctacttccaacttgggtgaaagaaccaaattaagaatctactggaagaaaattctctcacctaaacaaatgctaaagtgtaggaggaaagacaagtaaaagatatcaacttgtgcttttattatctctttatgtcttaacatcttccttagtaaggaaaacccatataaaggaataaaaaaaggaaggttggtggagatgtcaagtaatggatgcagcatagtttggtttagaagggatctgagggtggaggataacccagcactgatggcaggagtaagagcaggagctgttgttgctgttttcatatgggctcctgaagaagaaggtcaatatcaacctggaagggtttcaaggtggtggctgaaacacagtttggcttatcttgattcatctttgagaaatcttggcactcctcttatcaccaagagatccactgatagtgtttctgctctattagaagttgttaagtccactggtgctactcaacttttctttacccatttatatgatccattgtcacttatcagggatcaccgagcaaaggaggttctgagtgctcatggtataacagtacgttcctttaattcagacttattgtatgaaccatgggatgtcaatgatgaacatggccaaccattcacaacttttgatgctttttgggaaagatgccttaacatgccttatgacccaccagcaccttttctcccacctaaaaggattattccaggagatatatcaaggtgctcttgtgatgcattggtgtttgaagatgaatcagagaaggcaagcaatgcacttcttgctcgagcatggtcccccgggtggagcaatgcggacaaggccttgacgacattcataaacggtccactaattgagtattccgaaaatcgcaggaaggctgacagtgccacaacctcatttctctcccctcatttgcattttggtgaggtgagtgtcaagaaagttttccatcttgttcggattaagcaagtgctatgggccaatgaaggaaacaaggctggtgaggaaagtgtgaacttgtttctcaagtctattggtcttagagagtattcaaggtacgtaagtttcaaccatccctatagtcatgaaaggcctcttctaggccacctcaagtttttcccttgggtagtcaatgaaggatattttaaggcatggaggcaaggcagaacaggctaccctttggtggatgctggcatgagagagttgtgggccactggttggcttcatgatcggatacgtgttgtagtttcgagtttcttcgtgaaggttctgcagcttccttggagatgggggatgaaatatttctgggataccctcttggatgctgatcttgagagtgatgctcttggttggcagtacataactggtactctacccgatggtcgcgaatttgacagaatagataatccacagtttgagggatacaaatttgatccgaatggagaatatgtacgacgctggcttcctgagctttccagattaccaactcaatggatacatcatccatggaacgcaccagaatcggtactccaagctgctggtatagaacttggttcaaattaccctcttccgattgtggcaatagacgaagcgaaagcaaggttgcaagaagcacttatacaaatgtggcaacaagaagcagcttatagagctgcaactgaaaatggaactgaggaagggcttggagagtcatttgagtcaactccaattgcttttcctgaggacatacaaatggaggaaggacatgaatctgttaggaacaatacccctgcagcatcgactcggcgttacgaggatcagatggtcccaagcatcacttcttcattggtgagagtggaaggggaagaaacttctttggatgttcaaaactcagcagaagagagcagagctgaagttcctataaatgtgaatgcacaacaaaatacaagagagacagtgtttcacactgctaacagaaacactcaactacagcataataacaataatacaacgtggtttcgaaacggagccgaagattccacagcggaatcttcaagtagtactaggagagaaagggatggaggagaagttccggtatggtctccgacgacttctagttacccagagccatttgtagatgatgaaaatggtttaggaggcagttcatcttacttgcagaggcatcctcagtctcaccaattgatgaattggacaaggttacctcagactgggtaattcacttctaaaccaagcagactaggtaggtggaaaatgcactctcctcttcttttggaaagtgtgatggcaaacttctcaatgaatgaacatacatatacatgtgttcatttcctacaccttaaaccagcatgacatttgattaagcctgacttcaaaatgtgtatgaaaatttcaattcatacaggcagtttcatctgcagtctcttttgttttcttatacaatatgtgtaagcctactgtatagtatattctgtgcagtgagggagaaagagccactattggatctttagtcctctaataaactaaggtttgtgattatcatttaaaggtaaatatgtcactttataatctctgcgttcttcacatgagtttaatagtgaaaagtttctttacattactagtatcatttaatgatgtgatagtcaaactttttaaatgatctagcaatataagaataggtgatagtgtttttttttgtgtgcatcaaaatgaaatcatgtataaatttctttcctgtgtaactctattgccactataaagtccactcattggtgcacacatttctgaa

SEQ ID NO: 6310 - DNA, 2911 bp, Glycine max
ctatccttctcactgtgtccattctgtcaaagcctttgggctttttcgtacaactaggtagtgaaagcaacaatatacgaatttttgttgaaaatactactaataatttccaccaaaagcacaaatgttatgataaaaaatacaagcaaaacgtaataagtgccaaaacttaaaaagtcatcaacccaataatcacactgtgcttacacctatttatggcttaaaatctccctttaaacaagttagaaagaaaagccaagacaagaaaagaaaaaaagggagagaagcagaaagagagagagagagaactgaaaaaagaaaagaaaagataagactaattaacgtttttttggtttggttttcttcaacacgcaggagacacgaagtaaagagacaagttacatcagatggttaaaacttgttaaaagagtttgtgtatgtgtgtgaaagtagtttaaggttgtgggggtggttgaagaagttttttagctttgtagatagagatgtcaggtggtggaggcagcatagtgtggttcagaagagatctgaggatagaagacaatccagcactgacagcaggagtgagagctggtgctgtggttgcagttttcgtatgggcacctgaagaagaaggtcaatactaccctggcagggtctctagatggtggctcaagaacagtttggctcatcttcattcctctctgaggaatcttggcactcctctcatcactaagcgatccactgacactctttcttctcttcttgaggttgttaagtccactggagccactcaacttttttttaatcatttgtatgatcccctgtcacttgtcagggatcaccgagcaaaggaggttctgactgctcagggcataacagtacgttccttcaatgcggatttattatatgaaccatgggaagtgaatgatgcacatggccgaccattcacaacttttgctgctttttgggaaagatgccttagcatgccttatgaccctgagtcacctcttctcccacctaaaaggataattccaggtgatgcatccaggtgtcctagtgatacattgctgtttgaagatgaattagagaaggcaagcaatgcacttcttgctcgagcatggtcacctgggtggagcaatgctaacaaggcattgacaaccttcataaatggtccactgattgagtactcaaaaaaccgcaggaaagcagacagtgcaactacctcacttctgtccccccatttgcactttggtgagttgagtgttaagaaggtcttccatcttgtccgcatcaaacaagttttgtgggccaacgaaggaaacaaagccggcgaagagagcgtgaacttgttcctcaaatctataggtcttagagaatattcaaggtacattagtttcaaccacccctacagtcatgaaaggcctcttctaggccaccttaagttctttccttgggttgtaaacgaaggctattttaaggcatggagacaaggcaggactgggtaccctttagtggatgctgggatgagggagttgtgggccactggttggctgcatgatcgaatacgtgttgtagtttccagtttctttgtgaaggttctgcagcttccatggagatggggaatgaaatatttctgggacacccttttggatgcagatcttgagagtgatgctcttggttggcagtacatatctggtagtctccctgatggtcgtgaaattgaccgaatagataatccacagtttgagggatacaaattcgaccctaatggagaatatgtgcgacgctggcttccagaacttgcaagattaccaaccgagtggatacatcatccttggaatgcaccagagtcagtgctacaagctgctggaattgagttaggatcgaactatcctcttccaattgtgggaatagatgcagcaaaaaccagattactagaagcgctatcagaaatgtggcaacaagaggcagcttcaagagctgcaatggagaatggaactgaggaaggacttggagactcttctgaatccgttcctgctgcttttcctcaagacatgcaaatggaggaaactcatgagcctgttaggaacaatccccttcctgttgctcggcgctaccaggatcagatggttccaagcatcacttcttccttgttgagagtggaagaggaagaaacttcttctgatcttcgacactcggcagaagagagcagcagagctgaagtgccagtaactgcaaatgcacaacaaaatgtaggagttacattgaatgaacggatgctgcagaccactaataggaatgcacaaacacaatacaatactacaatggagctgagaaatgtagctgaagattcagcagtagaatcttcaagtggtaccaggagagaaagggatggaggtgtagttccagtatggtctcccccagcttctagttactcagaacaatttgtaggagaggaaaatggtataacaaacagttcatctttcttgcaaaggcatcctcagtctcaccaaatgctgaattggaggcagctacctcagactgggtaattcatatctaaagcaattagactagaagcaaggaggtggaaattacactaccacttttctgttgagagaaagtgaggtgttgaagccccattgaacatacatgtgttaatttccttctcctttaccaccacctgacctccaatgtgtatggaaatttcaattcatacggcagttcatctgcagtcccttctgctttcttgtacaatatttgcaacttgctgtatagtatagtttgtgtagtgagggagaaagagccaccataggatctttggtctactaataaactcagatttaaaatgttacatctaaaaaatactatttatttttatcaaagtatatttatataattttatttatattca

SEQ ID NO: 6311 - DNA, 2681 bp, Glycine max
cttacacctatttatggcttaaaatctccctttaaacaagttagaaagaaaagccaagacaagaaaagaaaaaaagggagagaagcagaaagagagagagagagaactgaaaaaagaaaagaaaagataagactaattaacgtttttttggtttggttttcttcaacacgcaggagacacgaagtaaagagacaagttacatcagatggttaaaacttgttaaaagagtttgtgtatgtgtgtgaaagtagtttaaggttgtgggggtggttgaagaagttttttagctttgtagatagagatgtcaggtggtggaggcagcatagtgtggttcagaagagatctgaggatagaagacaatccagcactgacagcaggagtgagagctggtgctgtggttgcagttttcgtatgggcacctgaagaagaaggtcaatactaccctggcagggtctctagatggtggctcaagaacagtttggctcatcttcattcctctctgaggaatcttggcactcctctcatcactaagcgatccactgacactctttcttctcttcttgaggttgttaagtccactggagccactcaacttttttttaatcatttgtatgatcccctgtcacttgtcagggatcaccgagcaaaggaggttctgactgctcagggcataacagtacgttccttcaatgcggatttattatatgaaccatgggaagtgaatgatgcacatggccgaccattcacaacttttgctgctttttgggaaagatgccttagcatgccttatgaccctgagtcacctcttctcccacctaaaaggataattccaggtgatgcatccaggtgtcctagtgatacattgctgtttgaagatgaattagagaaggcaagcaatgcacttcttgctcgagcatggtcacctgggtggagcaatgctaacaaggcattgacaaccttcataaatggtccactgattgagtactcaaaaaaccgcaggaaagcagacagtgcaactacctcacttctgtccccccatttgcactttggtgagttgagtgttaagaaggtcttccatcttgtccgcatcaaacaagttttgtgggccaacgaaggaaacaaagccggcgaagagagcgtgaacttgttcctcaaatctataggtcttagagaatattcaaggtacattagtttcaaccacccctacagtcatgaaaggcctcttctaggccaccttaagttctttccttgggttgtaaacgaaggctattttaaggcatggagacaaggcaggactgggtaccctttagtggatgctgggatgagggagttgtgggccactggttggctgcatgatcgaatacgtgttgtagtttccagtttctttgtgaaggttctgcagcttccatggagatggggaatgaaatatttctgggacacccttttggatgcagatcttgagagtgatgctcttggttggcagtacatatctggtagtctccctgatggtcgtgaaattgaccgaatagataatccacagtttgagggatacaaattcgaccctaatggagaatatgtgcgacgctggcttccagaacttgcaagattaccaaccgagtggatacatcatccttggaatgcaccagagtcagtgctacaagctgctggaattgagttaggatcgaactatcctcttccaattgtgggaatagatgcagcaaaaaccagattactagaagcgctatcagaaatgtggcaacaagaggcagcttcaagagctgcaatggagaatggaactgaggaaggacttggagactcttctgaatccgttcctgctgcttttcctcaagacatgcaaatggaggaaactcatgagcctgttaggaacaatccccttcctgttgctcggcgctaccaggatcagatggttccaagcatcacttcttccttgttgagagtggaagaggaagaaacttcttctgatcttcgacactcggcagaagagagcagcagagctgaagtgccagtaactgcaaatgcacaacaaaatgtaggagttacattgaatgaacggatgctgcagaccactaataggaatgcacaaacacaatacaatactacaatggagctgagaaatgtagctgaagattcagcagtagaatcttcaagtggtaccaggagagaaagggatggaggtgtagttccagtatggtctcccccagcttctagttactcagaacaatttgtaggagaggaaaatggtataacaaacagttcatctttcttgcaaaggcatcctcagtctcaccaaatgctgaattggaggcagctacctcagactgggtaattcatatctaaagcaattagactagaagcaaggaggtggaaattacactaccacttttctgttgagagaaagtgaggtgttgaagccccattgaacatacatgtgttaatttccttctcctttaccaccacctgacctccaatgtgtatggaaatttcaattcatacggcagttcatctgcagtcccttctgctttcttgtacaatatttgcaacttgctgtatagtatagtttgtgtagtgagggagaaagagccaccataggatctttggtctactaataaactcagatttaaaatgttacatctaaaaaatactatttatttttatcaaag

SEQ ID NO: 6312 - DNA, 2903 bp, Quercus alba
gaagtactagaagataagagctaaaccaaacctatccacctcaaaatcaaatgtactttattcttgtttatggcctaaaatcccctccttatattaccagaaagtatagagaaaaggcaaaaagctaaagattacttacaacacccttggtctgctcagaggagagagagagagagtttatgatttggtttgtaaattttttttggagatgtcaggtggtgggtgtagcatagtatggtttagaagagatctgaggctagaagacaacccagctttacaagctggagtgagagcaggtgctgtggttgctgttttcatatgggcacctgaagaggaaggccactactaccctggaagagtttcaaggtggtggcttaatcacagtttggctcaccttgattcctctttgagaagccttggcacttctctcatcaccaaaagatccactgacactatttcttctctacttgaggttgttaagtccactggtgctagtcaactcttcttcaaccacttatatgatcctttgtcacttgttagggatcaccgtgcaaaggaggttttaacagctcaaggcatagctgttcgttccttcaatgcggatttgctctatgaaccttgggatgttaatgatgcccatggccgcccattcacaacttttgctgccttttgggaaagatgcctcagcatgccttatgaccccgagtctccacttcttccacccatgaggatagtttcaggtgatgtatcaaggtgcccttctgatgcattagtgtttgaggatgaatcagagaagggaagcaatgcactccttgctcgagcatggtcacctgggtggagcaatgctgataagactctgactacattcatcaatggaccattaatagagtattctaaaaatcgcagaaaagctgatagcaatacaacctcacttctatctccccacttgcattttggggaggtgagtgtgagaaaagtatttcatcttgtccgtatcaagcaggttctgtgggccaatgaaggcaaccaggctggggaagagagtgtcaacttgtttctgaaatctattggtcttagagaatattctaggtacttttgttttaaccatccatatagtcacgaaaggcctcttcttgggcaccttaagtacttcccttgggtcgtgaatgaaggttattttaaggcatggagacaaggtagaactggttatccattggtggatgctggcatgagagagttatgggccactggctggctgcatgatcgaatacgagtagtggtttctagtttttttgtgaaggttctgcaacttccatggagatggggaatgaagtatttctgggatacactcttagatgcagatcttgagagtgatgctcttggttggcagtatatatctggtactcttcctgatggccgtgaatttgaccgcatagataatccacagtttgagggttacaagttcgaccctcatggagaatatgtacgacgttggcttcctgaacttgctaggataccaactgaatggatacaccacccatggaatgcaccagaacctgtcctccaagctgctggaattgagctggggtcaaactaccctcttcctattgtagggatagatgcagcaaaagccaggttgcaagaagcactatcagagacgtggcaacaagaagcagcttcaagagctgtaattgaaaatggaactgaggaagggcttggagactcctctgaatcaaccccaattgcctttcctcaagatatacaaatggcagagaatcatgaaccagtgaggaacaacccccctaccacaattcggcgttatgaggatcagatggtcccaagcatgacttcttctttggtgagagtggaagaggaagaaccttctttggatattcaaaatttggcagcagatagcagagctgaagtcccaaccgatggacatgtaaatcaagaagcaacaagaaacacattaaacccagcagttgttcagaatgttcatagccacaatcttccacaatttaatactccaatagtgctgaggaatgctgcagaagactccacagcagaatcatctagtagtattaggagagagagggatgggggtgtagttccagtttggtctccttcaacctcgagttactcagagcagtttgtaggtgatgaaaatggtattggaactagttcatcgtacttgcagaggcatcctcagtctcaccaaatagttaattggaggcggctatctcaaactgggtagaacatatacgcactagaagactagtagctcagaggtgaagatatgtgtcatgcaatcctgtgggccaatgggatggtgaaccaacaccccacatacttctttcaccacctttctttcctttcttgttgtaccatatatgctgtatagtaaatgttgtctttgtaagggaagaggagagtcataatagggatgtgtagttctccaataaaccaggtttgtgctttctcattttattaagtaggctgatattttattctagtttgtgtttatattatccacatattctcccctatgcaacattgctgacttctttaggctcaaggaagtaaattgaaatttaactaggctatgacaggcttgaagtatatagtagcttcttatattaaaaaatgttccggccttgcacttgactagtactttcagattgttttcttgttttatgaagattcattttttgtatcccctttttaaaaagttaaatctcatgagatattgagtagaaagaggtgaaaaaatccaatcggtatcaaagaatgatttgaactatgattttctgatatttagcttggctggatctttccagcacatttctttttgcactgtcactaagaattgtaatagagttgctcagtattgagcttcttatgct

SEQ ID NO: 6313 - DNA, 2627 bp, Theobroma cacao
aaattcaaccaaaaaaccaaggagagaaaaacatagatacataataaataagcaactagaggtaaaagataagtaccacacctctctctcccacttataatctcatgcactttttcctcccattaataataatactaaaaagctactcctgttggcagaagcaaaaaagataagatttttaattagacaacaagaactgcctggccatggtatatagttgagaaaagatagaaggtaggtttcgttttgccagtttttgtttgatgagctttgggagatatgtcaggtggtgcttgtagcatagtttggttcaggagggatctcagagttgaagataatccggcacttgcagctggtgttagagcaggtgctgttgtggcagtttttatatgggcacctgaagaagaaggccattattaccctgggagggtgtcaaggtggtggcttaagcagagtttggctcatcttgattcttctttgaggagtctcggtacttgtctcatctcaaagagatctactgagagtgtgtcttctcttcttgaggttgttaaatctactggtgctactcagctcttcttcaatcacttgtatgatcctatatcactggttagggatcatcgtgcaaaggaggtattaacagcccatggtgtagcagtgcgatctttcaatgcagatttactttatgaaccctgggatgtaaatgatgctcagggccgccctttcactacttttgctgctttctgggaaaaatgccttagcatgccctatgaccctgaggctccacttcttccacctaagagaataatctcaggtgatgtgtcaaactgcccttcgcatccattggcgtttgaagatgaatcagagaagggaagcaatgcacttctagctcgagcatggtcacctgggtggagcaatgctgataaggcattgaccacattcattaatggacctctaattgagtactctaagaatagaagaaaggctgatagtgctacaacctcatttctctctccccacttgcattttggggaagtgagtgtgagaaaagtctttcatcttgtccgcatcaagcaggttctatgggccaatgaagggaacgaggctggagaagagagtgtgaacttgtttatcaagtcaattggactgagggaatattcaagatacttgagttttaaccatccttacagtcatgaaaggcctcttctcgggcatcttaagtttttcccttgggtagtggatgagggctattttaaggcatggagacaaggtagaactggttatccactggtggatgctggcatgagagagttgtgggccactggctggctacatgaccggataagagttgtagtttctagtttctttgtaaaggttctgcagcttccttggagatggggtatgaagtatttttgggataccctcttggatgcagacttagaaagcgatgctcttggttggcagtatatatctggtactcttccagatggtcgtgagtttgaccgcatagataatccacagtttgagggttacaagtttgacccacatggagaatatgtccgacggtggcttcctgaactggcaagactgccaactgattggatacatcatccatggaatgctcctgaatctgtactccaagctgctggaattgagcttgggtcaaattaccctctacctattgtaggaatagatgctgcaaaagccaggttgcaagaagcactttcagagatgtggcaacaagaagcagcatcaagggctgcaattgaaaatggaactgaggagggccttggagactcttctgaatcagcgccatttgcctttcctcaagacatacaaatggaggaaaaccttgaaccagcaaggaacaatgctccagctacaacccggcgttatgaggatcagatggttcctagcatgacttcttctttggtgagaggagaagatgaagaaccttctttggatcttagaacttcagcagaagagagcagagcagaagttccaagaaatttaagtatggatcaagaaccacgaagagacatattaaaccaaggagttccacaaacagttcgtaacagtaacacttttctgcaatttaatatcccaacgggggtgggaaatgctgaggattccacagcagaatcttctagtagtagtggtaggagagagagggatggaggagttgttccagtttggtctcctccagcttctagttattcagagcagttcataggtgatgaaaacggtattggtgggagctcatcttatttgcagaggcatccacggtcccaccaaatagttaactggaggcgtttatctcaaactgggtgaaacagatacaccccaaaagactggaatcttgcagttggagaatgccaaaatgcccttgtgggctaatgggatgatagcatgcctctttatctacccccatctgtcagtcaccaatctaacttgatcagcagttgacctgctatgtgtatgaaacttaaaattgatacagcagctgatctgctctcgttttccccctattgtatcatatgcatagttctgctgtatagtattttgtcttaagaaaggggaaagagtcatggtagaaatgtgtagtcctctaataaaaccaggtttgtgta

SEQ ID NO: 6314 - DNA, 2783 bp, Theobroma cacao
ctctctctccaaggggcaagccaagtcctttttggttgcacctggtcctcaaaggctacaaccgggattcatttgtagaaattcaaccaaaaaaccaaggagagaaaaacatagatacataataaataagcaactagaggtaaaagataagtaccacacctctctctcccacttataatctcatgcactttttcctcccattaataataatactaaaaagctactcctgttggcagaagcaaaaaagataagatttttaattagacaacaagaactgcctggccatggtatatagttgagaaaagatagaaggtaggtttcgttttgccagtttttgtttgatgagctttgggagatatgtcaggtggtgcttgtagcatagtttggttcaggagggatctcagagttgaagataatccggcacttgcagctggtgttagagcaggtgctgttgtggcagtttttatatgggcacctgaagaagaaggccattattaccctgggagggtgtcaaggtggtggcttaagcagagtttggctcatcttgattcttctttgaggagtctcggtacttgtctcatctcaaagagatctactgagagtgtgtcttctcttcttgaggttgttaaatctactggtgctactcagctcttcttcaatcacttgtatgatcctatatcactggttagggatcatcgtgcaaaggaggtattaacagcccatggtgtagcagtgcgatctttcaatgcagatttactttatgaaccctgggatgtaaatgatgctcagggccgccctttcactacttttgctgctttctgggaaaaatgccttagcatgccctatgaccctgaggctccacttcttccacctaagagaataatctcaggtgatgtgtcaaactgcccttcgcatccattggcgtttgaagatgaatcagagaagggaagcaatgcacttctagctcgagcatggtcacctgggtggagcaatgctgataaggcattgaccacattcattaatggacctctaattgagtactctaagaatagaagaaaggctgatagtgctacaacctcatttctctctccccacttgcattttggggaagtgagtgtgagaaaagtctttcatcttgtccgcatcaagcaggttctatgggccaatgaagggaacgaggctggagaagagagtgtgaacttgtttatcaagtcaattggactgagggaatattcaagatacttgagttttaaccatccttacagtcatgaaaggcctcttctcgggcatcttaagtttttcccttgggtagtggatgagggctattttaaggcatggagacaaggtagaactggttatccactggtggatgctggcatgagagagttgtgggccactggctggctacatgaccggataagagttgtagtttctagtttctttgtaaaggttctgcagcttccttggagatggggtatgaagtatttttgggataccctcttggatgcagacttagaaagcgatgctcttggttggcagtatatatctggtactcttccagatggtcgtgagtttgaccgcatagataatccacagtttgagggttacaagtttgacccacatggagaatatgtccgacggtggcttcctgaactggcaagactgccaactgattggatacatcatccatggaatgctcctgaatctgtactccaagctgctggaattgagcttgggtcaaattaccctctacctattgtaggaatagatgctgcaaaagccaggttgcaagaagcactttcagagatgtggcaacaagaagcagcatcaagggctgcaattgaaaatggaactgaggagggccttggagactcttctgaatcagcgccatttgcctttcctcaagacatacaaatggaggaaaaccttgaaccagcaaggaacaatgctccagctacaacccggcgttatgaggatcagatggttcctagcatgacttcttctttggtgagaggagaagatgaagaaccttctttggatcttagaacttcagcagaagagagcagagcagaagttccaagaaatttaagtatggatcaagaaccacgaagagacatattaaaccaaggagttccacaaacagttcgtaacagtaacacttttctgcaatttaatatcccaacgggggtgggaaatgctgaggattccacagcagaatcttctagtagtagtggtaggagagagagggatggaggagttgttccagtttggtctcctccagcttctagttattcagagcagttcataggtgatgaaaacggtattggtgggagctcatcttatttgcagaggcatccacggtcccaccaaatagttaactggaggcgtttatctcaaactgggtgaaacagatacaccccaaaagactggaatcttgcagttggagaatgccaaaatgcccttgtgggctaatgggatgatagcatgcctctttatctacccccatctgtcagtcaccaatctaacttgatcagcagttgacctgctatgtgtatgaaacttaaaattgatacagcagctgatctgctctcgttttccccctattgtatcatatgcatagttctgctgtatagtattttgtcttaagaaaggggaaagagtcatggtagaaatgtgtagtcctctaataaaaccaggtttgtgtatttactcttaactgattaggaagttatttattgtaattcatatttgtgctacctatttgtttttccagctttgaccac

SEQ ID NO: 6315 - DNA, 2564 bp, Citrus clementina
aaaaagtgtaattgtgacatcaaggacaccttttttattccttcttttttagtttattgctttatggtctaaaatctccagggaaaaaaataaaaaaccggagggaccaaaaaaagataagatttaactgatgaaagacatggtgtacataactgagacataaattataggaagtgggtttgttttggatttttggttggtggtgagttttgttggagatgtcaggtcgtggttgtagcatagtttggttcagaagagatctaagagttgaagataatccagcactagcagctggtgttagagctggtgctgtaattgctgttttcatttgggcacctgaagaagagggtccttattatcctgggagagtgtctaggtggtggctcaagcacagcttgtctcatctggattcttctttgaggagtcttggtacttctcttgtcactaagagatcaactgatagtgtttcttctcttcttgaggttgttaaagctactggtgctactcagctcttcttcaaccatttatatgaccccctgtcgctggttcgagatcaccgagctaaggaggctctaactgctcaaggaatagctgtgcgctcctttaatgctgacttgctctatgagccgtgggatgtaaatgatgcccaaggccaacctttcgcgacctttgctgctttctgggagaaatgccttagcatgccttttgaccctgacgctccacttctccctcctaagaggataaattcaggtgatatgtccaggtgtccttcagatacattggtgtttgaagatgaatcagagaagggaagcaatgcacttcttgctcgagcatggtctcctggctggagcaatgctgataaggctctgaccactttcattaatgggcctttaattgagtactctaagaatcggagaaaggctgatagtgctacaacctcatttctctctccacatttgcattttggggaggttagtgtgaggaaagtcttccatcttgtccgcatcaagcaggtttcatgggccaatgaagggaacaaggctggtgatgagagtgtgaacttgtttctcaagtcaattggtcttcgggaatattcaaggtacatgagttttaaccatccttacagtcatgaaaggcctcttcttgggcaccttaagttcttttcttgggttgtggatgagggctattttaaggcatggaggcaaggtagaactggttatccactggtggatgctggcatgagagagttgtgggccactggttggcttcatgatcggatacgagtagtagtttctagtttctttgtaaaagttctacagcttccatggagatgggggatgaaatatttttgggataccctcttggatgcagatttagaaagtgatgctcttggttggcagtacatatctggtactatccctgatggccgtgcttttgaccgaattgacaatccacagtttgagggttacaagtttgaccccaatggagaatatgtacgacggtggctccctgaacttgccagactgcccactgaatggatacaccacccatggaatgcaccagaatctgtgctccaagctgctggcattgagctgggttccaattacccttttcccatagtacggattgacgcagcaaaatgcaggctggacgaagcactttcagaaatgtggcagcaagaagcagcttcaagagctgcaattgagaatggaactgaggaaggtcttggagactcctctgactcagccccaattgcctttcctccggacatacagatggaggaaatccctgaacctgctaggaacaaccttcctaccacagctcggcgttatgaggatcagatggtcccaagcatgactacttctttggtgagagttgaagaggaagagtcttctttggagcttcgaaattcagcagaagaaagcagagcagaagtgccgagaaatgcaaatgtaaatcaagaacctagaagggacactttaaaccaaggtgttctccaaactgttcataacaacaacgcttttcaacaatttaatgccgcaatagtgctggcaaatgctgaagactccacagcagaatcttcaagtactagtagaagagagagagacggaggggtggttccagtttggtctcctgcaacttctagttactcagagcagctagtaggtgatgaaaatggcattggaacgagttcatcttacttgcagaggcatccacagtctcaccaaataatgaattgtaggcggctttctcaaactgggtaagacatatgtacatatgtagatgacacaaactggaagctgggaagatgaaagatgaaatgatttcccaatccaatgcgccaaagggatgataaaccagtgtcacatgttatctttatccacccacttttcatctcaatagtataaaactgatagttcacttcctgcggctgaaactccatgtcagtacaggtttggcgagttgcaggataggttcttgttctgaaatgctactacctggtattttggaattcattttgaggttcgctattatatgttttcctgaaaagaggaaagaaaatt

SEQ ID NO: 6316 - DNA, 2564 bp, Citrus sinensis
aaaaagtgtaattgtgacatcaaggacaccttttttattccttcttttttaatttattgctttatggtctaaaatctccagggaaaaaaataaaaaaccggagggaccaaaaaaagataagatttaactgatgaaagacatggtgtacataactgagacataaattataggaagtgggtttgttttggatttttggttggtggtgagttttgttggagatgtcaggtcgtggttgtagcatagtttggttcagaagagatctaagagttgaagataatccagcactagcagctggtgttagagctggtgctgtaattgctgttttcatttgggcacctgaagaagagggtccttattatcctgggagagtgtctaggtggtggctcaagcacagcttgtctcatctggattcttctttgaggagtcttggtacttctcttgtcactaagagatcaactgatagtgtttcttctcttcttgaggttgttaaagctactggtgctactcagctcttcttcaaccatttatatgaccccctgtcgctggttcgggatcaccgagctaaggaggctctaactgctcaaggaatagctgtgcgctcctttaatgctgacttgctctatgagccgtgggatgtaaatgatgcccaaggccaacctttcgcgacctttgctgctttctgggagaaatgccttagcatgccttttgaccctgacgctccacttctccctcctaagaggataaattcaggtgatatgtccaggtgtccttcagatacattggtgtttgaagatgaatcagagaagggaagcaatgcacttcttgctcgagcatggtctcctggctggagcaatgctgataaggctctgaccactttcattaatgggcctttaattgagtactctaagaatcggagaaaggctgatagtgctacaacctcatttctctctccacatttgcattttggggaggttagtgtgaggaaagtcttccatcttgtccgcatcaagcaggtttcatgggccaatgaagggaacaaggctggtgatgagagtgtgaacttgtttctcaagtcaattggtcttcgggaatattcaaggtacatgagttttaaccatccttacagtcatgaaaggcctcttcttgggcaccttaagttcttttcttgggttgtggatgagggctattttaaggcatggaggcaaggtagaactggttatccactggtggatgctggcatgagagagttgtgggccactggttggcttcatgatcggatacgagtagtagtttctagtttctttgtaaaagttctacagcttccatggagatgggggatgaaatatttttgggataccctcttggatgcagatttagaaagtgatgctcttggttggcagtacatatctggtactatccctgatggccgtgcttttgaccgaattgacaatccacagtttgagggttacaagtttgaccccaatggagaatatgtacgacggtggctccctgaacttgccagactgcccactgaatggatacaccacccatggaatgcaccagaatctgtgctccaagctgctggcattgagctgggttccaattacccttttcccatagtacggattgacgcagcaaaatgcaggctggacgaagcactttcagaaatgtggcagcaagaagcagcttcaagagctgcaattgagaatggaactgaggaaggtcttggagactcctctgactcagccccaattgcctttcctccggacatacagatggaggaaatccctgaacctgctaggaacaaccttcctaccacagctcggcgttatgaggatcagatggtcccaagcatgactacttctttggtgagagttgaagaggaagagtcttctttggagcttcgaaattcagcagaagaaagcagagcagaagtgccgagaaatgcaaatgtaaatcaagaacctagaagggacactttaaaccaaggtgttctccaaactgttcataacaacaacgcttttcaacaatttaatgccgcaatagtgctggcaaatgctgaagactccacagcagaatcttcaagtactagtagaagagagagagacggaggggtggttccagtttggtctcctgcaacttctagttactcagagcagctagtaggtgatgaaaatggcattggaacgagttcatcttacttgcagaggcatccacagtctcaccaaataatgaattgtaggcggctttctcaaactgggtaagacatatgtacatatgtagatgacacaaactggaagctgggaagatgaaagatgaaatgatttcccaatccaatgcgccaaagggatgataaaccagtgtcacatgttatctttatccacccacttttcatctcaatagtataaaactgatagttcacttcctgcggctgaaactccatgtcagtacaggtttggcgagttgcaggataggttcttgttctgaaatgctactacctggtattttggaattcattttgaggttcgctattatatgttttcctgaaaagaggaaagaaaatt

SEQ ID NO: 6317 - DNA, 3236 bp, Vitis vinifera
gtcaaagaggggggtgggggggaggggaattagagaagggactagagggagggaaggtgggtgggatttgttttgatgcattggataagaaagaaaaaggaaaatctagaaaaagaaaagttgtggctacaaattgcctatcaatttgttgtgtcctcacttccattaaccaatcctcttcaccactccctcaaaggcccttccttttggtttttaatggtctagtattcaatttcatggaaaataaactccacccagaaatcggagggaagaggtaatataaaataaaacacagaagttaaggataagtgcacaatctagtccttcaaaagtgcacctttttttgcttatggcctaaaatccacctcgtattcctggggaagcaaagggaaaagcaaagataagttcgattacaggcccctggtgtgagctttgacatggcatgtagctgagaaagagtgttggaattgtggttggtatctttggagatgtcaggaggtgggtgtagcattgtttggttcaggagagatctgagggttgaggataatcctgcactagcagctggtgtgagagcaggggctgtgattcctgtgtttatatgggcacctgaagaggaaggcccctattaccctgggagggtctcaagatggtggctcaagcagagtttggctcaccttgattcctctttgaggagccttggcactcctctcatcaccaagagatctactgactgcgtttcttctctccttgagattgtcaaatctaccggagctactcttctcttcttcaatcatttgtatgatcccttgtcacttgtcagggatcaccgggcaaaggaggctttaactgctcaaggcatagctgtacattcctttaacgcggatttgctgtatgaaccatgggatgttaatgatgcccagggccactcattcacaaccttctcagctttctgggacagatgccttagcatgccctatgaccctgaggcacctctccttcctcccaaaaggattaacccgggtgacgtgtcaaggtgcccctcagacacaattgcatttgaagatgaatctgagaagggtagcaatgcacttcttgctcgagcatggacacctggatggagcaacgctgataaggccctaaccatattcattaatggaccattaattgagtattctaagaatagtaggaaggctgatagtgctacaacctcatttctctctccccatttgcattttggggaggtgagtgtgaggaaagtattccatcttgtccgcatcaagcaggtactgtgggccaacgaagggaacaaggctggtgaagagagtgtgaacttgttccttaagtccattgggcttagggaatattcaagatacttgagttttaaccatccttacagtcatgaaaggccacttcttggacacctgaagttcttcccttgggttgttgatgaaggctattttaaggcatggagacaaggtagaactggatatccattggtggatgctggcatgagagagctatgggccaccggttggatgcatgatcggataagggttgtggtttctagtttttttgtgaaggttttgcagcttccatggcggtggggaatgaagtatttctgggatacactgttggatgcagatcttgagagtgatgctcttggttggcagtatatatctggtactctccctgatggccgtgagtttgatcgcatagacaatccacagtttgagggttacaaattcgaccctaatggagaatatgtacgaaggtggctccctgaacttgctaggcttcctactgaatggatacaccacccatggaatgcaccagaatctgtactccaagctgctggaattgagttggggtcaaactaccctctccctattgtagagatagatgcagcaaaagccaggttgcaagaagcactttcagagatgtggcaagcagtagcagcttcaagagctgcaattgagaatggaaccgaggagggccttggagactctgaatcagccccaattgcctttcctcaagacgtacaaatggaggagattcctgagcctgtgaggaacaaccctaccactactgcagttagacgctatgaggatcagatggttccaagcatgacttcttcttttctaaggattgaaggagaaccatctttggacattcaaaattcagcagaaaatagcagagcagaagtcccaacaaatgttaatgcaaatcaagaaccaagaagggaaactcttaaccgaggggttacacactcagttcgaagcaacaaccacaacctgccacaatttaatattatgatagggcggaatactgctgaagattccacagcagaatcttcaagcaccacaaggagagagagggatggaggtgtagttccagtttggtctccctcaacttctagttatgcagagcagtttgtgagtgaagagaatggcattggaaccagttcatcttacttgcagaggcatccacggtctcaccagttaatgaattggaagcaactttctcaaactgggtaaatatttgaatgtgacggtacaagaatctgggaagaggagaaagtgactaggacgggcccataggctggtgaaccagcgcccagcacacatccttatatccactccttttttgttcactagtcacctgatcaacagttgatccccagtgcatgaaatctcgaactgatacaggcagctcatctgctatcctttttccacgtttcctgttgtatcatacatgtagctctactgtatagtaaaatgttctcataaggaaaggaaatagagtcataatagggaagggatatgtagtcctctaataaacccaggcttgtgctgtttcattttattgattaggcagatattcttgttgtaatccatatttatgttatctccattttgttttcctgtcgcaacaccgcttactgctgtaaattagactgggttataacttatattttgaaattgtcatttgtttcaattacagacacaccagttaatgggctttggtaacttgtattcacaaaattcattgaaattgatagagcctttagaagagaactgcaagaaatgaagtggatgcctcgaaatttcagtcattccgtttcctcaacttctggaggctgttactggtgctaggtttagtaaaagccaatgtcatcaacaaggtcccttaagattaagctaaaagaatggaagggaattaaatgtattagcctgcag

SEQ ID NO: 6318 - DNA, 2986 bp, Gossypium raimondii
gtcaaacctctctctcccacttatagtcaatcacatgcacttttttcctcccattattattaataataacactaaaaagcttctcctgtttgaaaaaaagctggaacgataagatttttaattagacaacaaggattttcctggccatgctatatggtagaggaaaaataataaaaggtgggtttgttttttgcatgtttttaggttgatgagcttttgggagatatgtcaggtagtgcttgcagcatagtttggttcaggagggatctgagagttgaagataatccagcacttgcagctggtgttagagctggcgctgttgttgcggtttttgtatgggcacctgaagaagaaggccattattaccctggaagggtgtcaaggtggtggctgaagcacagtttggctcaccttgattcttctttgaggagccttggtacttgtctcatcactaagagatcttctgatagtgtttcctctctgcttgaggttgttaaatctactggtgctactcagctcttcttcaatcacttgtatgatcctatatcactggttagggatcatcgggcaaaggaggtattaacagcccatggtgtagcagttcgatcgttcaatgcagatttactttatgaaccctgggatgtaaatgatgctcaaggacgccctttcactactttttcttctttctgggaaagatgcctgagcatgccctatgaccctgaggctccacttcttcctcctaagagaatcatttcaggcgatgtgacaacttgccattcggatgaattggtgtttgaagatgaatcagagaagggaagcaatgcgcttttagctcgagcatggtcacctggttggagtaatgctgataaggctttgaccacattcattaatggacctctaattgagtactctaagaatagaagaaaggctgatagtgccaccacctcatttctctctccccacttgcactttggggaggtgagcgtcagaaaagtctttcatcttgtccgcatcaagcaggttctatgggccaatgaagggaataaagctggtgaggagagtgttaacttgtttctcaagtcaattggtctgagggaattttcaagatacttgagttttaaccatccttacagccatgaaaggcctcttcttgggcatcttaagtttttcccttgggtagtggatgagggctattttaaggcatggagacaaggtagaactggttatccattggtggatgctggcatgagagagttgtgggccactggctggctacatgaccggataagagtcgtagtttcaagtttctttgtaaaggttctgcagcttccatggagatggggtatgaagtacttttgggataccctattagatgcagatttagagagtgatgctcttggttggcagtatatatccggtactcttctggatggccgtgagtttgaccgcatagataatccacagtttgagggttacaaatttgacccacatggagaatatgtccgaaggtggctccctgaacttgcaagattgccaacagattggattcaccatccatggaatgctcctgaatctgtactccaagctgctggaattgagctcggatcaaattaccctcttcctattgtaggaatagatgctgcaaaagataggttgcaagaagcactttcggtgatgtggcaacaagaagctgcttcaagagctgcaattgagaatggaactgaagaaggccttggagactctagtgaatcagtgccatttgccttccctcaagacatacaaatggaggaaaatgttgaaccagcaaggaacgatgctccagctacaactcggcgatacgaagatcagatggttcctagcatgacttcttctttggtgagaggcatacatgaagaagcttcttcggatcttagaacttcaacagaagatagcagagcagaagttccaagaaacgttaatatacatcaagaaccacaaagagactcattaaaccagggaattcagctaacagctcgtaacaacaacacttttcggcaatttaatctcccaatggggttgggaaatgctgaggattccacagcagattcatctactagcagtagtaggagagaaagggatggcggagttgttccagtttggtctcctccagcttctagttattcagagcagttcataggtgatgaaaacggtattggtacgagctcatcttatttaccaaggcatccacagtcccaccaaatagtaaactggaggcgtttatctcaaactggataaacacttacgaacaccggaatcttgtagtcagagaatgccagaatggccaatcttgtgggctgatggggtataacatggcttcaatctaccacactcgttatccccaatctaacttgatcagcagttgccctcctatgtgtacgaaacttaagattgatccggctgctgatctgtgtactatctttttcccatgctgtaccatattacatagtcctgctgtatagtattttgtttcttttataagatagtgaagagagtcatgggtagaatttagaattgtgtagtcctcaaataaaaccatgtttatgttacttttaactgattgtaagaaatgattgtattgtaattcatatttttggtgctctctgtttgtttttccagctttaccacatcatatctatagatttgaaaagaaaaaaaaaactacagtagaatgcttattttttattgatgaaaaaactacgtcataggtagatatttcctatatttctttgattcttatttgtactaaagcatccatcaacaagcctaatcgagtatgcttcctcctagggaaaactattgaacgctgctgttggacattggtgaaatctccaactacgagatttggatgggatcagacttcagagtaaagctcattatgcatgctttttatgctctcaggcttttctggttcaggtgctcgaagaacactgtacacaaaagttgcggc

SEQ ID NO: 6319 - DNA, 3172 bp, Populus trichocarpa
acagaattattatcaattagtacaaacaaataaataaataaaaaacatagaattatcattatcacccaatacatttggagcagaatatgacaggtgataacaaaagaagtaatcaaataaaagataagtgcaaaatctatcatctccaccctccaaaatcacttgcacttttcaatgcttatggtctacgataacttacctctcctctagtagaatcaagagagtaaaccccagaagcagaaagtattaactacaatctcttccttgctgagcttctaaagaaagctagcaaaacaggaaaagttggatatggcatatagcaactgtcatagcaaagagagagagtgactatttttgttttcaattttgatttttgttagagagaaagatgtcaggaggtgggtgtagtatagtttggttcaggagagatctaagggtagaagataacccggcacttgcagctggtgtaagagcaggtgctgttgttgctgtgtttgtatgggcacccgaggaggaaggccattattatcccggtagggtctcaaggtggtggcttaaacaaagtttggctcatcttgactcttctttaaggagtcttggtacttctcttgttactaagagatcaactgatagtgtttcttctcttcttgaggttgtcaaatctaccggtgctactcagcttttattcaaccacttatatgaccccttgtcactggttagggatcaccgggcaaaggagattttgactgctcaaggtattactgtaagatcttttaacgcggacttgctttatgaaccatgggatgttaatgatgcccaaggccgtccgttcacaacctttgacactttctgggaaagatgcctcagcatgccttttgatccagaggctccacttctcccgcctaagaggattatttcgggtgatgtatccagatgcccttcagtcacgctggtatttgaagatgaatcagagaaaggaagcaatgcacttcttgcaagagcatggtcacctggatggagcaatgctgatagggctttgaccactttcattaacggaccactaattgagtactctatgaatcgtagaaaggctgatagcgccacaacctcatttctctcaccacacttgcattttggggaggtgagtgtgagaaaagtcttccatcttgttcgcatcaagcaggttctgtgggcaaatgaagggaacagggccggcgaagagagtgtaaacttgtttatcaagtcaattggtcttagggaatattcaagatacttgagtttcaaccatccttgcactcatgaaaggcctcttcttgggcaccttaagtttttcccttgggttgtggacgaaggctattttaaggcatggagacaaggtagaacaggttatccattagttgacgctggaatgagagaattgtgggctgctggttggctgcatgatcgtatacgtgtggtagttgctagtttctttgtgaaggttctacaacttccatggagatggggaatgaagtacttttgggataccctattggatgcagatttagagagcgatgctcttgggtggcaatacataacgggcactctcccagacagccgtgagtttgatcgcatagataatccacagtttgagggttacaaatttgacccgaatggagaatatgtacgccggtggcttcctgaacttgctaggctaccaactgaatggatacaccacccatggaatgcacctgaatctgtactccaagctgccggaattgagctgggatcaaattaccctctccctattgtagggatagatgcagcaaaggtcaggttggaagaagcactttcagaaatgtggcagcaagaagctgcttcaagagctgcaattgagaatggaacagaggaagggcttggagactcctctgaatcagccccaattgccttccccgaagacatacatatggaggaaaaccatgagcctgtgagaaacaatcctcctgctacaaatcgtcgctatgaggatcagatggtcccaagcatgacatcttcctttctgagaattgaagacgaagaaacttcttctgatgtacgcaattctacaggagatggcagagcagaggtgccaagagatgtaaatgtgaatcaagaaccaagaagagacgctttgaaccaggggtttgttcaaactgttcgtaataacactgctttgtcaccatttaatattttgagaggtctgacaaatgttgaagactcgaccgcagagtcttcaagtagtagtaggagagagagggatggaggtatagttccagtttggtcccctccaacttctagttactcagagcagtttgttggtgatgacaatggaattggagcaacttcttcttacttgcagaggcatccacagtctcaccagataatcaattggaggcggctatctcaaactgggtaaaacaaatattcatggtgagaaggaagcagggaattggagaacacaatgatgcttaatcttatgatttagtctgttgataaaccagagtaccttgtatattttatcaacccatgttctcaccattctaatatgatcagtggtaggacctccaatctgtatgatacacacaaatgattcaggcagtccatctgctatcccgttttctgtacttttctgtatcacatacgtagatctgctgtatagtatttataagcgaaggatgagagtgatggtagggggatgtagttttctaataatcccaggtttgtgctttcttgcttgactaggaagataatttactgtaattcaaccttgtatcctcactttcactacccttgaagattgcttattcctgagctccaactgatttctgctgtgaaatgttggccagcttagctttttgtatcgaaattgttgccaggagatgtatttcaaaatatagctaggatgaggtgctatactctgctggctactggataggggtgaagtagtatagatgaacctgaaactagttttacattatttgatagactggagaagctggaatagggaaactaaagggttactgattttggattttacagtttcaccgctcttttatcgcgtagtaatattttacatgtagtatatttaacatttatttaacaaattactaaaacaggatgaggttttatcatgtgctcatcctcttgcaagtca

SEQ ID NO: 6320 - DNA, 3415 bp, Gossypium raimondii
aaatataataaacttaataaatgagcatctagaagtaaaagataagtgtcaaacctctctctcccacttatagtcaatcacatgcacttttttcctcccattattattaataataacactaaaaagcttctcctgtttgaaaaaaagctggaacgataagatttttaattagacaacaaggattttcctggccatgctatatggtagaggaaaaataataaaaggtgggttagttttttgcatgtttttaggttgatgagcttttgggagatatgtcaggtagtgcttgcagcatagtttggttcaggagggatctgagagttgaagataatccagcacttgcagctggtgttagagctggcgctgttgttgcggtttttgtatgggcacctgaagaagaaggccattattaccctggaagggtgtcaaggtggtggctgaagcacagtttggctcaccttgattcttctttgaggagccttggtacttgtctcatcactaagagatcttctgatagtgtttcctctctgcttgaggttgttaaatctactggtgctactcagctcttcttcaatcacttgtatgatcctatatcactggttagggatcatcgggcaaaggaggtattaacagcccatggtgtagcagttcgatcgttcaatgcagatttactttatgaaccctgggatgtaaatgatgctcaaggacgccctttcactactttttcttctttctgggaaagatgcctgagcatgccctatgaccctgaggctccacttcttcctcctaagagaatcatttcaggcgatgtgacaacttgccattcggatgaattggtgtttgaagatgaatcagagaagggaagcaatgcgcttttagctcgagcatggtcacctggttggagtaatgctgataaggctttgaccacattcattaatggacctctaattgagtactctaagaatagaagaaaggctgatagtgccaccacctcatttctctctccccacttgcactttggggaggtgagcgtcagaaaagtctttcatcttgtccgcatcaagcaggttctatgggccaatgaagggaataaagctggtgaggagagtgttaacttgtttctcaagtcaattggtctgagggaattttcaagatacttgagttttaaccatccttacagccatgaaaggcctcttcttgggcatcttaagtttttcccttgggtagtggatgagggctattttaaggcatggagacaaggtagaactggttatccattggtggatgctggcatgagagagttgtgggccactggctggctacatgaccggataagagtcgtagtttcaagtttctttgtaaaggttctgcagcttccatggagatggggtatgaagtacttttgggataccctattagatgcagatttagagagtgatgctcttggttggcagtatatatccggtactcttctggatggccgtgagtttgaccgcatagataatccacagtttgagggttacaaatttgacccacatggagaatatgtccgaaggtggctccctgaacttgcaagattgccaacagattggattcaccatccatggaatgctcctgaatctgtactccaagctgctggaattgagctcggatcaaattaccctcttcctattgtaggaatagatgctgcaaaagataggttgcaagaagcactttcggtgatgtggcaacaagaagctgcttcaagagctgcaattgagaatggaactgaagaaggccttggagactctagtgaatcagtgccatttgccttccctcaagacatacaaatggaggaaaatgttgaaccagcaaggaacgatgctccagctacaactcggcgatacgaagatcagatggttcctagcatgacttcttctttggtgagaggcatacatgaagaagcttcttcggatcttagaacttcaacagaagatagcagagcagaagttccaagaaacattaatatacatcaagaaccacaaagagactcattaaaccagggaattcagcaaacagctcgtaacaacaacacttttcggcaatttaatctgccaatggggttgggaaatgctgaggattccacagcagattcatctactagcagtagtaggagagaaagggatggcggagttgttccagtttggtctcctccagcttctagttattcagagcagttcataggtgatgaaaacggtattggtacgagctcatcttatttaccaaggcatccacagtcccaccaaatagtaaactggaggcgtttatctcaaactggataaacacttacgaacaccggaatcttgtagtcagagaatgccagaatggccaatcttgtgggctgatggggtataacatggcttcaatctaccacactcgttatccccaatctaacttgatcagcagttgccctcctatgtgtacgaaacttaagattgatctggctgctgatctttgtactatctttttcccatgctgtaccatattacatagtcctgctgtatagtattttgtttcttttataagatagtgaagagagtcatgggtagaatttagaattgtgtagtcctcaaataaaaccatgtttatgttacttttaactgattgtaagaaatgattgtattgtaattcatatttttggtgctctctgtttgtttttccagctttaccacatcatatctatagatttgaaaagaaaaaaaaaactacagtagaatgcttattttttattgatgaaaaaactacgtcataggtagatatttcctatatttctttgattcttatttgtactaaagcatccatcaacaagcctaatcgagtatgcttcctagggaaaactattgaacgctgctgttggacattggtgaaatctccaactacgagatttggatgggatcagacttcagagtaaagctcattatgcatgctttttatgctctcaggcttttctggttcaggtgctcgaagaacactgtatacaaaagttgcggccattgctccaagaactggagctacaatatagacccaaaggtttttataaacaccggaggcaacagcagggcctaaacttcttgcagggttcatcgaagctccggtaatcggcctggcaaatatatggagatcataaattttactatatgaagtatgatcgaaagaattgttcatgaaatataaaaaaagaatggaatgttgctgggaaagttcacttacccagctacaatgacattaaacagcactgtagcacctattgcagctccagcgacagctttgcactgctttggtcaatcgaagattcagaataactataattaacatttgtacataaaacatagcttattcctgaggaattgaaaagaacataaaacaaggtatcgac

SEQ ID NO: 6321 - DNA, 2893 bp, Prunus mume
agttcgcctaccaatttgttgtaacttgtacaccacccactcctttttggcacgaaccaatcgtctctctctctctgcccaaaaggcgtttttgtagcaactagcctaaattgcatgggggagaatttcatccaaaaaattaggaataaataaataagaaagaaaagtaaaagataagggcaaaaatcaaatctttcactcctgaaaaagaaatgaacttttttttttcctgttgggtctaaattcccatcctcataaaactctaaagtatgagaaacagagcaaacgataagattaattacaacccccctggctcaaagagagagaaagacagagagagaaggatatgtcagatggtatattagcttgagatagaaaatacttgtgctgggttttgttggttggtgaaatagtttttggggatgtcaggtggtggatgcagtgtagtctggttcaggagagatctgagggtggaagataacccagctttagctgctggagtgagagcaggaagtgtggtttgtgtctttatttgggcacctgaggaagaaggcccatattaccctggaagggtgtcaagatggtggctcaaacacagcttggctcatcttgattcctctttgagaagtctgggcacatctctcatcaccaagaggtccactgacagtgtttcttctcttcttgaggttgttatttccactggtgccactcagctcttcttcaaccacttatatgatcctatatcactggttagggatcaccgggccaaggaggttttaactgctcaaggcatagctgtgcgttcctttaatgcggatttgctctacgaaccatgggatgttaatgatgtcaatggtcgcccgttcaccaccttcgatgctttttggggaagatgccttagcatgccatatgacccagatgcaccgcttctcccccctaagagaattatatcaggtgacacatcaaggtgcccttctgatacattggtttttgaagatgaatcagagaagggaagcaatgcgcttcttgctcgagcatggtcacctgggtggagcaacgctgataaggctctaaccacatttataaatggaccattacttgagtactctcaaaaccgcaggaaggctgatggtgccacaacatcattactttctccccatttgcattttggggaggtaagtgtgaggaaagcatttcatcttgttcgcatcaagcaggttctttgggccaatgaaggcaacaaggctggtgaagagagtgtgaacttgtttctgaagtctattggtcttagggaatattcaagatacattagttttaatcatccctacagtcacgaaagacctcttcttgggcacctaaagttcttcccctggattataaatcagagctattttaaggcatggaggcaaggtagaactggctatccattggtggatgctggcatgagagagttgtgggccacaggctggctgcatgatcgtatacgagtagtagtttctagtttttttgtaaaggttctgcagcttccatggaggtggggaatgaagtatttctgggatacactcttagatgctgatcttgaaagtgatgctcttggttggcagtatatatctggtactatccccgatggtcgtgaatttgaccgcatagataatccacagtttgaaggttacaaatttgacccaaatggagaatatgtgcgaaagtggcttcctgaacttgccagacttccaactgaatggatacaccacccatggaatgcaccagaatctgtactccaagcagctggaattgaattaggatcgaattaccctctccctattgtaggaatagatgcggcgaaaaccaggttgcaagaagcattattagagatgtggcagcacgaagctgcttcaagagctgctgttgaaaatggaactgaagaagggcttggagattcctctgaatcaacccctattgcctttcctcaagacatacaaatggaggaaaattatgaacccgtgaggaacaaccttcctgccactcgaaggtatgaagatcagatggtcccaagcataactacatctttggtgagagttgaagaggaagaaagttcattggatattcgaaatttggtggaagaaaccagaggagaagtgcctacgaatgaaatggtaaatcaagaaccaagaagagacactttaaaccaaggggttttgcagactattcgtaacaacactctgccacaaccaaatgccgcaatagggctgcagcatgctattgaagattccactgcagaatcttccggtagcagtaggagagagagggatggaggtgtagttccagtctggtctccttcaacttctagctactcagagcagtttgcgagtgatgacaatagcattggaacaagttcttacttgcaaagacatccacagtctcaccaaataatgaattggaggcggctatctcaaactgggtaaaacatatagatgcaaataggaaaaaaaaaagtgtggtgtggtgaagtgatgcacgccatcaaatggatttggggaagctgaacatatcttccacattgaccttccaacccgttctcctggccacgagtgaccttaaacagcagtagacccccagtgtgtgatattttctaattaatacaggcaacttattagctatccttttcttcttcatttttcttgttctaccataatgcagctctgttgtatagcaatgttgtacttataaaggaagagagtgaaatgagatatgtagtcattgaacaaactcaggtttttgctttctcattctattggtagcagatacttataacgtatgctatgtatccacactttgttgtaggtttggaaatttactgatctgttatggaaattgcacccactaagtatctgcc

SEQ ID NO: 6322 - DNA, 3127 bp, Manihot esculenta
agatgcctttttggttgcaaaataaaccaaaaaagaccaagcccaaattcatttcactgaaaaagtatttccaccattacatttggaggaaaataattatcagtgctacataatagtgattaaacaaaaggtaattgcaaaacccatcaccaacccttcaaaatcaaaataatgtttttttagtggtttactgtttatgggtctaaattctctctcatagatttaatgggtatgaagcagaagtagaaaagataatattgttaattaaattctctggtgaccttcaggacacagaaaaagaggaaaaataaaagaaagagacagacagatatggtatatagctgatataaaaagagagagtgtgtgtgtgtgtgaggaagcttggttggtgtttatttgtggggagatgtctggtgggtgtagcatagtctggttcaggagagatctgagggtagaggataatccagcacttgcagctggtgtaagagctggtgctgttgttgcagtgtttatatgggcacctgaagaagaaggccattattaccctggtagggtctcaaggtggtggctcaagcaaagtttggctcatttaggctcttctttgaggagccttggaactacccttgtcaccaagagatctactgatagtgtttctgctctgcttgaggttgtcaaatctactggtgctacccagctcttcttcaaccacttatatgaccccttgtcactggttagggatcaccgggcaaaggagcttttgactgctcaaggagtagctgtgagatcctttaatgcagatttgctttatgaaccgtgggaagttaatgatgcacagggaagccctttcacgacttttggtgaattctgggaaagatgccttagcatgccttacgatccagaggctccacttctcccacccaaaaggattatttcaggtgatatatcaagatgtccgtctaacttattgatatttgaagatgaatcagagaagggaagcaatgcgctgcttgctcgagcatggtcacctgggtggagcaatgctgataaggctttgatgacattcatcaatggaccactaattgagtactctaagaatcgtaggaaggctgacagtgctacaacctcctttctctctccccatttgcattttggggaggttagtgtcagaaaggtttttcaccttgttcgcatgaagcaggttctttgggcaaatgatgggaacaaggctggtgaagagagtgtaaacttgtttcttaagtcaattggtttgagggaatattcaagatacctgagttttaaccatccttacagtcatgaacgtcctcttcttgggcaccttaaatttttcccttgggttgtagatgaaggctattttaaagcttggagacaaggaagaactggttacccattagttgatgcaggaatgagagagttgtgggccactggctggctgcatgatcgaataagattagtagtttctagtttctttgtgaaggttctacagcttccttggaggtggggaatgaagtatttctgggataccctcttggatgctgatttagaaagtgatgcacttggttggcagtacatatctggtactcttcctgatggtcgagagtttgatcgcatagataatccgcagtttgagggttacaaatttgatccaaatggagaatatgtacgaaggtggcttccagaacttgccagactacctactgaatggatacaccatccatggaatgcacctgaatctgtactccaagctgccggaattgagctcggatcaaattatcctctcccagtagtatggatagatgctgctaaagttaggttgcaagaagcgctttcagaaatgtggcagcaagaagcggcttcaagagctgccattgagaatggaacagaggaagggcttggagactcatctgaatcagccttaattgcattccctcaagatatactaatggaagaaagacatgaacctgtaagaaataaccttccttccacaatccggcgttatgaggatcagatggtcccaagcatcactacttccttgctaagagttgaagaggaagaaacttcttcagatcttcggaatgtaacagaagataccagagcagaggtgccaagaaatgtaaatatcaatcaagaacaaagaagagacaacttaaacctgggggctgcacaaactatccgcgaaaacaatttggcacattttagtgttgtcagaagtctaggtattgaagattcaacagaagaatcttcaagtagtagtaggagagagagagatggaggcatagttccagtgtggtcccctccatctgctagttactcagagcagtttgctggtgatgaaaatggaattggaacaagtccttatttgcagaggcatccacagtcccaccagatactgaattggaggcggctgtctcagactgggtaagaagtagaaaagactggaaagactaaaaatgtccaactccttactgtgattgtcatgattgcagttcatactttgtcctacagtcggtgttatagttgtctgcaagttctttttgcttgatgattgaaggttcaaggtctgaagaaattatacttgacccaggaattcttacaaccttagatctcacagccggactcgtaaagaatcgctgtcaagtccatgaaacaaaatatggggactaataagtgaatcagagtggagttgtgataatttcaggatgagtagtattaactattcctgactccgaatctttctcttgtcaacaggtaaaaaaaacatatattcatggcgagacatggtgctaagaggtgaagaatgcaatggtgcttatcctgcgagttagtgggttgataaaacaaaataccacttgtatcattaccaatctatgttcttgtcacctatttaatctgatcaatggatgaccttcgatgtgtgccatggtccaaaaagattcaggcagaccatctaccgtccattttctgtactacttgtaccataatacatagttctgctgtatagtgtttataagcaagggatgagagtgatcgtcgggatttgtagttctctaataaaccgaggtttgtgcttttctatttagttgattaggcagatgatttactgttattc

SEQ ID NO: 6323 - DNA, 2448 bp, Prunus persica
agagagagaaagacacagagagaaagatatgtcagatgggtatattagtttgagatagaaaatacttgtgctgggttttgttggttggtgaaatattttttggggatgtcaggtggtggatgcagtgtagtctggttcaggagagatctgagggtggaagataacccagctttagctgctggagtgagagcaggaagtgtggtttgtgtctttatttgggcacctgaggaagaaggcccatattacccgggaagggtgtcaagatggtggctcaaacacagcttggctcatcttgattcctctttgagaagtctgggcacatctctcatcaccaagaggtccactgacagtgtttcttctcttcttgaggttgttatttccactggtgccactcagctcttcttcaaccacttatatgatcctatatcactggttagggatcaccgggccaaggaggttttaactgctcaaggcatagctgtgcgttcctttaatgcggatttgctctacgaaccatgggatgttaatgatgtcaatggtcgcccgttcaccaccttcgatgctttttggggaagatgccttagcatgccatatgacccagatgcaccgcttctcccccctaagagaattatatcaggtgacacatcaaggtgcccttctgatacattggtttttgaagatgaatcagagaagggaagcaatgcgcttcttgctcgagcttggtcacctgggtggagcaacgctgataaggctctgaccacatttataaatggaccattacttgagtactctcaaaaccgcaggaaggctgatggtgccacaacatcattactttctccccatttgcattttggggagctaagtgtgagaaaagcatttcatcttgttcgcatcaagcaggttctttgggccaatgaaggcaacaaggctggtgaagagagtgtgaacttgtttctgaagtctattggtcttagggaatattcaaggtacattagttttaatcatccttacagtcacgaaagacctcttcttgggcacctaaagttcttcccctggattataaatcagagctattttaaggcatggaggcaaggtagaactggctatccattggtggatgctggcatgagagagttgtgggccacaggctggctgcatgatcgtatacgagtagtagtttctagtttttttgtaaaggttctacagcttccatggaggtggggaatgaagtatttctgggatacactcttagatgctgatcttgaaagtgatgctcttggttggcagtatatatctggtactatccctgatggtcgtgaatttgaccgcatagataatccacagtttgaaggttacaaatttgacccaaatggagaatatgtgcgaaagtggcttcctgaacttgccagacttccaactgaatggatacaccacccatggaatgcaccagaatctgtactccaagcagctggaattgaattaggatcgaattaccctctccctattgtaggaatagatgcggcgaaaaccaggttgcaagaagcattattagagatgtggcagcacgaagctgcttcaagagctgctgttgaaaatggaactgaagaagggcttggagattcctctgaatcaaccccaattgcctttcctcaagacatacaaatggaggaaaattatgaaccagtgaggaacaaccttcctgccacccgaaggtatgaagatcagatggtcccaagcatgactacatctttggtgagagttgaagaggaagaaagttcattggaaattcgaaatttggtggaagaaaccagaggggaagtgcctacaaatgaaatggtgaatcaagaaccaagaagagacacattaaaccaaggggttttgcagactattcgtaacaacactctgccacaaccaaatgccgcaatagggctgcaacatgctattgaagattccactgcagaatcttccggtagcagtaggagagagagggatggaggtgtagttccagtctggtctccttcaacttctagctactcggagcagtttgcgagtgatgacaatagcattggaacaagttcttacttgcaaagacatccacagtctcaccaaataatgaattggaggcggctatctcaaactgggtaaaacatatagatgcaaataggaaaaaaaaaagaaaaaaaagtgtggtgtggtgaagtgatgcacgccatcaaatggatttggggaaggtgaacatatcttccacattgaccttccaaccctttctcctgtccacgagtgacctcaaacagcagtagacctcctgtgtgtgatattttctaattaatacaggcaacttattagctatccttttcttcttttttcttgttctaccataatgcagctctgttgtatagcaatgttgtacttataaaggaagagagtgaaataagatatgtagtcatt

SEQ ID NO: 6324 - DNA, 2681 bp, Euonymus alatus
gcatccaagaataggggagttaaacagaggcaataaaaaacaatccaaccagataacgcaagtaacagataggcaagaaaaatcaaacccagattttggtctgaaatccttctcccaacttggtgtgcttcacgggatgtctgaggggggaaaagaaattatgtaaattgtttagtgggtaagaattgagagagacgaattgggtttttttggggttggtgagttttggagatgtcaggtggtggatgtagcatagtatggtttaggagagatctgagggtagaggataacacagcactattagctggtgtgagagcaggtgctgtggttgcagtatttatatgggctcctgaagaggagggtcagtacaacccggggagggtttcaaggtggtggattaagcacagcttggctcaccttgaatcttccttgaggagccttggcacaaccctaatcaccaagaggtcaactgacagtgtggccactctgcttgagattgtcaaatctactggtgctactcagctcttcttcaaccacttatatgatcccatgtccctcgtcagggatcacagggcaaaggaggttttaggtgctcatggagttgctgtccgttccttcaatgcggatttactctacgaaccatgggatgttaacgatgctcaaggtcgccctttcacaactttcgctgctttctgggaaagatgccttagcatgccttatgatccagaggctccacttctaccaccaaaacggataatttcaggtgatgtatctaggtgcccttcagatactttgatatttgaagacgaatctgagaagggaagcaacgcccttcttgctcgagcatggtcaccagggtggagtaatgccgataaggctatgaccacattcctaaatggagcactaattgagtactcagagaatcgtagaaaggcagatagtgctacaacctcatttctcctccccccaccttcattttggggaggtaagtgttagaaaagtcttccatcttgttcggatcaagcaggtcttgtgggccaatgaagggaacaaggctggtgaagagagtgtgaacttgtttctgaagtcaattggccttagggaatactcaagatacatgagttttaaccatccttacagtcatgaacgacctcttcttgggcaccttaagttctttccttgggttgttgatgaaggctattttaaggcatggagacaaggtagaaccggttatccattagtggatgctggtatgagagaattgtgggccacaggttggctgcatgatcgtataagagttgtagttgccagtttcttagtgaaggttctgcaacttccatggagatggggaatgaaatacttctgggatacgttactggatgcagatttagaaagtgatgctctcggttggcaatatatatctggtactctccccgatggacgtgagcttgatcgcatagacaatccacagtttgagggttacaagttcgatcccaatggagaatatgtgcgacggtggcttcctgagctggccaggctaccaaccgaatggatacaccatccatggaatgcgcctgaatctgtactccaagctgccggaattgagctgggatcaaattacccccttccaatcgtaggtatagatgcagcaaaagccaggttgcaacaagcactttcagatatgtggcagcaagaagcagcttcaagagctgtactggagaatgggaccgaggaagggcttggggactccactgaatcagcaccaatttcctttccccaggataccttgatggaggagaatcaggaacctgtgaggaacaatccgcctgctacaattcgacgttacgaggatcagatggttccaagtgttactagttcgttggtgagagttgaagaggaagaaacttcttctgttcgaaatttggcaggagatggcagagcagaagttccaagagatatacatgtcaatcaagaaccaataagagaacccctaaaccaaggagttacacaaaatcttctaggtaatagcacaatgccacagttcaatatcacaatggcactggggaatgctgaagattccacagcagaatcttcgagtagtggtagcagtctgagagaaagggatggggggctagttccagtttggtctcctccaacttctagttactcagagcatttagttggggatgaaaatggcatcggaactagttcatcatacttgcagaggcatccacagtctcaccagataatgaattggaggcagctttctcaaacagggtaaacggatgtgcattgagactgaaagctgggtttgaaggacgcaatggtgcttatggttggttgatggattagaatatttcaatatcatctctatctccggagttctattacttcaccagccgaactcgacggaaggttgaccaccaatgtgtacgatagtccaaaatgataaatgcatcccaactgctatcctttttctttgttgtaaaatatatgtagattttctgtatagtatttgtcattcttattaggcagagaagaacatcaatgtaggtatatgtagtcctctaataaatgcaaagtgtgtcatgagaagtagccaagtagtttgtcaatgtactacaagattaaacttgtggaattcttcttatggatcagaatggaaataaagttcattgtga

SEQ ID NO: 6325 - DNA, 1978 bp, Ricinus communis
atgtcaggtggtggttgtagcatagtttggttcaggagagatctaagagtagaagataatccagcacttgcagctggtgttagagctggggctgttgttgccgtctttgtatgggctcctgaggaagaaggtcattattaccctggtagagtatctaggtggtggcttaagcaaagtttggctcatttggattcttctttgagaagtcttggcactgttcttgttagtaaaagatcaactgatagtgtttcttcccttcttgaagttgttaaatctactggtgctactcaactcttcttcaaccacttgtatgatccaatttcactggttagggatcatcgggcaaaggaggttttgactgcacaaggcatagctgtaagatctttaacgcggatttgctatatgaaccctgggatgccttagcatgccttatgatccagaggctccacttctcccacctaagagaattatttcaggtgatatatctagatgcccttcagacacactgatatttgaagatgaatcagaaaagggaagcaatgcactgcttgctcgagcatggtcacctgggtggagcaatgctaataaagcgctaactacattcatcaatgggccacttattgagtactcaaagaatcgtagaaaggctgatagtgctacaacctcctttctttctcctcatttgcattttggtgaggttagtgtgagaaaggtcttacatcttgttcgcattaagcaagttctgtgggcaaatgaagggaacaaggctggtgaagaaagtgtgaacttgtttcttaaatcaattggtcttagggaatattcaagatacctgagttttaaccatccttatagtcatgaacgccctcttcttgggcatcttaagttttttccttggattgtgaatgaaggctattttaaggcttggagacaaggtagaactggttatccattggttgatgcaggaatgagagagttgtgggccactggttggctgcatgatcgaatacgagtagttgtttctagtttctttgtaaaggttctacagcttccatggagatggggaatgaagtatttctgggataccctcttggatgcagatttagagagtgatgctcttggttggcagtacatatctggtactcttcctgatggccgagagtttgatcgtatagacaacccacagtttgagggatacaaatttgatccccatggagaatatgtacgacggtggcttcctgaacttgccaggctgccaactgaatggatacatcatccatggaatgcacctgaatctgtactccaagctgctggaattgagctaggatcaaattaccctctccccattgtagggatagatgcagctaaagtcaggttgcaagaagcactttcagaaatgtggcagcacgaagccgcttccagagctgctattgagaatgggactgaagaaggtctaggagactcttctgaatcagctccaattgccttccctcaagatatacaaatggaagaaaaccttgaacctataagaaacaatcctcctattccaattcgccgttatgaggatcagatggttccaagcatgacttcttctttgctaagagttgaagaagaagaaacttcgtcagatcttcgaaatgctgcagaagatagcagagctgaggtgccaagagatgtaaatgtcaatcaagaacaaagaagaaaccttggggttgcacaagcttttcgtagtaacaacttaccaaatgttaatattctcagaggtctgccaaatactgaggattcaacagcagaatcttcgagtagtactaggagagagagggatggaggtatagttccagtgtggtctcctccaagcactagttactcagagcagtttgctggtgatgaaaacggtattggaaccagttcttcttacttgcaaaggcatccgcaatctcaccagataattaattggaggcggctgtctcagactgggtaa

SEQ ID NO: 6326 - DNA, 2805 bp, Vitis vinifera
ctcttcaccactccctcaaaggcccttccttttggtttttaatggtctagtattcaatttcatggaaaataaactccacccagaaatcggagggaagaggtaatataaaataaaacacagaagttaaggataagtgcacaatctagtccttcaaaagtgcacctttttttgcttatggcctaaaatccacctcgtattcctggggaagcaaagggaaaagcaaagataagttcgattacaggcccctggtgtgagctttgacatggcatgtagctgagaaagagtgttggaattgtggttggtatctttggagatgtcaggaggtgggtgtagcattgtttggttcaggagagatctgagggttgaggataatcctgcactagcagctggtgtgagagcaggggctgtgattcctgtgtttatatgggcacctgaagaggaaggcccctattaccctgggagggtctcaagatggtggctcaagcagagtttggctcaccttgattcctctttgaggagccttggcactcctctcatcaccaagagatctactgactgcgtttcttctctccttgagattgtcaaatctaccggagctactcttctcttcttcaatcatttgtatgatcccttgtcacttgtcagggatcaccgggcaaaggaggctttaactgctcaaggcatagctgtacattcctttaacgcggatttgctgtatgaaccatgggatgttaatgatgcccagggccactcattcacaaccttctcagctttctgggacagatgccttagcatgccctatgaccctgaggcacctctccttcctcccaaaaggattaacccgggtgacgtgtcaaggtgcccctcagacacaattgcatttgaagatgaatctgagaagggtagcaatgcacttcttgctcgagcatggacacctggatggagcaacgctgataaggccctaaccatattcattaatggaccattaattgagtattctaagaatagtaggaaggctgatagtgctacaacctcatttctctctccccatttgcattttggggaggtgagtgtgaggaaagtattccatcttgtccgcatcaagcaggtactgtgggccaacgaagggaacaaggctggtgaagagagtgtgaacttgttccttaagtccattgggcttagggaatattcaagatacttgagttttaaccatccttacagtcatgaaaggccacttcttggacacctgaagttcttcccttgggttgttgatgaaggctattttaaggcatggagacaaggtagaactggatatccattggtggatgctggcatgagagagctatgggccaccggttggatgcatgatcggataagggttgtggtttctagtttttttgtgaaggttttgcagcttccatggcggtggggaatgaagtatttctgggatacactgttggatgcagatcttgagagtgatgctcttggttggcagtatatatctggtactctccctgatggccgtgagtttgatcgcatagacaatccacagtttgagggttacaaattcgaccctaatggagaatatgtacgaaggtggctccctgaacttgctaggcttcctactgaatggatacaccacccatggaatgcaccagaatctgtactccaagctgctggaattgagttggggtcaaactaccctctccctattgtagagatagatgcagcaaaagccaggttgcaagaagcactttcagagatgtggcaagcagtagcagcttcaagagctgcaattgagaatggaaccgaggagggccttggagactctgaatcagccccaattgcctttcctcaagacgtacaaatggaggagattcctgagcctgtgaggaacaaccctaccactactgcagttagacgctatgaggatcagatggttccaagcatgacttcttcttttctaaggattgaaggagaaccatctttggacattcaaaattcagcagaaaatagcagagcagaagtcccaacaaatgttaatgcaaatcaagaaccaagaagggaaactcttaaccgaggggttacacactcagttcgaagcaacaaccacaacctgccacaatttaatattatgatagggcggaatactgctgaagattccacagcagaatcttcaagcaccacaaggagagagagggatggaggtgtagttccagtttggtctccctcaacttctagttatgcagagcagtttgtgagtgaagagaatggcattggaaccagttcatcttacttgcagaggcatccacggtctcaccagttaatgaattggaagcaactttctcaaactgggtacaagaatctgggaagaggagaaagtgactaggacgggcccataggctggtgaaccagcgcccagcacacatccttatatccactccttttttgttcactagtcacctgatcaacagttgatccccagtgcatgaaatctcgaactgatacaggcagctcctctgctatcctttttccacgtttcctgttgtatcatacatgtagctctactgtatagtaaaatgttctcataaggaaaggaaatagagtcataatagggaagggatatgtagtcctctaataaacccaggcttgtgctgtttcattttattgattaggcagatattcttgttgtaatccatatttatgttatctccattttgttttcctgtcgcaacaccgcttactgctgtaaattagactgggttataacttatattttgaaattgtcatttgtttcaattacag

SEQ ID NO: 6327 - DNA, 2742 bp, Fragaria vesca
tatttaaataaaaaaagaaatcagaaaagtaaaagataagggcagagatcaaaatcatgcactcacccaaaattgagatcaactctttcttgctgcctggaggggtctaaaatcccatccttacaatacccaaaaagtatgagaaaacagggcaaaagataagattagttacaagccccagggtgtgtgttcctagagagagaaagcaacgctcagaaagggtgtggtatatagtttgagatagaaaaaaaaaaacacttgtgttctgggttttgttggttggtgagtttttttttcttcttcttttgtttgggagatgtcaggtggtagtggttgcagtgtagtttggttcaggagagatctgagggttgaagacaatccagctttgttagctggagttagagcaggaggagttgttgctctttttatttgggcacctgaggaagaagggccttattacccaggaagggtctcaaggtggtggctcaaacacagtttggcacatcttgattcctctttgagaagtttgggcactcctctcatcaccaaaaaatctactgacagtgtttcttctcttcttgaggtttgtcttgcaactggagccactcagctcttcttcaaccacttatatgatcctatatcactggttagagatcacagggccaaggaggttttgtccgccaacggcataactgtgcgttcctttaacgccgatttgctctatgaaccatgggatgttaatgatgtccacggtcgtccattcacaacctttgatgctttttgggaaagatgcctcagcatgccctttgatccagaggcaccacttctcccccctaagagaatcatatcaggtgatgcatcaaggtgtcctcctgatacattggtttttgaagatgaatcagagaagggaagcaatgcgctacttgctcgagcatggtcacctgggtggagcagtgctgataaggcagtaaccacatttattaatggtccattgatcgagtattccacaaaccgcagaaaggctgatagtaatacaacttcactgctttctccccatttgcattttggggaggtaagtgtcagaaaagtatttcatcttatacgcatcaagcagttgctttgggccaatgaaggtaacaaggctggtgaagagagtgtgaacttgtttctgaaatctattggtcttagggagtattcaagatacattagtttcaatcatccttacagtcatgaaagacctcttcttgggcacctaaaattcttcccctgggttataaatcagaactatttcaaggcatggaggcaaggtcgaactggctatccgttggtggatgctggcatgagagaattgtgggctactggctggctgcatgatcggatacgagttgttgtttctagtttcttcgtaaaggttctgcagctcccgtggaggtggggaatgaagtatttctgggacacactcttagatgctgatcttgaaagtgatgctcttggttggcagtatatatccggcactatccctgatgggcgtgagtttgaccgcatagataatccacagtttgagggttacaagtgtgatccacatggagaatatgtgcgaaggtggcttcctgaactatccaggctaccaactgactggatacaccacccatggaatgcaccagagtctgtactccaggcagctggaattgaacttggatcaaattacccccttcctattgtaggaatagaagcagcaaaatccaggttgcaagaagcgttaactgaaatgtggcagcatgaacgagccgctgctgagaatggaactgaagaagggctcggagagtcttctgaatcaacctccattgcgtttcctgaagacatacaaatggaggatagtcatgaacaggtgaggaataaccctcctcctccaactcgacgctatgaggatcagatggtccctagtatcactacttccctcgtgcgagttgaagaggaagaaagttctttggatcttccaagcagagctgaagtgcctacaaatgttactggggatcaagaaccaatgagagacacaatgaaccaagagggttttcagcctaatcataacaacactccaccacaacctaatactacactaaccctgcagtatgttgttgaagattcgacggcggaatcgtctagcagtactaggagagagagggatggaggtgtagttccagtttggtctccttcaaattctagctactcagagcagtttgtgagtgatgaaaatggcattgcaacaagttcttacttgcagagacatcctcagtctcaccaaataatgaattggaggcggctatctcaaactgggtaatacatatggctgcaataggatgtaaattgctatgaggcaattatgatgcactggcactggcgtcaagtcctattgatcagggaagctgaactttaattctagactgaatttgaaccccttctcctccctgagtgacctcaacaccagtagacctccagtgtgtatgatatgtttcgaattaatacaggctgcttattagctattcatttcttgttctaccataatgtagctctatgtatagaatgttgtactcaagtgagtgaaataagatatgtagtcattgaacaaactcaggttctcttttattttcctcattaatttcattagtagatatcttatcataatactttccgccttttctctctgtattaggtataaaactatactggtttgctactttgaaa

SEQ ID NO: 6328 - DNA, 2051 bp, Manihot esculenta
gtgtatatttctcggggattgagatgtcaggtgggtgtagcatagtctggttcaggagagatctgaggatagaagataacccagcactcgcagctggcgtaagagctggtgctgttgttgcagtgtttatatgggcacctgaagaggaaggccattattatcctggtagggtctcaaggtggtggctgaagcagagtttggctcatctggattcgtctttgaggagccttgggactcctcttgtcaccaagagatcaactgatagtgtttctactcttcttgaggttgttaaatctactggtgctacccatatcttcttcaaccacttgtatgaccccttgtcactggttagggatcaccgggcaaaggagattttgactgctcaaggaatagccgtaagatccttcaatgcagatttgctttatgaaccgtgggacgttaatgatgcccaaggacgccctttcaccacctttgctgccttctgggaaacatgccttagcatgccttatgatccagaggctcctcttctcccaccaaagaggattatttcaggtgatatatcgagatgcccttcagatttgttgatatttgaagatgaatctgaaaagggaagcaatgcactgcttgctcgagcgtggtcacctgggtggagtaatgctgataaggctttgactacattcatcaatggaccattaattgagtactccaagaatcgtaggaaggctgacagtgctacaacatcttttctttctccccatttgcattttggggaggttagtgtcagaaaagtctttcaccttgtccgtattaagcaggttctttgggcaaatgaagggaacaaggcaggcgaagagagtgtaaacttgtttcttaagtcaattggtctgagagaatattcaagatacatgagttttaaccatccttacagtcatgaacgtccacttcttgggcaccttaaattttttccttgggtagtggatgaaggttattttaaggcttggagacaaggtagaactggttatccattagttgatgctggaatgagagagttgtgggctactggttggctgcatgatcgaatccgagtagtagtttctagtttctttgtgaaagttctgcagcttccatggagatggggaatgaagtatttctgggatactcttttggatgctgatttagaaagtgatgctcttggttggcagtacatttccggtactctccctgatggccgtgcctttgatcgcattgacaatccgcagtttgagggttacaaatttgatccgcatggagaatatgtaagacggtggcttccagaacttgccaggctaccaactgaatggatacatcatccatggaatgcacctgaatccttactccaagctgccggaattgagcttggatcaaattatcctctcccaattgtagggatagatgcagctaaagtcaggttgcaagaagcgctttcagaaatgtggcagcaagaagcagctttcagagctgccattgagaatgggactgaggaagggcttggagattcatctgaatcagccccgtttgctttccctcaagacatgcaaatggaagaaactcatgagcttgtaagaaataaccttcctactacgattcggcgttatgaggatcagatggttccaagcattacttctttgctaagagttgaagacgaagaaacttcttcagatattcaaaatgttgcagaagacagcagaggagtggtgccaagaaatgtaaatgtcaatcaagaacaaagtagatacgctttaaatcagggggctgcacaaactattcatggtaacaataatttgccgcattttagtgttgtcagtgatccgggaaatgtggaagattcaacagcagaatcttctagtagtagtagaggtatagttccagtctggtcccctccaaccgctagttactcagatcaatttgctggagatgaaaatggaattggaacaagttcttatttgcagaggcatccacaatctcaccagataatgaattggaggcggctctctcagaatgggtaagaagaa

SEQ ID NO: 6329 - DNA, 2507 bp, Tripterygium wilfordii
tgagttttggagatggcaggtggtgggtgtagcatagtatggtttaggagagatctgagggtagaggataacccagcactattagctggtgtaagagcaggtgctgtggttgcagtatttatatgggcacctgaagaggagggtcactacaacccagggagggtttcaaggtggtggattaagcacagcttggctcaccttgaatcttccttgaggagccttggcacaaccctcctaaccaagaggtcaactgacagtgtggccactcttcttgagattgtcaaatctactggtgctactcagctcttcttcaaccacttatatgatcccatgtccctcgtcagggatcacagggcaaaagaggttttaggtgctcatggtgttgctgttcgttccttcaattcggatttactctacgaaccgtgggatgttaatgatgcccaaggtcaccctttcacaacttttactgctttctgggaaagatgccttagcatgccttatgatccagaggctccacttctaccaccaaaacggataatttcaggtgatgtatctaggtgcccttcagatagtttgatgtttgaagacgaatctgagaagggaagtaatgcccttcttgctcgagcatggtcaccggggtggagtaatgctgataaagctttgaccacattcctaaatggagcattaattgagtactcaacgaatcgtagaaaggcagatgctgctacaacctcatttctctccccccaccttcattttggggaggtaagtgttagaaaagtcttccatcttgttcggatcaagcaggtcttgtgggccaatgaagggaacaaggctggtgtagagagtgtgaacttgtttctgaagtcaattggccttagagagtattcaagatacatgagttttaaccatccttacagtcatgaacgacctcttctagggcaccttaagttttttccttgggttgttgatgaaggctattttaaggcatggagacaaggtagaactggttatccgttagtggatgctggtatgagagaattgtgggccacaggttggctgcatgatcgtataagagttgtagttgccagtttctttgtgaaggtcctgcaacttccatggagatggggaatgaaatacttctgggatacattattggatgcagatttagaaagcgatgctcttggttggcaatatatatctggtactctcccagatagccgtgagttggatcgcatagacaatccacagtttgagggttacaagtttgaccccaatggagaatatgtgcggcggtggcttcctgagctggccagactaccaacagaatggatacaccacccatggaatgcgcctgaatctgtacttgaagctgccggaattgagctgggatcaaattacccccttccagtcgtagggatagatgcagcaaaagtcaggttgcaacaagcactttcagctatgtggcagcaagaagcagcttcaagagctgtaatggagaatgggaccgaggaagggcttggggagtccactgaatcagcaccatttgcttttccccaagataccctgatggaggagaaccatgaacctgtgaggaacaatcctcctgctacaattcgacgttacgaggatcagatggttccaagtattacttgttctttggtgagagttgaagaggaagaaacttcttcagttcgaaattttgcagaagaaggcagagcagaagttccaagagatatacatgtcaatcaagagccaacaagagaccccctaaaccaagaggttacacaaaatcgtctaggtaatagcacaatgccacagttcaatatcacgattgcactggggaatgctgaagattccacagcagaatcttcgagtagtggtaatggtcggagagaaagggatgggggtgtagttccggtttggtctcctccaacttctagtttctcagagcattttgttggggatgaaaatggcatcggaactagttcatcatacttacagagtcatccacaatctcaccagataatgtcgtggaggcggctttctcaaacagggtaaacggatgtgcattgagactaaaagctggggttgaaggacgccatggtgcttatggtcggttgatgagtctctgtcagcagttttcttacttcaccaaccgaacttgatggaatgctgacaaccgatgtgtatgattgtcgaaaatgataaatgcatcccaactgctatcctttttcattgacgtacaatatatgtagatttttttcctgtatagtatttgtcaattcttataaggcagaggagcatcaatgtaggtatgtgtagtcctctaataaatgcaaagtgtgccctttcttgtttacttgattggttgggtatttgattacactttatgtttgcgttatgttagaatatgtacgaatgatgtgaaatgtctcagctattgaatagaaaagtacctaatgttagcagagcagaaggtcttggtacaatgtaaacttatggag

SEQ ID NO: 6330 - DNA, 2765 bp, Amsonia hubrichtii
tgcaatctttctctcttcttatggtctgaaatcatccttctcacctaagtgaaaactgacaagtcattctttgtcctccgagatagggcgccatattatggtttatagagaggagagagaggagtgttgaaagttgagttcttgaaaactttgggagatgtcaggtgggggatgtagtattgtatggttcagaagggatctgagagtagaagataaccctgcactggctgctggagtaagagcaggggcagtggttgcggtgttcatatgggcacctgaggaagagggtcactatcatcctggaagggtgtcaagatggtggcttaagcacagtttggctcatcttgattcttccttgaggagccttggcactgctcttgtcacaaagagatctactgatagtatttcttctcttcttgaagttgtcaagtctacaggggctactcagctcttctttaatcatttatatgaccctatatcactggtgagggatcaccgggcaaaggaagttttaacagctcaaggtgtcaccgtgcactccttcaatggcgacctgctctacgaaccctgggaagttcatgatgaagaaggtcgtccgttcaggacctttgcagcattctgggaaagatgcctcagcatgccttatgaccctgaagctccacttcttccacctaaaagaataatctccggtgatgtctccagatgcccttcagataacttaatctttgaggatgaatcagaaaaaggaagtaatgctcttcttgctcgggcatggtctcctggctggagtaatgctaacaaggcactgacgaccttcattaatggaccattaattgaatactcaaagaaccgtcgaaaggctgatagtgcgacaacctcatttctttctcctcacttacattttggggaagtcagtgtacgaaaggttttccatctagttcgaattaaacaagtcctgtgggccaacgagggaaacagagcaggtgaagagagtgtcaacctattcctcaagtcaattggtctcagagagtattcaaggtacatgagctttaatcatccttacagccatgaaaggcctctgcttggtcacctcaagtatttcccttgggtattggatgaggattactttaaggcctggcgacaaggtagaactggttaccctttggtggatgctggtatgagagagctatgggcaactggctggctacatgataggatacgagttgttgtctctagtttctttgtcaaggttttgcagcttccttggagatggggtatgaaatatttttgggatactctactagatgcagatcttgaaagtgatgctcttggctggcagtatatatccggtactctacctgatggtcgtgaatttgatcgcatggacaatccacagtttgagggttacaaatttgatccaaatggagagtatgtccggaggtggcttcctgaacttgctaggttacctactgaatggatacatcatccttggaatgcaccagaatctgtactccaagctgctggggttgagctaggttccaattatcctctccctatagttggaatagatgctgccaaagccaggttggtagaagcgctttcacaaatgtggcagcttgaggcagcttcaagagctgctattgagaatggaactgaagaaggtcttggggactctgaatcaggaccaattgcctttcctcaatacatgcaagttgagatggatcagcaacctatcagaaataatcccacaactgcagtaattcgacgttatgaggatcagatggtcccaagcataacttcatctctgttgagaatggaagatgaagaaacttctgtggatctgagaaattcagcagcaagtagtagagcggaagtgccaataactgctaatgtaactgaagaacctgtgagagaagcatttaaccaacctcatacgccaacagttcaaaataaccacactatgcaccaattcagttttccagtaggtcgaagaaattctgaagactcaacagcagaatcttccattggtggtaggagagaaagggatggaggtgtagttccagtgtggtctccttcaagttctaatttttcagatccatttgttagtgaagataatggcttgggagctagttcttcttacttgcaaaggcatcctgagtctcaccaattgatgaactggaggcggctctctcaaactggataaggtgaatgcatatacatgaccaactactaggcaagagctgaaaattccagatactttatagtgtcccttggatgatagaagctctccatgaatagcaaacaaattaaccctcttctttttgactcgttcaggagtggatctgtgcctaaattttgaaattggatcaggggtttcatctgtaacctctcgttgtctcctttggtgccacacaggtggctctgttgtatagcatatattcttcttgtaaggctggagaaatcttgaaatgggatgggcattatcaataaactcggcctctttgtttattaggcagctgtagttattacaataacgttgacatatgcccctcctcttattcccttgcacaatttccctgttactacatccatgatgttccgggattcagctttcctgcctgtatacttgcactgtacttgttttaagggccaagtaacttgtatattgtcagtagtcggtgtttcagtggcttcttgaacatattctgccaccaaatgtaacctttccatagtatctttccaatttggagatgtataacatcctt

SEQ ID NO: 6331 - DNA, 3125 bp, Solanum lycopersicum
aggataagaaagaaagaaagatataaaaataaaatcttgaaaaaacataaagttgtggatgcaaatctcccataagttctcatgttaccccaccaccataaccaatcaccctcaatctcactttctcctccctctttctctggagaggtttgtttttttgggtggacaatgcctatagtaacttcacaagaatagcatctcatcattcatcaaagaataacatttggggtttgttaaagttaggttctttactagaatttgcctaaaaaaaatcatctttgtaatctttatctcctcagtgaaagctacagggaacagtcaaagtatagataagattaaccccaatatacttctgtctaagaaagactcaataacatggtgtttacatagtaagagagaaaaatagagagaaaaagactagtctttggtgttgttgaaggaagatgtcaggtggtggttgtagcatagtatggtttagaagggatctgagagtggaagataaccctgctttggctgctggagttagagcaggggcagttattgctgtgtttatttatgctcctgaagaagaagggcattattatcctggtagagtttcaagatggtggcttaagcagagtttggctcatcttgattcatctttgaagagtcttggaacctcccttattacaaagagatctactgatagtatttcttctcttcttgaagttgttaaatctactggtgctactcagctcttcttcaatcatttgtatgatcctatttcacttgtgagagatcatcgcacaaaagaaatcttaacagctcaaggtatatcagtgcgttcctttaatgctgatttgctctatgaaccatgggaagttaatgacgatgaaggtcgcccgttcacaacattttctgctttttgggagaaatgccttagcatgccttatgatccagaagctccacttcttcctcccaaaaggattatatctggtgatgcatcaagatgcccttcagacaacttggtatttgaagatgaatcagagaaaggaagcaatgcacttcttgctcgggcatggtcacctggctggagtaatgctgataaagcactaactactttcgttaatggaccattacttgagtactcgcagaaccgtcggaaagctgatagtgcaacaacatcctttctatctccacatttacattttggggaagtcagtgttcgtaaggtattccattttgttcgcatcaagcaagttctctgggccaatgaaggaaataaagctggtgaagagagtgttaatttgttccttaagtccattgggctgagggagtactcaagatacatgagttttaatcatccttatagccatgaaaggccccttcttggtcacctaaggtacttcccatgggtagtggatgaaggctactttaaggcatggagacaaggtagaacaggttatcctttggttgatgctggtatgagagagttatgggcaactggttggcttcatgatcgtatccgagtcgtggtatctagtttctttgtgaaggttctgcagcttccatggaggtgggggatgaagtatttttgggacacattgttagatgcagatcttgagagtgatgctcttggttggcaatatatctctggtaccctacctgatggtcgtgagcttgatcggattgataatccacagtttgtgggatacaagtgtgaccctcatggggaatatgtccggcggtggcttcctgaacttgctaggctgcccaccgaatggatacaccatccatggaatgcaccagaatctgtgcttgaagctgctggcattgagctgggttccaattatcctcttcctatagttgaaattgattcagcaaaagttagactagaacaagccctatcacaaatgtggcagaatgatgcagctgcaagagctgcgattgagaatggtatggaagaaggacatggtgactctgctgactccccaatagcatttcctcaggccatgcatatggaaatggaccatgaaccagtcaggaacaaccctgtaatagttactgttcgacgctatgaagatcaaatggtgccaagcatgacgtcatctttgttcagagctgaagatgaagagaactccgtggacattaggaattcagttgtggaaagtagggcagaagttccaacagacatcaatgtagctgaagttcataggagagacacgcgtgaccaagccgtcatgcaaactgctcgaaccaatgctaccccacattttaattttgcggtaggtaggaggaattctgaagattcaacagcagaatcttccagtagtactagagaaagggatgggggtgtagtgcctacatggtctccctcaagtagtaactattcggaccaatatgttggtgatgataatggtattgggaccagttcatcttacttgcaaaggcatccacaatctcaccagctaatgaactggcagcggctttctcaaacagggtgatcatttatgtggagttacgatagcaacaaggcggagaagcaagtggctaatacagacatttggctcagcacatttagtacagcattcatctactctttctctcatagtcctgacctgatcagccatctttgtgtctatatctctaattgatcaggtggttcgtctggattttcatcctcatctgtcgggcatccccatttacctattataccatatatgtgtctctgctgtatagtatagaagtttttcataaggccaaataagtgttagaaagaggttgcagtcctctgtcaagctcacacttgtgcctttttttttccttctcttttctgctacttacattttgatggcaataacgattatctgaagtcctggaactaattagatttttgtggatatcatagtttcaaactctgtttgacggatgtacatgtggtttaagcagcttcatctcatatttttgttatgggaacattgtcattattctataagatttctagtttgaacattttcattgttctgcttggcagttgtgtctgttcagctgaaagctgtaagttgagttgttaacattccctgtttggtcttgtgtgtgcgtgtttgtgtgtgtatcttatcaatgcatcagaagatattcgggta

SEQ ID NO: 6332 - DNA, 3128 bp, Solanum lycopersicum
gtggatgcaaatctcccataagttctcatgttaccccaccaccataaccaatcaccctcaatctcactttctcctccctctttctcttgaggggtttgtttttttgggtggacaatgcctatagtaacttcacaagaatagcatctcatcattcatcaaagaataacatttggggtttgttaaagttaggttctttactagaatttgcctaaaaaaatcatctttgtaatctttatctcctcagtgaaagctacagggaacagtcaaagtatagataagattaaccccaatatacttctgtccaagaaagactcaataacatggtgtttacatagtaagagagaaaaatagagagaaaaagactagtctttggtgttgttgaaggaagatgtcaggtggtggttgtagcatagtatggtttagaagggatctgagagtggaagataaccctgctttggctgctggagttagagcaggggcagttattgctgtgtttatttatgctcctgaagaagaagggcattattatcctggtagagtttcaagatggtggcttaagcagagtttggctcatcttgattcatctttgaagagtcttggaacttcccttattacaaagagatctactgatagtatttcttcacttcttgaagttgttaaatctactggtgctactcagctcttcttcaatcatttgtatgatcctatttcacttgtgagagatcatcgcacaaaagaaatcttaacagctcaaggtatatcagtgcgttcctttaatgctgatttgctctatgaaccatgggaagttaatgacgatgaaggtcgcccgttcacaacattttctgctttttgggagaaatgccttagcatgccttatgatccagaagctccacttcttcctcccaaaaggattatatctggtgatgcatcaagatgcccttcagacaacttggtatttgaagatgaatcagagaaaggaagtaatgcacttcttgctcgggcatggtcacctggctggagtaatgctgataaagcactaactactttcgttaatggaccattacttgagtactcgcagaaccgtcggaaagctgatagtgcaacaacatcctttctatctccacatttacattttggggaagtcagtgttcgtaaggtattccattttgttcgcatcaagcaagttctctgggccaatgaaggaaataaagctggtgaagagagtgttaatttgttccttaagtccattgggctgagggagtactcaagatacatgagttttaatcatccttatagccatgaaaggccccttcttggtcacctaaggtacttcccatgggtagtggatgaaggctactttaaggcatggagacaaggtagaacaggttatcctttggttgatgctggtatgagagagttatgggcaactggttggcttcatgatcgtatccgagtcgtggtatctagtttctttgtgaaggttctgcagcttccatggaggtgggggatgaagtatttttgggacacattgttagatgcagatcttgagagtgatgctcttggttggcaatatatctctggtaccctacctgatggtcgtgagcttgatcggattgataatccacagtttgtgggatacaagtgtgaccctcatggggaatatgtccggcggtggcttcctgaacttgctaggctgcccaccgaatggatacaccatccatggaatgcaccagaatctgtgcttgaagctgctggcattgagctgggttccaattatcctcttcctatagttgaaattgattcagcaaaagttagactagaacaagctctatcacaaatgtggcagaatgatgcagctgcaagagctgcgattgagaatggtatggaagaaggacatggtgactctgctgactccccaatagcatttcctcaggccatgcatatggaaatggaccatgaaccagtcaggaacaaccctgtaatagttactgttcgacgctatgaagatcaaatggtgccaagcatgacgtcatctttgttcagagctgaagatgaagagaactccgtggacattaggaattcagttgtggaaagtagggcagaagttccaacagacataaatgtagctgaaggtcataggagagacacgcgtgaccaagccgtcatgcaaactgctcgaaccaatgccaccccacattttaattttgcggtaggtaggaggaattctgaagattcaacagcagaatcttccagtagtactagagaaagggatgggggtgtagtgcctacatggtctccctcaagtagtaactattcggaccaatatgttggtgatgataatggtattgggaccagttcatcttacttgcaaaggcatccacaatctcaccagctaatgaactggcagcggctttctcaaacagggtgatcatttatgtggagttacgatagcaacaaggcggagaagcaagtggctaatacagacatttggctcagcacatttagtacagcatgcatctactctttctctcatagtcctgacctgatcagccatctttgtgtctatatctctaattgatcaggtggttcgtctggattttcatcctcatctgtcgggcatccccatttacctattataccatatatgtgtctctgctgtatagtatagaagtttttcataaggccaaataagtgttagaaagaggttgcagtcctctgtcaagctcacacttgtgccttttgtttttccttctcttttctgctacttacattttgatggcaataacgattatctgaagtcctggaactaattagatttttgtggatatcatagtttcaaactctgtttgacggatgtacatgtggtttaagcagcttcatctcatatttttgttatgggaacattgtcattattctataagatttctagtttgaacattttcattgttctgcttggctgttgtgtctgtaaagctgaaagctgtaagttgagttgttaacattccctgtttggtcttgtgtgtgtgtgtttgtgtgtgtatcttatcaatgcatcagaagatattcgggtacttgaacgagcagttcttatagttagttgtgttacactagaacaagagagactcttc

SEQ ID NO: 6333 - DNA, 2377 bp, Malus domestica
aaaagaagaaggccagacaatcctctgtctagaagaaaatcatatcttttcaccctgaaaaaagaaaaagaaatcaacctttttgttgttggtgggtcgtaaatcccatcctcataatattcaaaagtaagagaaatatagcaaaaagatcagatttagttacgaccccctgttgtgtgcttctagagagagatagaagagaaggatgatctgtccatatggtataatatgtgtttgagatagaaaaatattggtttgctgggttttgtttgttggtgaaaaatatatttttggagatgtcaggtggtggttgcagtgttgtttggttcaggagagatctgagggttgaagataacccagctttggcagctgcagtgagagcaggaggtgtggtgtgtgtcttcatctgggctcctgaggaggaaggcccttattatcctggaagggtttcaagatggtggctaaaacacagcttggctcatcttgattgctccctgaaaagtcttggcacttctctcatcaccaaaagatccactgacagtgtttcttctctccttgaagttgttgtttccactggtgccactcagcttttcttcaaccacttatatgatcctatatcactggttagggatcaccgggcgaaggaggttctgactgctcaaggtatagctgtgcgctcctttaatgcggatttgctctacgaaccatgggatgttaatgatgtccatgattgcccgttcactacctttgatgccttttggggaagatgtcttagcatgccatatgacccggatgcgccacttctcccccctaagagaattatttcaggtgatgtatcaaggtgcccttctgatacattggtttttgaagatgaatccgagaagggaagtaatgcacttcttgctcgagcatggtcacctgggtggagtaatgctgataaggctctgaccacatttataaatggacccttacttgattattcttataaccgcagaaaggctgatggtgctacaacatcattactttctccccatttgcattttggggaggtgagtgtgagaaaagcatttcatcttgctcgcatgaagcaggttctttgggccaatgaaagcaacaaggctggtgaagagagcgtaaacttgtttctgaagtctattggtcttcgggaatattcaagatacattagtttcaatcatccttacagtcatgaaagacctcttcttgggcacctaaaattcttcccctgggttataaatcagaactactttaaggcatggaggcaaggtagaactggctatccattggtggatgctggcatgagagagttgtgggctactggctggctgcatgatcgaatacgagtagttgtttctagtttcttcgtaaaggttctgcaacttccatggaggtggggaatgaagtatttctgggatacactattagatgctgaccttgaaagtgatgctcttggctggcagtatatatctggtactatccctgatggccgtgaatttgaccgcatagataatccccagtttgagggttacaagtgtgatccaaatggagaatatgtgcggaagtggcttcctgaacttgctaggctaccaactgaatggatacaccacccatggaatgcaccagaatctgtactccaagcagctggaattgaattaggatcgaattaccctctccctattgtaggaatagatgcggcaaaaacccggttgcaagaagctttatcagagatgtggcagcacgaagctgcttcaagagctgctgttgaaaatgggactgaagaagggcttggagactcgtctgaatcagtgccaattgcctttcctcaagacatacaaatggaggaaaataatgaaccagcgaggaacaaccctcctggcactcgaaggtatgaggatcagatggtcccaagcattactacttctttggttagagctgaagaggaagaaacttctttggaacttcaaaatttaacagaagaaaccagagcagaagtgcctacagatttaattgtgaatcaggaaccaagaagagacatgttaaaccaaggggtttttcagactactcgtaacaatgctcttccaccacccaatgctgcaatagggatgcaacatgctgttgaagattcgactgcagaatcttccagtagcactaggcgagagagggatggaggtgtagttccagtttggtctccttcaagttctagctactcagagcagtttgggagtgaagacaatagcattggaacaagttcgtacttgcagagacatcctcagtctcaccaaataatgaattggaggcggctatctcaaacggggtaagaattcttgaacgattcaccaatatccacaatgagactaaa

SEQ ID NO: 6334 - DNA, 2835 bp, Nicotiana benthamiana
tatttttattttttgtagtaacttgttcagaatagcataactcattcaagaattgagagaattaagttcttgtacgtacagataacatacagggaagttaaagataggttctttactataaagttcactttttttttgttgattatggtttgtaatcgttatctccttagtgaaagctacacggagcagtgaaaaaaagagataagattaatcccattattcttctatccaagaaaaagacacactaacatggtgtttacatagagagaaaaaatatttatatagagagagagagttgtggttggtgctgaggttggtgttgaggttgaggttgttgaaagaagatgtcaggtggtggttgtagcatagtatggtttagaagggatctgagagtagaagataatccagctttagctgcaggagtaagagcaggagcagtaattgctgtatttatatgggcacctgaagaagaagggcattattatcctggtagagtttcaagatggtggcttaagcaaagtttggctcatcttgattcatctttgaaaagtcttggcacttctcttgttactaaaagagctactgatagtatttcttctcttcttggaattgtcaaatctactggtgctactcagctcttcttcaatcatttatatgatccaatttcacttgttagagatcatcgcgcaaaagaagtgttaacagctcaaggtatatctgtgcgctcctttaatgccgatttgctctatgaaccatgggaagttaatgatgaagaaggtcgcccgttcacaacattttctgctttttgggaaaaatgccttagcatgacttatgatcctgaagctccacttctccctcctaaaaggattatacctggtgatgcatcaagaagctcttcggacagcttggtatttgaagatgaatcagagaaagggagcaatgcacttcttgctcgagcatggtcaccagggtggagcaatgctgataaagcactaactactttcgttaatggaccattacttgaatactcacagaaccgcaggaaagctgatagtgcgacgacttcctttctgtctccacatttacactttggggaagtcagcgttcgtaagttattccattttgttcgcatcaaacaagttctctgggccaatgaaggaaataaagctggtgaagagagtgtcaatttgttcctcaagtcgattggacttagggaatactccagatacatgagttttaatcatccttatagtcatgaaaggccgctgcttggtcacctaaggtactttccatgggtagtggatgagggttattttaaggcgtggaggcaaggtagaacaggttatcctttggttgatgctggtatgagagagctatgggcaacgggctggctacatgatcgtatcagagtcgtggtatctagtttctttgtgaaggttctgcagcttccgtggaggtggggaatgaagtatttttgggacacattgttagatgcagatcttgagagtgatgctcttggttggcaatatatctctggtaccctacctgatggtcgtgagtttgatcggattgataatccacagtttgtgggatacaagtgtgaccctcatggggaatatgtgcggcggtggcttcctgaactgtctaggcttcccactgaatggatacaccacccgtggaatgcaccagaatctgtacttgaagctgctggcattgagctgggttccaattatcctcttcccatcgtcgaaattgatgcagcaaaagtaagactagaacaagccctatcacaaatgtggcagcacgaagcagcttcacgagctgcgattgagaatggtatggaagaaggacacggtgactctgctgactccccaatagcattccctcaggccatgcatatggaaatggatcacgaaccagttaggaacaataaccccgttatagttactgttcgacgctatgaagatcagatggtcccaagcatgacatcgtctttgttcagagttgatgatgaagaaacctcagtgaatatcagaaattcagtggtggacactagagcagaagttccgaacgacgtcaatgtaactgaaggtcctaggagagacacactcgaccaagccgtcacacaacgagctcgaacaaacgccactccgccgcagtttaattttgtggttggtaggagaaattctgaagattctacagcagaatcttccagtagtactagagaaagggacgggggtgtagttcccgtatggtctccctcaagtactaattactccgaccaatatgttggtgatgacaatggcattgggaccagttcatcttacttgcaaaggcatccgcagtctcaccagctaatgaattggcagcggctttctcaaacagggtgatcatatgtgtggagttacgatagctacaaggtggagaagcaagtggctagtccagccatttggctcagcacatttagtgcaaatcgatcaggtggtttgtctggaatttcttcctcatctttcgggcaaccccatttccctgttgtacaatatatgtgtctctgctgtaaagtatagaagtcctgatttaggccaaataagtgtcagagaggggttcagagtcctctatcaagctcacatttgttctgctaataagttttgatggcaataacttattacctaagtactggcactgattggaagaacattgtggatatcatagtcttaagctctgtttgacagatgtaaatgtggtttaaacagcttcatcatatttttgttgtcagtacatttgtcacttattctataagatttctagtttgaacatttttattgttttgctggg

SEQ ID NO: 6335 - DNA, 2805 bp, Eucalyptus grandis
aacaccaccaaaattattttctgccgaaattcccggaaagaacataaaaatttattcaccgaagaagcaggaagaagagcagcatcattcccgattagagtcagagatacccattaaaaaaaactatttctttttgtcatttcttggtcattgctgtgctaagcattcccctgctcataatagcaaaggttgcatgtgcaaaggaacaagataagatcagctgacattccgaaagaggtatgctatgcttcgtagctgagcaagcgagagttggagaaatctacgcagaggttggtggccacggtcgggtcttcctatgctgtgattgtttgaatgtgaagaagaagaagaagagacatgtctgggtgtagcatagtgtggttcaggagagatctgagggttgaggacaaccctgcactagcggctggggtgaggtcaggttctgtgctggccgtgttcatctgggcgcccgaggaagaaggcgcgtattaccctggtagggtttcgaggtggtggctgaagcacagcctggctcaccttgactcgtccctcagaagccttggcacttgcctcatcaccaggagatccactgacagcgtttcctccctcctggagcttgttaagtccactggggctactcagctcttctttaaccacttgtatgatcccatatcacttgtcagagatcacagagcaaaggaggttttgaacgcccaggggataaatgtacactcattcaatgcagacttgctctatgaaccgtgggaagtaaatgatgatcaaggccatccattcacaacctttgctggtttctgggagaaatgcctcagcatgccttatgatccagaatccccactgcttcctccaaagagaataatttcaggtgatgtatcaagatgtccttcagaagctttggtgtttgaagacgaatctgagaaaggaagcaatgcgcttcttgctcgtgcttggtcccctgggtggagtaatgctgataaggctctgaccacatttgttaatggaccacttttagagtactctaaaaaccgcagaaaggctgacagtgctacaacctcattcctctctcctcacttgcacttcggagaagttagcgtgaggaaagtctttcacctggttcgcatcaagcaggttttatgggcgaatgaggggaacaaggctggtgaagagagcgtgaacttgttccttaaatctattggtctacgagagtactcaaggtacatgagctttaaccatccttacagccatgaaaggcctctccttggacacctcaagtacttcccatgggttgtggatgaggggcattttaaggcatggagacaaggcagaactgggtatccactagttgatgccggcatgagggagttgtgggctacagggtggcttcatgatcgtattagagttgtggtttcaagcttctttgtgaaggttttgcaacttccatggagatgggggatgaaatacttctgggacaccctcttggatgcagatctagaaagtgatgcccttggatggcaatacatatccggtacaatccctgatggtcgtgagtttgaccgcattgataatccacagtttgaaggttacaagtttgatcctaatggagaatatgtacgacgatggcttcccgaactggccagactaccaacggaatggatacaccatccttggaatgcacctgaatcggttcttcaagctgctggaattgagcttggatcaaattatcctctccctattgtaagtatagatgcagccaaagtaaggctgcaagatgcactttccattatgtggcagcacgaagcaacatcaagagccgctatagaaaacggaactgaagaagggctgggagactcatctgaatcagctccgatcgcttttcctcaagatattcaaatggaggaaaatcacgaaactatgcggaataacccaccaggtccagttcaccgctatgaggatcagatggtaccaagcataacttctctggttagagcggatgaagaagagacttcttctggtattcaaaactccataggtgatactagagcagaagtgcctgcaaatgtaaatttgaatgaagaaccaagaagagacacgttaaatgagggagttttccaacaacttcgaccaaacaacacccaaccaatgtataacttttcacctgggctacataatgatgctgaagattccactgcagagtcttcgagcactggcaggagagagagggatggaggagtcgttccagtttggtcgccgtcaacttctagttactctgaccaaattgcgggcgacgaaaatggaattggcaatggttcagcatttttacaaaggcatccacaatcccatcaaataattaattggaggcgattatctcaaactgggtgactatgcaatacgcaagaaacatgaggagatatcatggagatggccacagcctaatccgaaaggggcacaagaagatgtagaagtcccgagtacatatcatatggcactgcttctctcttcaccagttcgacctgaccagcaatttaacctcgaaaagctacaccatggaagtttagaattgttccaggcagctggtggtccgtcctttttcttaatcattttccacttgtaccatatatggaatttgttcgtttgacaaaaaaaggtatgaagccgttgtgtatagtatatcttgttctcatagctggagagagtcgtcataacacggacatatgggcccctaataaaaccaacattgtgctttctcttcggttcatagttactctcatcatcatctagcagtcttca

SEQ ID NO: 6336 - DNA, 2750 bp, Gossypium raimondii
aaccaatcctcttcactcaggcttcatatatagaagatattcattgaaaaaaaaaacagagggaataatctttaaaaaataatttgtcatttgcactattatcctccattaataatgcttaaaacctcctttggttcacaaaatagccagaaagataaaactttttacttagaaaccaagaattccgtgccttatggtatatagttaagcaaagataaaatctgggtttttgttttgggagttatgtctagcatagtttggtttagaagggatcttagagttgaagataatccagcactcttagccggagttagggcaggccctgtttttgcagttttcatatgggcacctgaagaagaaggccattatcaacctggaagggtttcaagatggtggcttaaacatagtttggctcttcttgattcttctttgaggagcctgggaacttgcctcataacaaagagatcaactgatagtgtttcatctcttctccagattgttaaatccactggtgccactcagctcttcttcaatcacttgtatgatcctatatctctggttagggatcatcgagcaaaggaagtattgacggcccatggtgtagcagttcgatcgttcaatgcagatttgctttatgaaccttgggatgtaaatgatgataatggccgccctttcactacttttactgctttctgggaaaaatgccttaacatgccttttgaccctgaggctcctcttcttccacctaaaagaataatttcaggtgatgtgttaacttgcactacggatgtgttggtgtttgaagatgaattggagaagggaagcaatgcgcttttagctcgagcatggtcaccagggtggagcaatgcagataaagctttgacaacgttcattaatggacctttaattgagtactcgaagaacagaagaaaagctgatagtgcaacaacttcatttctttccccccatttgcattttggggaggttagtgtccgaaaagtctttcatctcgttcgaatgaagcaggttttatgggctaatgaagggaacaaagctggtgaagagagtgtaaacttgtttctgaagtcgatcggcttgagggaatactcaagatacttgagttttaaccatccttacagccatgaaaggcctcttctcggacatcttaagtttttcccttgggttgtcaatgagggttatttcaaggcatggagacaaggaagaacaggttatccattggtggatgctggcatgagagagttatgggccactggttggctgcatgatcgtattcgagttgttgtatcgagtttttttgtcaaagttttgcagctcccatggagatggggtatgaagtatttctgggatactctcttggatgcagatttagaaagcgatgctctcggttggcagtatatatccggtactctcccagatggtcgtgagttcgaccgcatcgataatccgcagtttgaaggttacaaattcgatccgaatggagaatatgtccgtcggtggcttccagaacttgcaagactaccaactgattggattcaccatccatggaatgctcctgaatctgtactccaagctgctggcatcgagcttgggtcaaattaccctctgcctattgtaggaatagatgctgcaaaatccaggttgcaagaagcactttcagagatgtggcaactagaagcagcttcaagagctgcaattgagaatggaactgaggaaggcctcggagactcttccgagtcagtgccatttgcatttccgcaagacatacaaatggaggaaaacattgaaccagcaaggaacaatgctccagctacaacacggagatatgaggatcagatggttcctagcatcacttcttcgttgttgagaggtgaacatgaagagtcttcttcgtatcttagaacttcagcagaagatagcagagcagaagttccaggaactgtaaatataaatcgagaacaacggagagacacattaaaccaagcgattccagaaacagcacgcagcctgcaacttaacttcccgattgggttgagaaatgctgaggattccacagcagaatcatctagtagtagtaggagagaaagggatggcggagttgttccagtttggtccccgccatcttcgagttaccccgagcaatttataggtgaggaaagtggtatcggtgcaagctcatcttttctacaagggcatccacagtcccaccaaatcataaattggaggcgattatctcaaaccgggtaaaacgaatacacgccaaaggcaggtacctagtacttgcagaacgctcagtctagtggccggattggacgataacatggcatgttatcaaccccatatattgtccacgaatctaactcgacctgcagccaactcgggagttggatgaatgatcagctatccaatgttctaccatacgcatagctctgctgtatagtgttttgtctcctttatataaaagggtagatgagattcatggtagaaatgttgtaatcctggaataaaaacaggcttctgtgtatttactttttaactgattaggaagttgtattgtataactcattcctattgctccctcttttttctttttatttaattacttatgtttgtcatttttaccgtcaaattttcggatataaatttaaaggagatatggccttccaagaatattaaatgatcgatgtgttctgatgcttttgagtctcgtaaccatgttttttttttcggtc

SEQ ID NO: 6337 - DNA, 2638 bp, Gossypium raimondii
agagggaataatctttacaaaataattagtcatttgcactattatcctccattaataatgcttaaaacctcctttggttgacaaaatagccagaaagataaaactttttacttagaaaccaagaattccgagccttatggtatatagttaagcaaagataaaatctgggtttttgtttcgggagttatgtctagcatagtttggtttagaagggatcttagagttgaagataatccagcactcttagctggagttagggcaggccctgtttttgcagttttcatatgggcacctgaagaagaaggccattatcaacctggaagggtttcaagatggtggcttaaacatagtttggctcttcttgattcttctttgaggagcctgggaacttgcctcataacaaagagatcaactgatagtgtttcatctcttctccagattgttaaatccactggtgccactcagctcttcttcaatcacttgtatgatcctatatctctggttagggatcatcgagcaaaggaagtattgacggcccatggtgtagcagttcgatcgttcaatgcggatttgctttatgaaccttgggatgtaaatgatgataatggccgccctttcactacttttactgctttctgggaaaaatgccttaacatgccttttgaccctgaggctcctcttcttccacctaaaagaataatttcaggtgatgtgttaacttgcactacggatgtgttggtgttcgaagatgaattggagaagggaagcaatgcgcttttagctcgagcatggtcaccagggtggagcaatgcggataaagctttgacaacgttcattaatggacctttaattgagtactcgaagaacagaagaaaagctgatagtgcaacaacttcatttctttccccccatttgcattttggggaggttagtgtccgaaaagtctttcatctcgttcgaatgaagcaggttttatgggctaatgaagggaacaaagctggtgaagagagtgtaaacttgtttctgaagtcgatcggcttgagggaatactcaagatacttgagttttaaccatccttacagccatgaaaggcctcttctcggacatcttaagtttttcccttgggttgtcaatgagggttatttcaaggcatggagacaaggaagaacaggttatccattggtggatgctggcatgagagagttatgggccaccggttggctacatgatcgtattcgagttgttgtatcgagtttttttgtcaaagttttgcagcttccatggagatggggtatgaagtatttctgggataccctcttggatgcagatttagaaagcgatgctctcggttggcagtatatatccggtactctcccggatggtcgtgagttcgaccgcatcgataatccgcagtttgaaggttacaaattcgatccgaatggagaatatgtccgtcggtggcttccagaacttgcaagactaccaactgattggattcaccatccatggaatgctcctgaatctgtactccaagctgctggcatcgagcttgggtcaaattaccctctgcctattgtaggaatagatgctgcaaaatccaggttgcaagaagcactttcagagatgtggcaactagaagcagcttcaagagctgcaattgagaatggaactgaggaaggcctcggagactcttccgagtcagtgccatttgcatttccgcaagacatacaaatggaggaaaacattgaaccagcaaggaacaatgctccagctacaacacggagatatgaggatcagatggttcctagcatcacttcttcgttgttgagaggtgaacatgaagagtcttctttgtatcttagaacttcagcagaagatagcagagcagaagttccaggaactgtaaatataaatcgagaacaacggagagacacattaaaccaagcgattccagaaacagcacgcagcctgcaacttaacttcccgattgggttgagaaatgctgaggattccacagcagaatcatctagtagtagtaggagagaaagggatggcggagttgttccagtttggtccccgccatcttcgagttaccccgagcaatttataggtgaggaaagtggtatcggtgcaagctcatcttttctacaagggcatccacagtcccaccaaatcataaattggaggcgattatctcaaaccgggtaaaacgaatacacgccaaaggcaggtacctagtacttgcagaacgctcagtctagtggccggattggacgataacatggcatgttatcaaccccatatattgtccacgaatctaactcgacctgcagccaactcgggagttggatgaatgatcagctatccaatgttctaccatacgcatagctctgctgtatagtgttttgtctcctttatataaaagggtagatgagattcatggtagaaatgttgtaatcctggaataaaaacaggcttctgtgtatttactttttaactgattaggaagttgtattgtataactcattcctattgctccctcttttttctttttatttaattacttatgtttgtcatttttaccgtcaaattttcggatataaatttaaaggagatatggccttccaagaatattaaa

SEQ ID NO: 6338 - DNA, 2443 bp, Nicotiana benthamiana
gttaccccaccaccttaaccaatcacattcactttctcgttctcctctctctctctcttgaacctatttttattttttgtagtaacttgttcagaatagcataattcattcaagaattgagagattaagttcttgtacgtatcattaacatctagggaagttaaagataggttctttactataaagttcacttttttgtgttgattatggtttgtaatcattatctccttagtgaaagctacagggagcagtgaaaaatagagataagattaatcccattattcttctatccgagaaaaagacacactaacatggtgtttacatagagagaaaaaatatatatagagagagagagttgtggttggtgttgaggttgttgaagatgtcaagtggtggttgtagcatagtatggtttagaagggatctgagagtagaagataatccagctttagctgcaggagtaagagcaggagcagtaattgctgtatttatatgggcacctgaagaagaagggcattattatcctggtagagtttcaagatggtggcttaaacaaagtttggctcatcttgattcatctttgaaaagtcttggcacttctcttgttactaaaagatctactgatagtatttcttctcttcttgaaattgttaaatctactggtgctactcagctcttcttcaatcatttatatgatccaatttcacttgttagagatcatcgcgcaaaagaagtgttaacagctcaaggtatatctgtgcgctcctttaatgccgatttgctctatgaaccatgggaagttaatgatgaagaaggtcgcccgttcacaacattttctgctttttgggaaaaatgccttagcatgccttatgatcctgaagctccatttctccctcctaaaaggataatacctggtgatgcatcaggatgctcttcggacagcttggtatttgaagatgaatcagagaaaggaagcaatgcacttcttgctcgagcatggtcaccagggtggagcaatgctgataaagcactaactactttcgttaatggaccattacttgaatactcacagaaccgcaggaaagctgatagtgcgacgacttcctttctgtctccacatttacactttggggaagtcagcgttcgtaaagtattccactttgttcgcatcaaacaagttctctgggccaatgaaggaaataaagctggtgaagagagtgtcaatttgttcctcaagtcgattggacttagggaatactccagatacatgagttttaatcatccttatagtcatgaaaggccgctgcttggtcacctaaggtactttccatgggtagtggacgagggttattttaaagcttggaggcaaggtagaacaggttatcctttggttgatgctggtatgagagagctatgggcaacgggctggctacatgatcgtatcagagtcgtggtatctagtttctttgtgaaggttctgcagcttccgtggaggtggggaatgaagtatttttgggacacattgttagatgcagatcttgagagtgatgctcttggttggcaatatatctctggtaccctacctgacggtcgtgagtttgatcggattgataatccacagtttgtgggatacaagtgtgaccctcacggggaatacgtgcggcggtggcttcctgaactgtctaggctgcctaccgaatggatacaccacccatggaatgcaccagaatctgtacttgaagctgctggcattgagctgggttccaattatcctcttcccatcgtcgaaattgattcagcaaaagtaagactagaacaagccctatcacaaatgtggcagcacgaagcagctgcaagagctgcgattgagaatggtatggaagaaggtcatggcgactctgctgactccccgatagctttccctcaggccatgaatatggaaatggaccacgaaccagttaggaacaatcaccccgttatagttactgttcgacgctatgaagatcagatggtcccaagcatgacttcgtctttgttcagagctgatgatgaagaaacctctgtggatattagaaattcagtagtggacaatagagcagaagttccaaacgatgtcaatgtaactgaagatcctaggagaaacagacttgacgtagcagtcacacaaccagctcgaaccaatgccactcccccacagtttaattttgtggttggtaggagaaattctgaagattctacagcagaatcttccagtagtactagagaaagggacgggggtgtagttcccgtatggtctccctcaagtactaattactccgaccaatatgttggtgatgacaatggcattgggaccagttcatcttacttgcaaaggcatccgcagtctcaccagctaatgaattggcagcggctttctcaaacagggtaagatacttaaaacatc

SEQ ID NO: 6339 - DNA, 2890 bp, Lupinus angustifolius
acataagtgcccaaactaaaaaaaattcttcaaacctaaataattaaccaaatagtaactaatttacctatttttttggcttaaagtcctccacttatcatattagaaagaaacaccaacccaagaaagaaaaaaaaaagctgagaagtatagacaacataaaaaagataagagtgatttcctggttggttttttcagcattcaacagaaaggaataaaagaaacatgttgcatggttaacaagaccaagaatattgtatgcatgtgtgtgtgaatagtttgtgtagagatatgtcaagtggtggatgcagcatagtatggttcaggagagatctaagggtagaagataatccagcactgagtgcagcagttagagctggaactgtggttgcacttttcatatgggcacctgaagaagagggtcaatatcaacctggtagagtttctaggtggtggctcaagcatagtttggctcatcttgattcatctcttagaagtcttggtacttctcttatcactaagagatcaactaatagtgtttcatctctacttgatgttgttaagtccactggagccactcaactcttttttaaccacttatatgatcccttgtcacttatcagggatcatcaagcaaaggaggttctgacttctcacggcattacggtactatccttcaacgcggatttgttatatgaaccatgggatatcaacgatgcctgtggccaaccattcacaacttttgctgccttttgggaaagatgccttagcatgccttatgacccagactcacctcttctccctcctaagaagattattccaggtgatgtatcaaggtgcatgtctgatatattggtgcttgaagatgaattagagaaggcaagcaatgcacttcttgctcgagcatggtcacctgggtggagcaacgctaacaaggctttgaccacattcataaatggtccactgcttgagtattcgaaaaatcgcaagaaggctgacagtgccacaacctcatttctttccccccatttgcattttggtgagttgagtgtgaaaaaggtcttccatcttgtctgcatcaagcaaattttatgggcaaacgaaggaaacaaggccggtgaagaaagcgttaacttgttcctccagtctattggccttagagagtattcaaggtacatttgtttcaaccaccccaatagtcatgaaaggcctcttctaggacagcttaagttatttccttgggtagtgaatgaaggctattttaaggcatggaggcaaggcagaactggttacccattggtggatgctggcatgagggagttgtgggccacgggttggctgcacgatcgtatacgtgtcgtggtttccagtttctttgtgaaggttttgcagcttccctggagatggggaatgaaatatttctgggataccctcttggatgcagatcttgagagtgatgctctcggttggcagtacatatctggttctctcccggatggccgtgaattagaccggatagataatccacagtttgagggatacaaatttgatccaaatggagaatatgtacggcgctggcttccagagcttgctagattaccaactgaatggatacatcatccatggaatgcaccagaagcggtactcgaagctgctggagttgagcttggatcaaactatccccttccaattgtaggaatagacgcagcagaaaccagattagaagaagcactatcagaaatgtggcgactagaagcagcttcaagagctgtcactgaaaatggaaccgaggaagggcttggtgactcatcggaatcgactgctgttgcttttcctcaagacatccaaatggaggaaagtgatgaacctgcaaggaacaattctcctcctcttgctcgacactaccaggatcagatggttccaagtatcacttcttccctgacgagagttgaggaggaagtaacttctgatattagaaactcagcagaacaaagcagagctgaagtaccaataaacgtaaacacgcggcaaaatgcaagagatgcattgaacgaaaggatgttgcagactgctcaaaggaatgcacaactacactacaatagtggaatgcacatgagaaatgcagctgaagattccgcagtagaatcgtcaagtattagtaggaggagggagagagatggaggcgtagttccagaatggtctccttcggcttctagttactcggagcagttagtaggagatgaaaatggcatagctagcagttcatcttacttgcaaaggcatcctcagtctcaccaattgctgaattggaggggactacctcagaccgggtaagatttctcgaatcactgaagtctgaaagcattaataatctataccttataccacttgtcgaaaaaatttgtcacaggatcctatgttctaaacatttgaagaacatcaaatgaatttccaatcttctacactcattattgatattttaattacaggtgatgcatatataaagcaagcagattagaagcaaggagttggaaaatacactatttctttaagataaagtgggatggtgaacctgcattgaacatacatgtattagtttcctactcctcttacctgtctcaatacaagattaatggctgacctttgatgtgtatgaaaatttcaattcatagagcaatacatccacagttccattttggtttcttgtacaatatttgttggcttgttgtatagtatattttgtgtagtgagggagaaagagacactataagatctttggtccactaataaactcaggtttgtacttattatttcggcatattagtccagtaataaactcaggctatagttattgtttaaagcaaatatagtacttttatcagttttatga

SEQ ID NO: 6340 - DNA, 3084 bp, Sesamum indicum
tcagttttcttgcaaccccactacccagaaccaatcgcattcactctcctccatctctctagcaaaagggttctctttgcttggctgcctattttgataacagtattaacttcaggcaaatcaagattcaccaagaattaaattctttcagtttcagacacacatatgtagtctcctaccaaaattagggacaaagaacggttgtaaaacgagttcttcgctatccaagaactgcagtttccttttattgtcggttgtttgaaattctcaattgttgaaaccagtagcaaagcaccacaaaggggtacgaccatttacagcccacctcaagaaagagacggaattatggtgtctagatagcagagaagtgcgtgttgtgtgtgtatttcttgttttgttatttgttcgaattgtctaggtagcagagaattaggattgaattttgtgtgttttttcctttgtcttgtttgagattgatgggaatgtcaggaagtggatgtagtatagtatggtttaggagagatctgagagtggaagacaatccagcactagctgctggggtgaggtcaggggcagttgtagcactgtttatatgggcacctgaggaagaagggcactattatcctggaagggtctcaagatggtgggttaagcagagtttagcacatcttgatagctctttgaggagccttgggacttctcttgttactaagaggtctactgatagtgtttcttgtcttcttcaagttatcaaatccactggagcgactcaactcttcttcaaccatttatatgaccctatatcactggttagggatcaccgagcaaaggaagtcttgacagctgaaggtgtagcagtccgctccttcaatgcagacttgctctatgaaccttgggaagttcatgatgaggaaggtcggccatttacaacttttactggattctgggagaaatgccttagcatgccatacgatcctgaagctccactgctcccaccaaaaagaattattcctggtgatgtgtcaagatgcccagcagacactttagtatttgaagatgagtcggagaaaggaagcaatgcacttcttgctcgggcatggtcacctggctggagcaatgcagataaggccctaacaaccttcttaaatggaccactcatagagtactcaaagaaccgtagaaaggccgatagcgctacaacctcgttcctttctccccatttacattttggggaaattagcgtcagaaaggtcttccatcttgttcgcattaagcaagttctctgggctaatgaaggtaatgtagcaggtgaagagagcgtcaacttgttcctcaagagtattggccttagggagtattcgagatacatgagtttcaatcatccttacagccatgaaaggcctttacttggacacctgaagtatttcccttgggttgtggatgagggctactttaaagcctggagacaaggaagaacgggatatcctctggtcgatgctggtatgagggagctgtgggccactggctggctacatgatcggatacgggtagttgtctccagtttctttgtgaaagttctgcagctgccttggagatggggaatgaagtacttctgggataccctactggatgcagatcttgagagcgatgctcttggttggcaatatatatctggtactcttccagatggtcgtgagtttgatcgtattgataatccccagtttgagggctacaagtttgaccccaacggagagtatgttcgacgatggcttcctgaacttgcccgattgccaaccgaatggatacaccatccatggaatgcaccagaatctgtgctccaagctgctggaattgagctcggctcaaattaccctcttcccatcgtcgaaattgttgctgcaaaagcccggttgcaagaagcactctcgcagatgtggcagcatgaagcagcttcaagagctgccatcgagaatggaatggaggaggggctcggagactcgtctgagtctacccctattgcgtttccctcagagacacacatggagatggataatgaacctatcagaaacaaccccacaaacaatatcattcgacactatgaggatcagatggtgccaagcatgacatcctcttttctgcgggtcgaagatgaagagacatcaatcgagcttagaaactcagtcgacaacagcagagctgaggtaccgtcgaatataaacgtaacagaggagccaagaagagaagtacatggccatgctattatgcaggcagatagaaccaatgatgctttcccgcatactaatttttcaagagctcgtagaaactctgaagattcaacagcagaatcatcgagtagcagtagaagagagagagatggtggtgtagttccagtttggtctccctcgagttctagctactctgatcaatttcccggtgaggataatggtatcggaaccagttcctcttacttgcaaaggcatccgcagtctcaccagctattgaactggaggaggctttctcaaactgggtaagtcgcaatctttgcataatgcataaaaatgctgctagcagtttcgacatatatcagtttcatgctctttctaccagatgacttccgcaaagaccttatattggaatgaacacagccgttgtagtcagtgtgatggaaccagcatctaatgtaaaacatatctgcttttcatcacactgatcacaccagatcaacaatccattgccatctacaattttttcctagtctggatcaggtgatccgtcttgctgttgtacgatatttgtagttctgctgtatagttatatatattgttccacaagctcggacaaatatcaacgtagacacgtgcagcctttcaataaatgcaggtttgcgccttgtatattattctattgactagggagatatttcgattgcaataatgctctactccacattgttcatcgatacaatacttctatgtttgaccgcaaagttacgcacgagctcttgtagagtaacctgtagattgtttcaatgctccacctgttgtatattctgagagacgacgatgtcttctgggaacaacctgt

SEQ ID NO: 6341 - DNA, 2625 bp, Gossypium hirsutum
tttggttgacaaaatagccagaaagattaaaactttacacttagaaaccaagaattccgagccttatggtatatagttaagcaaagataaatctgggtttttgtttcgggagttatgtcgagcatagttggtttagaagggatcttagagttgaagataatccagcactcttagccggagttagggcaggccctgtttttgcagttttcatatgggcacctgaagaagaaggccattatcaacctggaagggtttcaagatggtggcttaaacatagtttggctcttcttgattcttctttgaggagcctgggaacttgtctcatcacaaagagatcaactgatagtgtttcatctcttctccagattgttaaatccactggtgccactcagctcttcttcaatcacttgtatgatcctatatctctggttagggatcatcgagcaaaggaagtattgacggcccatggtgtagcagttcgatcgttcaatgcagatttgctttatgaaccttgggatgtaaatgatgataatggccgccctttcactacttttaatgctttctgggaaaaatgccttaacatgccatttgaccctgaggctcctcttcttccacctaaaagaataacttcaggtgatgtgttaacttgcactacggatgtgttggtgttcgaagatgaattggagaagggaagcaatgcgcttttagctcgagcatggtcaccagggtggagcaatgcggataaagctttgacaacgttcattaatggacctttaattgagtactcgaagaacagaagaaaagctgatagtgcaacaacttcatttctttccccccatttgcattttggggaggttagtgtccgaaaagtctttcatctcgttcgaatgaagcaggttttatgggctaatgaagggaacaaagctggtgaagagagtgtaaacttgtttctgaagtcgattggcttgagggaatactcaagatacttgagttttaaccatccttacagccatgaaaggcctcttctcggacatcttaagtttttcccttgggttgtcaatgagggttatttcaaggcatggagacaaggaagaacaggttatccattggtggatgctggcatgagagagttatgggccactggttggctgcatgatcgtattcgagttgttgtatcgagtttttttgtcaaagttttgcagctcccatggagatggggtatgaagtatttctgggatactctcttggatgcagatttagaaagcgatgctctcggttggcagtatatatccggtactctcccggatggtcgtgagttcgaccgcatcgataatccgcagtttgaaggttacaaattcgatccgaatggagaatatgtccgtcggtggcttccagaacttgcaagactaccaactgattggattcaccatccatggaatgctcctgaatctgtactccaagctgctggcatcgagctcgggtcaaattaccctctgcctattgtaggaatagatgctgcaaaatccaggttgcaagaagcactttcagagatgtggcaactagaagcagcttcaagagctgcaattgagaatggaactgaggaaggcctcggagactcttccgagtcagtgccatttgcatttccgcaagacatacaaatggaggaaaacattgaaccagcaaggaacaatgctccagctacaacacggagatatgaggatcagatggttcctagcatcacttcttccttgttgagaggtgaacatgaagagtcttctttgtatcttagaacttcagcagaagatagcagagcagaagttccaggaactgtaaatataaatcgagaacaacggagagacacattaaaccaagcgattccagaaacagcacgcagcctgcaacttaacttcccgattgggttgagaaatgctgaggattccacagcagaatcatctagtagtagtaggagagaaagggatggcggagttgttccagtttggtccccgccatcttcgagttaccccgagcaatttataggtgaggaaagtggtatcggtgcaagctcatcttttctacaagggcatccacagtcccaccaaatcataaattggaggcgattatctcaaaccgggtaaaacgaatacacgccaaaggcaggtacctagtacttgcagaacgctcagtctagtggccggattggacgataacatggcatgttatcaaccccatatattgtccacgaatctaactcgacctgcagccaactcgggagttggatgaatgatcagctatccaatgttctaccatacgcatagctctgctgtatagtgttttgtctcctttatataaaagggtagatgagattcatggtagaaatgttgtaatcctggaataaaaacaggcttctgtgtatttactttttaactgattaggaagttgtattgtataactcattcctattgctccctcttttttctttttatttaattacttatgtttgtcatttttaccgtcaaattttcggatataaatttaaaggagatatggccttccaagaatattaaatgatcgatgtgttctgatgcttttgagtctggtagccatgttttttcggtctgcgtacta

SEQ ID NO: 6342 - DNA, 2721 bp, Panax ginseng
cccccccccccccccgccgagagagagagagagggggaaagagttgtgatttgggaatttgggaatttggagatttttttgaagatgtctgctggtgggtgtaatatagtttggtttaggagagatctgagggtagaagataatccagcactggctgcaggtgttagagcaggagcagtaattgcagtctacatatgggcacctgaggaagatggacactattacccaggaagggtttcaagatggtggcttaagcagagtttgtcccaacttgattcatcattaagaagccttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccgttccttcaatgcagacttgctatatgaaccatgggaagttcttgatgacgtaggtcacccattcacaacatttacagctttctggaacaaatgccttagcatgccttatgatcccgagtcaccacttcttccgcctaagcgaataatctcaggtgacgtgtctcggtgcccttcagacacattggtattcgaagatgaatcagagaaaggaagcaatgcgctcctcgctcgggcatggtcacctgggtggaacaatgctgataaggcactaaccacgttcattaatggtccattgattgagtactctaaaaatcgtagaaaggctgatagtgctacgacctcatttctctcccctcatttacattttggcgaagtgagtgtgcgaaaagtctttcatcttgttcgcctcaagcaagttctgtgggccaatgaagggaaccaagctggtgaagagagtgtcaacttgttcctcaagtctattggtcttagggaatattcgagatacataagttttaatcatccatacagccatgaaaagcctctgcttgtgcacctaaagtttttcccttgggtagtggatgagggctattttaaggcctggagacaaggtagaactggttatccattggttgatgcaggtatgagagagttgtgggccacgggttggcttcacgatcggatacgagttgtagtgtctagtttctttgtgaaagttcttcagcttccatggagatggggcatgaagtatttttgggataccctattagatgcagatcttgaaagtgatgctcttggttggcagtatatatctggaacactccctgatggtcgtgaatttgaccgtatagataatccacagtttgagggttacaaatttgacccaaatggagaatttgtacgacggtggcttcctgagcttgctagactgcctactgaatggatacaccacccttggaatgcaccaccaattgtacttcaagctgccggaattgagctcggttccaattaccctcttccaatcattgaaattgatgcagcaaaatccaggttagaacaagcgcttacagaaatgtggcaacaggaagcagcgtctagagctgtaattgagaatggaaccgaagaaggtctaggagactcctctgattcagcctccattgcatttcctcaagacatggaggaggatcatggaacttttaggaacaaccctactaccactacaattcgacgttatgaggatcaaatggtcccaagcatgacggcttctttggtaaggggccaagaggaagacacttcttcagatctcagagtaggaaatggcagagcagaagtgccaataaatgttaacatggatcaggaaccaaggacagaaatatttaaccaacctattgcacaaacagctcaaaccaacaacattctgccacgatttaatattgcaatagggctgagggatgctgaagattctacagcggaatcttctagtagtagtgttaagagagaaagggatgggggagtggttccagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcccttcaccagtcctaaagttgaccttatttatatgaaacgattgtactggagcaggtgctcatctgaatcctccttttggcccctgttgtatcatatttgtgccttcattgtatagtaactattgatagctagaggagctaaagagtgcttaatagggtttgtgcagttctctaataaactacgggtttggttgcctttcgtttttcttttaatttaggaaataattattattgtactattatcattcctcctcgctacattgttccactgtcttagtcattgaagaaacttgtaaaagtaaaaaaaaaaacaaaaaaacaaaaaaaaaaaaaaaaaaaaaaacaaaaaaacaaaaaaaacaaaaaaacaaaaaaaacaaaaaaaacaaaaaaaagaaaaaaaagtaaaaagaaaagtaagaagaagaagaagagaagagagagacaccacacacaaaaacaccccccccccccccccccccccccccccccccccccccccccccc

SEQ ID NO: 6343 - DNA, 2546 bp, Euphorbia peplus
gaaagcaaaagagctatggtctaaaaattcccctcatagaaagaggagaagaaagtgttatgtataactgaaaaagaaacatactttcatggtgaaattcagtgagacagaagagataatgatgatggtacatatctgatatagaaataaagacagacagattggagggtgtgtttggctgctgttgtttgttgtagtaagagatagatagagatatgccaggtggatgtagcatagtatggttcagaagagatctgagggttgaagataacccagctcttgctgctggtgttcgtgcaggttcagttatagctgtcttcatatgggcacctgaagaagaaggtcattattatccaggtagagtttcaagatggtggcttaaacagagcttagctcatcttgattcttctttaaagactcttggttgtaaacttatgaccaaaagatcatcagatagcgtcgctgctcttcttgatgtcgttaaaactaccggtgccacccagattttcttcaaccatttgtatgatccgttgtcgctggtgagggatcaccgggcaaaggaggtgttgacgggtaaagggatagcggtgagatcttttaatgccgatttgctgtatgaaccgtgggatattaatgatgcgcaaggacgtccttttacgacttttgctggtttctgggagagatgtctcagtatgccttatgatcctgagtctcctcttcttcctcccaagaggattgttgcaggtgatacatccagatgccctgccgacacacttatctttgaagatgaatcagaaaaaggaagcaacgcattgctttctcgggcatggtctccagggtggagcaatgccgataaagccttgacaacctttgtaaacggacctctaattgagtactctaagaatcgtaggaaagcagacagtgcaacgacctcttttctttcacctcatctgcattttggggaggtaagtgtgagaaaagtttttcatcttgttcgaatcaggcaagtcctatgggcgaacgaagggaacaaagctggagaagaaagtgttaacttgtttctaaaatctattggtctgagagagtattccagatacatgagtttcaaccatccttatagccatgaaaggcctcttcttgggcacctgaagttctttccttgggttgtggatgaagggtattttaaggcttggagacaaggtaggactggttatccattagttgatgcaggaatgagagagttgtgggcaactgggtggcttcatgatcgaattagagttgtggtttctagtttctttgtgaaggttcttcagcttccatggagatggggaatgaagtatttttgggatacccttttggatgcagatttagaaagtgatgctcttggttggcaatacatttctggtactctccctgatagccgtgactttgatcgcatcgacaatccacagtttgagggttatagaaccgacccaaatggagaatatgtgcggaggtggcttcctgaacttgccagactgcctactgaatggatacatcacccctggaatgctccagaatctgtactccaagctgctggaatcgagcttgggtcaaattaccctcttcccattgtaggaatagaagcagccaaagtaagattgcaagaagcacttgcagaaatgtggcagcttgaggcagcttcaagagctgcaattgagaatgggactgaggaagggctcggagactcagctgactcggccccaattgccttccctcgagacatacttatggaggaaaaccacgagcctgtaagaaacatcccccctgctacagttcggcgttatgaggatcagatggttccaagcatgacttgttctctgattcgagctgaagaggaagaaacttcctccgatcttcgtaatgcagcagaagatggcagagcagaggtgccaagaaacctaaacggtaatcaagaacaaatgagagaaactttaaaccctgctgtcacgcaaactttccgtgctgacaacaatgggatgcattttaatcttaccggaggtccagcacataccgaagactcaacagcagaatcgtcaagtagtggtagtaggcgagagagggatggaggcatagttccggtttggtcaccaccaagtgcaagttactcggaacagtatggtggagatgacaatggaatgggagcaagttcatatttgccaaggcattcacaagctcatcaagtagtaaattggaggaggctatcgcagaccgggtaaaacatacaaccattgctgggccggaccagaccggacacaggaaaattcaatcctgcagaattggtgggttgagaaaatgaagtcattctcgagcgatgaactttgtgataattgtattgaagcttggtgttttgaccttggaaatgtatgatagtgaagatagacagaggtagtaagaacatttgctatcctttttaccctgtatttgtaccataatacatagttctctgctgtatagtatttataaatgagggaatgagagtgattatagggatctttagttctact

SEQ ID NO: 6344 - DNA, 2626 bp, Cannabis sativa
ttttagtgttataatttttcgctttgagataaggaaaaaaaataaaataataaaataatgaaaaatctttggaaataaaagttgtggctatagtttatttaggccatgtatttgttgtatcccttactacatgaaccattcctcgtcactcactcttcttctagctagctcatctatttctctctctccttctcaaagggcccatctttgttgccactagtctaagagaagattaaccctcaaaacttaaaatcattgggggatgaatttcacccctaaaaaaagttgggaacataatcagcttcaacttttctcccttaatgacttaaaaatctcatcttttatcttcatatgaccagaaaactgtacagacaggtataggttcagataaaatcacagtcccctggtgtgtcgcaaagagagagaaagagagagaaaagagaaagtgggatatggtgtatagttgagagaggagaaagatagagaaagagagaaaaaagaaaagaaaagaaaaaagaagacagattttcaatttgcaagctcagagggcggttagtggtggattaaggagatgtcaggaggtggatgtagcatagtatggttcaggagagatctaagggtagaagataatccagctttagcagctggtgttagagcaggtgctgtgattgctgtctttgtctgggcacccgaggaagaaggtcattactatcctgggagggtatcaagatggtggcttaagcaaagtttggctcatcttgatttctctttgcgaagttttggcacttctctcatcaccaaaagatctgctgatagtgtttcttctcttcttgaggttgtcaagtccactggtgccaaacaaatactcttcaaccacttatatgaccccttgtctcttgtcagagatcatcgagcaaaggaggttttgacttctcaaggcatagttgtgcgttcctttaatgctgatttgctgtatgaaccatgggaggttaatgatgatcaaggccgcccattcacaaccttcacatctttctgggagaggtgccttagcatgccatatgacccggaatctccacttctcccacctaagagaataatttcaggtgatgtatcaaggtgccgtcctgatacactggtgtttgaagatgattcagagaaaggaagcaacgctctcctcgctcgagcttggtctcctggttggagcagtgctgataaggctctcacaaatttcattaatggaccactcattgagtatgcaaaaaatcacaagaaagctgatagtgctacaacttcacttctctctccccacttgcattttggggaggtaagtgtgagaaaagtgttccatcttgttaggatcaagcaagttttgtgggccaatgaaggaaacaaggctggtgaggagagtgtgaacttgttcctaaagtctattggtctaagagaatactcaagatacatgagttttaatcacccatacagtcatgaaaggccccttcttgggcatctaaagttctttccatgggttgtgaatgaggattatttcaaggcatggaggcaaggtagaactggatatccattggtggatgctggcatgagggagttgtgggccactggctggcttcatgatcgaattcgggtggtagtttcgagcttttttgttaaagttttgcaacttccttggaggtggggaatgaagtatttctgggatacactcttggatgctgatctcgagagtgatgctcttggttggcaatatatatctggtactctccctgatggcagggaattcgaccgcatagataatccacagtttgaggggtacaaatttgatccacatggagagtatgtaaggaggtggcttcctgaactttcgagattgccaactgaatggattcaccatccctggaatgcaccagaatctgtactgcaagctgctggaattgaactgggattaaactaccctctccctattgttggaatagatgctgcaaaagccagattggaagaagcactatctgagatgtgggagcaagaagcagcttccagggctgcaatagagaatggaaccgaggaaggtcttggagattcctctgacaacaacgacggtgtgattgccttccctcaagacatacaaatggaggagaaccgtgaacctccaaggaacaatcctcctcctccaacaactcgacactatgaagatcagatggtcccaagcatgactacttctttgttcagggtcgacgaggaagaatcctctgtggattttcgtacttcagcagtagacagccgagctgaagtgccaacaaatgttgttgtgacacaggaacgaaggagtgaagtgttgaaccgtggacctgtgcagactatcactcagccacagtacaatccaactgcaatgcagtatgttgctgaggattccacagcagaatcttcaagtactactaggagagagcgagatggtggtgttgttcctgtttggtctccttcagctaccagttactcggagcagtttgttagtgaagaaaatggtattggcgcaagttcttcttatttgcagagacatcctcagtctcatcaaataataaactggaggaggctatctcaaaccgggtgtgaactattttct

SEQ ID NO: 6345 - DNA, 2711 bp, Olea europaea
tgcaattttcttgaaccccactagactaccatagccaatccccttcatctctgtttctaagtgaaagggattttttcccttggtctgcctttttgattagattaacttcaggcaaatcaagattcatccagaaatttgggagaagtaaattctttcactaccacaaaacaaagaaagcacaagttatttattgttcataggctgaagtcttagttgctgaaacccatatagaaattcattctctatattgggattatttgacaatcttgggagatgtcagggggtagatgtagtattgtatggttcaggagggatctgagagtggaagataatccggcattagctgctggagtgagggcaggggcaatagtggcagtttttatatgggcacctgaggaagaagggccctattaccctggaagggtatcaagatggtggcttaagcagagtttggctcatctcgatacctctttaagaaccctaggcacttctctcgtaacaaagagatctaatgatagtttatcttcacttgttgaagttgtgaaatctacaggagctactcaactctttttcaaccatttatatgatcccatatcactggttagggatcacagagcaaaagaagttttaacagctcaaggtgttgctgttcgttcctttaatgcggacttgctttatgaaccttgggaagttcatgatggagaaggccgtctgttcacaaccttttctgcattctgggacagatgccttagcatgttgtatgaccctgaggctccacttctcccacctaaaagaatcatctctgctgatgtgtcaagatgcccttcagatactttggtatttgaagatgaatcagagaaaggaagtaatgcacttctagcacgggcatggtcgcctggctggagtaatgctgataaggccctagcgaccttcatcaatggaccactaatagaatactccatgaatcgtcgaaaggctgatagtgctacaacctcgtttctctccccgcatttacatttcggagaagtcagcgttcgaaaagtttttcatcacgttcgcatgaagcaagttctttgggccaatgaagggaacaaagcaggtgaagagagtgtcaatttgttcctcaagagtattggccttagggaatattcaagatacatgagtttcaatcatccatatagccatgaaaggcccttacttggtcacctaaagtattttccctgggtagtggacgagagctattttaaggcatggagacaaggcagaactggttatccactggtggatgctggtatgagagagctgtgggccactggctggttacatgatcggatacgagtcgttgtctctagtttctttgtgaaggttctgctgcttccgtggagatggggaatgaagtacttctgggataccctattagatgccgatcttgagagtgatgcccttggttggcagtatatatctggcacacttcccgatggtcgtgagttggatcgtattgataatccacagtttgagggttacaagtttgaccccaatggagagtatgttcgacgatggcttcctgaactttctagattgccaactgaatggatacatcatccatggaatgcgccagaatccgtactccaagctgctggaattgagctgggctccaattacccttctccaattgttgaaatggatgcagcaaaagccaggttacaagaagcattgtcacagatgtggcagaatgaagctgcttcaagggctgcaattgagaatggaatggaagagggacttggagactcctcagaatatgcccccattgcatttcccgaagacacgcaaatggagacggaccatgaacctgtcagaaacaaccctgtaaatacagtaattcgacgttacgaggatcagatggttccaagtatgacttcttcttttgtcagggttgatgatgaagcaacttctattgatctcagaaattcagcagatgatagtcgagcagaagtaccgaccaatgttaatgtaaatgcaactgaagagccaagagaaacacatggacatgatgttgtgcaaacagttagaaccgtcaacactttcccgcaatttaattttgcaatgggtcagagagattctgaagattcaacagcagaatcatccagtggcagtagaagagaaagggaggggggtgtagtcccagtttggtctccctcgagttctaattactctgatcaattcgctggtgaggacaatggtattggaaccggttcttatttgcaaaggcatccacagtctcaccagctagtgaacttgaggcggctctctcaaactgggtgatgatataccagccttgatgttgagaaacaagataatgtccattgtagtccgtgggatgaaaccattatctattgtactctctctcgccaccgatcttgtctgatcaacaattcatgatatctgaagtttttcaaattgggtcaggttgttcatactcctctgcttgtctattgctgtaccatgtatgtggatttgctatacagtatgttctgattgttataacttaaattgattataggtgtcagtaatcagtttgagtgcaagactcaaaaaattactataaaactagtgtaaaatgctgctattgggattttcaccgtccattgtaagaataatagatagaaatgatgttcatcttcattaagaattctggtgtgaaatccatttat

SEQ ID NO: 6346 - DNA, 2892 bp, Solanum phureja
gttctcatgttaccccaccaccataaccaatcacactcaatctcactttctcctccctctttctgtagaggggtttgtttttttgggtggccaatgcctatagtaacttaagaagaatagcatctcatcattcatccaagaataacatttggggtttgttaaagttaggttctttactagaattttgcctaaaaaaatcatctttatctcctcagtgaaagctacagggaacagtcaaagtatagataagattaaccccaatatacttctgtccaagaaagactcaataacatggtgtttacatagaaagagagaaaaatagagagagaaaaagagtagtctttggtgttgttgaaggaagatgtcaggtggtggttgtagcatagtatggtttaggagggatctgagagtggaagataaccctgctttggctgctggtgtaagagcaggggcagttattgctgtgtttatttatgctcctgaagaagaagggcattattatcctggtagagtatcaagatggtggcttaagcagagtttggcttatcttaattcatctttgaagagtcttggaacttcccttattacaaagagatctactgatagtatttcttctcttcttgaagttgttaaatctactggtgctactcagctcttcttcaatcatttgtatgatcctatttcacttgtgagagatcatcgcacaaaagaaatcttaacagctcaaggtatatctgtgcgttcctttaatgctgatttgctctatgaaccatgggaagttaatgacgatgaaggtcgcccgttcacgacattttctgctttttgggagaaatgccttagcatgccttatgatccagaagctccacttcttcctcctaaaaggattatatctggtgatgcatcaagatgcccttcagacaacttggtatttgaagatgaatcagagaaaggaagcaatgcacttcttgctcgggcatggtcacctggctggagtaatgctgataaagcactaactactttcgttaatggaccattacttgagtactcgcagaaccgtcggaaagctgatagtgcaacaacatcctttctatctccacatttacattttggggaagtcagtgttcgtaaggtattccattttgttcgcatcaagcaagttctctgggccaatgaaggaaataaagctgctgaagagagtgttaatttgttccttaagtccattgggctgagggagtactcaagatacatgagttttaatcatccttatagccatgaaaggcccctgcttggtcacctaaggtacttcccatgggtagtggatgagggctactttaaggcatggagacaaggtagaacaggttatcctttggttgatgctggtatgagagagttatgggcgactggctggcttcatgatcgtatccgagtcgtggtttctagtttctttgtgaaggttctgcagcttccatggaggtggggaatgaagtatttttgggacacattgttagatgcagatcttgagagtgatgctcttggttggcaatatatctctggtaccctacctgatggtcgtgagcttgatcggattgataatccacagtttgtgggatacaagtgtgaccctcatggggaatatgtccggcggtggcttcctgaacttgctaggctgcccaccgaatggatacaccacccgtggaatgcaccagaatctgtacttgaagctgctggcattgagttgggttccaattatcctcttccaatagttgaaattgattcagcaaaagttagactagaacaagccctatcacaaatgtggcagaatcatgcagctgcaagagctgcgattgagaatggaatggaagaaggacatggtgactctgctgactccctaatagcctttcctcaggccatgcatatggaaatggaccatgaaccagtcaggaacaaccccgtaatagttactgttcgacgctatgaagatcaaatggtgccaagcatgacgtcatctttgttcagagctgaagatgaagagaactctgtggacattaggaattcagttgtggaaagtagggcagaagttccaacagacatcaatgtagctgaaggtcataggagagacacgcatgaccaagccgtcatgcaaactgctcgaaccaatgccaccccacattttaattttgcggtaggtagaaggaactctgaagattcaacagcagaatcttccagtagtactagagaaagggatgggggtgtagtgcctacatggtctccctcaagtaccaactattcagaccaatatgttggtgatgataatggtattgggaccagttcatcttacttgcaaaggcatccacaatctcaccagctaatgaactggcagcggctttctcaaacagggtgatcatctatgtggagctacgatagctacaaggtggagaagcaagtggctaatatagacatttggctcagcacatttagtacagcattcacctactctttctctcgaagtcctgacctgatcagccatctttgtgtctatatctctaattgatcaggtggtttgtctggattttcatcctcatctgtcgggcatccccatttacctatcataccatatatgtgtctctgctgtatagtatagaagtttttcataaggccaaataagtgttagaaagaggttgcaatcctctgtcaagctcacacttgtgcttttctgctacttacattttgatggcaataacgattatctgaagtcctggaactaattagatttttgtggatatcatagtttcaaactctgtttgactgatgtacatgtggtttgagcagcttcatcttatatttttgttgtcggaacattgtcattattctataagatttctagtttgaaca

SEQ ID NO: 6347 - DNA, 2512 bp, Panax ginseng
atttttttgaagatgtctgctggtgggtgtaatatagtttggtttaggagagatctgagggtagaagataatccagcactggctgcaggtgttagagcaggagcagtaattgcagtctacatatgggcacctgaggaagaaggacacttttacccaggaagggtttcaagatggtggcttaagcagagtttgtcccaacttgattcatcattaagaagccttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccattccttcaatgcagacttgctatatgaaccatgggaagttcttgatgacgtaggtcacccattcacaacatttacagctttctggaacaaatgccttagcatgccttatgatcctgagtcaccacttcttccgcctaagcgaataatctcaggtgacgtgtctcggtgcccttcagacacattggtattcgaagatgaatcagagaaaggaagcaatgcgctcctcgctcgggcatggtcacctgggtggaacaatgctgataaggcactaaccacgttcattaatggtccattgattgagtactctaaaaatcgtagaaaggctgatagtgctacgacctcatttctctcccctcatttacattttggcgaagtgagtgtgcgaaaagtctttcatcttgttcgcctcaagcaagttctgtgggccaatgaagggaaccaagctggtgaagagagtgtcaacttgttcctcaagtctattggtcttagggaatattcgagatacataagttttaatcatccatacagccatgaaaagcctctgcttgtgcacctaaagtttttcccttgggtagtggatgagggctattttaaggcctggagacaaggtagaactggttatccattggttgatgcaggtatgagagagttgtgggccacgggttggcttcacgatcggatacgagttgtagtgtctagtttctttgtgaaagttcttcagcttccatggagatggggcatgaagtatttttgggataccctattagatgcagatcttgaaagtgatgctcttggttggcagtatatatctggaacactccctgatggtcgtgaatttgaccgtatagataatccacagtttgagggttacaaatttgacccaaatggagaatttgtacgacggtggcttcctgagcttgctagactgcctactgaatggatacaccacccttggaatgcaccaccacctgtacttcaagctgccggaattgagctcggttccaattaccctcttccaatcattgaaattgatgcagcaaaatccaggttagaacaagcgcttacagaaatgtggcaacaggaagcagcgtctagagctgtaattgagaatggaaccgaagaaggtctaggagactcctctgattcagcctccattgcatttcctcaagacatggaggaggatcatggaacttttaggaacaaccctactaccactacaattcgacgttatgaggatcaaatggtcccaagcatgacggcttctttggtaaggggccaagaggaagacacttcttcagatctcagactaggaaatggcagagcagaagtgccaataaatgttaacatggatcaggaaccaaggacagaaatatttaaccaacctattgcacaaacagctcaaaccaacaacattctgccacgatttaatattgcaatagggctgagggatgctgaagattctacagcggaatcttctagtagtagtgttaagagagaaagggatgggggagtggttccagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcccttcaccaatcctaaagttgaccttatttatatgaaaacgattgtactggagcaggtgctcatctgaatcctccttttggcccctgttgtatcatatttgtgccttcattgtatagtaactattgatagctagaggtgctaaagagtgcttaatagggtttgtgcagttctctaataaactcgggtttgtgccttttcgtttttcttttaattaggaaaatattattattgtactattatcattcctcctcgctacattgttccatgtcttagcattgaagaacttgtaaagtaacttctatgttgaattgtaaaacacttccataggcctgctgaatgtacatgcctgtttatatttgtagacgtccc

SEQ ID NO: 6348 - DNA, 2731 bp, Panax ginseng
gatagggaaagtgggattcagcataaactgagaaatttttgaattacttatatctgaatcactagataagttaaaagataagcccataatccactttccaaactccaaaccactctctttttttaaaatgttttttggcctaaaatcattctcaaatcagtgaaaacttatgggataccataaagcataggattagttaaagtattctgctgttctccatgagaaggacagagatggaatatagttaggagagagagggggaaagaatcgtgatttgggaatttggagatttttttgaagatgtctgctggtgggtgtaatatagtttggtttaggagagatctgagggttgaagataatccagcactggctgcaggtgttagagcaggagcagtaattgcagtctacatatgggcacctgaggaagaaggacacttttacccaggaagggtttcaagatggtggcttaagcagagcttgtcccaacttgattcatcattaagaaggcttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccgttccttcaatgcagacttgctatatgaaccatgggaagttcttgatgacgtaggtcacccattcacaacatttacagctttctggaacaaatgccttagcatgccttatgatcctgagtcaccacttcttccgcctaagcgaataatctcaggtgacgtgtctcggtgcccttcagacacattggtattcgaagatgaatcagagaaaggaagcaatgcgctcctcgctcgggcatggtcacctgggtggaacaatgctgataaggcactaaccacgttcattaatggtccattgattgagtactctaaaaatcgtagaaaggctgatagtgctacgacctcatttctctcccctcatttacattttggcgaagtgagtgtgcgaaaagtctttcatcttgttcgcctcaagcaagttctgtgggccaatgaagggaaccaagctggtgaagagagtgtcaacttgttcctcaagtctattggtcttagggaatattcgagatacataagttttaatcatccatacagccatgaaaagcctctgcttgtgcacctaaagtttttcccttgggtagtggatgagggctattttaaggcctggagacaaggtagaactggttatccattggttgatgcaggtatgagagagttgtgggccacgggttggcttcacgatcggatacgagttgtagtgtctagtttctttgtgaaagttcttcagcttccatggagatggggtatgaagtatttttgggataccctattagatgcagatcttgaaagtgatgctcttggttggcagtatatatctggaacactccctgatggtcgtgaatttgaccgtatagataatccacagtttgagggttacaaatttgacccaaatggagaatttgtacgacagtggcttcctgagcttgctagactgcctactgaatggatacaccacccttggaatgcaccaccacttgtacttcaagctgccggaattgagctcggttccaattaccctcttccaatcattgaaattgatgcagcaaaatccaggttagaacaagcgcttacggaaatgtggcaacaggaagcagcgtctagagctgtaattgagaatggaaccgaagaaggtctaggagactcctctgattcagcctccattgcatttcctcaagacatggaggaggatcatggaacttttaggaacaaccctactaccactacaattcgacgttatgaggatcaaatggtcccaagcatgacggcttctttggtaaggggccaagaggaagacacctcttcagatctccgggtaggaaatggcagagcagaagtgccaataaatgttaacatggatcaggaaccaaggacagaaatatttaaccaacctattgcacaaacagctcaaaccaacaacattctgccacgatttaatattgcaatagggctgagggatgctgaagattctacagcggaatcttctagtagtagtattaggagagaaagggatgggggagtggttccagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcctttcaccactcctaaagttgaccttatttatatgaaaacgattgtactggagcaggtgctcatctgaatcctccttttggcccctgttgtatcatatttgtgccttcattgtatagtaactattgatagctagaggagctaaagagtgcttaatagggtttgtgcagttctctaataaactcggttttgtgtccttttcgtttttctttaattaggaaaatattattattgtactattatcattcctctcgctacattgttccatgtcttagcattgaagtaacttgtaaagtaactttc

SEQ ID NO: 6349 - DNA, 3076 bp, Panax ginseng
ataaccaatccctttttctgcctctctggtcctttattcctaattttcttcacaccgatgatagattgatagggaaagtgggattcagcagaaactgagaaatttttgaattacttatatctaaatcactagataagttaaaagataagcccctaatccaaactccaaaccactctctttttttaaaatgttttttggcctaaaatcattctcaaatcagtgaaaacttatgggataccataaagcataggattagttaaagtattctgctgttctccatgagaaggacagagatggaatatagttaggagagagagggggaaagaatcgtgatttgggaatttggagatttttttgaagatgtctgctggtgggtgtaatatagtttggtttaggagagatctgagggtggaagataatccagcactggctgcaggtgttagagcaggagcagtaattgcagtctacatatgggcacctgaggaagaaggacacttttacccaggaagggtttcaagatggtggcttaagcagagcttgtcccaacttgattcatcattaagaaggcttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccgttccttcaatgcagacttgctatatgaaccatgggaagttcttgatgacgtaggtcgcccattcacaacatttacagctttctggaacaaatgccttagcatgccttatgatcccgagtcaccacttcttccacctaagcgaataatctcaggtgacgtgtctcggtgcccttcagacacattggtattcgaagatgaatcagagaaaggaagcaatgcgctcctcgctcgggcatggtcacctgggtggaacaatgctgataaggcactaaccacgttcattaatggtccattgattgagtactctaaaaatcgtagaaaggctgatagtgctacgacctcatttctctcccctcatttacattttggcgaagttagtgtgcgaaaagtctttcatcttgttcgcctcaagcaagttctgtgggccaatgaagggaaccaagctggtgaagagagtgtcaacttgttcctcaagtctattggtcttagggaatattcgagatacataagttttaatcatccatacagccatgaaaagcctctgcttgtgcacctaaagtttttcccttgggtagtggatgagggctattttaaggcatggagacaaggtagaactggttatccattggttgatgcaggtatgagagagttgtgggccacgggttggcttcacgatcggatacgagttgtagtgtctagtttctttgtgaaagttcttcagcttccatggagatggggtatgaagtatttttgggataccctattagatgcagatcttgaaagtgatgctcttggttggcagtatatatcaggaacactccctgatggtcgtgaatttgaccgtatagataatccacagtttgagggttacaaatttgacccaaatggagaatttgtacgacagtggcttcctgagcttgctagactgcctactgaatggatacaccacccttggaatgcaccaccacctgtacttcaagctgccggaattgagctcggttccaattaccctcttccaatcattgaaattgatgcagcaaaatccaggttagaacaagcgcttacggaaatgtggcaacaggaagcagcgtctagagctgtaattgagaatggaaccgaagaaggtctaggagactcctctgattcagcctccattgcatttcctcaagacatggaggaggatcatggaacttttaggaacaaccctactaccactacaattcggcgttatgaggatcaaatggtcccaagcatgacggcttctttggtaaggggccaagaggaagacacctcttcagatctccgggtaggaaatggcagagcagaattgccaataaatgttaacatggatcaggaaccaaggacagaaatatttaaccaacctattgcacaaacagttcaaaccaacaacattctgccacgatttaatattgcaatagggctgagggatgctgaagattctacagcggaatcttctagtagtagtattaggagagaaagggatgggggagtggttccagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcctttcaccagtcctaaagttgaccttatttatatgaaaacgattgtactggagcaggtgctcatctgaatcctccttttggcccctgttgtaccatatttatgccttcattgtatagtaactattgatagctagaggagctaaagagtgcttaatagggtttgtgcagttctctaataaactcgggtttgtgccttttcgtttttcttttaattaggaaaatattattattgtactattatcattcctcctcgctacattgttccatgtcttagcattgaagaacttgtaaagtaacttctatgttgaattgtaaaacacttccataggcctgctgaatgtacatgccggtttaaggaagcagtggtatcaacgcagagtacatggggagagcgaacgtcgtcagaaagtttctctctcctcagccacactcaggaactcagcaacaacaatggtatttgccaaagctgtaaagccaagggcatactttaagcggtaccaggttaagtttaagagaaggagagagggtaagaccgattatcgtgcgaggattcgtctgatcaatcaggataagaacaagtataaca

SEQ ID NO: 6350 - DNA, 2758 bp, Citrullus lanatus
gggtacgtgttttctggggttttggattggtggtttttattttgtgagatgtcaggtggcggttgcagcatagtttggttcagaagagatctcagggttgaagataacccagctcttaccgccgccgtcagggctggcgccgtcgtcgccgtcttcatctgggctccggaggaagagggtcactattatcctggcagagtttcccgatggtggctcaaacaaagcttagcccatcttgattcctctcttagaagccttggtacttttcttcttactaagagatccaccaataccatttctgctttgcttgacgtcgttaaagccactggtgcttctcaactcttcttcaatcacttatacgatcctttgtcgctcattcgggatcatcaagctaaggaggttttatctgctcaaggcattggtgtgaggtcctacaatgcggatttactgtacgaaccgtgggatgttaaggatgccaatggcaatccatttactacctttgctggtttctgggagagatgtctcagcatgccttgtgatccagaggcaccactactcccacctaagagaataatctcaggtgatgcatctaggtgcccatgtgacacgttggtatttgaagatgaatcagagaaaggaagtaatgcgcttctcgcccgagcatggtctcctggatggagcaatgcagataaagctttgaccacattcatcaatggaccattacttgaatactcaaaaaaccgtaggaaggcggatagtgcaaccacctcgtttctgtctccccacttgcattttggagaggtaagtgtgagaaaagtgtttcatcttgttcgaatgaagcaggttttatgggccaatgaaggaaacaaggccggcgatgaaagtgtcaacttgtttctcaagtctattgggctcagagaatattccagatacatgagtttcaaccatccgtacagtcatgaaaggcctcttcttgggcatcttaaattttttccctgggttgtggatgaaggctattttaaggcatggaggcaaggaaggactggttatccattagtggatgctggtatgagggaattgtgggctacggggtggctgcatgatcggattcgagttgtagtttctagtttctttgtgaaggtgctgcagcttccttggagatggggaatgaagtatttctgggatactctcttggatgcagacctcgagagtgatgcgcttggttggcaatatatatctggaacacttcctgatagccgtgaatttgatcgcattgacaatccacagctggaaggctataaatttgacccaaatggagaatatgttaggagatggcttcctgaactttctagattgcccactgaatggattcatcacccatggaatgcaccagaatctgtgctccaagctgctgggatcgagcttggatcaaactacccccttcctatcgtaggactggatgcagctaaagctaggttggaagaagcgctgtcggagatgtggcaacaagaagcggcttcaagggctgcaattgagaatggaactgaagagggactcggggactcttctgagtcaatcccaattgcatttcctcaagacatagctatggaggaggaagaccttgagcctgcaaggatgaacgctcatacaattcggtgctacgaggatcagatggtcccaagcatgactagttcggtgagattagaagatgaaccttctttgaatattcaaagtacagcagaagatggtagagcagaagtacctacaaatacaaatctaccccaagagcccaccagagatgcagtaaacccaagagttctgccaactgctctgacacagactcgacgtccctataccgcaggtatagccctaagaacttctgttgaagactccactgccgagtcttcttccagtagtgatgttagaagagagagagatggaggtgtggttccggtttggtctccaccaagttcgagttacactgagcagtttgtagttgatgaaaatggcatcggaacaagctcttcgttcttgcaggggcatcaacagactcatcaaataatcaattggaggcggctatctcagactgggtaacaacttgtgaatcatatgcagtagagcagataaaatgttcatttctctgatggccatatcccacaagaagtagttggtagcttggacctctttttccgtctagcgaaaaatatgaacgttccgctgcataatcttcatcctataatatgaaaaattcatgtttgttacagttatttctctgtcatttgacatgattcaatgggcttttctttaacaggtgagaggcaaatatgggaaaactagcagatagaggaggagaatgcaaattcactcaatgctattctattaggggtggtcaggtcagccagatggtgaaccagcaacaaactaacatgttcttctactttctccaccaatctgacttgaccattggtcattgtcatgtgtatcaaattcctaactgatagatgcagttcatctgctgatggtcatctccctccctctcgccctcgctctctttccgttattacggttgtatcataagtcttgctatgctgtatagtgaaagttgtaatttgtgtagctgtaacacaagggtagagaattgaaatagcgattgtcgtcgtcttcaaataaactcaagtttgcaactagcccggattcttgtaagcttatgcttaagctatggaaatatttctctatcttgcttgcctttaagattaga

SEQ ID NO: 6351 - DNA, 2631 bp, Panax ginseng
gagagagagagagagagagggagggaaagagttgtgatttgggaatttgggattttggagatttttttgaagatgtctgctggtgggtgtaatatagtttggtttaggagagatctgagggtagaagataatccagcactggctgcaggtgttagagcaggagcagtaattgcagtctacatatgggcacctgaggaagaaggacacttttacccaggaagggtttcaagatggtggcttaagcagagtttgtcccaacttgattcatcattaagaagccttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccgttccttcaatgcagacttgctatatgaaccatgggaagttcttgatgacgtaggtcacccattcacaacatttacagctttctggaacaaatgccttagcatgccttatgatcctgagtcaccacttcttccgcctaagcgaataatctcaggtgacgtgtctcggtgcccttcagacacattggtattcgaagatgaatcagagaaaggaagcaatgcgctcctcgctcgggcatggtcacctgggtggaacaatgctgataaggcactaaccacgttcattaatggtccattgattgagtactctaaaaatcgtagaaaggctgatagtgctacgacctcatttctctcccctcatttacattttggcgaagtgagtgtgcgaaaagtctttcatcttgttcgcctcaagcaagttctgtgggccaatgaagggaaccaagctggtgaagagagtgtcaacttgttcctcaagtctattggtcttagggaatattcgagatacataagttttaatcatccatacagccatgaaaagcctctgcttgtgcacctaaagtttttcccttgggtagtggatgagggctattttaaggcctggagacaaggtagaactggttatccattggttgatgcaggtatgagagagttgtgggccacgggttggcttcacgatcggatacgagttgtagtgtctagtttctttgtgaaagttcttcagcttccatggagatggggcatgaagtatttttgggataccctattagatgcagatcttgaaagtgatgctcttggttggcagtatatatcaggaacactccctgatggtcgtgaatttgaccgtatagataatccacagtttgagggttacaaatttgacccaaatggagaatttgtacgacagtggcttcctgagcttgctagactgcctactgaatggatacaccacccttggaatgcaccaccacctgtacttcaagctgccggaattgagctcggttccaattaccctcttccaatcattgaaattgatgcagcaaaatccaggttagaacaagcgcttacggaaatgtggcaacaggaagcagcgtctagagctgtaattgagaatggaaccgaagaaggtctaggagactcctctgattcagcctccgttgcatttcctcaagacatggaggaggatcatggaacttttaggaacaaccctactaccactacaattcggcgttatgaggatcaaatggtcccaagcatgacggcttctttggtaaggggccaagaggaagacacctcttcagatctccgggtaggaaatggcagagcagaagtgccaataaatgttaacatggatcaggaaccaaggacagaaatatttaaccaacctattgcacaaacagttcaaaccaacaacattctgccacgatttaatattgcaatagggctgagggatgctgaagattctacagcggaatcttctagtagtagtattaggagagaaaggggtgggggagtggttccgagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcccttcaccactcctaaagttgaccttatttatatgaaaacgattgtactggagcaggtgctcatctgaatcctccttttggcccctgttgtaccatatttatgccttcattgtatagtaactattgatagctagaggagctaaagagtgcttaatagggtttgtgcagttctctaataaactcgggtttgtgccttttcgtttttcttttaattaggaaaatattattattgtactattatcattcctcctcgctacattgttccatgtcttagctttgaagaacttgtaaagtaacttctatgttgaattgtaaaacacttccataggcctgctgaatgtacatgccggtttattttaaaaaaaaaaaaaaaaaaaaaaaaaaaaaaaaaaaaaaaaaaaaaaaaaaaaaaaaaacaaaaaaaaaaa

SEQ ID NO: 6352 - DNA, 2687 bp, Cucumis melo
cgggagagatgtcaggtggcggttgtagcatagtttggttcagaagagatctcaggattgaagataatccagctcttaccgccgccgtcagagctggcgccgttgtcgccgtcttcatctgggctcctgaagaagagggtcactattatcccggtagagtttcccgatggtggcttaaacaaagcttagctcatcttgattcttctcttagaagccttggtacttttcttctcactaagagatccaccaacaccatttctgctttgcttgacgtctttaaagccaccggtgcttctcatctcttcttcaatcacttatacgatcctttgtcgctcattcgggatcatcgagtgaaggaggttttatctgcccaagggatacgtgtgaggtcttacaatgcagatttactgtacgaaccttgggatgttaaggatgccaatggcaacccgtttactacctttgctggtttctgggagagatgtcttagcatgccttgtgatccagaggcaccactactaccacctaagagaatagtttcaggtgatgcatctaggtgtctatgtgatactctggtatttgaagatgaatcagagaagggaagtaatgcacttctcgctcgagcatggtctcctggatggagcaacgcagataaagctttaaccacattcatcaatggaccattacttgaatactcaaaaaatcgtaggaaggcggatagtgcaaccacctcgtttctgtctccccacttgcatttcggtgaggtaagtgtgagaaaagtgttccatcttgttcgaatgaaacaggttttatgggccaatgaaggaaacaaagctggcgaagagagtgtcaacttgtttcttaagtctattgggcttagagaatattccagatacatgagtttcaaccatccgtacagtcatgaaagacctcttcttgggcatcttaaattcttcccctgggttgtggatgaaggctatttttaaggcctggaggcaaggaaggactggttatccattagtggatgctggtatgagggaattgtgggctacgggatggctgcatgaccggatccgagtcgtcgtttctagtttctttgtgaaggttctgcagcttccttggagatggggaatgaaatatttctgggatactctcttggatgcagatctagagagtgatgcgcttgggtggcagtacatatctggaacacttcccgatagccgcgaatttgatcgcattgacaatccacagctggagggttataaattcgacccaaatggagaatatgtccggagatggcttcctgaactttctagattacccactgaatggattcatcacccatggaatgcaccagaatctgtgctccaagctgctgggatcgagcttggatcaaactaccctcttcccatcgtaggactggatgcagctaaagctaggttggaagaagcactgtcagagatgtggcaacaagaagcggcttcaagggctgccatagagaatggaactgaagagggacttggggactcttctgagtcgatcccgattgcgtttcctcaagacattgcaatggatgaggaagacattgagcctgcaagagtgaacgctcatacagttcggtgctacgaggatcagatggtcccgagcatgactagttcggtgagattagaagatgaatcttctttgaatattcaaagtacagcagaagatggtagagcagaagtacctacaaatgcaaatctaccccaagagcccgccagagatgcagttaacccaagagctatgccaactgctccgacacagactcggcttccctataccgcaggtatagccctaagaacttctgttgaagactcgactgcagagtcttcttccagtagtgatgttagaagagagagagatggaggtgtagttccggtttggtctccaccaagttcgagttacacggagcagtttgtggttgatgaaaatggcattggaactagctcttcgttcttgcaggggcatcaacagactcatcaaataatcaattggaggcggctatctcagactgggtaacaacttgtgaatcatatgctgtagaggagataaaatgttcatattctctggtggctatatccccacaagaagtagttggtagcttggacttctttttccgtctcgaaattcttctagcgaaaaatacgaacgatttgctgcataatcatcatcctataatatgaaaattttcatgtttgttaaagttgtttctgtgtctttgacatgattcaatgggcttttctttaacaggtgagaggcaaatatgggaaaactagcagacagtggaggacaatgcaatttcactcgatgctattttattaggggtggtcaggtcagccagatggtgaacaagcaacaaactaacatgttcttctactttctccaccaatctgacttgaccattggtcgctgtcacgtgtatgaaattcctaactgatagatgcagttcatctgctgatggtcatctccctccttccctctctcttgtgctctttccgttattacggttgtatcataaagtcttgctatgctgtatagtgaaagttgtaatttgtgtagttgtaacaccaagggtagagaattgaaatagcgattgtcagtcgtcttcgaataaactcaagtttgcgactagcccgaattcttgtaagctt

SEQ ID NO: 6353 - DNA, 2467 bp, Cucumis sativus
atgtcaggtggcggttgtagcatagtttggttcagaagagatctcaggattgaagataacccagctcttaccgccgccgtcagggccggtgccgtcgtcgtcgtcttcatctgggctcctgaagaagagggtcactattatcccggtagagtttcccgatggtggctcaaacaaagcttagctcatcttgattcctctcttagaagccttggtacttatcttctcactaagagatccaccaacaccatttctgctttgcttgacgtctttaaagccaccggtgcttctcacctcttcttcaatcacttatacgatcctttgtcgctcattcgggatcatcgagtgaaggaggttttatctgcccaagggatacgtgtgaggtcttacaatgcagatttactgtacgaaccgtgggatgttaaggatgccaatggcaatccgtttactacctttgctggtttctgggagagatgtcttagtatgccttgtgatccagaggcaccactactaccacctaagagaataatttcaggtgatgcatccaggtgtccatgtgatacgctggtatttgaagatgaatcagagaagggaagtaatgcgcttctcgctcgagcatggtctcctggatggagcaacgcagataaagctttgaccacattcatcaatggaccattacttgaatactcaaaaaatcgtaggaaggcagatagtgcaaccacctcatttctgtctccccacttgcatttcggagaggtaagtgtgagaaaagtattccatcttgttcgaatgaaacaggttttatgggccaatgaaggaaacaaagctggcgaagagagtgtcaacttgtttctcaagtctattgggcttagagaatattccagatacatgagtttcaaccatccgtacagtcatgaaagacctcttcttgggcatcttaaattcttcccctgggttgtggatgaaggctattttaaggcatggaggcaaggaaggactggttatccattagtggatgctggtatgagggaattatgggctacgggatggctgcatgaccggatccgagttgtcgtttctagtttctttgtgaaggttctgcagcttccctggagatggggaatgaaatatttctgggatactctcttggatgcagatctagagagtgatgcgcttgggtggcagtacatatctggaacacttcccgatagtcgcgaatttgatcgcattgacaatccacagctggagggttataaattcgacccaaatggagaatatgtccggagatggcttcctgaactttctagattacccactgaatggattcatcacccatggaatgcaccagaatctgtgctccaagctgctggggttgagcttggatcaaactaccctcttcccatcgtaggactggatgcggccaaagctaggttggaagaagcgctgtcggagatgtggcaacaagaagcggcttcaagggctgccatagagaatggaactgaagagggactcggggactcttctgaatcgatcccaattgcatttcctcaagacattgcaatggatgaggaagacattgagcctgcaaggatgaacgctcatacagttcggtgctacgaggatcagatggtcccaagcatgactagttcggtgagattagaagatgaatcttctttgaacattcaaagtacagcagaagatggtagagcagaagtacctacaaatgcaaatctaccccaagagccggccagagatgcagttaacccaagagctatgccaactgctccgacacagactcgacgcccctataccgcaggtatagccctaagaacttctgttgaagactccactgcagagtcttcttccagtagtgatgttagaagagagagagatggaggtgtagttccggtttggtctccaccaagttcgagttacacggagcagtttgtggttgatgaaaatggcatcggaactagctcttcgttcttgcaggggcatcaacagactcatcaaataatcaattggaggcggctatctcagactgggtgagaggcaaatatgggaaaactagcagacagaggaggacaatgcaatttcactcaatgctattttattaggggtggtcaggtcagccagatggtgaacaagcaacaaactaacatgttcttctattttctccaccaatctgacttgaccattggtcactctcatgtgtatgaaattcctaactgatagatgcagttcatctgctgatggtcatctccctcctcgctctcttgtgctctttccgttattacggttgtatcataaagtcttgctatgctgtatagtgaaagttgtaatttgtgtagttgtaacaccaagggtagagaattgaaatagcgattgtcagtcgtcttcgaataaactcaagtttgcgactagcccggattcttgtaagctcatgcttatgctatggaaatatttctct

SEQ ID NO: 6354 - DNA, 2425 bp, Tripterygium wilfordii
ctatccaccaggcaacaaaatcaaacccaaattttggtctgaaatcctcctcccatgttgatgtgcttcactgggtatctgagggaggatatgaaagtacgtaaatcttttgtggataaggattgagagagacgaattgggttttctgggtttggtgagttttggagatggcaggtggtggatgtagcatagtgtggtttaggcgagatctgagggtagaggataacccagcactgttagctggtgtgagagcaggtgctgtggttgcagtgtttatatggtctcctgaagaggagggtcactacaacccagggagggtttcaaggtggtggattaagcaaagcttggctcaccttgaatcttccttgaggaggcttggcacaaccctcctcaccaagagatcaactgacagtgtggccactcttcttgagattgtcaaatctactggtgctactcagctcttcttcaaccacttatacgatcccatgtccctcgtcagggatcacagggcaaaggaggctttaggtgctcatggcgttgctgtccagtccttcaatgcggatttactctatgaaccatgggatgttaatgatacccaaggttgccctttcacaacttttactgctttctgggaaagatgccttagcatgccttatgatccagaggctccacttttaccaccaaaacgaataatttcaggtgatgtatctaggtgcccttcagatactttgatatttgaagacgaatctgagaagggaagtaacgcccttctcgctcgagcatggtcaccagggtggagtaatgccgataaggcgttgaccacattcctaaatggatccttaatggagtactcaaagaatcgtagaaaggcggatagtgctacaacctcatttctctccccccaccttcattttggggaggtaagtgttagaaaagtcttccatcttgttcggatcaagcaagtcttgtgggccaatgaagggaacaaggctggtgaagagagtgtgaacttgtttctgaagtcaattggccttagagaatattcaagatacatgagttttaaccatccttacagtcttgaacgacctcttctagggcaccttaagttctttccctgggttgttgatgaaggctatttcaaggcatggagacaaggtagaaccggttatccgttagtggatgctggtatgagagaattgtgggccacaggttggctgcatgatcgtataagagtcgtagttgccagtttctttgtgaaggttctgcaacttccttggagatggggaatgaaatacttctgggatacgttattggatgcagatttagaaagtgatgctcttggttggcaatatatatctggtactctccccgatggccgtgagtttgatcgcatagacaatccacagtttgagggttacaagtttgaccccaatggagaatatgtgcgacggtggcttcctgaactggccagactaccaaccgaatggatacaccacccatggaatgcgcctgactctgtactccaggctggcggaattgagctgggatcaaattatccccttccaatcgtagggatagatgcagcaaaagtcaggttgcaacaagcactttcagagatgtggcagcgagaagcagcttcaagagctgtaatggagaatgggactgaggaagggcttggggactccactgaatcagcaccaattgcctttcctcaagatatactaatggaggagaaccacgaacctgcatggaacaatcctcctgctacaattcgacgttacggagatcagatggttccaagtattacttgttctttggtgagagttgaagaggaagaaaattctgttcaaaatttggcagaagatggcagagcagaagttccaagagatatacatgtcaatcaagagccaacaagagaccccctgaaccaagaagttacacaaaatcttctaggtataagcacaatgccacagttcaatatcacaattgcactgggggatgctgaagattccacggcagaatcttcaagtagtggtagtagtcagagagaaagggatggtggtgtagttccggtttggtctcctccgacttctagttacccagagcattttgttggggatgaaaatggcatcgcaactagttcatcatacttggagaggcatccacaatctcaccagataatgaactggaggcggctttcgcaaacaggttaaccagatgtgcattggccattgagactaaaagccgggattgaaggacgcaacggtgcttatggtcggtcgatgaattggaatttttcgtataatctctatctgccactctcttacttcaccagctgaacttgatggaaggttgaaggttgacgactgatgtgtaggaaatgataagtgcatcccaactgctatcctttttcattgatgtacaa

SEQ ID NO: 6355 - DNA, 2569 bp, Panax ginseng
tttggagatttttttgaagatgtctgctggtgggtgtaatatagtttggtttaggagagatctgagggtggaagataatccagcactggctgcaggtgttagagcaggagcagtaattgcagtctacatatgggcacctgaggaagaaggacacttttacccaggaagggtttcaagatggtggcttaagcagagcttgtcccaacttgattcatcattaagaagccttggtactacccttatcaccaaaagatccactgatagtgtttcttctcttcttgaagttatcaaatccactggggctactcaggtcttcttcaaccacttatatgatcctttgtcacttgtcagggatcaccgtacaaaggaggttttaactgctcaaggaatagctgtccgttccttcaatgcagacttgctatatgaaccatgggaagttcttgatgacgtaggtcgcccattcacaacatttacagctttctggaacaaatgccttagcatgccttatgatcccgagtcaccacttcttccacctaagcgaataatctcaggtgacgtgtctcggtgcccttcagacacattggtattcgaagatgaatcagagaaaggaagcaatgcgctcctcgctcgggcatggtctacctgggtggtaaacaaatgctgataaggcactaaccacgttcattaatggtaccattgattgagtactactaaaaatcgtagaaaggctgatagtgctacgacctcatttctctcccctcatttacattttggcgaagttagtgtgcgaaaaagtctttcatcttgttcgcctacaagcaagttctgtgggccaatgaagggaaccaagctggtgaagaagagtgtcaacttgttacctcaagtctattggtcttaggggaaatattcgaggatacataagttttaaatctatccatacagccatgaaaagcctctgcttgtgcacctaaagtttttcccttgggtagtggatgagggctattttaaggcatggagacaaggtagaactggttatccattggttgatgcaggtatgagagagttgtgggccacgggttggcttcacgatcggatacgagttgtagtgtctagtttctttgtgaaagttcttcagcttccatggagatggggcatgaagtatttttgggataccctattagatgcagatcttgaaagtgatgctcttggttggcagtatatatctggaacactccctgatggtcgtgaatttgaccgtatagataatccacagtttgagggttacaaatttgacccaaatggagaatttgtacgacggtggcttcctgagcttgctagactgcctactgaatggatacaccacccttggaatgcaccaccaattgtacttcaagctgccggaattgagctcggttccaattaccctcttccaatcattgaaattgatgcagcaaaatccaggttagaacaagcgcttacggaaatgtggcaacaggaagcagcgtctagagctgtaattgagaatggaaccgaagaaggtctaggagactcctctgattcagcctccattgcatttcctcaagacatggaggaggatcatggaacttttaggaacaaccctactaccactacaattcggcgttatgaggatcaaatggtcccaagcatgacggcttctttggtaaggggccaagaggaagacacctcttcagatctccgggtaggaaatggcagagcagaagtgccaataaatgttaacatggatcaggaaccaaggacagaaatatttaaccaacctattgcacaaacagttcaaaccaacaacattctgccacgatttaatattgcaatagggctgagggatgctgaagattctacagcggaatcttctagtagtagtattaggagagaaagggatgggggagtggttccagtatggtctccctcagcttctagttattcagagcaatacgttaacgaagaaaattcttacttgcagaggcatccgcaatctcaccaagtaatgaactggaggcggctttctcaaacagggtaaacattacgcctggaaggcaactggccaggtgaggaatattccggacaggccagtcctacagccattgggacaacgaacagcacctgcatacatcttcatccacccttcctttcaccagtcctaaagttgaccttatttatatgaaaacgattgtactggagcaggtgctcatctgaatcctccttttggcccctgttgtaccatatttgtgccttcattgtatagtaactattgatagctagaggagctaaagagtgcttaatagggtttgtgcagttctctaataaactcgggtttgtgccttttcgtttttcttttaattaggaaaatattattattgtactattatcattcctcctcgctacattgttccatgtcttagctttgaagaacttgtaaagtaacttctatgttgaattgtaaaacacttccataggcctgctgaatgtacatgccggtttatatttgtagactttccgaattgtatacgtatataatatatgtataagcatg

SEQ ID NO: 6356 - DNA, 2662 bp, Vinca minor
gattccatattatattatggtttatagataggagaaacaaaagggttaaaaagttgagttcttgaaaggtttttttttagggagatgtcaggggggtgtagtattgtatggttcagaagagatctgagagtagaagataaccctgcacttgctgctggggtaagatcaggggcagttattgcagttttcatatgggcacctgaggaagaaggtcattatcatcctggaagggtttcaagatggtggcttaaacagagtttatcttatcttgattcttctttgaggagtcttggaactgcccttgttactaagagatctactgatagtatttcttctttacttgaagttgttaagtcaactggggctactcaattgttctttaatcatttatatgaccccatatcactggtgcgagatcaccgggcaaaggaagttttaacagctcaaggtgtggccatccgctcctttaatgcagacctgctctacgaaccctgggaagttcttgatgaggaaggtcgtccattcagcaccttttcagcattctgggaaagatgtctcagcatgccctatgaccctgaagctccacttcttccacctaaaagaataatctcgggtgatgtgtctagatgtccatcagataacttaatctttgaggatgaatcagaaaaaggaagtaatgcacttctttctcgggcatggtctcccggctggagcaatgctgacaaggcactaaccactttcatcaatggaccattaattgaatattcaaagaaccgtcgaaaagctgatagtgctacaacctcatttctttctcctcacctacattttggggaagttagtgtccgaaaggttttccacctagttcgcatcagacaagttttgtgggccaatgaggggaatagtgccggtgaagagagtgtcaatctgttcctcaagtctattggtttacgagagtattcaaggtacatgagttttaatcatcctcaaagccatgaaaggcctctactgggtcacctcaaatatttcccttgggtagtggatgagaattactttaaggcctggcgacaaggtagaactggttaccctttggtggatgctggtatgagagagctatgggcaactggctggctacatgataggatacgagttgtcgtttctagtttctttgtcaaggttttgcagcttccgtggaggtgggggatgaaatatttttgggatactcttctggatgccgaccttgaaagtgatgctctcggttggcagtatataactggtactctaccagatggtcgtgagtttgatcgcattgacaatccacagtttgagtgttacaaatttgatccaaacggagagtatgttcggaggtggcttcctgagctctctagattaccgactgaatggatacatcatccatggaatgcaccagaatctgtactccaagctgctgggattgagctaggttccaattaccctctccctatagttggaatagatgcagccaaagtgaggttagaagaagcgctttcacaaatgtggcaacttgaatcggcttctagagctgctatcgagaatggaactgaagaaggacttggtgactctgaagcaggaccaattgactttcctcaagacatgcaaattgaggttcagcaaccaatcagaaataatcccacgactacagtaattcggcgttatgaggatcagatggtcccgagcataacatcatctctgtttagaattgaagatgaagaaacttccacagatgttagaaattcagcagaaacaagtagagcagaagtgccgataactgttaatataatcgaagaacctccaagagaaccgccgtttaataacaacactccgccccagttcaactttccagtaggtcggagaaattctgaagactcaacagcagaatcttcaatcggtggtagtaggagagaaagggacggaagcgttgttccagtgtggtctccttcaagttctaatttttccgatccatttgttaacgaagataatagtataggaggagctagttcgtcttacttgcaaaggcatcctgagtctcaccgtatgaactggaggcggctctctcaaactggataaggtatagatgaatcatgaagtatgatgatgctgaagaacttactaatttttccaatttgctgttggtttatgaaattctaaagtagtttaaatttcatttcagttgcagtaaatatttctttttccataaatgcatattacaaagcataataatccctcaagttactgtctggtttacaaattgtaaggctcagcttctcaagtaagactctcaggtttggtgatacttcttcatacttcagcagaatgtagaaatagatcattgtagttggtcttcgtgctttgttcttcatctttttccggctccggtaccctgagtacactgtatactaaggttgcagccatggcgccaaggacgggtgccacgacatagacccagatgttcttgtattcgccggccactattgcaggtccaatgcttcttgcaggattcatggaagctccagttataggcctgccattcatagtctcattaatagcaaacaactctttagactgttctctatagagctatagggagagaatttggtaatatcttcggaaaaatctgttatgggtc

SEQ ID NO: 6357 - DNA, 2073 bp, Ricinus communis
atgtcaggtggtggttgtagcatagtttggttcaggagagatctaagagtagaagataatccagcacttgcagctggtgttagagctggggctgttgttgccgtctttgtatgggctcctgaggaagaaggtcattattaccctggtagagtatctaggtggtggcttaagcaaagtttggctcatttggattcttctttgagaagtcttggcactgttcttgttagtaaaagatcaactgatagtgtttcttcccttcttgaagttgttaaatctactggtgctactcaactcttcttcaaccacttgtatgatccaatttcactggttagggatcatcgggcaaaggaggttttgactgcacaaggcatagctgtaagatctttaacgcggatttgctatatgaaccctgggcccccccccccccccccccccccccccccccccccccccccccccccccccccccccccccccccccccccccccccccccccccccccccccccatgccttagcatgccttatgatccagaggctccacttctcccacctaagagaattatttcaggtgatatatctagatgcccttcagacacactgatatttgaagatgaatcagaaaagggaagcaatgcactgcttgctcgagcatggtcacctgggtggagcaatgctaataaagcgctaactacattcatcaatgggccacttattgagtactcaaagaatcgtagaaaggctgatagtgctacaacctcctttctttctcctcatttgcattttggtgaggttagtgtgagaaaggtcttacatcttgttcgcattaagcaagttctgtgggcaaatgaagggaacaaggctggtgaagaaagtgtgaacttgtttcttaaatcaattggtcttagggaatattcaagatacctgagttttaaccatccttatagtcatgaacgccctcttcttgggcatcttaagttttttccttggattgtgaatgaaggctattttaaggcttggagacaaggtagaactggttatccattggttgatgcaggaatgagagagttgtgggccactggttggctgcatgatcgaatacgagtagttgtttctagtttctttgtaaaggttctacagcttccatggagatggggaatgaagtatttctgggataccctcttggatgcagatttagagagtgatgctcttggttggcagtacatatctggtactcttcctgatggccgagagtttgatcgtatagacaacccacagtttgagggatacaaatttgatccccatggagaatatgtacgacggtggcttcctgaacttgccaggctgccaactgaatggatacatcatccatggaatgcacctgaatctgtactccaagctgctggaattgagctaggatcaaattaccctctccccattgtagggatagatgcagctaaagtcaggttgcaagaagcactttcagaaatgtggcagcacgaagccgcttccagagctgctattgagaatgggactgaagaaggtctaggagactcttctgaatcagctccaattgccttccctcaagatatacaaatggaagaaaaccttgaacctataagaaacaatcctcctattccaattcgccgttatgaggatcagatggttccaagcatgacttcttctttgctaagagttgaagaagaagaaacttcgtcagatcttcgaaatgctgcagaagatagcagagctgaggtgccaagagatgtaaatgtcaatcaagaacaaagaagaaaccttggggttgcacaagcttttcgtagtaacaacttaccaaatgttaatattctcagaggtctgccaaatactgaggattcaacagcagaatcttcgagtagtactaggagagagagggatggaggtatagttccagtgtggtctcctccaagcactagttactcagagcagtttgctggtgatgaaaacggtattggaaccagttcttcttacttgcaaaggcatccgcaatctcaccagataattaattggaggcggctgtctcagactgggtaa

SEQ ID NO: 6358 - DNA, 2717 bp, Phaseolus vulgaris
tttcttttacctatttatggcttaaaatctcccaataaacaagttagacagagaagccaggacgaggaagaaagagagaagaagagagaacttaaaaaaagaaaaaggtaacatattctgtttggttttcttcaaaacagaaagaaagtaaagagaagttatgagatgagatgagatggttaaaactggtgtgtgaaagcagtttaaggttgtagagatgagaggtggcggtggatgcagcatagtgtggttcagaagagatctgagggtagaggacaaccctgcactgacggcaggagtaagagctggtgctgtggttgcagttttcatctgggcacctgaagaagaagggcagtactaccccggcagagtctccaggtggtggctcaaacaaagcttggctcatcttgattcttctctcaggaatcttggcactcgtctcatcactaagcgatccactgatactgtttcttctctcctcgaggttcttaagttcactggagctactcaactctattttaatcatttatatgatcccctgtcacttgtaaaggatcaccgagtaaaagaggttctaaatgctaagggcataacagtacgttccttcaacgcagatttactatatgaaccatgggatgtgaatgatgtccatgctcgaccattcacaacttttgctgctttctgggacagatgtcttaacatgccttatgaccccgactctcctcttcttccacctaaaaggataattccaggtgatgtgtcgagatgccctagtgatagattggtgtttgaagatgaatcagagaaggcaagcaatgcacttcttgctagagcatggtcaccagggtggagcaatgctaacaaggcattgacagccttcataaatggtccactgatagagtactcaacaaattgcaggaaggctgacagtgccactacctcacttctctcaccccatttgcattttggtgagttgagtgtcaagaaggtcttccatcttgtccgcatcaaacaacttttgtgggccaacgaaggaaacaaggccagtgaagagagtgtgaacttgttccttaaatctattggtcttagagaatattcgaggtacattagtttccaccacccctacagtcatgaaaggcctcttctaggccaccttaagttctttccttgggttgtaaatgaggcttattttaaggcatggagacagggcagaactgggtaccctttagtggatgcagggatgagggagttgtgggctactggttggctgcatgatcgcatacgtgttgtagtttccagtttttttgtgaaagttctgcagcttccttggagatggggaatgaaatatttctgggacacccttttggatgcagatcttgagagtgatgctcttggttggcagtacataactggtacactccctgatggtcgtgaatttgaccgaatcgatcatccacagtttgagggctataaattcgaccccaatggagaatatgtgcgacgctggcttccagaacttgcaagattacctactgagtggatacatcatccttggaatgcaccagaatcagtgctccaagctgctggaattgagctaggatccaactatcctcttccaattgtgggaatagatgcagcaaaaactagattacaagaggcattatcagaaatgtggcaactagaggctacttcaagagctgaagtggaaaatggaactgaggaaggacttggagaatcctctgaatcaattcctgctgcttttgcgcaagacacgcaaatggaggaaactcatgaacctgttaggaacaatccccttcctgttgctcgaagcttcctggatcagatggttccaagcatcacttccaccctgctgagagtagaagacgaagaaactacttctgatcttcgaaactcagcagaagagagcagcgcagctgaagtgccaataaatgtaaatgcacaacagaatgcaggaggagttacatggaacgaacggatcttgcagagtgctcataggaatacacaagtacaatacaatactacaatggagctaagaaacgtagctgaagattctgccgtagaatcttcaagtggtaccaggagagaacgggatggaggttcagttccagtatggtctccccctgcttccagtgactcagaacaatttgtaggagatgaaaatggtattacaaacctcttccttgcaaaggcatcctcggtctcaccaattactgaattgtaagcagctacctcagaccgggtatttcttatctaaagcaattagactagaagaaggataatgcactatcacctttactttgagataaagtgggatgttgaagccgcattagacatacatgtgttaatttccgactccttttaccaccggctgacctccaatgtgtaggagatttcaattcatgcacagttcatctgcattttctttgctttcttgtacaatatttgctacttgctgtatggtatagtttgtgttgttagggagaaagagccaccataggatctttggtctaataataaactcagatttgtgctttcagttaaggcagatatattagttatgatacgagctttatttacattttctctgccctacatctatgctaaccactataaagtgcacctcatcttcttctcacatttctgaatcttctgcagcatattaatctacactgctataacactttctattttgtttt

SEQ ID NO: 6359 - DNA, 3033 bp, Phaseolus vulgaris
catatccctctcactctgtccattctgtcaaaccctgttttttcgtacaactagccattgaaagcaacaaaatacgcatttgttgtaaaatattgataatttcaccaaaaccagattatcacagtaaaggcgagtgccacaactttaaaagtcatcaacccaataatcacacgtttcttttacctatttatggcttaaaatctcccaataaacaagttagacagagaagccaggacgaggaagaaagagagaagaagagagaacttaaaaaaagaaaaaggtaacatattctgtttggttttcttcaaaacagaaagaaagtaaagagaagttatgagatgagatgagatggttaaaactggtgtgtgaaagcagtttaaggttgtagagatgagaggtggcggtggatgcagcatagtgtggttcagaagagatctgagggtagaggacaaccctgcactgacggcaggagtaagagctggtgctgtggttgcagttttcatctgggcacctgaagaagaagggcagtactaccccggcagagtctccaggtggtggctcaaacaaagcttggctcatcttgattcttctctcaggaatcttggcactcgtctcatcactaagcgatccactgatactgtttcttctctcctcgaggttcttaagttcactggagctactcaactctattttaatcatttatatgatcccctgtcacttgtaaaggatcaccgagtaaaagaggttctaaatgctaagggcataacagtacgttccttcaacgcagatttactatatgaaccatgggatgtgaatgatgtccatgctcgaccattcacaacttttgctgctttctgggacagatgtcttaacatgccttatgaccccgactctcctcttcttccacctaaaaggataattccaggtgatgtgtcgagatgccctagtgatagattggtgtttgaagatgaatcagagaaggcaagcaatgcacttcttgctagagcatggtcaccagggtggagcaatgctaacaaggcattgacagccttcataaatggtccactgatagagtactcaacaaattgcaggaaggctgacagtgccactacctcacttctctcaccccatttgcattttggtgagttgagtgtcaagaaggtcttccatcttgtccgcatcaaacaacttttgtgggccaacgaaggaaacaaggccagtgaagagagtgtgaacttgttccttaaatctattggtcttagagaatattcgaggtacattagtttccaccacccctacagtcatgaaaggcctcttctaggccaccttaagttctttccttgggttgtaaatgaggcttattttaaggcatggagacagggcagaactgggtaccctttagtggatgcagggatgagggagttgtgggctactggttggctgcatgatcgcatacgtgttgtagtttccagtttttttgtgaaagttctgcagcttccttggagatggggaatgaaatatttctgggacacccttttggatgcagatcttgagagtgatgctcttggttggcagtacataactggtacactccctgatggtcgtgaatttgaccgaatcgatcatccacagtttgagggctataaattcgaccccaatggagaatatgtgcgacgctggcttccagaacttgcaagattacctactgagtggatacatcatccttggaatgcaccagaatcagtgctccaagctgctggaattgagctaggatccaactatcctcttccaattgtgggaatagatgcagcaaaaactagattacaagaggcattatcagaaatgtggcaactagaggctacttcaagagctgaagtggaaaatggaactgaggaaggacttggagaatcctctgaatcaattcctgctgcttttgcgcaagacacgcaaatggaggaaactcatgaacctgttaggaacaatccccttcctgttgctcgaagcttcctggatcagatggttccaagcatcacttccaccctgctgagagtagaagacgaagaaactacttctgatcttcgaaactcagcagaagagagcagcgcagctgaagtgccaataaatgtaaatgcacaacagaatgcaggaggagttacatggaacgaacggatcttgcagagtgctcataggaatacacaagtacaatacaatactacaatggagctaagaaacgtagctgaagattctgccgtagaatcttcaagtggtaccaggagagaacgggatggaggttcagttccagtatggtctccccctgcttccagtgactcagaacaatttgtaggagatgaaaatggtattacaaacctcttccttgcaaaggcatcctcggtctcaccaattactgaattgtaagcagctacctcagaccgggtatttcatatctaaagcaattagactagaagaaggataatgcactatcacctttactttgagataaagtgggatgttgaagccgcattagacatacatgtgttaatttccgactccttttaccaccggctgacctccaatgtgtaggagatttcaattcatgcacagttcatctgcattttctttgctttcttgtacaatatttgctacttgctgtatggtatagtttgtgttgttagggagaaagagccaccataggatctttggtctaataataaactcagatttgtgctttcagttaaggcagatatattagttatgatacgagctttatttacattttctctgccctacatctatgctaaccactataaagtgcacctcatcttcttctcacatttctgaatcttctgcagcatattaatctacactgctataacactttctattttgttttagtaattcatgtaatcatggacattatattttgacgggtcacagagacaaatcattgtgctgtctccagctttatctgttttgagtacctaagagtttgcgaatttggttcttcttttttatgataaagaatttggttcttct

SEQ ID NO: 6360 - DNA, 2314 bp, Glycine max
aaaagaaaaataatcttattcagttatctgtgtgattcggaacaaaacctagacggtccctggtaatttcaatttccaacgacgcgggagaagtacatgatggaagtgacgaaagaccctaattcagatttcgaactcgaactctacaccatcccaagctcttcaagatggttcgcgtgggaagaaatccacgaaacggagagaacagcgttcaaggaatacttcgacggaaactcaataacgcgaacccctaagatatacaaagagtaccgagacttcatcatcaacaagtacagggaagagccctcgaggaggctcaccttcaccgaggtgcgcaagtcgctggtcggcgacgtcacgttcctgcacaaggccttcctcctcttggagcattggggtctgatcaactacggcaccgcgcaaccttcttccggtgcggacgcagcggaggaggaggaggagcatcgcaaggttcgtctcgaggaaggcgcccctggtgggattcgtgtcgcggcgacgccgaattcgttgaagcctatgttgttgcctcgcaatgggaagagtggggtgaatgcgagtggggcttctctcaaattgccgccgctggcgtcgtactctgatgtttatggtgatttgattaggcagaaagagggcaactgtggcctttgcggtcacaaatgtggttctggacattaccgatgtacacaggataatttcattatttgtattaattgtttcaaaagcgggaattacggggagaaaaggtccacggaggattttgtattgagtgagtcaagtgaaaatagtggtaagcatgacactgtctggactgaggcagaaactcttctccttctagaatctgttttgaagcatggcgatgattgggaacttgttgctcaaagtgttcaaaccaagaccaaacttgattgtatctcgaaactcattgagctgccctttggggagctcatgttgggccctgctcacagaaatgttaacattaacgatgctaatggcatcgtgaacaatgcaaaacaagttcaatcatcttcatctgataaccaagagatttcaaagacaaaggaccaatctcctgagtttacaaatgaaaatgagcagaacggagatgctgtgaaggaaagtccttcaaaaagacagcgtgttgcttccctttcagattccagcagttcgctaatgaatcaggtgggactgatctctaatgtggttgaccctcatatcacagctgctgcagctgatgcggctgtttcagctctttgtgatgaggatttgtgtccaagggagatatttgatgttgacggtgaagaaggtttagagatggagaggtcctctctatcagaaatacctttgacactgcgtgtaagagctgccactgcaactgctcttggagctgctgctgcacgagcaaagttgttggcagaccaggaagacagagagattgaacatttagtagcaactataattgaagcacagattgacaaaatgctacagaaggttaaacattttgacgatctggagctattgatggaaaaggaacacgctgaaatggaaaataaaaaagattctatcttgactgaacggattgatgtgttacggagaacatttagatctggagtcactagatggaaagattattcttatgtaaaatcttagaccagttgattgtagtacaaattatttttaaataaagttgattgaatgatgaatcaagaaaatcgtgattgaatcaaatgttttttttttccttaaaattaatataatttgttattcttatcagaaaatatggacctgcttgtttattattttaaaaaaatatatttttttgtctctaaaatcaaaagaaaaatattacttgacaatgagttttgtcacttgggtgaaattatttttaaaaaacattatcagtgtttttgtttttagaacactttagctggaagggtgagagagacggagaccttgtctgggaggtggtggtttgagtggggccccctcatgtcctcatccacgtgggtatctaagccgatggaggagctctatgaggaaactggtaacaggattaccatcttgacccggcatctattgccaatattgacttccaaattatgtggagttttgctttgtttttgtaaaaaaattgtagctccttacgtgttcagattttggattggattaatctcttttgtggttttgttgtgggtctatctgtattaatgaaagtgagagtacatggcatgtgaaatgggtgttactgttgaatttatcaactgattgatatttattacaaataagtgtggacagg

SEQ ID NO: 6361 - DNA, 1959 bp, Glycine max
cggaacaaaacctagtcttgtccctggtgaggaaagagcggcatggaagtagcgaaagaccctaactcacaggcggattcagattcggaactggaactctacaccatcccaagctcttcaagatggttcgcgtgggaagaaattcacgaaacggagagagcagcattcaaggaatacttcgacggaagctcgatatcgcgaagcccgaagatatacaaagagtaccgagacttcatcatcaacaagtacagagaagagccctccagaaggctcacattcagcgaggttcgaaagtcgctcgtgggagacgtcacgttccttcacaaggtcttcctcttcttggagcattgggccttgatcaactacggcaccgcagaggatgtggaggaggaccattgcaaggttcgcttcgaagaaggcgcccccagtgggattcgagtcgccgccacgcccaattccttgaagcctatgctgctgcctcgcaatgggaagagtgccgccaatgccactggggcttctctcaaattgccgcctctggcctcttactctgatgtttatggtgatttgattaggcagaaagagggcaactgtgccctctgcgctcaccaatgtggttctggacattaccgatgtacacaggataattttattatttgtgcaaattgtttcaaaagtgggaattatggggagaaaaggtccgcagaggattttgtatttagtgagtcaagtgaaaatagtgtcaaacatgacactgtctggactgaggctgaaactcttctccttttagaatctgttttgaagcatggggatgattgggagcttgttgctcaaagtgttcaaaccaagaccaaacttgattgtatctcgaaactcattgagctgccctttggggagctcatgttgggccctactcacaaaaatgttaacattaacggtgctaatggcatcatgaacaatgccaaacaagttcaatcatcttcatctgacaaccaagaaatttcaaagacaaaggaccagactcctgagcttacaaatgaaaatgagcagaacggagatgcagtgaaggaaagtccttcaaaaagacagcgtgttgctgccctttcagattccagcagtttgctaatgaatcaggtgggactgatctctaatgtggttgaccctcatatcacagctgctgcagctgatgcagctgtttcagctctttgtgatgaggatttgtgtccaagggagatatttgatgttgaagaggattattcagcaagagctcttgagggtgaagaaggtttagagatggagaggtcctctctatcagaaatacctttgacactgcgtgtaagagctgccactgcaactgctcttggagctgctgctgcacgagcaaaattgttggcagatcaggaagacagagagattgaacatttagtagcaactataattgaagcacagattgagaaaatgctacgcaaggttaaacattttgacaatctggagctgttgatggaaaaggaacacgctgaaatggaaaatctaaaagattctatcttgactgaacggattgatgtgttgcggagaacatttagatctggagtcactagatggaaggattattcttatgcaaaatcttagaccagtttgtatgcatgtgtatagtaagattactgttcactgttattttacatcagggccaatgaagtactgtaacatttattatttattataaccatataatccagtgatcagctaacggcttttagaaggttatatcttagatactatctaaacctttttgggtagctatgtgctgttggatacttttaattttggcttttgaatggattctataaattcatgtaacttgtaatgtattaaattgtacaaaattcaatttctttcatttataaagttccttgtctagataattacaccgcatcatcgaaaaggccatggtgcagaagtgat

SEQ ID NO: 6362 - DNA, 1893 bp, Cajanus cajan
gggagaagcaaatagatcaacgtccacatttgcgtgagttagagcctccgccatggacgattcagactccgagctcgagctctacaccatcccaagctcttcaagatggttcgcgtgggacgaaatccacgagacggagcgaacggcgttcaaggaattcttcgacgggagctcggtgtcgcgaacccccaagatatacaaagagtaccgcgacttcatcatcaacaagtaccgcgaggagccctcgcggaggctcacgttcaccgaggtgcgcaagtcgctggtgggtgacgtcacgttcctgcgcaaggcgttcctctttctccagaattggggtctgatcaactacggcgcgccttccgctgcggacgcggagggggatgtggaggacgagtgcagggttcgggtcgaggatggggcgcccaccgggattcgcgtggcggccacgccgaactcgctgaagccgatggcgggggggcgcggcgccgccaagagtggggggagtgcgagtgggggttcgctcaagttgccgccgctggcttcgtattctgatgtttatggcgatttgattaggcagaaggaggtcaagtgtgggctttgcggtgataaatgtggttctggacattaccgatgtagccaggataatttcattatttgtacaaattgcttcaaaagtgggaatttcggggagagaaggtctgcagaggatttcgtattaagtgagtcaagtgaaaatagtggcaaacacgacactgtctggactgaaggagaaactcttctccttttagaatctgtgttgaagcatggggatgattgggaacttgttgctcaaagtgttcaaaccaagactaaacttgattgtatctcaaaactcattgagcttccctttggggagctcatgttgggctctgctcacagaaatgttaacagtaacagtgttaatggcatcatgaacaatgcaaagcaagttcagtcatcttcagctgacgatcaagaaacttccaagacaaatgaccaatgtcctgagctaccaaatgaaaatgagcagaatggggatgctgtgaaggaaagtccttcaaaaagacagcgtgttgctgccctttcagattccagcagttcattaatgaatcaggtggggctgatctctactgtggttgatcctcatatcacagctgctgcagctgatgctgctgtttcagcactttgtgatgaaaatttgtgtccaagggagatatttgatgttgaagaggatgaaggtttagagaccgagaggtcctctctgtcagaaatggatcacagctgtccaaaggatggcatacctttgacactgcgtgttagagctgccactgcaactgctcttggagctgctgctgctcgagcaaagttgttggccgaccaggaatacagagagatcgaacatttagtggcaactataattgacgcacagattgagaaattgctacacaaggttaaacattttgacgatctggagctgttgatggagaaggaacacgctgaaatggaaaatctaaaagattctatcttgactgatcgaattgatgtgttacggagaacatttaggtctggaatcactagatggaaggattattcgtatgtaaaatcttagttttcatgcatgtgtataattttggtactccatgccgaacgatggagttggactattattttacatcagggccaacacgaactgttagacttgctattcgccgttattttacatcagggccaatgaagtactgtaaaatttgttgtttattatctaaattttttgggtagcgcttacgtgcttgatacttataattttggcttttgaacgggacactaaattcgtctagcttgtattgtagtgtaattaaattgtacaaaattcaa

SEQ ID NO: 6363 - DNA, 1032 bp, Vigna unguiculata
aggaactccaataagcaaaagccaattgatacttgcatatcacaaaacacacacacacacactcacacactctctaaaaaaatcccctatcacctaactcacctatcttcaactcaacccctttagtctcagagtgttacatacacttacagaacatggaatatacttattcagcagagggtgcagaggcagaaacttacaccagtagcagcaccaccccatcaagtgccatgagatcatcaaagaagaaagccaacaacaacacaagaaggttcagtgatgatcaaatcaaatcattggaaaccatgtttgagacagagtccaggcttgagcctagaaagaagttgcagctcgcaagagaccttggattgcagccacgacaggttgctatatggtttcagaacaagagagctaggtggaagtcaaagcaactcgagagagactatggtatactacaatccaattacaacagtttggcctcacgctttgaagctctcaagaaggaaaaacaaacattactaattcagttgcagaagctgaatcatctaatgcagaagccattggagggaggtcagagtaggacacaagttgaagctgcaaacagcatggacagtgaatcagaaaatggaggcaccatgaaatgtgaggaggaggaaaagccaagcccatcagtggaaagatcagaacatgtgcacggtgttctgtctgatgatgatggtagcataaaggtggaagattttggcctagaagatgaacatggtctcttgaactttggggagcatgctgatgactccttgacttcaccagaagattggagtgcttttgaatccgatggtctcttaggccaaacgaccggtgattaccaatggtgggatttctggtcctgaatgaaacagaacaaccagaatttttgtgaaggaatatgtatgcgtattaatgcttcatgtttggttccatattttgcatgcaaatcttcacatctggatgcagctagttatagcttctacattttttagcaaaaaaaaaaaaaaa

SEQ ID NO: 6364 - DNA, 1248 bp, Glycine max
actaagatagaaaaataggtaatattcacaatgtacaggtggaagaatattgtatgttgaggtgtcaacaggaccaatgagttttggatataaagccatcaactggggacttcactctgaccaccatgataggaactccaataagcaaaagccaattgatacgtgcatatcacaaaactactcttaaacacacacacaccccaaaaaaatcctctatcaccaaactcacctatttcctcaactcaaggccctatagtcccagcaagtgagtgagcgtcacacaacatggaatatacttattcagcaggtgtagaggcagaaactcacacaagtagcagcaccaccccatcaagatcaaagaagagaaacaacaacacaagaaggttcagtgatgaacaaatcaaatcattggagaccatgtttgaatcagagtcaaggcttgagcctagaaagaagttgcagctggccagagagcttggattgcagccaaggcaagttgctatatggtttcagaacaagagggctaggtggaagtcaaagcaacttgagagagactatggcatactccaatccaattacaacagtttggcttcccgttttgaagctcttaagaaggaaaatcaaacattactaattcagctgcagaagctgaatcatctaatgcagaagccaatggagccaggtcagagatgcacacaagttgaagcagcaaacagcatggacagtgaatcagaaaatggaggcaccatgaaatgtgaagctgagggaaagccaagcccatcaatggaaatatcagaacatttacttggtgttctgtctgatgatgacacaagcataaaggtggaagactttggcctagaagatgaacatggccttctgaattttgctaagcatgttgatggttccttgacttcaccagaagattggaatgcttttgaatccaatgatctattaggccaatcaaccactgatgattaccaatggtgggacttctggtcctgaatgaaacagagcaaccaaaattttgtggaggaaatatttatgcatatgaatgcttcatgtttggttccacgttggcgacttagattcgataactgggtagcaattagttatagctttcacgtttatgagcaaaatccacgcgattttttcattaataacgagtttccaaacacgcactaaatcaatactaattaagagaacataattaagcaccacctaagacaacgcagactaaaaatatttgtt

SEQ ID NO: 6365 - DNA, 1225 bp, Glycine max
attcacaatgtacaggtggaagaatattgtatgttgaggtgtcaacaggaccaatgagttttggatataaagccatcaactggggacttcactctgaccaccatgataggaactccaataagcaaaagccaattgatacgtgcatatcacaaaactactcttaaacacacacacaccccaaaaaaatcctctatcaccaaactcacctatttcctcaactcaaggccctatagtcccagcaagtgagtgagcgtcacacaacatggaatatacttattcagcaggtgtagaggcagaaactcacacaagtagcagcaccaccccatcaagatcaaagaagagaaacaacaacacaagaaggttcagtgatgaacaaatcaaatcattggagaccatgtttgaatcagagtcaaggcttgagcctagaaagaagttgcagctggccagagagcttggattgcagccaaggcaagttgctatatggtttcagaacaagagggctaggtggaagtcaaagcaacttgagagagactatggcatactccaatccaattacaacagtttggcttcccgttttgaagctcttaagaaggaaaatcaaacattactaattcagctgcagaagctgaatcatctaatgcagaagccaatggagccaggtcagagatgcacacaagttgaagcagcaaacagcatggacagtgaatcagaaaatggaggcaccatgaaatgtgaagctgagggaaagccaagcccatcaatggaaatatcagaacatttacttggtgttctgtctgatgatgacacaagcataaaggtggaagactttggcctagaagatgaacatggccttctgaattttgctaagcatgttgatggttccttgacttcaccagaagattggaatgcttttgaatccaatgatctattaggccaatcaaccactgatgattaccaatggtgggacttctggtcctgaatgaaacagagcaaccaaaattttgtggaggaaatatttatgcatatgaatgcttcatgtttggttccacgttggcgacttagattcgataactgggtagcaattagttatagctttcacgtttatgagcaaaatccacgcgattttttcattaataacgagtttccaaacacgcactaaatcaatactaattaagagaacataattaagcaccacctaagacaacgcagactaaaaatatttgtt

SEQ ID NO: 6366 - DNA, 957 bp, Cajanus cajan
gttatacaacatggaatatacttattcagcagaggctgaaacttacacaagtagcagcaccaccccttcaactgccctcagaaagaagaaaaacaacaacaacaacaacaacaacaacaacaacaacaacacaagaaggttcagtgatgatcaaatcaaatcattggagaacatgtttgagactgagtcaaggcttgagcctagaaagaagctgcagcttgcaagagagcttggattgcagccaagacaggttgctatatggtttcagaacaagagagccaggtggaagtcaaagcaactagagagggactataccatactccaaaccaattataacaccctggcctcacgttttgaagctctaaggaaggaaaagcaaacattactaatacagttgcagaagctgaatcatctaatgcagaagccgttggagccaggtgagaaatgcacacaggttgaagcagcaaacagcgtggacagtgaatcagaatatgggggcaccatgaaatgtgaagctgaggaaaagccaagcccttcaatggaaagatcagaacatgtgtttggtgttctgtcagatgatgacacgagcataaaggtggaaaactttggcctagaagatgaacctggtcttctgaattttgctgagcatgctgatggttccttgacttcaccagaagattggggtgcttttgaatccaatgatctcttaggccaatcaaccagtgattaccaatggtgggacttctggtcctgaatgaaacagaacaaccaaaattttgtggaggaattaatgtatgtatgcatatgaatgcttcatgttttgttccacattggatattatgatttttcatgttaacttagaaataactagtcatagattccacagttttaaacgaaattggtgtgattttatccaacacgaaccaaatcaataaacaaggtaacaccacctaagat

SEQ ID NO: 6367 - DNA, 1351 bp, Glycine max
ctgaccaccatgataggaactccaataagcaaaagccaattgatacgtgcatatcacaaaaactactcttacacaccaaaaaaatcctctatcaccaaactcacctataccctcaaactcaaggccctatagtccaagcaagtgagtgagtgttacaacttacacagcatggaatatagtcaatatactacttattcagcagaaggtgttgaggcagaaacttacacaagtagctgcaccaccccatcaagatcaaagaagagaaacaacaacaacacaagaaggttcagtgatgaacaaatcaaatcattggagaccatgtttgagtcagagacaaggcttgagcctagaaagaagttgcagcttgcaagagagcttggattgcagccaaggcaagttgctatatggtttcagaacaagagggctagatggaagtcaaagcaacttgagagagactatggcatactccaatccaattataacactttggcttcacgttttgaagctctgaagaaggaaaaacaaacattactaattcagttgcagaagctgaatcatctaatgcagaagccaatggagccaagtcagagatgcacacaagttgaagcagcaaacagcatggacagtgaatcagaaaatggaggcaccatgaaatgtaaagctgagggaaagccaagcccatcatcattggaaagatcagaacatgtacttggtgttctgtctgatgatgacactagcataaaggtggaagactttaacctagaagatgaacatggccttctgaattttgttgagcatgctgatggttccttgacttcaccagaagattggagtgcttttgaatccaatgatctatttggccaatcaaccactgatgattaccaatggtgggacttctggtcctgaatgaaacagaataaccaaaattttgtggaggaaatatatatatatatatatatatatatatatatatatatatatatatatatatatatatatatatgatgaatgcttcatgtttggttccactttggcgacttgattcgataattgggtagcaattagttatagcttccatgtttttaagcaaaaagcgatgcaattttttttattaataacgagtttccaaacacctaaatcaataattaagagaacatcattaagcaccacctaagataaacgcagaattaaaaaatatttcttacatgaaagatgtgtgttatgtctggctattagttatcatcaattccacaaatttctgtggaaaaccaaactgtacttacactttaaaaggaaaaaaaaaatctcaaatctgaaagaagagattttattaataacaagttcacagagg

SEQ ID NO: 6368 - DNA, 1808 bp, Glycine max
caggaccaatgagttttggatataaagccaacaattggggacttcactctgaccaccatgataggaactccaataagcaaaagccaattgatacgtgcatatcacaaaaactactcttacacaccaaaaaaatcctctatcaccaaactcacctataccctcaaactcaaggccctatagtccaagcaagtgagtgagtgttacaacttacacagcatggaatatagtcaatatactacttattcagcagaaggtgttgaggcagaaacttacacaagtagctgcaccaccccatcaagatcaaagaagagaaacaacaacaacacaagaaggttcagtgatgaacaaatcaaatcattggagaccatgtttgagtcagagacaaggcttgagcctagaaagaagttgcagcttgcaagagagcttggattgcagccaaggcaagttgctatatggtttcagaacaagagggctagatggaagtcaaagcaacttgagagagactatggcatactccaatccaattataacactttggcttcacgttttgaagctctgaagaaggaaaaacaaacattactaattcagttgcagaagctgaatcatctaatgcagaagccaatggagccaagtcagagatgcacacaagttgaagcagcaaacagcatggacagtgaatcagaaaatggaggcaccatgaaatgtaaagctgagggaaagccaagcccatcatcattggaaagatcagaacatgtacttggtgttctgtctgatgatgacactagcataaaggtggaagactttaacctagaagatgaacatggccttctgaattttgttgagcatgctgatggttccttgacttcaccagaagattggagtgcttttgaatccaatgatctatttggccaatcaaccactgatgattaccaatggtgggacttctggtcctgaatgaaacagaataaccaaaattttgtggaggaaatatatatatatatatatatatatatatatatatatatatatatatatatatatatatatatatgatgaatgcttcatgtttggttccactttggcgacttgattcgataattgggtagcaattagttatagcttccatgtttttaagcaaaaagcgatgcaattttttttattaataacgagtttccaaacacctaaatcaataattaagagaacatcattaagcaccacctaagataaacgcagaattaaaaaatatttcttacatgaaagatgtgtgttatgtctggctattagttatcatcaattccacaaatttctgtggaaaaccaaactgtacttacactttaaaaggaaaaaaaaaatctcaaatctgaaagaagagattttattaataacaagttcacagaggttcattgctacatctttataattaaagctgtatgtttggctttcttatggcaaccgaaacataaaaagttcacactaacaggtatccaacatgaagggccaagacgtgccccactccacattattatggtggtgacacaaactataaaataagcatttgaattaatgaaaagcagctaccacaagtatggtgttcattgcctatgaaaattgatgaccaaattggagccaaatatggctattccaaaatttaaataatattcaaaataagacctagactgtttaatttcatgcaaatataaattccattcgtcctgtgaaatagaagcaagttgttcaatgattatatcaaactaggaaatcctcttcacactttcagagcataaccgttccaagaaatagaattaaca

SEQ ID NO: 6369 - DNA, 1443 bp, Glycine max
gtatgaggttcgatcaaaagcatagaagcacaaaagtaaaagaacgagctagaaagtgaagtagaaatataacaagaaaagagaatggaagtagcacaggtactccacatgaacggtggcgttggagacgcaagctatgcaaacaactcccttgttcagcaaaaggtgatttgtttgacaaagcccataagagaggaagccataagaagcctctattgcagcacacaccccagaagcttggcaattgcagatttgggttgctcttctggaccaaacactttatttgttgtgtctgaattcataaaaattgtggagaagctttgccgagagctgaaccacaaatctccagaatacaaagtctttctgaatgatctccctgggaatgacttcaacaacatcttcaagtctcttgacagcttcaaagagaaattgtgtgatgaaatggaaagtgggatcggtccatgctacttctcgggtgttcccggttctttctatggaagggttttcccatatcaaagtcttcattttgtccattcctcatacagccttcaatggctatctaaggttcctgagggtgtagacaacaacaagggcaatgtttacataggcagtacgagccccaaaaatgttgtgagagcttactatgagcaatttcagagagatttctctctttttctcaagtgtcgtgcagaggaattggttgaaggaggacgcatggttctcacatttttgggaagaagaagcgatgatccatctagcaaggatggttgctacatttgggagcttttggctactgctcttagtgatatggtcttgcagggaatcataagagaagagcaattagatacttttaacatccctcaatacactccatccccatctgaagtgaaattggaagttcttaaagaaggatcattcgccatcaatcgtctagaggtttctgaggtgaattggaatgctctcgatgagtggaatgctctagactttgaatctgaaaggtctgaatcacttagtgatggtggatacaatgtggcacagtgcatgagggctgtggcagaacctatgctgattagccactttggtgaagctatcattgaagaggttttttgccgctaccagcaaatcttggctgaacgtatgtccaaggagaaaaccaagttcatcaatgttaccatattattgactagaaaagcataagcaagaagtttgcatctatatatggtttctcaaaatggattgttgtagttgttgtgagttgtgactgtttgcttgtttgtgtttttttctagcaattaactggcaaaatgttaagttggagaaaaagaaaactagtatgatgctgtacctttggtagtaagtttctttttaatattattatgtaataaaattatttatgtgagactatgataatcagtatttggtgtactatatttcatattttca

SEQ ID NO: 6370 - DNA, 1791 bp, Glycine max
aagtagaaaaaaacctaaggaaaggagaatgaaagtagcacaggttctgcacatgaacggtggctttggagatgcaagctatgcaaacaactcccttgttcagctatacttatatagacaacatgtttgtggtcaaatatataactgacaatgacgacagagaactacgttgtaaacgacccacttttggatcaaatgtcaatcacttcatagcccgtacgacatttttatatgcagagatggatagccacgagaaaaacgttattttatgtaaaatcatatatgagaagaaaacaaacattttcttgttaaaaaacagttttcacatctatatatatataggtgtggtatgaggttcgatcaaaagcatagaagcacaaaagtaaaagaacgagctagaaagtgaagtagaaatataacaagaaaagagaatggaagtagcacaggtactgcacatgaacggtggctttggagatgcaagctatgcaaacaactcccttcttcagcgaaaggtgatttgtttgacaaagcccataagagaggaagccataagaagcctctattgcagcacacaccccagaagcttggcaattgcagatttgggttgctcttctggaccaaacactttatttgttgtgtctgaattcataaaaattgtggagaagctttgccgagagctgaaccacaaatctccagaatacaaagtctttctgaatgatctccctgggaatgacttcaacaacatcttcaagtctcttgacagcttcaaagagaaattgtgtgatgaaatggaaagtgggatcggtccatgctacttctcgggtgttcccggttctttctatggaagggttttcccatatcaaagtcttcattttgtccattcctcatacagccttcattggctatctaaggttcctgagggtgtagacaacaacaagggcaatgtttacataggcagtacgagccccaaaaatgttgtgagagcttactatgagcaatttcagagagatttctctctttttctcaagtgtcgtgcagaggaattggttgaaggaggacgcatggttctcacatttttgggaagaagaagcgatgatccatctagcaaggatggttgctacatttgggagcttttggctactgctcttagtgatatggtcttgcagggaatcataagagaagagcaattagatacttttaacatccctcaatacactccatccccatctgaagtgaaattggaagttcttaaagaaggatcattcgccatcaatcgtctagaggtttctgaggtgaattggaatgctctcgatgagtggaatgctctagactttgaatctgaaaggtctgaatcacttagtgatggtggatacaatgtggcacagtgcatgagggctgtggcagaacctatgctgattagccactttggtgaagctatcattgaagaggttttttgccgctaccagcaaatcttggctgaacgtatgtccaaggagaaaaccaagttcatcaatgttaccatattattgactagaaaagcataagcaagaagtttgcatctatatatggtttctcaaaatggattgttgtagttgttgtgagttgtgactgtttgcttgtttgtgtttttttctagcaattaactggcaaaatgttaagttggagaaaaagaaaactagtatgatgctgtacctttggtagtaagtttctttttaatattccagtgtgtaataaaattatttatgtgagactatgatagttagtatttggtgtactatatttcatattttc

SEQ ID NO: 6371 - DNA, 1080 bp, Phaseolus vulgaris
atggaagtagctcaggtactgtgcatgaacggtggcgttggagacgctagctatgcaaacaactctcttgttcagctaaaggggatttgtttgacaaagtcaataagagaggaagccataactagcctctattgcagtgcactccccagaagtttggcagttgcagatttgggttgctcttctggaccaaatactttgtttgttgtgtctgaactcatcgagactgtggagaagctttgccaacagctgaaccataaatctccagaatacaaggtttttctaaatgatctctctgggaatgacttcaacaacatctttaagtccattgacagctttaaagagaaattgcaaaatgaaatggaaagtggtccatgctacttctctggggttcccggatctttctatggcagggttttcccaagtcaaagtttgcattttgtccactcctcttacagccttcattggctgtctaaggttcctgagggtgtagacaacaagggaaatatctatataggtagaacaagcccaacaaatgttgtgagagcttactatgaccaatttcaaagagatttctgtctttttctcaagtgtcgagcagaggaattagttgaaggaggtcgtatggttctgacatttttggggagaagcaacgaggatccatgtagcaagaataatctttgctacatttgggagcttatggcttcggctcttaatgatatggtttctcagggaatgataaaggaagagcaagtagacagttttaacatcccacagtacactccatcaccatctgaagtggaattggaagttcttaatgaaggatccttttctatcaatcgtctagaagtgtctgaaatgaaccgggacactcttgactttgaacctgaaaggtttgaatcaattggtgatgatgtggcgcagtggatgagggctttggcagaacctatgctggttagtcactttggtgaagacatcattgaagaggttttcacccgctacaaacaaatcttggctcatcgtttgtccaaggagaaaactcagttaatcagtgtcactttattattgactagaaagacatga

SEQ ID NO: 6372 - DNA, 1331 bp, Phaseolus vulgaris
gtaccaaatatcaatcacttaaagtcatgataggcacaacacatgatattttatgtgatgaaatgttaatgacagagtttgcacatctatatatacaggtatggtatgaacttgatcagaagcatagaagcacttagttaaggagaatatcccaaatcgagataaagagagatataaaagaaaacaatggaagtagctcaggtactgtgcatgaacggtggcgttggagacgctagctatgcaaacaactctcttgttcagctaaaggggatttgtttgacaaagtcaataagagaggaagccataactagcctctattgcagtgcactccccagaagtttggcagttgcagatttgggttgctcttctggaccaaatactttgtttgttgtgtctgaactcatcgagactgtggagaagctttgccaacagctgaaccataaatctccagaatacaaggtttttctaaatgatctctctgggaatgacttcaacaacatctttaagtccattgacagctttaaagagaaattgcaaaatgaaatggaaagtggtccatgctacttctctggggttcccggatctttctatggcagggttttcccaagtcaaagtttgcattttgtccactcctcttacagccttcattggctgtctaaggttcctgagggtgtagacaacaagggaaatatctatataggtagaacaagcccaacaaatgttgtgagagcttactatgaccaatttcaaagagatttctgtctttttctcaagtgtcgagcagaggaattagttgaaggaggtcgtatggttctgacatttttggggagaagcaacgaggatccatgtagcaagaataatctttgctacatttgggagcttatggcttcggctcttaatgatatggtttctcagggaatgataaaggaagagcaagtagacagttttaacatcccacagtacactccatcaccatctgaagtggaattggaagttcttaatgaaggatccttttctatcaatcgtctagaagtgtctgaaatgaaccgggacactcttgactttgaacctgaaaggtttgaatcaattggtgatgatgtggcgcagtggatgagggctttggcagaacctatgctggttagtcactttggtgaagacatcattgaagaggttttcacccgctacaaacaaatcttggctcatcgtttgtccaaggagaaaactcagttaatcagtgtcactttattattgactagaaagacatgaacaagaactttgcacctgaggagaaaactgagttcataaatttaaagaataagcaagaagtttca

SEQ ID NO: 6373 - DNA, 1343 bp, Glycine max
gtacgtagagataaaattatagaaacaagaatgaaggtagcacatgtgctacacatgaacggtggcgttggagacgcaagctatgcaaacaactcccttgttcagcaaaaggtgatttgtttgacaaagcccataagagaggaagccataacaagcctctattgcaacaccgtccccagaagcttggcggttgcagatttgggttgctcttctggaccaaacactttgtttgttgtgtctgaattcatcaaaattgtggataaactttgccgagagctgaaccacgaatctccagaatacaaggtctttctgaatgatctccctggcaatgacttcaacagcatcttcaagtcccttgacagcttcaaagagaagttgcgtgatgaaatggaaagtaggattggtccatgctacttctatggggttcctggttctttctatggcagggttttcccaaatcaaagtcttcattttgtccattcctcttatagccttcaatggctatctaaggttcctgagggtgtagacaacaacaggggcaatgtttacattggcagtacaagcccgacaaatgttgcgagagcttactacgagcaatttcaaagagatttctctctttttctcaagtgtcgtgcagaggaattagttaaaggaggtcgtatggttctaacatttttgggaagaagaagcgatgatccctctagcaaagatggttgctacatttgggagcttatggctactgctcttaatgatatggtcttgcagggaatcataaaagaagagcaattagatacttttaacattcctcaatacactccatctccatctgaagtgaaattggaagttcttaaagaaggatcatttgccatcaatcgtctagaggtgtctgaagtgaattgggatgcttttgatgactggaacgctcttgaatttgaatctgaaagggctgattcacttagtgatggcggatacaatgtggcacagtgcatgagggctgtggcagaaccaatgcttgttagccactttggtgaagctatcattgaagaggtttttagccgctaccaacaaatcttggctgatcgtatgtctaaggagaaaactaagttcaccaatgtcaccatattattgactaaaaaggcataagaagtttgcatctattaatggtttctcaaattggattgttatggtaatgtggttggtgtgagtgtctgcatgtttgtttgttttttcttctagcaatgaactagcaaaatgttaagttggagaaaaataaaactagtatgatgttgtaccttttgtagtaacttttatgtaataaaattatttgtgtgagattatgataa

SEQ ID NO: 6374 - DNA, 1159 bp, Phaseolus vulgaris
aaacaatggaagtggctcaggttctgtgcatgaacggtggcgttggagacgcaagctatgcaaaaaactctcttgttcagctaaaggggatttgtttgacaaagtcaataagagaggaagccataactagcctctattgcagtgcactccccagaagtttggcaattgcagatttgggttgctcttctggaccaaatactttgtttgttgtgtctgaactcatcgagactgtggagaagctttgccgacagctgaaccataaatctccagaatacaaggtttttctaaatgatctccctgggaatgacttcaacaacatctttaagtccattgacagctttaaagagaaattgcaaaatgaaatggaaagtggtccatgctacttctctggggttcccggatctttctatggcagggttttcccaagtcaaagtttgcattttgtccactcctcttacagtcttcattggctatctaaggttcctgagggtgtagacaacaagggaaatatctatatatgtagaacaagcccatcaaatgttgtgagagcttactatgaccaatttcgaagagatttctgtctttttctcaagtgtcgagcagaggaagtagttgaaggaggtcgtatggttctgacatttttggggagaagcaacgaggatccatgtagcaagaataacgtttgctacatttgggagcttatggcttcggctcttaatgatatggtttctcagggaatgataaaggaagagcaagtagatagttttaacatcccacaatacactccatcaccatctgaagtggaattggaagttcttaaagaaggatccttttctatcaatctgtctgaattgaactgggacactcttgactttgaacctgaaaggtttgaatcaattggtgatgatgtggcgcagtggatgagggctttggcagaacctatgctggttagtcactttggtgaagacatcattgaagaggttttcacccgctacaaacaaatcttggctcatcgtttgtccaaggagaaaactcagctcatcagtgtcactttattattgactagaaaaacatgaacaagaactttgcatctgaggagaaaactgagttcataaatttaaagaataagcaagaagtttcactacaaaaatcattaaat

SEQ ID NO: 6375 - DNA, 1364 bp, Phaseolus vulgaris
accaaatatcaatcacttaaagtcatagccacaacacatgatattttatgttatgaaaagacagagtttgctcatctatatatacaggtatggtatgaacttgatcagaagcatagaagcacttagttaaggagaatatcccaaatcgagataaagagagatataaaagaaaacaatggaagtggctcaggttctgtgcatgaacggtggcgttggagacgcaagctatgcaaaaaactctcttgttcagctaaaggggatttgtttgacaaagtcaataagagaggaagccataactagcctctattgcagtgcactccccagaagtttggcaattgcagatttgggttgctcttctggaccaaatactttgtttgttgtgtctgaactcatcgagactgtggagaagctttgccgacagctgaaccataaatctccagaatacaaggtttttctaaatgatctccctgggaatgacttcaacaacatctttaagtccattgacagctttaaagagaaattgcaaaatgaaatggaaagtggtccatgctacttctctggggttcccggatctttctatggcagggttttcccaagtcaaagtttgcattttgtccactcctcttacagtcttcattggctatctaaggttcctgagggtgtagacaacaagggaaatatctatatatgtagaacaagcccatcaaatgttgtgagagcttactatgaccaatttcgaagagatttctgtctttttctcaagtgtcgagcagaggaagtagttgaaggaggtcgtatggttctgacatttttggggagaagcaacgaggatccatgtagcaagaataacgtttgctacatttgggagcttatggcttcggctcttaatgatatggtttctcagggaatgataaaggaagagcaagtagatagttttaacatcccacaatacactccatcaccatctgaagtggaattggaagttcttaaagaaggatccttttctatcaatctgtctgaattgaactgggacactcttgactttgaacctgaaaggtttgaatcaattggtgatgatgtggcgcagtggatgagggctttggcagaacctatgctggttagtcactttggtgaagacatcattgaagaggttttcacccgctacaaacaaatcttggctcatcgtttgtccaaggagaaaactcagctcatcagtgtcactttattattgactagaaaaacatgaacaagaactttgcatctgaggagaaaactgagttcataaatttaaagaataagcaagaagtttcactacaaaaatcattaaataaaaatcaattataaagacaaaaaataattagttg

SEQ ID NO: 6376 - DNA, 1389 bp, Glycine max
ggaatagaagcacaaaagtaaaagaacatagaacgagtaagtacgtagagataaaattatagaaacaagaatgaaggtagcacatgtgctacacatgaacggtggcgttggacacgcaagctatgcaaacaactcccttgttcagcaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttgccgggagctaaaccataaatctccagaatacaaggtctttctgaatgatcttcctgggaatgacttcaacaacatcttcaagtcccttgatagcttcaaagagaagttgcgtgatgaaatggaaagtaggattggtccatgctacttctatggggttcctggttctttctatggcagggttttcccaaatcaaagtcttcattttgtccattcctcttatagccttcaatggctatctaaggttcctgagggtgtagacaacaacaggggcaatgtttacattggcagtacaagcccgacaaatgttgcgagagcttactacgagcaatttcaaagagatttctctctttttctcaagtgtcgtgcagaggaattagttaaaggaggttgtatggttctaacatttttgggaagaagaagcgatgatccctctagcaaagatggtggctacatttgggagcttatggctactgctcttaatgatatggtcttgcagggaatcataaaagaagagcaattagatacttttaacattcctcaatacactccatctccatctgaagtgaaattggaagttcttaaagaaggttcatttgccatcaatcgtctagaagtgtctgaagtgaattgggatgcttttgatgactggaacgctcttgaatttgaatctgaaagggctgattcacttagtgatggcggatacaatgtggcacagtgcatgagggctgtggcagaaccaatgcttgttagccactttggtgaagctatcattgaagaggtttttagccgctaccaacaaattttggctgatcgtatgtctaaggagaaaactaagttcaccaatgtcaccatattattgactaaaaaggcataagaagtttgcatctattaatggtttctcaaattggattgttatggtaatgtggttggtgtgactgtttgcttgtttgtttgttttctagcaatgaactagcaaaatgttaagttggagaaaaaaaaaactagtatgatgttgtaccttttgtagtaactattatgtaataaaattatttgtgtgagattatgataattggtattcgg

SEQ ID NO: 6377 - DNA, 1466 bp, Cajanus cajan
atagaagcaaaaattaaagcaaagagcaaaacgagtgaaagagagaatagaaagaagaaaaaaaagaatggaagtagcacaggtactgcacatgaacggaggcgttggagacgcaagctatgcaaacaactcctttgttcagcaaaaggtgctttgtttgacaaagcccataagagaggaagccataacaagcctctattgcaacacactccctagaagtttgggaattgcagatttaggttgctcttctggaccaaacactttgtttgtggtttcagaatgtatcaagactgtggagaagctttgccaacagctgaaccataaatctcccgaatacaaggtctttctcaacgatcttcctgggaatgacttcaacaacatatttaagtctcttgacagcttcaaagagaaattgtatcatgaaatggaaagtagggttggtccatgctacttctctggggttcccggttctttctatggcagggttttccctaatcgaagtcttcattttgttcattcctcttacagccttcaatggctatctaaggttcctgagggtgtagataacaacaagggcaatatttacataggcagtacaagcccatcaaatgttgtgagagcatactacgaacaatttcaaacagatttctctcattttctgaagtgtcgagcagaagaacttgttgaaggaggtcgtatggttctcacatttttgggaagaagaagcgacgatccatctagtaaggatggttgctacatttgggagcttatggctaaggctcttaatgatatggtcttggagggtatcataaaggaagaacaattggatacttttaacatcccgcagtacactccatccccatctgaagtgaaattggaagttttaaaagaaggatcattcgccttaagtcgtctagaagtgtcagaagtgaattggaactggaattccattgatgattggaacagtactcttgactttgaatttgataggtctgatgaatcacttggtaatggagggtacaatgtggcacagtgcatgagggctgtggcagaacctatgctgattagtcactttggtgaagctattattgaagaggtttttagccgctaccaaaaaatattgaatgatcgtatatccaaggagaaaactgagttcatcaatgttaccgtattattgactagaaaagcataaccaagaagtttgcatctatggtttttcataactattgtggtagtattaatgggtattatttgtttgcttgcttttctatttccctagcaattagctagcaaaatgttatgatgaagaaaaactaaaaactaggaatattgtgttgtaccgttggtataatagtttttttcttttatgtatatatatgtatgcatttttatatgtgtacgtgtatattctcgattgtgtaataaaattatttgagagattattataattaatctattatatttca

SEQ ID NO: 6378 - DNA, 1115 bp, Glycine max
atgaaggtagcacaggtgctgcacatgaacggtggcgttggacacgcaagctatggaaacaactcccttgtgcaggaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttaccgggagctaaaccataaatctccagaatacaaggtctttctgaatgatcttcctgggaatgacttcagcaacatcttcaagtcccttgatagcttcaaagagaagttgtgtgatgaaatggaaagtgggattggtccatgctacttctctggggttcctggttctttctatggcagggttttcccaaatcaaagtcttcattttgtccattcctcttatagccttcaatggctatctaaggttcctgagggtgtagacaacaacaggggcaatgtttacattggcagtacaagcccgacaaatgttgcgagagcttactatgagcaatttcaaagagatttctctctttttctcaaatgtcgtgcagaggaattagttaaaggaggtcgtatggttctaacatttttgggaagaagaagcgatgatccctctagcaaagatggtggctacatttgggagcttatggctactgctcttaatgatatggtcttgcagggaatcataaagaagagcagttagatacttttaacattcctctatacactccatctccatctgaagtaaaattggaagttcttaaagaaggttcatttgccatcaatcgtctagaggtgtctgaagtgaattggaatgcttttgatgactggaacgctcttgaatttgaatctgaaaggtctgatacacttagtgatggcggatacaatgtggcacagtgcatgagggctgtggtagaaccaatgcttgttagccactttgatgaagctatcattgaagaggtttttagccgttaccaacaaattttggctgatcgtatgtctaaggagaaaactaagttcaccaatgtcaccatattattgactctaaaagcataagca

SEQ ID NO: 6379 - DNA, 1165 bp, Glycine max
tagagataaaataatagaaacaagaatgaaggtagcacaggttctgcacatgaacggtggctttggagatgcaagctatgcaaacaactcccttcttcagcgaaaggtgatttgtttgacaaagcccataagagaggaagccataagaagcctctattgcaacaccgtccccagaagcttggcggttgcagatttgggttgctcttctggaccaaacactttgcttgttgtgtctgaattcatcaaaattgtggagaagctttgtcgggagctaaaccataaatctccagaatacaaggtctttctgaatgatcttcctggaaatgacttcaacaacatcttcaagtcccttgatagcttcaaagagaagttgtgtgatgaaatggaaagtaggattggtccatgctacttctatggggttcctggttctttctatggcagggttttcccaaatcaaagtcttcattttgtccattcctcttatagccttcactggctatctaaggttccggagggtgtagacaacaacaggggcaatgtttacattggcagtacaagcccgacaaatgttgcgagagcttactatgagcaatttcaaagagatttctctctttttctcaagtgtcgtgcagaggaattagttaaaggaggtcgtatggttctaacatttttgggaagaagaagcgatgatccctctagcaaagatggttgctacatttgggagcttatggctactgctcttaatgatatggtcttgcagggaatcataaaagaagagaaattagatacttttaacattcctctatacactccatctccatctgaagtgaaattggaagttcttaaagaaggatcatttgccatcaatcgtctagaggtgtctgaggtgagttggaatgctcatgatgagtggaacgctcttgaatttgaatctgaaaggtctgaatcacttagtgatggcggatacaatgtggcacagtgcatgagggctgtggcagaaccaatgcttgtcagccactttggtgaggctatcattgaagaggtttttagccgctaccaacaaatcttgactgatcgtatgtccaaggagcaaactaagttcatcaatgtcaccgtattattgactagaaaagcataagcaagaagtttgcatctatgtatgatt

SEQ ID NO: 6380 - DNA, 1330 bp, Glycine max
atgaaggtagcacaggtactgcacatgaacggcggcgttggacacgcaagctatgcaaacaactcccttcttcaggaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttgtcgggagctaaaccataaatctccagaatacaaggtctttctgaatgatcttcctggaaatgacttcaacaacatcttcaagtcccttgatagcttcaaagagaagttgtgtgatgaaatggaaagtaggattggtccatgctacttctatggggttcctggttctttctatggcagggttttcccaaatcaaagtcttcattttgtccattcctcttatagccttcactggctatctaaggttccggagggtgtagacaacaacaggggcaatgtttacattggcagtacaagcccgacaaatgttgcgagagcttactatgagcaatttcaaagagatttctctctttttctcaagtttcgtgcagaggaattagttaaaggaggtcgtatggttctaacatttttgggaagaagaagcgatgatccctctagcaaagatggtggctacatttgggagcttatggctactgctcttaatgatatggtcttgcagggaatcataaaagaagagaaattagatacttttaacattcctctatacactccatctccatctgaagtgaaattggaagttcttaaagaaggttcatttgccatcaatcgtctagaggtgtctgaagtgaattggaatgcttttgatgactggaacgctcttgaatttgaatctgaaaggtctgatacacttagtgatggcggatacaatgtggcacagtgcatgagggctgtggcagaaccaatgcttgtcagccactttggtgaggctatcattgaagaggtttttagccgctaccaacaaatcttgactgatcgtatgtccaaggagcaaactaagttcatcaatgtcaccgtattattgactagaaaagcataagcaagaagtttgcatctatatatggtttctcaaatggtattgctgtagtcatagtttaaaaatccggttctactagtcagctcggatcggtccaattgagatctgatgatataaccgggccgatttcgttattgaaccgatcatgcatttgatctggaatgacccggtcaaacccttccggttggtgtaaattcgacgatcctgtctcgtttttaaa

SEQ ID NO: 6381 - DNA, 1430 bp, Glycine max
atagaagcactaaagtaaaagaacatagaacgagtgaagtacgcgcgtagagataaaataatagaaacaagaatggaggtagcacaggtactgcacatgaacggtggcgttggagacgcaagctatgcaaacaactcccttgttcaggaaaaggtgatttgtttgacaaagcccataagagaggaagccataacaagcctctattgcaacaccgtccccagaagcttggcggttgcagatttgggttgctcttctggaccaaacactttgctttttgtgtctgaattcatcaaaattgtggagaagctttgccgggagctaaaccataaatctccagaatacaaggtctttctgaatgatcttcctgggaatgacttcaacaacatcttcaagtcccttgatagcttcaaagagaagttgtgtgatgaaatggaaagtgggattggtccatgctacttctctggggttcctggttctttctatggcagggttttcccaaatcaaagtcttcattttgtccattcgatggctatctaaggttcctgagggtgtagacaacaacaggggcaatgtttacattggcagtacaagcccgacaaatgttgcgagagcttactatgagcaatttcaaagagatttctctctttttctcaaatgtcgtgcagaggaattagttaaaggaggtcgtatggttctaacatttttgggaagaagaagcgatgatccctctagcaaagatggtggctacatttgggagcttatggctactgctcttaatgatatggtcttgcagggaatcataaaagaagagcagttagatacttttaacattcctctatacactccatctccttctgaagtgaaattggaagttcttaaagaaggttcatttgccagcaatcgtctagaggtgtctgaagtgaattggaatgcttttgatgactggaacgctcttgaatttgaatctgaaaggtctgatacacttagtgatggcggatacaatgtggcacagtgcatgagggctgtggcagaaccaatgcttgttagccactttggtgaagctatcattgaagaggtttttagccgctaccaacaaatcttggctgatcgtatgtccaaggagcaaactaagttcatcaatgtcaccgtattattgactagaaaagcataagcaagaagtttgcatctatatagggtttctcaaatgggattgttgtagtcatactttaaaaatccggctcgactagcgtggtcggattgagatttgatgacataacctgtccgattttattattggaccgattatgtttttggtctagaataacccggtccaacccgtccgatttggagtaaattcggcgatcccgtatgatatttccatttcacatgaaaaagaaaataaaaaaaatgttaaaaaaatttaagactta

SEQ ID NO: 6382 - DNA, 1368 bp, Glycine max
tagaacaagaatgaaggtagcacaggtactgcacatgaacggtggcgttggaaacgcaagctatgcaaacaactcccttgttcaggaaaaggtgatttgtttgacaaagcccataagagaggaagccataacaagcctctattgcaacaccgtccccagaagcttggcggttgcagatttgggttgctcttctggaccaaacactttgctttttgtgtctgaattcatcaaaattgtggagaagctttgccgggagctaaaccataaatctccagaatacaaggtctttctgaatgatcttcctgggaatgacttcaacaacatcttcaagtcccttgatagcttcaaagagaagttgtgtgatgaaatggaaagtgggattggtccatgctacttctctggggttcctggttctttctatggcagggttttcccaaatcaaagtcttcattttgtccattcgatggctatctaaggttcctgagggtgtagacaacaacaggggcaatgtttacattggcagtacaagcccgacaaatgttgcgagagcttactatgagcaatttcaaagagatttctctctttttctcaaatgtcgtgcagaggaattagttaaaggaggtcgtatggttctaacatttttgggaagaagaagcgatgatccctctagcaaagatggtggctacatttgggagcttatggctactgctcttaatgatatggtcttgcagggaatcataaaagaagagcagttagatacttttaacattcctctatacactccatctccttctgaagtgaaattggaagttcttaaagaaggttcatttgccagcaatcgtctagaggtgtctgaagtgaattggaatgcttttgatgactggaacgctcttgaatttgaatctgaaaggtctgatacacttagtgatggcggatacaatgtggcacagtgcatgagggctgtggcagaaccaatgcttgttagccactttggtgaagctatcattgaagaggtttttagccgctaccaacaaatcttgactgatcgtatgtccaaggagcaaactaagttcatcaatgtcaccgtattattgactagaaaagcataagcaagaagtttgcatctatatagggtttctcaaatgggattgttgtagtcatactttaaaaatccggctcgactagcgtggtcggattgagatttgatgacataacctgtccgattttattattggaccgattatgtttttggtctagaataacccggtccaacccgtccgatttggagtaaattcggcgatcccgtatgatatttccatttcacatgaaaaagaaaataaaaaaaatgttaaaaaaatttaagactta

SEQ ID NO: 6383 - DNA, 1367 bp, Cajanus cajan
atagaagcaaaaattaaagcaaagagcaaaacgagtgaaagagagaatagaaagaagaaaaaaaagaatggaagtagcacaggtactgcacatgaacggaggcgttggagacgcaagctatgcaaacaactcctttgttcagcaaaaggtgctttgtttgacaaagcccataagagaggaagccataacaagcctctattgcaacacactccctagaagtttgggaattgcagatttaggttgctcttctggaccaaacactttgtttgtggtttcagaatgtatcaagactgtggagaagctttgccaacagctgaaccataaatctcccgaatacaaggtctttctcaacgatcttcctgggaatgacttcaacaacatatttaagtctcttgacagcttcaaagagaaattgtatcatgaaatggaaagtagggttggtccatgctacttctctggggttcccggttctttctatggcagggttttccctaatcgaagtcttcattttgttcattcctcttacagccttcaatggctatctaaggttcctgagggtgtagataacaacaagggcaatatttacataagcagtacaagcccgtcaaatgttgtgagagcatactacgaacaatttcaaacagatttctcgcattttctgaagtgtcgagcagaagaacttgttgaaggaggtcgtatggttctcacaattttgggaagaagaagcgacgatccatctagtaaggatggttgctacatttgggagcttatggctaaggctcttaatgatatggtcttggagggaatcataaaggaagaacaattggatacttttaacatccctcaataccatccatccccatctgaagtgaaattagaagtttttaaagaaggatctttcgtcatgaatcgtctagaggtatcagaagtgaactggaaccggaatgccattgatgattggaacagtactcgtgactttgaatttgaaaggccttatgaatcgcttggtgatggagggtacaatatggcacgatgcatgagggctgtgacagaaccaatgctgattagccactttggagaagctatcattgcagagctttttagccgataccgacaaatcttgactgattgtatgtccaaggagaaaactgagtttatcaatgttaccatattattgactcgaaatgcataagcaagaagtttgcatctatggtatttcagaaagattgtcgtaataatttgatataattgtttgtttgcttttttattttctctagtaattaattagaaaaatgttaagatgaaggaaaaaaaaaagctgagagtattgtgtattaccttctttatattagctttttcttatatgt

SEQ ID NO: 6384 - DNA, 1131 bp, Lotus japonicus
aatggaagttacacaggttctacacatgaatggaggagttggagaagcaagctatgcaaacaactctttagttcagcaaaaggtgatttctttaacaaagcctataagagaagaagccataaccagcctttattgcaccacattcccaagaagccttgcaattgcagacatgggttgttcttcaggaccaaacactctgtttgtggtttcagaaattatcaaggttgtggaaaagctttgccgagagctgaaccgtaaatctccagagtacaaggtgtttttgaatgaccttcctggaaatgatttcaacaacatctttaagtcccttgacagcttcaaagagaaactaagtgatgaaatggaatcggacataatgggtccatgctacttctatggggttcctggttctttctatggcagagtttttcctaatcaaagtctaaattttgtccattcttcttacagcctccaatggctatctaaggttcctgaaggagcagagaacaataaagacaatatatacatatcgagaacaagcccctcaaatgttgtaaaggcttactacgagcagtttcaaagagatttctctgtttttctcaagtgtcgtgcagaggaactagttgaagggggtcgcatggttctaacatttttgggaagaaagagtgacaatccatgtagcaaggagtgttgctacatttgggaacttatggctaaagctctcaatgatatggtcatgcaggggattataaaggaagaccaagtgactactttcaacatccctcaatatactccatctccattagaagtgaaatgggaagttcttaaagaaggatcattcgccattaatcgcttggaggtgtcagaagtgaattggaacgctatggatgaatgcaatgtttttgaatttgagtctgaaatgaatgaatcactgagtgatagtggatacaatgttgctcagtgcatgagggcagtggctgaacctttgctggttaatcactttggtgaagctatcattgaaaaggtttttagtcgctaccaagaaatcttggctgataggatgtctaaggagaaaactaaatttgtcaatgttaccatattgttgactaggaaaggatgaggagaagaagcttg

SEQ ID NO: 6385 - DNA, 1182 bp, Cajanus cajan
ggaacgcacagaagcacaaattaacgtgaaagagattacagaaaaagcaatagaatggaagtagaaaaggtactgcacatgaatgggggcattggagacgcaagctatgcaaatagctcctttgttcagcaaaaggtgctttgtttgacaaagtccataagagaggaagccataacaagcctctattgcaacacactccctagaagtttggaaattgcagatttaggttgctcttctggaccaaacactttgtttgtggtttcagaattcatcaagactgtggagaagctttgccaaaagctgaaccataaatctcccgaatacaaggtctttctcaacgatcttcctgggaatgacttcaacaacatatttaagtctcttgacagcttcaaagagaaattgtatcatgaaatggaaagtagggttggtccatgctacttctctggggttcccggttctttctatggcagggttttccctaatcgaagtcttcattttgttcattcctcttacagccttcaatggctatctaaggttcctgagggtgtagataacaacaagggcaatatttacataagcagtacaagcccgtcaaatgttgtgagagcatactacgaacaatttcaaacagatttctcgcattttctgaagtgtcgagcagaagaacttgttgaaggaggtcgtatggttctcacaatgttgggaagaagaagctacgatccatccagtaaggatggttgctacatttgggagcttatggctaaggctcttaatgatatggtcttggagggaatcataaaggaagaacaattggatacttttaacatccctcaataccatccatccccatctgaagtgaaattagaagtttttaaagaaggatctttcgtcatgaatcgtctagaggtatcagaagtgaactggaaccggaatgccattgatgattggaacagtactcgtgactttgaatttgaaaggccttatgaatcgcttggtgatggagggtacaatatggcacgatgcatgagggctgtgacagaaccaatgctgattagccactttggagaagctatcattgcagagctttttagccgataccgacaaatcttgactgattgtatgtccaaggagaaaactgagtttatcaatgttaccatattattgactcgaaatgcataagca

SEQ ID NO: 6386 - DNA, 1409 bp, Lotus japonicus
aatggaagttacacaggttctacacatgaatggaggcgttggagaagcaagttatgcaaacaactccttagttcagcaaaaggtgatttctttgacaaagcctataagagaagaagctataaccagcctttatcgtagcacattcccaagaagccttgcaattgcagacatgggttgttcttcaggaccaaacactctgtttgtggtttcagaaactatcaaggttgtggaaaagctttgccaagagctgaaccttaaatctccggaatacaaggtgtttttgaatgatcttcctggaaatgatttcaacaacatctttaagtcccttgacaacttcaaagagaaactaagtgatgaagtggaatctaggataattggtccatgctacttctatggggttcctggttctttctatggcagggtttttcctaatcaaagtctgcattttgtccattcctcttacagccttcattggctatctaaggttcctgaggcagtagacaacaataagggcaatatttacatatccagcacaagcccctcaaatgttgtaaaggcttactacaagcagttccaaggagatttctctgtttttctcaagtgccgtgccgaggaactagttgaagggggtcatatggtcctaacattcttgggaagaaggagtgacaatccatgtagcaaagagtgttgctacatttgggaacttttggctacagctcttaatgatatggtcatgcagggaattataaaggaagaccaagtgactactttcaacatccctctttatactccatcttcattagaagtgaaattggaagttcttaaagaaggatcattcgccatcaatcgcttggaggtgtcagaagtgaattggaacgctatggatgaacggaatgcctttgaatttgaatctgaaatgaatgaatcactgagtgatgctggatacaatgttgctcagtctgtgagggctgtggctgaacctatgcttgttaatcactttggtgaagctatcattgaaaatgtttttagtcgctaccaagaaatcttggatgataggatgtctaaggagaaaactaaatttgtcaatgttactatattgttgacaaggaaaggatgaggagaagaagcctgcgcaatctatgattcatatttgtggttttgtcataaagattttcttaattgttgtgttggtttgtttggtttaactttagattgtaatcaggcaggaaatcttatgctaaggaaaaataaagacaaaactaggagtattttgttgggtcatggctagtgatatttgttttcaattgtgtaatgaaattatttaagtgtggattatatatgataattgttctattacttcataggtttgggtaatggaatggaaatatgaaatcataagggtagaaaaa

SEQ ID NO: 6387 - DNA, 1293 bp, Glycine max
aacaaattaagctgagaaatgaaaggggagagaggaaacaagtatgtcactgttccccaattttctgtgcttagagtgaagcatttcgaaacagcaagacacaatgccttcggctcaagatccattctacgttgtcaagcaagaaattcaagaatctattgataagctacaatctacgtttcaccaatgggaaaagactgctgatgctggcgagcgatccaatctatcaaaggaagttcttggtagttgtgaaagcattgaatggcaggtggatgaattggacaaagcaatttctgtagcctctagagatccttcttggtatggcattgatgaagtggaggttgaaaaccggaggaagtggaccagtgatgctcgcacccaggtgagcacagcaaagaaagcagtgcaagctggaaagggcttaaacaatgctagtctaaatgggatgcacaaggaattaatgaggcttcctagttctcatcaaactacatctaaccaatatgctgcccaggataatgatgatttcatagagtcagaatcggacaggcagatgcttcttataaagagacaagatgaggagttggatgagcttagtttaagtgtacaaagaataggaggtgttggacttactatacatgaagagctccttgcacaggaaaagattattgatgaactgggtaatgagatggacagtacatctaatcgcctagattttgtccaaaaaaaagtggcaatggtcatgaagaaggctagtgcaaagggccagatcatgatgatattgggtttgctggcgctgttcattttcctctttatcttggttttcttcacctagtcattgagacaaccttgtcaatgctctgtttgtacatggaaaaagatctaaagcttctgtgaagatacaagattattgggagattcaatatgtttaaaaaatgaatggaagcctctttggtttgtcaaaggcagtagaaaattttgattatgatgaaaagagaagcgatgtacttggaaacttggaaatatcacaagaggattttgtttctgaacaagatggattacaaatgtgatttaaattagttgtattcgttttaaagatgatttaaccctgcatataatgtttgatgtggtttttttttttttataacgacagcgtggtgttttgaatttatactttcatgactgtaccaaaatagcttatgatctatcttcatacaaatcaacccattatttacctgctgactcctggtggcatgatgatcttgtcagttgctgttttgtgttggcacactagaa

SEQ ID NO: 6388 - DNA, 1369 bp, Cajanus cajan
atgaataaaaaagataattgtatttttattttccgagatatatattttgtttagaagaagaaattaagggaagaaatgaaagggaagagagaaagcagagtgtgtcactgttccccaatttagtgtgaagcttttggaaacaaacaacgatgccttctgctcaagatccattctacgttgtcaaggaggagattcaagaatctattgataagttgcaatctgcttttcaccaatgggaaaacactgctgaggctggcgagcgatcacgtctttcgaaagaagttgttgctagttgtgaaagcattgaatggcaggtggatgaattggacaaagcaatttctgtagcctctcgagatccttcttggtatggcattgatgaagtggagcttgaaagccggaggaggtggaccagtgatgctcgcacccaggtgagcacaacaaagaaagcagcggcagctgggggctcaaatataacaaacaatgctactctaaatgggatgcacagggaattaatgaggcttcctaattcttaccaagctgcatctgaccaatatgctgcccgggataatgatgattttatagaatcagaatcagataggcagatgcttcttatgaagaaacaagatgaggagttggacgagcttagtttaagtgtgcaaagaattggaggtgttggacttactattcatgaagagctcctatcacaggaaaagattattgatgaactgggtaatgagatggaaagtacatctaatcgtctagatttcgtccaaaaaaaagtggcaatggtcatgaagaaagctagcgcaaagggccagatcatgatgatattgggtttgctggcgctgttcattttcctctttatcttggtattcttcacctagtcgttgagaccaacgcaccccgtcaatgttctgcttgtacatgaaaaaagactaaagcttctgtgaagatacaagattaatgggatgacattcaatgactaaaagtcaaaggaaggcctagttggtttgtcgaaggcggtagaaaattttgattatgatgaaaagcaaactgttgtacttgaaaatataacgagaggattttgtttctgaacaagatggatcacaaatgtgatttaaattagttgtgctcgtttttaagatgatttttcctgcatatagtgttttgtgtcatctttttcattttataacgacagcgtggtattttaaattcttactttaaggactgtaatattcaaaaacaacccattatttagcatgtgatctatgcacaaaacaaccccttatttacctgctcactcctagctagtggcatgatgatcttgccagatgtcagatgctgatttggacaagttggcacactggaa

SEQ ID NO: 6389 - DNA, 1260 bp, Glycine max
aaaaacaagctgagaaatgaaagtgaagagaggaagcagagtgtgtgactgttccccaatttcctgtgcttagagtgaagaagcatttagaaaaagcaagacacgatgccttcggctcaagatccattctacgttgtcaagcaagaaattcaagaatctattgataagctaaaatccacttttcaccaatgggaaaacactgctgatgttggcgagcgatccagtctatcaaaggaagttcttgctagttgtgaaagcattgcatggcaggtggatgaattggacaaagcaatttctgtggctgctagagatccttcttggtatggcattgatgaagtggaggttgaaaaccggaggaagtggaccagtgatgctcgcacccaggtgagcaaagcaaagagaacagtggaagctggaaagggctcaaacaatgctagtctaagtgggatgcacagggaattaatgaggcttcctagttctcatcaaactacatctaaccaatatgctgcccaggataatgatgatttcatagagtcagaatcagacaggcagatgcttcttattaagagacaagatgaggagttggatgagcttagtttaagtgtacaaagaattggaggtgttggacttactatacatgaagagctccttgcgcaggaaaagattattgatgaacttggcaatgagatggacggtacatctaatcgcctagattttgtccagaaaaaagtggcaatggtcatgaagaaggctagcgcaaagggccagatcatgatgatattgggtttgttggcgatgtttattttcctcttcatcttggtattcttcacctagtcagtgagaccgatgaaccctggcaatgctttgtttgtacatgaaaaaagatttaaagcttctgtgaagatacaagattaatgagacattaaatatgcctaaaactcaaatatggaagcgtctttgatttgtggatgatttgtggaaggcagtagaaaattttgattatgatgaaaaaggaagcaacgtacttgaaaatttcacaagaggattttgtttctgaacaagacggctcgcaaacgtgatttaaattagtagtattcgtttttaagatgattttctcctgcatgtattgcttgatgccgtttttttttctttttgtaacgacaacgtggtgtttcgaatttatatacttttgactttgagtgtaccaaaatagcgtatgatctgtcttatacaaatcaaatcaaccaattatttacctgc

SEQ ID NO: 6390 - DNA, 1272 bp, Glycine max
aaaaacaagctgagaaatgaaagtgaagagaggaagcagagtgtgtgactgttccccaatttcctgtgcttagagtgaagaagcatttagaaaaagcaagtcacgatgccttcggctcaagatccattctacgttgtcaagcaagaaattcaagaatctattgataagctaaaatccacttttcaccaatgggaaaacactgctgatgttggcgagcgatccagtctatcaaaggaagttcttgctagttgtgaaagcattgcatggcaggtggatgaattggacaaagcaatttctgtggctgctagagatccttcttggtatggcattgatgaagtggaggttgaaaaccggaggaagtggaccagtgatgctcgcacccaggtgaacaaagcaaagagaacagtggaagctggaaagggctcaaacaatgctagtctaagtgggatgcacagggaattaatgaggcttcctagttctcatcaaactacatctaaccaatatgctgcccaggataatgatgatttcatagagtcagaatcagacaggcagatgcttcttattaagagacaagatgaggagttggatgagcttagtttaagtgtacaaagaattggaggtgttggacttactatacatgaagagctccttgcgcaggaaaagattattgatgaacttggcaatgagatggacggtacatctaatcgcctagattttgtccagaaaaaagtggcaatggtcatgaagaaggctagcgcaaagggccagatcatgatgatattgggtttgttggcgatgtttattttcctcttcatcttggtattcttcacctagtcagtgagaccgatgaaccctggcaatgctttgtttgtacatgaaaaaagatttaaagcttctgtgaagatacaagattaatgagacattaaatatgcctaaaactcaaatatggaagcgtctttgatttgtggatgatttgtggaaggcagtagaaaattttgattatgatgaaaaaggaagcaacgtacttgaaaatttcacaagaggattttgtttctgaacaagacggctcgcaaacgtgatttaaattagtagtattcgtttttaagatgattttctcctgcatgtattgcttgatgccgtttttttttctttttgtaacgacaacgtggtgtttcgaatttatatacttttgactttgagtgtaccaaaatagcgtatgatctgtcttatacaaatcaaatcaaccaattatttacctgcttaagtttacag

SEQ ID NO: 6391 - DNA, 1130 bp, Arachis hypogaea
actctttcgccatttatcttctctgtgcagagagagagagagagagagagagagagagttccgacaacaataacaataagataatatgccctcagctcaagatccattctacgttgtcaaagaggagattcaagattccattgataagttgcaatcttcttatcaccaatgggaaagcacttctgacggtggggatcgaacaaatctctcaaaggaagttcttactgcttgtgagagcattgaatggcaggtggatgaattggacaaagcgatttctgttgcatctagagatccttcttggtatggcattgatgaggtcgagattgaaaaccggagaaggtggaccagcagtgctcgcactcaggtgcgcacaatgaagaattcagtggaagccggaaaggcctcgaatgtgacgaaccatgcaagtgtgaatgggatgcgcagggaattgatgaggcttcctaattcacatcaagctgatacatccaaccagtatactgccaaccataatgatgatttcattgaatcagaatctgacagacagatgcttcttatgaaaaaacaggatgaggagttggatgagcttagtttaagtgtacaaagaattggaggtgttggacttacgatacatgaagaactccttgcacaggaaaagattatagatgaactgggtaatgagatggacagtacatccaatcgtctagatttcgtacaaaaaaaagtggcaatggtgatgaagaaagctagtgcaaagggtcagatcatgatgatattgggtttgctggcactgtttattttcctattcatcttggtgttcttcacctaaactcagttgagattggcccttgtttgtacatgaagagagagatatctcagtttttgcgagaagatacaagattattgggacatgctttagtgtctattaatcaaatggaagccattttggtatttcaaggcagtagaattttatgattgtgatgataaagggacaatgtaaggatttagattctctgaacatttggattacaaatatgattggatttagggttattcggattaaattgttctcttagatgtaatgtaatgtgatgtcaacttatttttaacatccttttagaatgagagcatgg

SEQ ID NO: 6392 - DNA, 1135 bp, Arachis hypogaea
aagcagtggtatcaacgcagagtggccattacggccgggggagagagagagagagaaataacaataagataatatgccctcagctcaagatccattctacgttgtcaaagaggagattcaagattccattgataagttgcaatcttcttatcaccaatgggaaagcacttctgacggtggggatcgaacaaatctctcaaaggaagttcttactgcttgtgagagcattgaatggcaggtggatgaattggacaaagcgatttctgttgcatctagagatccttcttggtatggcattgatgaggtcgagattgaaaaccggagaaggtggaccagcagtgctcgcactcaggtgcgcacaatgaagaattcagtggaagccggaaaggcctcgaatgtgacgaaccatgcaagtgtgaatgggatgcgcagggaattgatgaggcttcctaattcacatcaagctgatacatccaaccagtatactgccaaccataatgatgatttcattgaatcagaatctgacagacagatgcttcttatgaaaaaacaggatgaggagttggatgagcttagtttaagtgtacaaagaattggaggtgttggacttacgatacatgaagaactccttgcacaggaaaagattatagatgaactgggtaatgagatggacagtacatccaatcgtctagatttcgtacaaaaaaaagtggcaatggtgatgaagaaagctagtgcaaagggtcagatcatgatgatattgggtttgctggcactgtttattttcctattcatcttggtgttcttcacctaaactcagttgagattggcccttgtttgtacatgaagagagagatatctcagtttttgcgagaagatacaagattgttgggacatgctttagtgtctattaatcaaatggaagccattttggtatttcaaggcagtagaattttatgattgtgatgataaagggacaatgtaaggatttagattctctgaacatttggattacaaatatgattggatttagggttattcggattaaattgttctttagatgtaatgtaatgtgatgtcaacttatttttaacatccttttagaatgagagcatggagttttaaaccaaaaaaa

SEQ ID NO: 6393 - DNA, 1182 bp, Lupinus angustifolius
aaaataatgagaaatttattgaataaacatcaatataaaagttgagaaatgaaatagaagagagaaaacagagtgtaacactgtttttccaattttctctatctctgtgtgtaacactccataagatgccctcagctcaagatccattctacgttgtcaaggaagagattcaagattctattgataagttgcaatctacttttcaccaatgggaaaacactcctgatgctggggagcgatcacatctttcaaaggaagttcttaccggttgtgaaagtattgaatggcaggtggatgaattggacaaagcaattgctgtagcatctagagatccttcttggtatggcattgatgaattggagattgaaaaccgtaagaggtggaccagcagtgctcgtacccaggtgcggacagtgaagaaagctgctgaagctgaaaacggtccaaataaaacaaaccatgctagtgtcaatgggatgcacagggaattaatgaggcatccaaattctcatcaatctgatatatccaacaattatgctgcccaagatagtgatgatttcatagaatcagaatcagatagacagatgcttctaataaagaggcaggatgaggagttggatgagcttactttgagtgtacaaagaattggaggcgttggacttacaatacacgaagagctcctagcgcaggaaaagattatagatgaacttggttccgagatggacagtacatctaatcgtctagacttcgtccaaaaaaaagtgggaatgatcatgaagaaggctagtgcaaagggccagatcatgatgatattgggtttgctggctttgttcattttcctctttatcttggtattcttcacttagtgagaagatcttcacactgcactctttcctacatgaaaagagatctcagtttttgtgaagaagatacaagattaatggggcatggatatgccttatattaactaaatggaagccctttttggtctattgaaggttgctcagaattctgatcctgatgaaaaaggaagcaaaatatactgtaggaggattttgattctgaacaaattggactataaatatgatctgaactagtagctatttttttgaacttgtggttatttgttttattatgtctttctgactattattgaataataaggtaaactggtttacacta

SEQ ID NO: 6394 - DNA, 1162 bp, Lupinus angustifolius
agaacattagataatagaccgagtgttgttttctacttttctagcatctacttccttcctaatttcatctttctcgtcgctaacatgccctcagctcaggatccattctacgttgttaaggctgagattcaagaatctattgataagttgcaatcgacttttcgccaatgggaaaacgctctggatgctggggagcgagttcatttatcgaaggaggtccttgctggatgcgaaagcatagagtggcaggtggatgaattggacaaagcaattgctgtagcatctcaagatccttcttggtatggcattgatgaagtggagcttgaaagccggaggaggtggacaagcagtgcccggactcaggtaggcactgtgaagaaagctgtggaagctggaaagggctcaagcacagcaagccatgctagtgtaaatgcaatgcaccaagaactaatgaggctacctaattcacgtgaaactgatacatacaaccaatatgctgcccaagataatgatgatttcatacaatccgaatcagatagacagatgcttcttataaagagacaggatgaggagttggacgagcttagtttaagtgtgcaaagaattggaggagttggacttacaatacacgaagagctaattggacaggaaagaattatagatgagctgggctctgagatggacagtacatcaaatcgtctagattttgtccaaaaaaaagtagcaatggttatgaaaaaggctagtgcgaagggccagatcatgatgatattgggtttgttcgccttgttcattttcctctttatcttggtattcttcacctagtcattgagatggaactagtctttaccgttttgtacatgtaaagagatgtctggatatttttatggaatattaattggaaatggaagccttcttggtttctaaatggcagtagaaaattatgattctggactgtatgtagttaacggttcacaataggattttgaattttgattcttgaaaacatggatttacccttataagatattagtggtatttgttgcttaaccattttctgttgtttgtaatgtttgatttgatgtcgttatttgtttgctatgtaaatgttataaaattcagtgaaataagaagggagaacactgatggtctagaagttcat

SEQ ID NO: 6395 - DNA, 1288 bp, Cicer arietinum
atttgtttttacattccatactcttagtgcaagtaactgcttaagttgagaaaactacgaaaacgagtaaattacagaaaacacagggttgcttcctccattttttctccaatttcgtgtattcatcgttctaattcccaaaaagaattagagaagatgccctcagctcaagatccattttacgttgtcaaagaagagattcaagattctattgataggttgcaatctaattttcaccaatgggaaaacacatctgatactggggagcatttgcacctttcaaaggaagttattgctgcttgtggaagtattgagtggcaggtagatgaattggacaaagcaatttctgttgcatctagagatccttcttggtatggcattgatgatgtggagattgaaaaccggaggaggtggaccagcaatgctcgtacccaggtgcgcacagttaagaaaacggtggaatctggaaagggctccaatacaacaagtcatgcaagtataaatgggatgcacaaggaattaatgaggcttcctgattctcatcaaagtacatccaacaaatacaccgctggggataatgatgattttatagaatcagaatcagataggcagatgcttcttataaagaggcaggacgaggagttggatgagcttagtttaagtgtacaaagaattggaggtgttggacttacaatacatgaagaactccttgggcaggaaaagattttagatgaacttggcaacgagatggacagtacatccaatcgtctagatttcgttcaaaaaagagtggcaatggtgatgaagaaggcaagtgtgaagggccagatcatgatgatattgggtttgctagcactgttcattttcctttttatcttggtattcttcacctagatcatttctgaaaagggatccaagtttgagaagataaaagattaatggtacatgtctatgctcaaattgaaacctctttggtttattgaagacagtagagaattttgattgtgatgaaaagggtagcaatgtggttaaaagtatcataagagaggattttgatttgaacaagttgtttgatcacaaatatgatcttttaattagtattagtataatcgtttttaaaatgattttttcacttgcatgtaaatgtaatgtaatgcttgatggctataccataatatcttatgatctcatgcaaaaataaccttaataacccacctcagcacattatatattctgtcactcttgcggcatattttatgagtatactgatattttagtctttgaactg

SEQ ID NO: 6396 - DNA, 744 bp, Lotus japonicus
gatgccctctgctcaagatcctttctacgttgtcaaggaggaggttcaggattctattgataagttgcaaactacttttcaccaatgggaaaacacttctgatgctggtgagcgagagcgtctttcaaaggaagttctcgctggttgtgaaagtactgaatggcaggtggatgaattggacaaagcaatttctgtagcatcaagagatccttcttggtatggcattgatgaagtggagattgaaaatcggaggaggtggaccaccaatgctcgcacccaggtgcgcacaacaaagaaagcggtggaagctggaaagggctcaaatacaagtataaatgggatgcgcaaggaattgatgaggcttcctgattctcatcaaactacgtccaaccaatatgctgcacaagatagtgatgatttcatagactcggaatcagataggcagatgcttcttataaagaaacaggatgaggagttggatgagcttacgttaagtgtacagagaattggaggtgttggactcacgatacacgatgagctcgttgcgcaggaaaggattatagatgaactgggtaatgagatggacagcacaactaatcgtctagattttgtccaaaaaaaagtggcaatggtcatgaagaaggctagtgcaaagggtcagttcttgatgatattgggtttgctggctctgttcattttcctcttcatcttggtatttttcacctagtaattgagatgggccct

SEQ ID NO: 6397 - DNA, 1215 bp, Medicago truncatula
ttcttttcttttcacttgcttgctaactttcttctcaaccaaacaaagcttagtgttcgttccttcctccatttcttcatcaatttcgtgtctttaccattcaaatcccaattccagattctgaggaaaaaaatgccctcagctcaagatccattttacgttgtcaaagaagatattcaagattctattgataggttgcaatctaattttcaccaatgggagaacacttctgatactggtgagcatttgaacctttcaaaggaagttcttgctgcttgtggaagtattgagtggcaggtggatgaattggacaaagcaatttctgtagcatctagagatccttcttggtatggcattgatgaagtggagattgaaaaccggaggaggtggaccagcaatgctcgcacccaggtgcgcacaattaagagaacagtggaagctggaaagggatcaaatccaacaactcatgctagtataagtgggatgcacagggaattaatgaggcttccagattctcatcaaagtacgtctaagtctaaccaatatgcctctggggataatgatgatttcatagaatcagaatcagataggcaaatgcttcttataaagcagcaggacgaggagttagacgagcttagtttaagtgtacagagaatcggaggtgttggacttacaatacatgaagagctccttgggcaggaaaagattctagatgaactgggaaatgagatggacagtacatccaatcgtttagattttgtccaaaaaagagtggcaatggtgatgaagaaggccagtgcaaaggggcagatgatgatgatatgtggtttgctggccctgttcattttcctttttatcttggtattcttcacttagtcatttctgaatgcattggttgtaaatgcaaaaagggatccaagtttgagaagacaaaagattaatgggacatcctatgtcttggtcaaatggaaggctctttgaaggcagtaggaaattttgaatgtgatgaaaagggtagcaatgagcttaaaagtatcaaaagattaagttttgatcacaaatatgatttgaattagtaccagtattcgaatatataatgattttcttctgcatgttactgtaatgtactgtaatgcttgatgactataccataataatcttttatcatgctattcatcttctcactcttgatgatattcacatttatgatcctgc

SEQ ID NO: 6398 - DNA, 1185 bp, Medicago truncatula
caaaaaactcccatactttcttttcttttcacttgcttgctaactttcttctcaaccaaacaaagcttagtgttcgttccttcctccatttcttcatcaatttcgtgtctttaccattcaaatcccaattccagattctgaggaaaaaaatgccctcagctcaagatccattttacgttgtcaaagaagatattcaagattctattgataggttgcaatctaattttcaccaatgggagaacacttctgatactggtgagcatttgaacctttcaaaggaagttcttgctgcttgtggaagtattgagtggcaggtggatgaattggacaaagcaatttctgtagcatctagagatccttcttggtatggcattgatgaagtggagattgaaaaccggaggaggtggaccagcaatgctcgcacccaggtgcgcacaattaagagaacagtggaagctggaaagggatcaaatccaacaactcatgctagtataagtgggatgcacagggaattaatgaggcttccagattctcatcaaagtacgtctaagtctaaccaatatgcctctggggataatgatgatttcatagaatcagaatcagataggcaaatgcttcttataaagcagcaggacgaggagttagacgagcttagtttaagtgtacagagaatcggaggtgttggacttacaatacatgaagagctccttgggcaggaaaagattctagatgaactgggaaatgagatggacagtacatccaatcgtttagattttgtccaaaaaagagtggcaatggtgatgaagaaggccagtgcaaaggggcagatgatgatgatatgtggtttgctggccctgttcattttcctttttatcttggtattcttcacttagtcatttctgaatgcattggttgtaaatgcaaaaagggatccaagtttgagaagacaaaagattaatgggacatcctatgtcttggtcaaatggaaggctctttgaaggcagtaggaaattttgaatgtgatgaaaagggtagcaatgagcttaaaagtatcaaaagattaagttttgatcacaaatatgatttgaattagtaccagtattcgaatatataatgattttcttctgcatgttactgtaatgtactgtaatgcttgatgactataccataataatcttttatcat

SEQ ID NO: 6399 - DNA, 4167 bp, Glycine max
gctaaagatcttcctccttctttctctctcccttgtttgtgcagtcttctggctctcactctctatttatcacaccattaaccaccacctcttaaatatattttccataaatcaccaaaatttcccatttttttcacctccatcgtttcacccactgaatcacagttttcttttcttttctttctaacaaaaatcgcttctgcacacacaaggattcagaggcagaaggaaacaataccttgaaagtagatagatgtcgtcggcttcttctttgatggctgcttccagtgaaaggtggattgaccgtcttcagtactcctcattgttctggcctcctccaccggatggtcaacagagaaaggatcaaattgctgcatatgttgagtacttcattcagtttacatcagaacagtttgctgatgatattgctgagttgatccgtaaccgttatccatccaaggatattcttctctttgatgatgttttggcaacatttgtccttcatcatccagagcatgggcatgcagttgtgcttccaattatttcatgtattattgatggtactctagtctatgataaggctagtcctccatttgcttctttcatatcttcagtctgcccaaaaattgagaatgaatactcagaacaatgggctctagcatgtggtgaaattttgcgcattttaactcattacaatcgccctatttacaaaacggaaagacaatctggtgaaacagaaagaagcactagtggcagtcatgccacaactagtgaacctgggaaatctgggcataattctttgacacagcaagagaagaaacctattaggccgttgtccccctggattactgatatattgttgtcttcaccagttggtattagaagtgactatttccgatggtgcagtggtgttatgggtaaatatgctgcaggagaactgaagcctccatcaaccgcttcttcccgtggttctgggaagcatcctcaacttgtgccttcaactccaagatgggctgttgccaatggtgctggtgttatattgagtgtttgtgatgatgaagttgctcgcaatgagactactactttaacagcagctgctgtccctgcacttttgcttcctcctccaacgacagctttggatgagcatcttgttgctggattaccagctctggaaccatatgctcgtttatttcatagatattatgcaattgctactccaagtgctacacaaagacttcttcttggacttcttgaagcacccccatcgtgggctccagatgcacttgatgctgctgtgcagcttgtggagcttcttcgagctgctgaagattatgcatctggcataaggcttcctagaaattggatgcatttgcacttcttgcgtgcaatagggactgcaatgtccatgagagctggtatagccgctgatgctgccgctgctcttctttttcgtatactttcacagcctgcattactttttcctcctcttagacaagttgatggagttgaagttcaacatgaacctctgggtggttatatttcttcctataaaaagcagatagaagttcctgcagctgaagcctcaattgaagctactgcccaaggcattgcatcaatgctttgtgcccatggtccagaggttgaatggagaatttgcactatttgggaagctgcttatggcctgattcctacaagttcctcagctgttgatcttcctgaaattatagttgcaaccccgctacaaccacccatactgtcatggaatttgtacatacccctactgaaggtcctggaatatcttcctcgaggaagcccatcggaggcatgtcttatgaaaatatttgctgctacagtggaagctattcttcagaggacatttccacccgagtccactagagaacaaaacagaaaatcaaaatacctagctggcattggctctgcctcgaaaaaccttgccatggcagaacttcgtactatggttcattcactcttcttagaatcatgtgcatctgtagagcttgcttcacgcctactttttgttgtcttaactgtctgcgtcagtcatgaagctcaattcagtggaagcaagagaccaagaggtgaagataactattcagctgaggatattattgaggacttacaaacatctgaaaaccagaaagtatcaaaaaataggaaattgaagaagcaaggtcctgtagcagcatttgattcttatgttctggctgctgtttgtgctcttgcctgtgagcttcagttgttccctttgatttcatgtgggaataatcgtttagcttccaataatgtgcaagatatagccaagcctgttagactaaatggatcctcccatgagttgcagaatggcttagattcagcaatgcgtcatactcacagaattttagcaattttagaggcattattttcattgaagccatcttctgttggcacgccttggagttacagctcaaatgagatagttgcagcagctatggttgctgcacatgtttctgaactatttagaaggtcaaaaacttgcatgcatgctctgtctgttcttattcgttgcaaatgggacaatgaaattcattccagggcgtcatcattgtataatctcatagatattcacagcaaagctgttgcatctatagtgaacaaggcagaaccattagaagcaaccttaattcatgtaccgatttggaaggattccctcgtttgtgttggtgttaaaaggcagaatcagtgtgaaagtagtagctgctttgcccctgggcagacatctgttgtaccttcagaagattcattcccatcaaaagttgaccataattctcagaaaaccccatgttcaaaggatgcatcagattataccttgggtaaaggtgtcacaggtttctcattagatgcttctgatctagccaacttcctcacaatggacaggcatataggattgaattgcaatgggcaaatttttctaagatccacgctggcagagaaacaagagttatgtttctctgtagtttcactgttatggcacaagttgattgcatctcctgaaacacaaccttgtgcagaaagcacttctgcccaacagggctggagacaggttgttgatgcattatgcaatgttgtgtcagcctcaccaacaaaagcagctacggcagttgtacttcaggcggagcgggaattgcagccctggattgccaaggatgatgatttaggtcagaagatgtggagaatcaatcagcggattgtgaaattgatcgtggaacttatgaggaatcatgagacttcagaatcattggtaattgtggcaagttcttcagatttactactgcgagccacagatgggatgctggttgatggagaagcttgcactttaccacagttggagctattggaagcaacagctagagcagttcagccagtgctcgagtttggagaatctggattggctgtggcagatggcctttcaaaccttttaaagtgtcgcctctcagctacaattagatgtctttctcatccaagtgcacatgtccgagctctgagtatatcagttcttcgtgacattttgcatactggttcaatcagatgtagtcctaaacctcggagattaaatggcacccacaacccctcttatcaatacttcaatttggatgtcattgactggcaagctgacatagaaaaatgcttgacttgggaagctcacagccgactttcaaacggattgtctattaactttcttgataccgctgccaaagagttaggctgtactatttccatgtgaaatgaaatcatccatcttagtccgtgacaattttttactagacgtatagaaaaaaaaaagttattgatatgcttattgaactaacgggtttgcaaataagcataattctgctagtcctgttgaaaagagctgcagtcataattctagtatgtttatagaaagctcattttgtatcatgtatgtactgtagctaaactaagtttcaccctgaacttgcttgtgagtctgctctcgatagaacagtcttgtacagtaacgaaaaacgctgtaaccaggtccttttctatattgtctcattttgtgttatgcttatgttgatttagcttgtaatggaagtcatttccaattgtttggattaatgtatgatcaggcaggcttttcttttc

SEQ ID NO: 6400 - DNA, 4314 bp, Glycine max
agttgtgttctcttctctagtttgtttctgcagttttgcctctctctctctctctctcactatctatctatcccaccataaccattaaccaccacctcttaaatatttttccacaaatcaccaaaatttcccatttttttcaccctctgaatcacaatttttttctttctaactaaaatcgcctctacacacaaggattcagcatgttttggctggaagttggataactgcttttgattctcagaggcagaaggaaacaataccttgaaagtaaatagatgtcgtcatcttcgtcttcgatggctgcttccagtgaaaggtggattgaccgtcttcagtactcctcattgttctggcctcccccaccagatggtcaacaaagaaaggatcaaattgctgcatatgttgagtacttcattcagtttacatcagaacaatttgctgatgatattgctgagttgatccgtaaccattatccatccaaggatattcttctctttgatgatgttttggcgacatttgtccttcatcatccagagcatgggcatgcagttgtgcttccaattatttcatgtattattgatggtacactagtctatgataaggctagtcctccatttgcttctttcatatcttcagtctgcccaaaaattgagaatgaatactcggaggaatgggctctagcatgtggtgaaattttgcgcattttaactcattacaatcgccctatttacaaaacagaaagacaatctggtgaaaccgaaagaagcactagtggcagtcatgccacaactagtgaacctgggaaatctgggcataattctttgacacagcatgagaagaaacctataaggccgttgtccccctggattactgatattttgttggcttcaccagtaggtattcgaagtgactatttccgatggtgcagtggtgttatggggaaatatgctgcaggagaactcaagcctccatcaaccgcttcttcccgtggttctgggaagcatcctcaacttgtgccttcaactccaagatgggctgttgccaatggtgctggtgttatattaagtgtttgtgatgatgaagttgctcgcaatgagactgctactttaacagcagctgctgtccctgcgcttttgcttcctcctccaacgacagctctggatgagcatcttgttgctggattaccagctctggaaccatatgctcgtttatttcatagatattatgcaattgctactccaagtgctacacaaagacttcttcttggacttctagaagcacccccatcatgggctccagatgcacttgacgctgctgtgcagcttgtggagcttcttcgagctgctgaagattatgcatctggcataaggcttcctagaaattggatgcatttgcatttcttgcgtgcaatagggactgcaatgtccatgagagctggtatagccgctgatgctgcagctgctcttctttttcgtatactttcccagcctgcattgctttttcctcctcttagacaagttgacggagttgaagttcaacatgaacctttgggtggttatatttcttcctataaaaagcagatagaagttcctgcagctgaagcctctattgaagctactgcccaaggcattgcatcaatgctttgtgcccatggtccagaggttgaatggagaatttgcaccatttgggaagctgcttatggcctgattcctacaagttcctcagctgttgatcttccggaaattatagttgcaaccccactacagcctcccgtgctgtcatggaatttgtacatacccctattgaaggtcctggaatatcttcctcgtggaagcccatcagaggcatgtcttatgaaaatatttgctgctacagtggaagctattcttcagaggacatttccacctgagtccactagagaacaaaacagaaaatcaaaatacctagctggcataggctttggctctgcctcaaaaaacctggccgtggcagaacttcgtacaatggttcattcactcttcttagaatcatgtgcatctgtagagcttgcttcacgcctactttttgttgtcttaactgtctgcgtcagtcatgaagctcaattcagtggaagcaagaggccaagaggtgaagataactattcatctgaggatatcattgaggacttacaaacatctgaaaaccagaaagaatcaaaaaataggaaattgaagaagcaaggtcctgttgcagcatttgattcttatgttctggctgccgtttgtgcccttgcctgtgagcttcagttgttccctttgatttcacgggggaataatcatttagcttccaataaggtgcaagatatagccaagcctgttagactaaatggatcctcccatgagttgcggaatggcttagattcagcagtacgtcatactcacagaattttagcaattttagaggcactattttcattgaagccatcttctgttggaaccccttggagttacagctcaaatgagatagttgcagctgctatggttgctgcccatgtttctgaactatttagaaggtcaaaagcttgcatgcatgctctgtctgttctgattcgttgcaaatgggacaatgaaattcactccagggcatcatcattgtataatctcatagatattcacagcaaagctgttgcatctatagtgaacaaggcagagccattagaagcaaccttaattcatgcacctattcggaaggattcccttgtttgtgttggtgttaaaaggcagaatcagtgtgaaagtagtagctgttttgatgctgggcggacatctgttgtaccttcagaagattcattcccatcaaaacttgaccataattctaacaaaaccccatgtccaaagggtgcatcagattataccttgggtaaaggtgtcacaggtttctcattggatgcgtctgatctagccaacttcctcacaatggacaggcatataggattgaattgcaatggacaaatttttctaagatccacgctagcagagaaacaagaattatgtttttctgtagtttcactgctatggcacaagctgattgcatctcctgaaacacaaccttgtgcagaaagcacttctgcccaacagggctggagacaggttgttgatgcattatgcaacgttgtatcagcctcaccaacaaaagcagctacagcagttgtacttcaggcggagcgggaattgcagccctggattgccaaggatgatgattcaggtcagaagatgtggagaatcaatcagcggattgtaaaattgattgtggaacttatgaggaatcatgagactgcagaatcattggtaattgtggcaagttcatcagatttactactgcgagccacagatgggatgctggttgatggagaagcttgcactttaccacagctggagctattggaagcaacagctagagcagttcagccagtgctcgagtttggagaatctggattggctgtggcagatggcctttcaaaccttttaaagtgtcgcctctcagctacaattagatgtctttctcatccaagtgcacatgtccgagctctgagtatatcagttcttcgtgacattttgcatactggttcaatcagatgtagtcctaaacctcggagattaaatggcacccacaacccttcttatcaatacttcaatttggatgccgttgactggcaagctgacatagaaaaatgcttgacttgggaagctcacagccgactttcaaacggattgtctattaactttcttgatatcgctgccaaagagttaggctgtactatttccatgtgaaatgaaatcatccatcttagtctgtgacaattttttgctagacttatagaaaaagaaaaagaaaacagaagttattgatatgcttatggaactaacgggtttgcaaataagcataattctgctagtcctgttaaaaagagctgcaatcataattctagtatgtttatagaaagctcattttgtatcatgcatgtactctagctaaactaagtttcaccttgaacttgcttgtgactctgctctggatagaacagacttgtacagtaacgaaaaacgactgtaaccaggtccttttctccatcattgtctcattttgtgttatgcttatgttgatttagcttgtatggaagtcagttccaattgtttggattaatgtatgttcaggcaggatttccttttttctctcttttaattttgtgagattgttgttggttttcatctttttgctagagatttgtgttttttctttattattttcaaagtgagtaaaatatgttttttt

SEQ ID NO: 6401 - DNA, 4403 bp, Glycine max
gtgagaggaaaatatcattgccacgtattcaatcaatctaggcttctcagagctgctaaagatcttctctttctttctctctcccagttgtgttctcttctctagtttgtttctgcagttttgcctctctctctctctctctctctcactatctatctatcccaccataaccattaaccaccacctcttaaatatttttccacaaatcaccaaaatttcccatttttttcaccctctgaatcacaatttttttctttctaactaaaatcgcctctacacacaaggattcagcatgttttggctggaagttggataactgcttttgattctcagaggcagaaggaaacaataccttgaaagtaaatagatgtcgtcatcttcgtcttcgatggctgcttccagtgaaaggtggattgaccgtcttcagtactcctcattgttctggcctcccccaccagatggtcaacaaagaaaggatcaaattgctgcatatgttgagtacttcattcagtttacatcagaacaatttgctgatgatattgctgagttgatccgtaaccattatccatccaaggatattcttctctttgatgatgttttggcgacatttgtccttcatcatccagagcatgggcatgcagttgtgcttccaattatttcatgtattattgatggtacactagtctatgataaggctagtcctccatttgcttctttcatatcttcagtctgcccaaaaattgagaatgaatactcggaggaatgggctctagcatgtggtgaaattttgcgcattttaactcattacaatcgccctatttacaaaacagaaagacaatctggtgaaaccgaaagaagcactagtggcagtcatgccacaactagtgaacctgggaaatctgggcataattctttgacacagcatgagaagaaacctataaggccgttgtccccctggattactgatattttgttggcttcaccagtaggtattcgaagtgactatttccgatggtgcagtggtattatggggaaatatgctgcaggagaactcaagcctccatcaaccgcttcttcccgtggttctgggaagcatcctcaacttgtgccttcaactccaagatgggctgttgccaatggtgctggtgttatattaagtgtttgtgatgatgaagttgctcgcaatgagactgctactttaacagcagctgctgtccctgcgcttttgcttcctcctccaacgacagctctggatgagcatcttgttgctggattaccagctctggaaccatatgctcgtttatttcatagatattatgcaattgctactccaagtgctacacaaagacttcttcttggacttctagaagcacccccatcatgggctccagatgcacttgacgctgctgtgcagcttgtggagcttcttcgagctgctgaagattatgcatctggcataaggcttcctagaaattggatgcatttgcatttcttgcgtgcaatagggactgcaatgtccatgagagctggtatagccgctgatgctgcagctgctcttctttttcgtatactttcccagcctgcattgctttttcctcctcttagacaagttgacggagttgaagttcaacatgaacctttgggtggttatatttcttcctataaaaagcagatagaagttcctgcagctgaagcctctattgaagctactgcccaaggcattgcatcaatgctttgtgcccatggtccagaggttgaatggagaatttgcaccatttgggaagctgcttatggcctgattcctacaagttcctcagctgttgatcttccggaaattatagttgcaaccccactacagcctcccgtgctgtcatggaatttgtacatacccctattgaaggtcctggaatatcttcctcgtggaagcccatcagaggcatgtcttatgaaaatatttgctgctacagtggaagctattcttcagaggacatttccacctgagtccactagagaacaaaacagaaaatcaaaatacctagctggcataggctttggctctgcctcaaaaaacctggccgtggcagaacttcgtacaatggttcattcactcttcttagaatcatgtgcatctgtagagcttgcttcacgcctactttttgttgtcttaactgtctgcgtcagtcatgaagctcaattcagtggaagcaagaggccaagaggtgaagataactattcatctgaggatatcattgaggacttacaaacatctgaaaaccagaaagaatcaaaaaataggaaattgaagaagcaaggtcctgttgcagcatttgattcttatgttctggctgccgtttgtgcccttgcctgtgagcttcagttgttccctttgatttcacgggggaataatcatttagcttccaataaggtgcaagatatagccaagcctgttagactaaatggatcctcccatgagttgcggaatggcttagattcagcagtacgtcatactcacagaattttagcaattttagaggcactattttcattgaagccatcttctgttggaaccccttggagttacagctcaaatgagatagttgcagctgctatggttgctgcccatgtttctgaactatttagaaggtcaaaagcttgcatgcatgctctgtctgttctgattcgttgcaaatgggacaatgaaattcactccagggcatcatcattgtataatctcatagatattcacagcaaagctgttgcatctatagtgaacaaggcagagccattagaagcaaccttaattcatgcacctattcggaaggattcccttgtttgtgttggtgttaaaaggcagaatcagtgtgaaagtagtagctgttttgatgctgggcggacatctgttgtaccttcagaagattcattcccatcaaaacttgaccataattctaacaaaaccccatgtccaaagggtgcatcagattataccttgggtaaaggtgtcacaggtttctcattggatgcgtctgatctagccaacttcctcacaatggacaggcatataggattgaattgcaatggacaaatttttctaagatccacgctagcagagaaacaagaattatgtttttctgtagtttcactgctatggcacaagctgattgcatctcctgaaacacaaccttgtgcagaaagcacttctgcccaacagggctggagacaggttgttgatgcattatgcaacgttgtatcagcctcaccaacaaaagcagctacagcagttgtacttcaggcggagcgggaattgcagccctggattgccaaggatgatgattcaggtcagaagatgtggagaatcaatcagcggattgtaaaattgattgtggaacttatgaggaatcatgagactgcagaatcattggtaattgtggcaagttcatcagatttactactgcgagccacagatgggatgctggttgatggagaagcttgcactttaccacagctggagctattggaagcaacagctagagcagttcagccagtgctcgagtttggagaatctggattggctgtggcagatggcctttcaaaccttttaaagtgtcgcctctcagctacaattagatgtctttctcatccaagtgcacatgtccgagctctgagtatatcagttcttcgtgacattttgcatactggttcaatcagatgtagtcctaaacctcggagattaaatggcacccacaacccttcttatcaatacttcaatttggatgccgttgactggcaagctgacatagaaaaatgcttgacttgggaagctcacagccgactttcaaacggattgtctattaactttcttgatatcgctgccaaagagttaggctgtactatttccatgtgaaatgaaatcatccatcttagtctgtgacaattttttgctagacttatagaaaaagaaaaagaaaacagaagttattgatatgcttatggaactaacgggtttgcaaataagcataattctgctagtcctgttaaaaagagctgcaatcataattctagtatgtttatagaaagctcattttgtatcatgcatgtactctagctaaactaagtttcaccttgaacttgcttgtgactctgctctggatagaacagacttgtacagtaacgaaaaacgactgtaaccaggtccttttctccatcattgtctcattttgtgttatgcttatgttgatttagcttgtatggaagtcagttccaattgtttggattaatgtatgttcaggcaggatttccttttttctctcttttaattttgtgagattgttgttggttttcatctttttgctagagatttgtgttttttctttattattttcaaagtgagtaaaatatgttttttt

SEQ ID NO: 6402 - DNA, 4006 bp, Arachis hypogaea
agtggtagagaagggaacaaccttcagagttcatagatgtcttcttcttcaatggctgcttccaatgaaaggtggatcgaccgacttcaatactcctcgttgttctggcctcccccaccggacggtcaacaaagaaaggatcaaattgcagcatatgttgagttcttcattcaatttacatcagagcaatttgctgacgatattgctgagttgatccgtaaccgttatccatcacaggaaatacttctctttgacgatgttttggcaacatttgttcttcatcatccagagcatgggcatgcagttgtacttccaattatttcatgcattattgatggcacgatagtctactataagagcagccctccattcgcttcgttcatatctttagtctccccaaagagtgagaatgaatactcagaacaatgggctttggcgtgtggtgaaattttgagaattttaactcattacaatcgcccaatattcaagaccgaaaggcaatatggtgaatcagaaagaagcagcagtggcagccatgcgaccactagtgactcggttgatgggaagtctgttcaaaattctttgatacagcaagagaaaaaaccaataaggcctctgtccccatggattactgatatattgctggctgcacctgtaggcattagaagtgactatttcagatggtgcagtggtgttatgggtaaatatgctgcaggagaactcaagcccccaacaactgcttcttcacgtggttccgggaagcatcctcaacttgtgccttcgactccaagatgggctgttgccaatggtgccggtgttatattaagtgtttgtgatgatgaagttgctcgctatgagactgctactttaacagcagctgctgtccctgcccttttgcttcctccaccaacaacagctctagatgagcatctagttgctggattaccagctctagagccatatgcacgcttatttcatagatactatgccattgctactccaagtgctacacagagacttcttcttggactcttagaagcaccaccatcatgggccccagatgcacttgatgctgctgtacagcttgtggagcttcttcgagctgctgaagattatgcttcaggcataaggcttcctagaaattggatgcatttgcatttcttgcgtgcaatagggactgcaatgtccatgagagcaggcatagctgctgatgccgcagcagctttgctttttcgtgtactttcccagcccgcattacttttcccacctcttaggcaagttgatggagtagaagtccaacatgaacccttgggtggttatatctcttcctacaaaaagcagatagaagttcctgcagcagaagcctccatggaggctactgcacaaggcatcgcatccatgctgtgtgcacatggcccagaggttgaatggagaatttgcaccatttgggaagctgcttatggcctgattcctacaagttcctcagctgttgatcttccagagattatagttgcaactccactacaacctcctatactatcatggaatttatacatccccctacttaaggtcctcgaataccttccacgcggaagcccatcggaggcatgtcttatgaaaatatttgctgctacagtggaagctattcttcagaggacctttccgtctgacaccactagagaacaaaacagaaaatcaaagtacctctttggagtggggtctgcctccaaaaaccttgctgtagcagaactccgcacgatggttcattcacttttcttagaatcatgtgcttctgttgagctcgcctcacgcctgcttttcgtagtcttaactgtctgcgttagtcatgaagcacaattcagcggaagcaagaggccgagaggtgaggacaattattcagccgaggaaatcattgaggacttgcatgctgtgtctgaaattcagaaagaaactagaaataggaaaatgaagaagcaaggtcctatagcagcatttgattcttatgttctggctgctgtttgtgctcttgcctgtgagcttcaattgttccctctgatttcacgggggaataatcattcagattccaacaatgtaaaagatatagccaagccttttagaataaatggaacgtcacatgagttgcagaacggcgtagactcagctatacgccatactcacagaatcttagcaattttggaggctttgttttcattgaagccgtcatcagttggcactccatggagttacagctcaaatgagatagtcgctgcagctatggttgctgcacatgtctctgaactatttagacggtccaaagcttgcatgcatgctctttctgttctgattcggtgcaaatgggacaatgaaattcactccagagcatcatccttgtataatctcatagatattcatagcaaagccgtagcgtctatagttatcaaagcagagccattagaagctacgttaattcatgcacctacttggaaggactctgttgtttctcttggtagtaaaagacacaatcagtgtgaaagtagtagctgctttgaccctaggcaaacatctattactactttggaagattcgggtccatcaaaacttaaccgcaaatctgataaaacttcttgttcaaatgaagcatcaggagggtgtaccttaggtaaaggtgtcacaggttttccattggatgcttctgatctcgccaactttcttacaatggacagacatataggattgagttgcaatgcacaaattttcctcagatccatgctggcagagaaacaagaattatgcttctctgttgtttcactactatggcacaagttgattgcttcccctgaaactcaaccttgtgcagaaagcacttctgcccaacagggctggaggcaggttgttgatgcattatgcaatgttgtatcagcgtcaccaacaaaagcagcaacagcagttgttcttcaggcggagagggaattgcagccatggattgccaaggatgatgatctgggtcagaagatgtggagagtcaatcagcggatcgtgaaattgatagtggagctaatgaggaatcatgatagtgcagagtcattggtaattttggcaagtgcgtcagatttgctgctacgagccacagatggtatgctggttgatggagaagcttgtactttaccacagctggagctgctggaagtaacagctagagcagtacagcctgtgctcgagttgggcgaatctggattggcagtggcggatggcctttcaaacttgttaaagtgccgcctatcagccactgttagatgcctctcccatccaagtgcacacgtccgtgcgctgagcatttcggttcttcgggacatcttgcatacaggttcgatcagatctggtcctaaaccgccgcaaataaacggcatccacgacccctcttatccatacttcaatttggatgtcactgactggcaagctgacatagaaaaatgcttgacatgggaagctcacagtcaactttcgaatgagttgtctataaagtatctcaataccgcagcaaaagaattaggctgtaccattaccatatgaacatgaaaagtgaaagtgaaatcatgtaaaaccatcttagtctatgacaattttttgcctagactttgttatagaaacagatgtcatttatgcttttggaactaacgggtttgcaaaataagtaacatcatgtgctagtcctgttaaaaatgccacagtcctgattccagtttggttatacagaaaagaaaagctaattttgtattatgctttaatgtgctgtttctgaacctggatcagaagttctcacagtggactgcatgctaatgattgtacttatgctctcggtagaagaaatttgtacattaactaaaaaccactttttaatccttgtcttatgttgtatgtgttgcttatgttgatttggcttgtaatgacatttaaatctaactgtatgatgagtctgtgttcagctggtttacttttaatctatcta

SEQ ID NO: 6403 - DNA, 4249 bp, Medicago truncatula
ttcttcttctattctatctatctatctaacatcttcatttccaaactataaacttaccacaaccctctttctatcatttctttcctccttttgatcattacacaatactctccattctcacacttacatcttctcatcctatcaattcagaaaatttccaattagctctacacacagctcagctaagctaacccaggatttaatacttgattggtatcatgttttggatggatttgggataaaattgcttttcatatataatcagaagctaaaggattcaagagttgaaagtttttgatgacttcttcttctatggctgctacaagtgaaaggtggattgaccgtcttcaattttcttcattattctggcctcccccacaagatgttcagcaaaaaaaggatcaaattgctgcatatgttgagtacttgattcagtttacatcagaacagtttgctgacgatattgctgagttgatccgcaaccgttacccgtcgaaggaaattattctctttgatgacgttttggcaacatttgtccttcatcatccagagcatgggcatgcagttgtacttcctattatttcgtgtattatcgatggtacactagtctatgataagactagtcctccatttgcttctttgatatctttagtctgcccaaaagatgagaatgaatattcagaacaatgggctcttgcatgtggtgaaattttgcgtattttaactcattacaatcgccccatttacaaaacggaaaggcaatccagtgaaacagaaagaagcagtagtggcagccatgcgacaactagtgagccacttaatgggaaagctgtcaataatgctttggcacaacaagagaaaaaacctatcaggcccttgtccccctggattactgatatattgttagttgcgcccgtaggcattagaagtgactatttccggtggtgcagtggtgttatgggcaaatatgcagcaggagaactcaagcctccatcaattgctacttcccgtggttctgggaagcatcctcaactcgtgccttctactcccagatgggctgttgccaatggtgctggtgttatattaagtgtttgtgatgatgaagttgctcgcaatgaaactgctattttaacagcagcagctgttcctgcacttctgcttcctcctccaacaacagctctggatgaacatcttgttgctggactaccagctctagagccatatgcacgtttatttcatagatactatgcaattgctactccaagtgctacacaaagacttcttcttggacttctagaagcacccccgtcgtgggctccggatgcacttgatgctgctgtgcagctcgtggagcttcttcgagctgctgaagagtatgcttctggcataaggcttcctagaaattggatgcatttgcatttcttgcgtgcaatagggactgcaatgtccatgagggctggcatagctgctgatgctgcagctgctttgcttttccgtatactttcacagccagcattgctttttcctcctcttagacaagttgatggagttgaagttcagcatgaacctttgggtggttatatttcatcctacagcaagcagatagaagttccttctgctgaagcctctattgacgctactgcccaaggcattgcgtcaatgctttgcgcccatggtccagaagttgaatggagaatttgcaccatttgggaagctgcttatggcctgattcctgcaagttcctcagccgttgatcttccagagatcatagttgcagccccactacaacctcccatactatcatggaatttgtacataccactacttaaggttctggaatatcttcctcgtggaagcccgtcagaggcttgtcttatgaaaatatttgctgctacagtggaagctattcttcagaggacatttccacctgagtccagcagagaacaaaacagaaaagcaaattacctctttggtcttggttcagcctctaaaaaccttgctgtggcagagcttcgtactatggttcattcactttttttagaatcatgtgcatctgtagagctttcttcgcgcctactttttgttgtcttaactgtctgtgtcagtcatgaagcccaattcagtggaagcaagaagcctagaggtgaagataattattcagttgaggaaatcattgaggacttgcaagcaatatcagaaatccgtaaagaaagaaaaaataggaaagtgaagaagcaaggtcctgtagcagcatttgattcttatgttatggctgctgtttgtgctcttgcctgtgagcttcagttgtttcctttgatgtcacggggaaataatcattcagtttccaataatgtgcaagatatagccaagcccgttacactacacggatcatcccaagatttgcagaatggcctagattcggcagtccgccatactcacagaattttagcaattttagaggcactattttcattaaagccctcttctgttggcactccttggagttacagctcaaatgagatagtggcagcagctatggttgctgcacatgtttctgaactatttagacggtcaaaagcttgcatgcatgctctgtctgttctgatacgttgcaaatggaacaaagaaattcactccagggcatcatcattgtataatctcatagatatccacagtaaagttgttgcatctatagtgaataaggcagagccattagaagccaccttaattcatgcacctatttacaaggacgcccttgtttgtcatgacggtaaaagaaagaatcggagtgaaaatggtagctgctctgaccctgggcagacatctattgtaccttcggcagattcaacaccatcaaaacatatccataaatctggaagaactccatgttcaaatgaagaagcatcagggtataacttgggtaaaggtgtcaccagtttctcgttggaggcatctgatctcgccaattttctcacaatggacaggcatataggcttgaactgcaatacacagatctttctgatatccatgctgtctgagaaacaggagttatgtttctctgtagtttctctactatggcacaaattgattgcatctcctgaaactcaaccatgttctgaaagcacttcagctcagcagggctggagacaggttgtcgatgcattatgcaatgttgtatcagcctcgccagcaaaagcagctacagctgttgttcttcaggcggagaaggaattgcagccctggatagccaaggatgatgatctaggtcagaagatgtggagaatcaatcagcggatcgttaaattgatagtggaacttatgaggaatcatgatagtgcggagtcattggtaattctggcaagtgcatcagatttacttctacgagccacagatgggatgcttgttgatggagaagcttgtactttaccacagctggagctattggaagcaacagctagagcaattcaaccagtgcttgagtttggagaaccaggattggctgtagcagacggcctttcaaaccttttgaagtgtcgtctagcagctaccattaggtgcctttgtcatccaagtgcacatgtccgtgctctgagcgtctcagttctccgtgacattttgcatactggttcaataaggtgtagtcctaaaccactgcggataaacggcagccacaatccctcttatcaatacttcaagttggacgtcgttgattggcaagctgacatagaaaaatgcatggcatgggaagctcacagcagaatttctgctggattgcctattaagtttcttgacactgctgccaaagaactaggctgcgctatttccgtatgaaatggaaatgaaaccatcttagtctgtgaccatttttcactagacttacagagaaactatttatgattttggaactaacaggtttgcatatatgcaaacatcattctgttggtcgtcataaaaagccgcagtcatgattgcagtttgtttatagaaagctcattttgtattatgtatgtgctctacgtagacactgagcaaatgttcaccacgaacttgctaatgactgtgcttttaatataacagacatgtacagttgtaaagacaagatgtaaccgggtcttttttattatccttgtcccattttgtgtaatacatatatgttgatagtgtgtcgtgaaattaaattctaattgttgtactaatgtgtgtccagcaactttgactttgtcaaatttttttagttttgttacatgca

SEQ ID NO: 6404 - DNA, 4189 bp, Medicago truncatula
cttctattctatctatctatctaacatcttcatttccaaactataaacttaccacaaccctctttctatcatttctttcctccttttgatcattacacaatactctccattctcacacttacatcttctcatcctatcaattcagaaaatttccaattagctctacacacagctcagctaagctaacccaggatttaatacttgattggtatcatgttttggatggatttgggataaaattgcttttcatatataatcagaagctaaaggattcaagagttgaaagtttttgatgacttcttcttctatggctgctacaagtgaaaggtggattgaccgtcttcaattttcttcattattctggcctcccccacaagatgttcagcaaaaaaaggatcaaattgctgcatatgttgagtacttgattcagtttacatcagaacagtttgctgacgatattgctgagttgatccgcaaccgttacccgtcgaaggaaattattctctttgatgacgttttggcaacatttgtccttcatcatccagagcatgggcatgcagttgtacttcctattatttcgtgtattatcgatggtacactagtctatgataagactagtcctccatttgcttctttgatatctttagtctgcccaaaagatgagaatgaatattcagaacaatgggctcttgcatgtggtgaaattttgcgtattttaactcattacaatcgccccatttacaaaacggaaaggcaatccagtgaaacagaaagaagcagtagtggcagccatgcgacaactagtgagccacttaatgggaaagctgtcaataatgctttggcacaacaagagaaaaaacctatcaggcccttgtccccctggattactgatatattgttagttgcgcccgtaggcattagaagtgactatttccggtggtgcagtggtgttatgggcaaatatgcagcaggagaactcaagcctccatcaattgctacttcccgtggttctgggaagcatcctcaactcgtgccttctactcccagatgggctgttgccaatggtgctggtgttatattaagtgtttgtgatgatgaagttgctcgcaatgaaactgctattttaacagcagcagctgttcctgcacttctgcttcctcctccaacaacagctctggatgaacatcttgttgctggactaccagctctagagccatatgcacgtttatttcatagatactatgcaattgctactccaagtgctacacaaagacttcttcttggacttctagaagcacccccgtcgtgggctccggatgcacttgatgctgctgtgcagctcgtggagcttcttcgagctgctgaagagtatgcttctggcataaggcttcctagaaattggatgcatttgcatttcttgcgtgcaatagggactgcaatgtccatgagggctggcatagctgctgatgctgcagctgctttgcttttccgtatactttcacagccagcattgctttttcctcctcttagacaagttgatggagttgaagttcagcatgaacctttgggtggttatatttcatcctacagcaagcagatagaagttccttctgctgaagcctctattgacgctactgcccaaggcattgcgtcaatgctttgcgcccatggtccagaagttgaatggagaatttgcaccatttgggaagctgcttatggcctgattcctgcaagttcctcagccgttgatcttccagagatcatagttgcagccccactacaacctcccatactatcatggaatttgtacataccactacttaaggttctggaatatcttcctcgtggaagcccgtcagaggcttgtcttatgaaaatatttgctgctacagtggaagctattcttcagaggacatttccacctgagtccagcagagaacaaaacagaaaagcaaattacctctttggtcttggttcagcctctaaaaaccttgctgtggcagagcttcgtactatggttcattcactttttttagaatcatgtgcatctgtagagctttcttcgcgcctactttttgttgtcttaactgtctgtgtcagtcatgaagcccaattcagtggaagcaagaagcctagaggtgaagataattattcagttgaggaaatcattgaggacttgcaagcaatatcagaaatccgtaaagaaagaaaaaataggaaagtgaagaagcaaggtcctgtagcagcatttgattcttatgttatggctgctgtttgtgctcttgcctgtgagcttcagttgtttcctttgatgtcacggggaaataatcattcagtttccaataatgtgcaagatatagccaagcccgttacactacacggatcatcccaagatttgcagaatggcctagattcggcagtccgccatactcacagaattttagcaattttagaggcactattttcattaaagccctcttctgttggcactccttggagttacagctcaaatgagatagtggcagcagctatggttgctgcacatgtttctgaactatttagacggtcaaaagcttgcatgcatgctctgtctgttctgatacgttgcaaatggaacaaagaaattcactccagggcatcatcattgtataatctcatagatatccacagtaaagttgttgcatctatagtgaataaggcagagccattagaagccaccttaattcatgcacctatttacaaggacgcccttgtttgtcatgacggtaaaagaaagaatcggagtgaaaatggtagctgctctgaccctgggcagacatctattgtaccttcggcagattcaacaccatcaaaacatatccataaatctggaagaactccatgttcaaatgaagaagcatcagggtataacttgggtaaaggtgtcaccagtttctcgttggaggcatctgatctcgccaattttctcacaatggacaggcatataggcttgaactgcaatacacagatctttctgatatccatgctgtctgagaaacaggagttatgtttctctgtagtttctctactatggcacaaattgattgcatctcctgaaactcaaccatgttctgaaagcacttcagctcagcagggctggagacaggttgtcgatgcattatgcaatgttgtatcagcctcgccagcaaaagcagctacagctgttgttcttcaggcggagaaggaattgcagccctggatagccaaggatgatgatctaggtcagaagatgtggagaatcaatcagcggatcgttaaattgatagtggaacttatgaggaatcatgatagtgcggagtcattggtaattctggcaagtgcatcagatttacttctacgagccacagatgggatgcttgttgatggagaagcttgtactttaccacagctggagctattggaagcaacagctagagcaattcaaccagtgcttgagtttggagaaccaggattggctgtagcagacggcctttcaaaccttttgaagtgtcgtctagcagctaccattaggtgcctttgtcatccaagtgcacatgtccgtgctctgagcgtctcagttctccgtgacattttgcatactggttcaataaggtgtagtcctaaaccactgcggataaacggcagccacaatccctcttatcaatacttcaagttggacgtcgttgattggcaagctgacatagaaaaatgcatggcatgggaagctcacagcagaatttctgctggattgcctattaagtttcttgacactgctgccaaagaactaggctgcgctatttccgtatgaaatggaaatgaaaccatcttagtctgtgaccatttttcactagacttacagagaaactatttatgattttggaactaacaggtttgcatatatgcaaacatcattctgttggtcgtcataaaaagccgcagtcatgattgcagtttgtttatagaaagctcattttgtattatgtatgtgctctacgtagacactgagcaaatgttcaccacgaacttgctaatgactgtgcttttaatataacagacatgtacagttgtaaagacaagatgtaaccgggtcttttttattatccttgtcccattttgtgtaatacatatatgttgatagtgtgtcgtgaaattaaattctaattgttgtact

SEQ ID NO: 6405 - DNA, 4529 bp, Cicer arietinum
ggtagatgcatgcatagagtaataataagatgagatggcaggcgatgtatgagaggagaggaaaatatcatagccacgtatgcagtcgatctaaacttctcatatgagagcagctaaagatcttctctctccacttgtagtatctatttctctataaacttaccaccacctctattttcatatttcttttctctctcaaactccttttttatttttagaaactaaattccctcatcttcacacttacatctttttaaccctcttaaatcactctatttcattctttctccacaaatttactctactcacaacctatccaagaagcttttgaatattaggtgacctctttgccaacgaggaaaataaatatttctcctacaaagtctcattcatttctcgggaatggtgaattaaaacttgactggtagcatcttttggatggattatggataaaattttggttttcttatataataataataatcagaggcaaaagaaaaagggaatagtttgtttgagagttgaaagttagatgggttcttcttccatggctgcttcaagtgaaaggtggattgaccgtcttcagtattcttcattgttctggcctcctccacaagatggtcagcaaaaaaaggatcaaattgctgcatatgttgagtacttgattcagtttacatccgaacaatttgctgatgatattgctgagatgatccgcaaccgttacccgtcaaaggaaattcttctctttgatgatgttttggcaacatttgtccttcatcatccagagcatgggcatgcagttgtacttccaattatttcatgtattattgatggtacactagtctatgataagactagtcctccatttgcttctctgatatctttagtctgcccaaaaaatgagaatgaatattcggaacaatgggctctggcatgtggtgaaattttacgtattttaactcattacaatcgcccgatttacaaaatggaaagacaatccagtgaaacagaaagaagcagtagtggcagccatgcaacaactagtgagcctcttgatgggaaagctgtcaataatgctttggcacaacaagagaaaaaacctattaggcccttgtccccttggataaccgatatattgttagctgcgcccgtaggcattagaagtgactatttccggtggtgcagcggggttatgggcaaatatgctgcgggagaactcaagcctccatcaactgcttcttcccgcggttctgggaagcatcctcaacatgtgccttcgactccaagatgggctgttgccaatggggctggtgttatactaagtgtttgtgatgatgaagttgctcgcaatgaaactgctattttaaccgcagcagctgttcctgctcttttgcttcctccgccaacaacagctctggatgagcatcttgttgctggattaccagctctagagccatatgcacgtttatttcatagatattatgcaattgctactccaagtgctacacaaagacttcttcttgggcttctagaagcacccccgtcgtgggctccagatgcacttgatgctgctgtgcagctcgtggagcttcttcgagctgctgaagagtatgcttctggcataaggcttcctagaaattggatgcacttgcatttcttgcgtgcaatagggactgcaatgtccatgagagctggcatagctgctgatgctgcagctgctttgcttttccgcatactttcacagccagccttacttttcccccctcttaggcaagttgatggagttgaagttcagcatgaacctttgggtggttatatatcttcctacagcaagcagatagaagttcctgctgccgaagcctctattgacgctactgcccaaggcattgcatcattgctgtgtgctcatggtccagaagttgaatggagaatttgcaccatttgggaagctgcttatggcctgattcctgcaagttcctcagctgttgatcttccagagattatagttgcatccccactacaacctcccacgttgtcatggaatttgtacatacctctgcttaaggtccttgaatatcttcctcgtggaagcccatcagaggcatgtctcatgaaaatttttgcggctacagtggaagctattcttcagaggacatttccacctgaatccagtagagaacacaacagaaaagcaaattacctttttggcattggttcagcctctaaaaaccttgccgtggcagaacttcggactatggttcattctctatttttagaatcatgtgcatctgtagagcttgcttcacgcctactttttgttgtcttaaccgtctgtgtgagtcatgaagcccaatttagtggaagcaagaagcctagaggtgaagataattattcagttgaggaaatcattgacgacttacaagcaatatcagaaagccggaaagaaaggaaaaacaggaaagtcaagaagcaaggtcctgtagcagcatttgattcttatgttatggctgctgtttgtgctcttgcctgtgagcttcagttgttccctttgatgtcacggggaaataatcattctgtttccaataatgtgcaagatatagccaaacctgttacactaaatggatcttcccaagatttgcagaatggtatagattcagcagtccgccatactcacagaattttatcaattttggaggcactattttcattaaagccgtcttctgttggtaccccttggagttgcagctcgaatgagattgtggcagcagctatggttgcagcgcatgtttctgaactatttagacggtctaaagcatgcatgcatgctctgtctgttctgattcgttgcaaatgggacaaagaaattcactcgagggcgtcatcattgtataatctcatagatattcatagtaaagttgttgcatctatagtcaataaagcagagccattagaagcaacattaattcacgcacctatttacaaggattcccttgtttgtcacgatggtaaaagaaagaatcgaagtgaaaatggtagctgctctgaccctgggcagacatctattgttcctttagagccttcggaagattcaacaccatcaaaacatagccataaatctggaagaactccatgttcaaatgaagcagcatcagggtataacatgggtaaaggtgtcactggtttctcgttggatgcttctgatttagccaacttccttacaatggacaggcatatagggttgaattgcaacacacagatttttctgatacctatgctggcagagaaacaggagttatgtttctctgtagtttctttactatggcacaagttgattgcatctcctgaaactcaaccatgctctgaaagcacttctgcgcagcagggatggagacaggttgttgatgcattatgcaatgttgtatcagcctcgccagcaaaagcagctacagctgttgttcttcaggcggagaaggagttgcaaccctggatagccaaggatgatgatctaggtcagaaaatgtggagagtcaatcagcggatcgtaaaactgatagtggagcttatgaggaaccatgatagctcggagtcactggtaattttggcaagtgcatcagatttactgctacgagccacagatgggatgcttgttgatggagaagcttgcactttaccacaattggagctattggaagcaacagctagagcagttcagccagtactagaattcggagaatcgggattggctgtggcagatggcctttcaaaccttttgaagtgtcgtctagcagctaccattaggtgcctatctcatccaagtgcacatgtccgcactctgagcgtctcggttcttcgggacattttgcataccagttcaatcaggtgtaatcctaaaccactgcgaataaacggcaaccacaacccctcttatcaatacttcaagttggatgttgttgattggcagactgacatagaaaaatgcttgacatgtgaagcccacagcagaatttcaagtgggttgcctattaagtttcttgacactgctgccaaagaattaggctgtgctatttccatatgaagtgaaacaatgcagaaaccatcttagtctgtgaccatttttcactagacttacagagacagttatttatgtgatttcggtactaatgggtttgcgtatatgcaaacatgattctattagtcctcggaaaaaaatccgcagtcatgtttttccattttgtttgtagaaagctcattttgtaatatgtatatgtgctctacgtagactctgagcaaatgttcaacatgaacttgctaatgactgctcttaattattagtataacagacatgtacagtttgaaagacaagatgtaaccaggtcttttttattatcctcgtatcattttgtgtaatatttgtttgaaattcaattctaattgttggactaatgtatgctcagcagctttgactttgtttattttatagtcctgtgaaatacttttgttataaattttaatattgatcatgtccatta

SEQ ID NO: 6406 - DNA, 4084 bp, Pisum sativum
gattattttctttcattcttcacaaatcattctaactccaatttttcttcttttacaacaatattctcatctccactcttacatctcttaaccctcctaattcaggaatttcattatttctccagaaattagctctgaacacagaagcaaaacaagaagggaatagtttgagatttggaagcttttcatggcttctactatggctgctactagtgaaaggtggattgatcgtcttcaattttcttcactattttggcctccaccacaagatggtcagcaaaagaaggatcaaattgctgcatatgttgagtacttgattcagtttacatcagagcaatttgccgacgatattgctgagttgatccgcaaccgttacccgtcgaaggaaattctcctctttgatgatgttttggcaacatttgtccttcatcatccagagcatgggcatgcagttgtacttccaattatttcatgtattatcgacggcacactagtctatgataagactagtcctccatttgcttctttgatatctttagtctgcccgaaaaatgagaacgaatattcagaacagtgggctctggcatgtggtgaaattttgcgtattttaactcactacaatcgccccatttacaaaatggaaaggcaatcgagtgaaacagaaagaagcagcagtggcagccttgcaacaactagtgagcctcttaatgggaaagctgtcaacagtgctttggcacaagagaaaaaacctattaggcccctgtccccctggattaccgatattttgttggctgcccctgtaggcattagaagtgactatttccggtggtgcagtggtgttatgggcaaatatgctgctggagaactcaagcctccgtcaactgcctcttcccgtggttctgggaagcatcctcaactcgtgccttcgactccaagatgggctgttgctaatggcgctggtgttatattaagtgtttgtgatgatgaagttgctcgcaatgaaactgctattttaacagcggctgctgttcctgcactattgcttcctcctccaaccacagctctggatgagcatcttgttgctggattaccagctctagagccatatgcacgtttatttcacagatattatgcaattgctactccaagtgctacacaaagacttcttcttggacttctagaagctcccccatcctgggctccagatgcacttgatgctgctgtgcagcttgtggagcttcttcgagctgctgaagagtatgcttctggcataaggcttcctagaaattggatgcatttgcatttcttgcgtgcaatagggactgcaatgtccatgagagctggcatagctgctgatgctgcagctgctttgcttttccgtatactatcacagccagcattgctttttcctccacttagacaagttgatggagttgaagttcagcatgaacctttgggcggttatatttcatcctacagcaagcagatagaagttcctgctgctgaggcttctattgatgctactgcccaaggcattgcatcaatgctgtgcgctcatggtccagaagttgaatggagaatttgcaccatttgggaagctgcttatggtctgattcctgctaattcctcagctgttgatcttccagaaataatagttgcagccccactccaaccgcccatactgtcgtggaatttgtatatacctttacttaaggtcctggaatatctccctcgcggaagcccgtcagaagcgtgtctcatgaaaatatttgctgctacagtggaagccattcttcagagaacatttccacccgaatccagtagagaacaaaacagaaaagcaagttacctctttggcattggttcagcctctaaaaaccttgctgtggcagaacttcggactatggttcattcactttttttagaatcgtgtgcttctgtagagctttcttcccgtctactttttgttgtcttgaccgtctgtgtcagtcacgaagcccaattcagtggaagcaagaaacctagaggtgaagataattattcagttgaggaaatcattgaggacttacaagcaatatctgaaatccggaaagaaaggaaaaataggaaagtgaagaagcaaggtcctgtagcagcatttgattcttatgttatggctgctgtttgtgctcttgcctgtgaacttcagttgtttcctttgatttcacggggaaataatcattcactttccaataatgggcaagatatagccaagcctgttacactacatggatcatcccaagatttgcagaatggtctagaatcggcagtccgtcatactcacagaattttagctattttagaggcactgttttcattaaagccttcttctgttggcaccccttggagttacagctcaaatgagatagtggcagcagctatggttgctgcacatgtttctgaactatttagacggtcaaaagcttgcatgcatgccctgtcggttttgatacgttgcaaatggaacaaagaaattcactccagggcatcatcattgtataatctcatagatatccacagtaaagttgttgcgtctatagtgaataaagcagagccattagaagcaaccttaattcacgcaccaatttacaaggactcccttgtttgtcatgatggtaaaagaaagaatcggagtgaaaatggtggctgctctgactctaggcagacatctactgtaccttcggaagattcaacaccatcaaaacatagccataaatctggaagaactccatgctcaaatgaagaagcatcagggtataacttgggtaaaggtgtcactggtttttcgttggaggcttctgatctagccaatttcctcacaatggacaggcatatagggttgaattgcaacacacaaatttttctaatatccatgctgtctgagaaacaggagttatgtttctctgtagtttccctactatggcacaagttgattgcatctcctgaaactcaaccatgttctgaaagcacttctgcacaacaggggtggagacaggttgtcgatgcattatgcaatgttgtatcagccgcgccggccaaagcagctacagctgttgttcttcaggcggaaaaggaactgcaaccctggatagccaaggatgacgatctaggtcagaagatgtggaggatcaatcagcggattgtaaaattgatagtggagcttatgaggaaccatgatagttccgagtcattggtaattctggcaagtgcatctgatttattactacgagccacagatgggatgcttgttgatggagaagcttgcactttaccacagctagagcttttggaagcaacagctagagcaattcagccggtgcttgagttcggagagccaggaatggctgtggcagatggcctttcaaaccttttaaagtgtcgtctagcagctacaattaggtgcctttgtcatccaagtgcacacgtccgcactttgagcgtctcagttcttcgtgatattttacatactggctcaatcaggtgtagtcctaaaccactgcgaattaatggcaaccacaacccctcttatccatacttcaagttggacgtcgttgattggcaagctgacatagaaaaatgcttgacatgtgaagctcacagccgaatttcagctggattgcctattaagtttcttgacactgctgccaaagaattaggctgtgctatttccatatgaaatggaaatgaaaccattttagtctgtgaccatttttcactaggacttacagagaaactatttatgattttggaactaacgggtttgcgtatacgcaaacatcattctgttagtcatcataaaaaatgcagtcatgattccagtttgtttatagaaagctcattttgtattatgtatgtgctctaattagacactgagcagacgttcaccatgaacttgctaatgactgtgcttttaatataacagacatgtacagttgtaaagacaagatgtaaccaggtttttttttattatcctcgtctcattttgtgtaatatatatatgttgatagagtttgtcatgaaattcaattctaattgttgtactaat

SEQ ID NO: 6407 - DNA, 4687 bp, Theobroma cacao
acctcttaaaattttccaagctaaggaaaaatacgtctttgccaaactgcagtttcttttttccttttagtaatacactcacattgtttatagcagagagttaaatctaaattaaaccaggagaaatatttagccgctcataccaaagcccagtaagaacatattttgattatcagttaaacagtaattcacaagttttacaaggcttgagaccgttagaggcagagactttgtggagactaataatactgttgtaaatttccagtccttttagagagagatgcaatagtttctcttgttgaattttctgcagagtggaagcttaggttctggtgtgtgttttgttggttgttccggtgattggttcaaaggggtatatttggaagatatatattgttcaagccacatggctagtccatctgagaggtggattgatggccttcagttctcatcactgttctggcctcctccacaagaccctcaacaacgaaaggttcaaattactgcatatgttgagtattttggtcaattcacatcagaacaattccctgaggatattgctgagcttgttcgcaaccgctatcctcacaaggaacagcgccttttcgatgatgttctggcaatgtttgttcttcaccatccggagcatgggcatgctgttgttcttcctattatttcatgcatcattgatggtacactggtgtatgataagagtacccctccctttgcttcattcatctccttagtctgcccaagtagtgagaatgagtattctgaacagtgggctctggcatgtggagagatcttacgaattctgactcattacaaccgtccaatatataagatggaacagcaaaatagtgagacagatagaagcaatagcagtggccaagctacgacaagtgaacctgtagatggtgaaccatcctttcatatacctttgatgcaacaggagagaaagcctttaaggcccttatctccctggattactgatatattgcttgcggcacctttgggtatcagaagcgattacttccgttggtgcagtggtgttatgggtaaatatgcagctggagacctcaagccaccttcaactgcttcttctcgtggatctggcaagcatcctcagcttatgccatcaactccaagatgggctgttgcaaatggtgctggtgtcattttaagtgtatgtgatgaggaggttgcacgctacgagactgctactttaacagctgcagcagtccctgcacttctacttcctcccccaacaacagctttggatgagcatctagttgctgggctaccagctcttgaaccgtatgcacgtttatttcatcggtactatgccatcgcaactccaagtgccacccaaagactccttcttggacttctagaagcaccgccatcatgggctccagatgcacttgatgctgctgtacagcttgtggaactccttcgagctgctgaagattatgctactggtataaggcttccacgaaattggatgcatttgcattttttgcgtgcaatagggactgcaatgtctatgagagcaggtattgctgctgatgctgctgcagctttactttttcgcatactatcacaacctgcactgctatttcctccactaaggcaagttgagggagtggaagttcaacatgaaccttctggtggttatatttcgtgttacaggaagcagatagaggtgcctgctgctgaagcaactattgaagctactgcccaagggattgcatcaatgctttgtgctcatggaccggaggtggaatggagaatttgtactatatgggaagctgcttatggcctgattccattgagctcttctgctgttgatcttccagaaattattgttgcaaccccattgcagcctgctatactatcatggaacctatatatacctcttcttaaggtactggaatacctcccacgtggaagtccttctgaagcatgtctcatgaagatatttgtggccactgttgaagcaattctccagagaacttttccacctgaatcctccagggtgcaaaccagaaaaacaagatacagcataggttctgcctccaagaaccttgctgtggctgagcttcgtacaatggtccattccctctttttagaatcatgtgcttctgtagagcttgcttcacgcctactttttgttgtcttaactgtgtgtgttagccatgaagctcaattcagtgggagtaagagaccgagatgtgaagaaagttatcctcctgatgagggcattgaggaatcacagtcaccatcagaaaggccgagagacataaaacctagaaaaacaaaaaaacaagggcctgtagctgcatttgattcttatgtgctggctgctgtttgtgctcttgcgtgtgagcttcagttgttccctttggttacaagaggaagtaatcattcaactgctaaagatgttcaagctatagctaagcctgcaaagttaaatggatcttctattgagtatggccatagtattgactcagctattcatcatactcacagaatcttggcaattttagaggcacttttttctctgaagccatcttctgttggcacctcatggagttacagttcaaatgaaatagttgctgcagctatggttgcagctcatgtttctgaactattcaggcggtcaaaggcttgcatgcatgcactctctgtcctaatgcgatgcaagtgggacaatgaaatttacaccagggcatcatcattatataatctcattgatattcacagcaaggctgttgcatccattgttaacaaggctgaaccattagaagcacaattgatacatgcacctgtttggaaggattcccccgtttgcttagatggaagaaaacaaaacaaacgtacaaataccacttgctttgatccagggcagtcatctgcttcagaatgtgaagattcaactcattcagacaagaatctcagatgtgagagagtgttagcatcagatgaaggctcaggaaattccttgggcaaaggaatagcaagttttcctttagatgcctcagatttggccaactttctcacaatggacaggcacataggattcaattgcagtgcacaaattcttctgagatctgtgcttgtggagaaacaagagttatgtttctccgttgtttcactattgtggcacaagctaatagcagcacctgaaacacaaccaagtgccgaaagcacatccgcccaacagggatggagacaggtggttgatgcattgtgcaacgtcgtatcagcatcaccgacaaaagcagccacagcagttgttcttcaggcggagagggagtttcagccttggattaccaaagatgatgatcaaggccagaagatgtggagaatcaaccagcggatcgtgaagttgatagtggaactaatgagaaatcatgatagcccagaatccttggtaattgtggctagtgcctctgatctacttctacgtgccacagatgggatgcttgttgatggggaagcttgcactttaccccagctggagctgctggaagcaacagctagagcagttcagccagtgttagagtggggagaatctggactggcagttgcagatggactttcaaacctgttaaagtgtcgtctaccagctacaactcgatgtctttctcatccaagtgcacacgttcgtgctctcagcacatcagtccttcgcaatattttgcatgcaggttcaattaaacctaattctaagcaggtggaaataaatggcatccatggtccctcttaccagtactttagtgtaggtgtcattgactggcacactgatattgaaaagtgcttaacatgggaagctcatagtcaacttgcaagaggaatgcctatacgatttctggatactgctgccaaagaattaggctgtagtatttctatataacatcaattaacttttcttcggattatcagtgtaagtatctttttctcttgaagcgagacaacaaagaggaatagactttttcaagtgggttgaaggatatgggtatgggcagaaatgtacctcttcaaatagtcctaggaatgaagcctttgaatgtcatgaaattgttcaagcaaaaggatggtgtatggtgaactgcctccctgaggtttcatgtgtctaatctgactttgctttaagcttagctttgtatgatataggcccaggtttcaatctattgtttggattcagttaacttggacagttattcggttagcatggagtgataaacccatacagcttctgctcagtttcaatttcggtttcttcctgtatttcagtgctttggatgtattgcttcctgtgtccttctcttgctggtaatattacaaaatacttcactcaaatttctttttttaaacactgctacatgctaaaacaaacataaatacatgataatattcttcttaaattgaaaaatgtatattttaaaaattttattgtaaaacaactgggtttcctaaaattattaaaagaaaaaatccgaagttggagtaacaatgaggattgcttgtcattaaaaataaaaaatattttatgattctaaaagaagaagttttggccatacaaggacaacccaaaaagaaaaatcagataaatctaaatcttgtaccgagatgaataagaattaagagcccctgatacaaggttacctccaatattacccat

SEQ ID NO: 6408 - DNA, 4135 bp, Castanea mollissima
caacatctctctctttcttatatttctcacaccaaaagcaaaatagagaaaaaaaaaaaaaggaaagagttttatttttctcattttacatcacagtatttcagagttaaaaatatctcaagattttttgtccttcagatatcagcttccagggaggtacctgtagagggttttgaattttgttgtcggttttgggagttgtggagctcaatccgtggtttgtgatcgatcttatgaccacatcgggccggcctccgggccctgatgttgaattacagcgttttgattattgattgttagctaatttgattgtgtattaagagagcataagtttgcttaatggctggttcatgtgagaggtggattgatcgtcttcaattctcctcattgttctggcctcccccgcaagatgcccaacaacgaaaggctcaaattactgcttatgttgagttctttggtcaatttacatcagaacaatttccagaggacattgctgagttgatccgtaaccgttatccgtcaaaggaaaagcgcctttttgatgacgttttggctacttttgtccttcatcatccagagcatgggcatgctgttgttcttccaattatttcatgtatcattgatggtacattggtgtatgataggaccagttctccatttgcttctttcatatcattggtctgcccaagcagtgagaatgagtactctgaacagtgggctctggcatgtggggagattttgcgagttttaactcactacaatcgcccaatatacaagatggaacaacagaatagtgattcagaaagaagcagtagtggctgccatgctaccactagtgactcttgcggggaatccagccaccatattcctttgttacagcaagagaggaaacctttaaggcctttgtctccctggattacagatatattgctggctgcacctcttggtatccgaagtgactatttccgatggtgcagtggtgttatgggtaaatatgctgctggagaactcaagccacctacgactgcttcttctcgtggatctggaaagcatcctcagcttatgccatcaactccaaggtgggctgttgcaaatggtgctggtgtcattttaagtgtttgtgatgaggaagttgctcgctatgaaactgctactttaacggcggccgctgtccctgcgcttctgcttcctcctccaacaacagctttggacgagcatctagttgctgggctaccagctcttgagccatatgcacgtttatttcataggtattacgccattgccacaccaagtgccacacagagacttcttcttggacttcttgaagcacctccgtcatgggctccagatgcacttgatgctgctgtccagcttgtagaactccttcgggctgctgaagactatgcatctggcataaggcttcctcggaactggatgcatttgcatttcttgcgtgccattgggactgcaatgtccatgagagcaggtatagctgctgatgctgcagcagctttacttttccgcatactctcacagcctgcattgctttttcctccactaaggcaagttgagggagttgaagttcaacatgaacctttgggcggttatatttcaagctataaaaagcagatagaagtgcctgcggctgaagcgacaattgaagctactgcacaagggattgcatcaatgctttgtgcccatggccctgaggttgaatggagaatttgtaccatatgggaagctgcctatggcctgattccattaagttcctctgcagttgatcttcctgaaatcatagttgcaactccattgcaaccccccatattatcatggaatctgtacatacctctccttaaggtcctggaataccttcctcgtggaagtccatctgaagcatgtctcatgaaaatttttgttgctactgttgaagcaattcttcagagaacttttccatctgagtcctctaaagaacaaaccaggaaaacaagatacctttatggcatagggtctgcctccaaaaaccttgctgtggcagagcttcgtaccatggtccattcacttttcttagaatcatgtgcctctgtagagcttgcttcacgcctactttttgttgtgttgactgtgtgtgttagtcatgaagctcagtcgaatgggagcaagagaccgagaggtgaagaaagttttccatctaatgaaagcgttgaggactcacaagtgatatctgaaaggcaaagagagatgaaaactaggaagttgaaaaagcaagggcctgtagcggcgtttgattcatatgttctagctgctgtttgtgctcttgcctgtgagcttcagttatttcctctaatttcaagggcgagtagtcacccaaactctaaagatgtttcagatgttgtcaagcctgtgaaaataaatggatctagtgatgagtttcgaaatagtattgactctgcaattcgtcatactcacagaatcttagcaattttagaagcacttttttcactgaagccctctactattggcacctcatggagttatagttcaaacgagatagttgctgcggcaatggttgccgctcatatttctgaactatttagacggtcaaaggcttgcatgcatgctctctctgtattgatgcgttgcaagtgggacaatcaaatttacaccagggcatcatcactatacaacctcattgatattcatagcaaagctgttgcatccattgttaacaaggctgagccactagaagcacacttgatacatgcaccattgtggaagaagtccctcctgaattctgatggcaaaagacgaagtcaacgtgaaaacagtgtttgctttgatcccggacagtcatctactccacagtctttggattcagcccattcagatactaaatttagggcatcacatccaaatgaaggctcaggaaataccttgggtaaaggtattgcaaatttaccattagatgcttcagatttagccaacttcctcacaatggataggcatataggatttaattgcagtgcccaagttcttctaagatcagtgctgccagagaaacaagaattatgtttctctgttgtttcattgctgtggcacaagttgattgcagctcctgaaattcaacctagtgcagaaagcacttctgcccaacaaggatggaggcaggttctagatgcgctatgcaatgtcgtatcagcatcacctacaaaagcagctacagcagttgttcttcaggcggatagggaattacaaccttggattgccaaagacgatgatcaaggtcagaagatgtggagaatcaaccaacgaattgtaaaactgattgtggagctaatgagaaatcacgataggccagaatcattaatgattttggcaagtgcttcagatctgcttctgcgcgccacagatgggatgctcgttgatggagaagcttgcactttaccacaactagagttactggaagcaacagccagagcggttcaacccgtgctggagtggggagaatctggactggcagttgcagatggcctttcaaacctcttaaagtgccgcctatcagctaccatccgatgcctttctcatccaagtgctcatgttcgtgctctgagcacatcagttcttcgtgatattttgcacactggttcaattaagtctaattcgaaaccagtggacataaatggcatgtctggtcccccttatcagtattttagtttaggtgtaattgactggcaagatgacattgaaaagtgcttaacatgggaagctcatagcagactcgcaactggaatgtctattgaatttcttggtacggctgccaaggaattagactgtagtatttccttataacatcaggtagcttttgccagccattttaggtttatgactatatttttcctagtgagacttagaatcatacattatttatttgcttgaacgacgtgggtttgcaggttggtaattatgcattctgttgtagatataaaagcctgagactgtcaattacagtgatttctatacataacaatccttctgcaagtattatagcgtacattgagtagatagggccacagttagtctttatttcttgtctaatatttattccaatataattacttatttttttcttctttcttaa

SEQ ID NO: 6409 - DNA, 4131 bp, Glycine max
acgcgggcacagagcttctctgaactctcctcttaaagatcttctcttctcttggcttcctttttggctctctgtcaccataagtaaccaccaaatcttttctttcatgaaattctattattattcacacaaaggaggaaaaatcaacacgaagatctcattctcgcagctgcaccgtttcaccttctaaatcagagtaccgttttttcatcagatccgtatacaaaactcctcagggaatgttgaattacgatattttaattcttgattggtagccggttttggctggatttgggttgttggtttttatatcagaaggagaaaggaataggttgagagttgaaagtgaaagtaaatttctgtttcaatggctgctgcttctggtgaaaggtggatggaccgtcttcagttttcctcattgttctggcctcccccactagatgatcaacaaagaaaggatcaagttgctgcgtatgttgaatacattggccaatttacatcagaacaattttctgaggatattgctgagttgatccgcaaccattatccatcaaaagaaatgctcctctttgatgatgtataggcggtacttgttcttcatcatccagagcacgggcatgcagttgtgcttccaattatttcatgtattattgatggtacgctggactatgataagactagtcctccatttgcttctttcatttctttagtctgcccaaaaaatgagaatgaatattcagaacaatgggctatggcatgtggtgaaattttgcgtattttaactcattacaatcgccccatatacaaaatggaaaggcaatattgtgaaccagaagtaagcagtggcaaaagtcatgcaacgactaatgattctgtagatggggagtctggccataattctttgatgcagcaggagaagaaacctataagacccttgtccccttggattactgatatattacgagctgcacctttaggcattagaagtgactattttcggtggtgcagtggtgttatgggtaaatatgctgcaggagaactcaagccacctactattgtttctgctcgcggttctgggaagcatcctcaactcgtgccatcaactccaagatgggcagttgctaatggtgctggtgttatattaagtgtttgtgatgatgaagttgctcgttatgagactgctactttaacagcagctgctgtcccggcactcctacttcctcctccaacaacagctttggatgagcatctcgttgctggattaccggctctagaaccatatgcacgtttatttcacagatattatgccattgcgactcctagtgcaactcaaagactacttcttggacttttagaagcacccccatcatgggctccggatgcccttgatgctgctgtgcagcttgtagagcttcttcgagctgctgaagattatgcttgtggaataaggcttcctagaaattggatgcattttcatttcttgcgtgctatagggactgcaatgtccatgagatctggtgtagctgctgatgctgcagctgcattgcttttccggatactttctcagcctgctttacttttccctccactaaggcaagttgatggagtcgaagttcaacatgaacctttgggtggatacatttcttccaatagaaagcagattgaagctgcttcagccgaagccactattgaagctacggcccaaggcattgcctcagtgctttgcgctcatggtccagaggtagagtggagaatttgtaccatttgggaagctgcttatgggttgattccattaaattcctcagctgttgatcttccagaaattgttgttgcaacaccacttcaacctcccatactctcatggaatttgtacatacccctactcaaggttctggaatatcttcctcgtggtagtccgtctgaagcatgtctcatgaaaatatttgttgctacagtggaagctattcttcagaggacatttccagctgagtccactagtgatcacaaaataaaaacaagatactattgtgtggggtctgcctccaaaaaccttgctgtggcagaacttcgtaccatggtgcattcgcttttcttagaatcatgtgcatctgttgagcttgcttcgcgcctactatttgttgtcttaacagtttgtgttagtcatgaggtccaattcaatggaagcaagaaaccaagaggtgaaaataattatttagtggaggaaattattgaggatttacaagcagtatctgaaagccagaaagaaacaaaaaataggaaaatgaagaagcaaggtcctgtagcggcatttgattcctatgttctggctgccgtttgtgctcttgcctgtgagcttcagctgttccctatgatctcacgaggagacaatcactcagtccccaacaatgtacaaaatatagccaagcctgtcaaaatagatggatcttcccatgcattgcagaatggcatagattcagcaatacgccatactcacagaattttagcaattttagaggcgctgttttcattgaagccatcttctgttggtacctcatggagttacagctcaaatgaaatagttgcagctgctatggttgctgcacatatttctgaactatttagacggtcaaaagcttgcatgcgtgctctgtctgttttgatgcgttacaaatgggatgatgaaattcactctagggcttcgtcattgtacactctcatagatattcacagaaaagcagttgcatccatagttaacaaggcagagccattgggagcaacctttattcatacccctatttgtaaagacccctgtgatagaagtaaaagaaaaaatcagtgtgaaaatagtaggtgccttgatcctgggcagacatctacttcgacttctgaggattcatcccgctcaaaattcagcaaaaaaagtgagagaacttcatattcaaatgaagcatcaggatgtacctttgaaaaagctaccacaagtctcccatttgatgcttctgatctagccaatttcttaactatggacaggcatataggatttaattgcagtgcccaaatttttctgagatcgaggcttgcagagaagcaacagttatgtttctctgtagtatcactactatggcagaagttgattggatctcctgaaactcaaccttgtgcagaaagcacttctgctcaacaggggtggagacaggttgctgatgcattatgcaaggttgtatctgcatctcctacgaaagcagctatggcagttgttcttcaggccgagaaggaattgcagccatggattgccaaagatgacaatctaggtcagaagttgtggagaatcaatcagcggattgtaaaattgataactgaactattgaggaatcatgataatttggaatcattagtaattgtggcaagtgcatcagatttactactacgagccacagatggaatgctggtggatggagaagcttgcactttaccacagctgaagctattggaagcaacggcgaaagcggttcaaccagtgattgagttgggagaatctggacttggagtggcagatgggctttcaaacctgttaaagtgtcgcctaccagctacaatcagatgcctttctcatccaagtgcacatgtccgtgctctgagcagttcggttattcgtgacattttgcatactagttcaattggatcgagtcctaagccactgcaaaagaatggcatccatgatcagtacttaaattttgatgtcattgactggcgagctgacgtagaaaactgcttgacatgggaagctcacagccggctttcaaatggattgtctattgaatatcttaacacagctgcggatgatttaggctttgctatttctatctgaaatgaaatgagaccatatgtaatcatcttagtaatttatgtttaggaacttaaattaagcttttcatgacagatattatctcaagatttgtataaaaccttgatgtaatctatgtttaggaacttaaatggtttgcaaataagtaaaccttctcattctgctagtttttgttagtaagtcacaagctagaaattgttatcccatctctctttttcccaaacacgacttcaagcaatgatgaccgtatatagaaactagtttcg

SEQ ID NO: 6410 - DNA, 4128 bp, Glycine max
actctcctcttaaagatcttctcttctcttggcttcctttttggctctctgtcaccataagtaaccaccaaatcttttctttcatgaaattctattattattcacacaaaggaggaaaaatcaacacgaagatctcattctcgcagctgcaccgtttcaccttctaaatcagagtaccgttttttcatcagatccgtatacaaaactcctcagggaatgttgaattacgatattttaattcttgattggtagccggttttggctggatttgggttgttggtttttatatcagaaggagaaaggaataggttgagagttgaaagtgaaagtaaatttctgtttcaatggctgctgcttctggtgaaaggtggatggaccgtcttcagttttcctcattgttctggcctcccccactagatgatcaacaaagaaaggatcaagttgctgcgtatgttgaatacattggccaatttacatcagaacaattttctgaggatattgctgagttgatccgcaaccattatccatcaaaagaaatgctcctctttgatgatgttttggcggtacttgttcttcatcatccagagcacgggcatgcagttgtgcttccaattatttcatgtattattgatggtacgctggactatgataagactagtcctccatttgcttctttcatttctttagtctgcccaaaaaatgagaatgaatattcagaacaatgggctatggcatgtggtgaaattttgcgtattttaactcattacaatcgccccatatacaaaatggaaaggcaatattgtgaaccagaagtaagcagtggcaaaagtcatgcaacgactaatgattctgtagatggggagtctggccataattctttgatgcagcaggagaagaaacctataagacccttgtccccttggattactgatatattacgagctgcacctttaggcattagaagtgactattttcggtggtgcagtggtgttatgggtaaatatgctgcaggagaactcaagccacctactattgtttctgctcgcggttctgggaagcatcctcaactcgtgccatcaactccaagatgggcagttgctaatggtgctggtgttatattaagtgtttgtgatgatgaagttgctcgttatgagactgctactttaacagcagctgctgtcccggcactcctacttcctcctccaacaacagctttggatgagcatctcgttgctggattaccggctctagaaccatatgcacgtttatttcacagatattatgccattgcgactcctagtgcaactcaaagactacttcttggacttttagaagcacccccatcatgggctccggatgcccttgatgctgctgtgcagcttgtagagcttcttcgagctgctgaagattatgcttgtggaataaggcttcctagaaattggatgcattttcatttcttgcgtgctatagggactgcaatgtccatgagatctggtgtagctgctgatgctgcagctgcattgcttttccggatactttctcagcctgctttacttttccctccactaaggcaagttgatggagtcgaagttcaacatgaacctttgggtggatacatttcttccaatagaaagcagattgaagctgcttcagccgaagccactattgaagctacggcccaaggcattgcctcagtgctttgcgctcatggtccagaggtagagtggagaatttgtaccatttgggaagctgcttatgggttgattccattaaattcctcagctgttgatcttccagaaattgttgttgcaacaccacttcaacctcccatactctcatggaatttgtacatacccctactcaaggttctggaatatcttcctcgtggtagtccgtctgaagcatgtctcatgaaaatatttgttgctacagtggaagctattcttcagaggacatttccagctgagtccactagtgatcacaaaataaaaacaagatactattgtgtggggtctgcctccaaaaaccttgctgtggcagaacttcgtaccatggtgcattcgcttttcttagaatcatgtgcatctgttgagcttgcttcgcgcctactatttgttgtcttaacagtttgtgttagtcatgaggtccaattcaatggaagcaagaaaccaagaggtgaaaataattatttagtggaggaaattattgaggatttacaagcagtatctgaaagccagaaagaaacaaaaaataggaaaatgaagaagcaaggtcctgtagcggcatttgattcctatgttctggctgccgtttgtgctcttgcctgtgagcttcagctgttccctatgatctcacgaggagacaatcactcagtccccaacaatgtacaaaatatagccaagcctgtcaaaatagatggatcttcccatgcattgcagaatggcatagattcagcaatacgccatactcacagaattttagcaattttagaggcgctgttttcattgaagccatcttctgttggtacctcatggagttacagctcaaatgaaatagttgcagctgctatggttgctgcacatatttctgaactatttagacggtcaaaagcttgcatgcgtgctctgtctgttttgatgcgttacaaatgggatgatgaaattcactctagggcttcgtcattgtacactctcatagatattcacagaaaagcagttgcatccatagttaacaaggcagagccattgggagcaacctttattcatacccctatttgtaaagacccctgtgatagaagtaaaagaaaaaatcagtgtgaaaatagtaggtgccttgatcctgggcagacatctacttcgacttctgaggattcatcccgctcaaaattcagcaaaaaaagtgagagaacttcatattcaaatgaagcatcaggatgtacctttgaaaaagctaccacaagtctcccatttgatgcttctgatctagccaatttcttaactatggacaggcatataggatttaattgcagtgcccaaatttttctgagatcgaggcttgcagagaagcaacagttatgtttctctgtagtatcactactatggcagaagttgattggatctcctgaaactcaaccttgtgcagaaagcacttctgctcaacaggggtggagacaggttgctgatgcattatgcaaggttgtatctgcatctcctacgaaagcagctatggcagttgttcttcaggccgagaaggaattgcagccatggattgccaaagatgacaatctaggtcagaagttgtggagaatcaatcagcggattgtaaaattgataactgaactattgaggaatcatgataatttggaatcattagtaattgtggcaagtgcatcagatttactactacgagccacagatggaatgctggtggatggagaagcttgcactttaccacagctgaagctattggaagcaacggcgaaagcggttcaaccagtgattgagttgggagaatctggacttggagtggcagatgggctttcaaacctgttaaagtgtcgcctaccagctacaatcagatgcctttctcatccaagtgcacatgtccgtgctctgagcagttcggttattcgtgacattttgcatactagttcaattggatcgagtcctaagccactgcaaaagaatggcatccatgatcagtacttaaattttgatgtcattgactggcgagctgacgtagaaaactgcttgacatgggaagctcacagccggctttcaaatggattgtctattgaatatcttaacacagctgcggatgatttaggctttgctatttctatctgaaatgaaatgagaccatatgtaatcatcttagtaatttatgtttaggaacttaaattaagcttttcatgacagatattatctcaagatttgtataaaaccttgatgtaatctatgtttaggaacttaaatggtttgcaaataagtaaaccttctcattctgctagtttttgttagtaagtcacaagctagaaattgttatcccatctctctttttcccaaacacgacttcaagcaatgatgaccgtatatagaaactagtttcgtattatgcttgttatgttta

SEQ ID NO: 6411 - DNA, 4021 bp, Gossypium hirsutum
agtggaagcataggtcctggtgtgttgttgttgattattctggtgattgattcaaaaaggtatacttggaagataaatattgtttactctaaatggctaatccatctaagaggtggattgacggtcttcagttctcatcgctgttctggccaccgccgcaagaccctcaagaacgaaaggttcaaattactgcatatgtcgagtattttggtcagttcacatcagaacaattccctgaggatattgctgagcttattcgcagccgctatccatctaaggagcaacgcctttttgatgatgttctggcaacttttgtccttcaccatccagaacatgggcatgcagttgttcttccaattatttcaggcatcattgatggttcgctggtgtatgataagagttccttgccctttgcgtcattcatctccttagtttgcccaagtagtgagaatgagtattctgaacagtgggctctagcatgcggagagatcttgcgaattctgactcattacaaccgtccaatatataaaatggagccacaaaataatgaaacagatagaagccacagcagcagccaagctacgacaagtgaatctgtagatggggaaccatcctttcagatacctttgatgcaacaggagaggaagcctttaaggcctttgtctccctggattactgatatattgctcgctgcacctctgggtataagaagtgattacttccgttggtgcagtggtgttatgggcaaatatgcagctggagacctcaagccacctactactgcttcttctcggggatctggaaagcatcctcagcttatgccatcaaccccaagatgggccgttgcaaatggtgctggtgtcattttaagcgtctgcgacgaagaggttgcacgctacgaaactgctagtttaacggctgcagcagtccctgcacttctacttcctcccccaacaacagctttggatgagcatctagttgctgggttaccggctcttgaaccatatgcacgtttatttcatcggtactatgccattgcaactccaagtgcgacccaaagacttcttcttgggcttcttgaagcaccaccatcatgggctccagatgcacttgatgctgctgtacagcttgtggaacttcttcgtgctgccgaagattatgcaactggtataaggcttcctcgaaattggatgcatttgcactttttgcgggcaattgggactgcaatgtctatgagggcaggtattgctgctgatgctgctgcagctttactttttcgcatactttcacagcccgcactactttttcctccaataagacaagttgagggagtagaagttcaacatgaaccttctggtggttatatctcatgttacagaaagcagattgaggtgcctgcagctgaagcaactattgaagctactgctcaagggattgcatcaatgctttgcgctcatggaccggaggtggaatggagaatatgtacaatatgggaagctgcttatggtctgattcccttgagctcttcagctgttgatcttccagaaattattgtttcaaccccattgcagcctcccatactatcatggaatctatacatacctcttcttaaggtgctcgaataccttccacgtggaagtccttctgaagcatgtctcatgaagatattcgtggcgactgtagaggctattcttcagagaacatttccacctgaatcccccagggagcaaaccagaaaaacaagatacagcataggttctgcctcaaagaatcttgctgtggcagagcttcgtacaatggtgcattcgctgtttttagaatcatgtgcttctatagagctcgcttcacgcctactttttgttgtcttaactgtgtgtgttagtcatgaggctcagttcagtgggagtaagagaccaagaggtgaagaaagttatccctctgatgagggcattgaggagtcacaggcacaatctgaaaagctgaaagacattaaacctagaaaagcaaaaaaacaagggcctgtagctgcatttgattcttatgtgctggctgctgtctgtgctcttgcctgcgagcttcagttgttccccctagttacaagaggaaatacgcattcaactgctaaagatgttcaagctatggccaaccctgcaaaagtaaatggatcttctatagagtatggacatggtattgactctgctattcatcacactcacagaatattagcaattttggaggcacttttttcgctgaagccatcttctgttggcacctcatggggttatagttcaaatgaaatagttgctgcagctatggttgctgctcatatttctgaactatttagacggtcaaaggcttgcatgtatgcactctctgttctaatgcgctgcaagtgggacaatgaaatttacaccagggcatcatcgttatataatctcatcgatattcacagcaaggctgttgcatccattgttaacaaggccgaaccattagaagcacaattgatatatgcacctgttagaaaatattccccttgtttagatgacagaaaacaaaacaagtgttcaagtgccacttgctttgatcctgggcaatcatctgcttcagaatgtgaagattcaacttgttcagacaataatctcagatctgagaaactgttagcatcagatgaaggcttaggaaattctttgggcaaaggtatagcaggtttcccattagatgcctcagatttggccaattttctcaccagggaccggcacataggattcaattgcagtgcacaaattcttctgagatcagtgcttgtggagaaacaagagttatgtttctctgtagtttcactactgtggcacaagctgatagcagcgcccgaaacacaacccagtgccgaaagcacatctgcccagcagggatggagacaggtggttgatgcgttgtgcaatgtcgtatcagcatcaccgacaaaagcaactacagctgttgtacttcaggcggatagggaattgcagccttggattgccaaagatgacgaccaaggtcagaagatgtggagaatcaaccagcgaattgtaaaattgatagtcgagctgatgagaaatcatgatagcgcagaatcattggtcattgtggcaagtgcttctgatctacttctacgtgccacagatggtatgcttgttgatggggaagcttgtactttaccacaactggagctgctggaagcaacagctagagcagttcagccggtactcgagtggggagaatcaggactggcagtagcagatggactttcaaacctgttaaagtgtcgtctaccagctacgactcgatgcctttctcatccaagcgcacatgttcgagctctcagcacatcagtccttcgcaatattttgcatataggttcaatcaattcaaaatctaaggtggaaatatatggtatccgtggtccctcttaccagttcttcaatataggtgccatcaactggcaaaatgatatcgaaaagtgcttaacatgggaagtttatagtcagcttgcaagaggaatgactatacagttcctcgacactgctgccaaagaattaggatgtaatatttccatataacatcgattaactttcggattatcagtataaataccctttttctttttttaaaactgagaatacaaagaagacttagacttgcttcaaattgcttgaaccacatggttggggcagaaaatgcagctcatcgagtagtcctaggggatgaggatgaaggctttgaatgccatgaaactcttcaagcaaggttagtgtatgataaaaatgccacactgaggtttcatgtgtctaatcttactttgctttaagcttagctttgtaagatatttagactgagttttcgatttgtttgtcggattacgatatttaatttcagtttaacttagtttatttcattagaatgatgaactgattggatgattcagttttttcttcagcatatatcagtacatgtttagtcattgtttttggctgctttattt

SEQ ID NO: 6412 - DNA, 4518 bp, Gossypium raimondii
ttctttattattttattacaacttggtttgtcgttttctattttttaatctcccaagtcccaacttcgacacgttaaaggccaacaccgtaattctcaaaacctcgtatgtaagctatgtagtattcatgccatcaccatgggatggatgggggtatcatgcatggtgacatgacatggggagtctgcgagacgagaggaaaatatcattgccacgtcatcagcaatcttaagcgaacggcccttctaaagatctcctctttctctctctcactcaccaaaaactgtaccacctcctcatattttccataaattttatttatttttcctttaaatttactgtcacatttgtttaaaacagagcgttaaatctaaattaattcaggaaaatatttagcatctgataaccgaagcccagggttgtgatgttgaattacgaaatcttgattcttgactggtagcagttgcagagtggaagcataggtcctggtgtgttgttgttgattattctggtgattgattcaaaaaggtatacttggaagataaatattgtttactctaaatggctaatccatctaagaggtggattgacggtcttcagttctcatcgctgttctggccgccgccgcaagaccctcaagaacgaaaggttcaaattactgcatatgtcgagtattttggtcagttcacatcagaacaattccctgaggatattgctgagcttattcgcagccgctatccatctaaggagcaacgcctttttgatgatgttctggcaacttttgtccttcaccatccagaacatgggcatgcagttgttcttccaattatttcaggcatcattgatggttcgctggtgtatgataagagttccttgccctttgcgtcattcatctccttagtttgcccaagtagtgagaatgagtattctgaacagtgggctctagcatgcggagagatcttgcgaattctgactcattacaaccgtccaatatataaaatggagccacaaaataatgaaacagatagaagccacagcagcagccaagctacgacaagtgaatctgtagatggggaaccatcctttcagatacctttgatgcaacaggagaggaagcctttaaggcctttgtctccctggattactgatatattgctcgctgcacctctgggtataagaagtgattacttccgttggtgcagtggtgttatgggcaaatatgcagctggagacctcaagccacctactactgcttcttctcggggatctggaaagcatcctcagcttatgccatcaaccccaagatgggccgttgcaaatggtgctggtgtcattttaagcgtatgcgacgaagaggttgcacgctacgaaactgctagtttaacggctgcagcagtccctgcacttctacttcctcccccaacaacagctttggatgagcatctagttgctgggttaccggctcttgaaccatatgcacgtttatttcatcggtactatgccattgcaactccaagtgcgacccaaagacttcttcttgggcttcttgaagcaccaccatcatgggctccagatgcacttgatgctgctgtacagcttgtggaacttcttcgtgctgccgaagattatgcaactggtataaggcttcctcgaaattggatgcatttgcactttttgcgggcaattgggactgcaatgtctatgagggcaggtattgctgctgatgctgctgcagctttactttttcgcatactttcacagcccgcactactttttcctccaataagacaagttgagggagtagaagttcaacatgaaccttctggtggttatatctcatgttacagaaagcagattgaggtgcctgcagctgaagcaactattgaagctactgctcaagggattgcatcaatgctttgcgctcatggaccggaggtggaatggagaatatgtacaatatgggaagctgcttatggtctgattcccttgagctcttcagctgttgatcttccagaaattattgtttcaaccccattgcagcctcccatactatcatggaatctatacatacctcttcttaaggtgctcgaataccttccacgtggaagtccttctgaagcatgtctcatgaagatatttgtggcgactgtagaagctattcttcagagaacatttccacctgaatcccccagggagcaaaccagaaaaacaagatacagcataggttctgcctcaaagaatctcgctgtggcagagcttcgtacaatggtgcattcgctgtttttagaatcatgtgcttctatagagctcgcttcacgcctactttttgttgtcttaactgtgtgtgttagtcatgaggctcagttcagtgggagtaagagaccaagaggtgaagaaagttatcctcctgatgagggcgttgaggagtcacaggcacaatctgaaaagctgaaagacattaaacctagaaaagcaaaaaaacaagggcctgtagctgcgtttgattcttatgtgctggctgctgtctgtgctcttgcctgcgagcttcagttgttccccttggttacaagaggaaatactcattcaactgctaaagatgttcaagctatggccaaccctgcaaaagtaaatggatcttctatagagtatggacatggtattgactctgctattcatcatactcacagaatcttagcaattttagaggcacttttttcgctgaagccatcttctgttggcacctcatggggttatagttcaaatgaaatagttgctgcagctatggttgctgctcatatttctgaactatttagacggtcaaaggcttgcatgtatgcactctctgttctaatgcgctgcaagtgggacaatgaaatttacaccagggcatcatcgttatataatctcatcgatattcacagcaaggctgttgcatccattgttaacaaggccgaaccattagaagcacaattgatatatgcacctgttagaaaatattccccttgtttagatgacagaaaacaaaacaagtgttcaagtgccacttgctttgatcctgggcaatcatctgcttcagaatgtgaagattcaacttgttcagacaataatctcagatctgagaaactgttagcatcagatgaaggcttaggaaattcattgggcaaaggtatagcaggtttcccattagatgcctcagatttggccaattttctcaccagggaccggcacataggattcaattgcagtgcacaaattcttctgagatcagtgcttgtggagaaacaagagttatgtttctctgtagtttcactactgtggcacaagctgatagcagcgcccgaaacacaacccagtgccgaaagcacatctgcccagcagggatggagacaggtggttgatgcgttgtgcaatgtcgtatcagcatcaccgacaaaagcaactacagctgttgtacttcaggcggatagggaattgcagccttggattgccaaagatgacgaccaaggtcagaagatgtggagaatcaaccagcgaattgtaaaattgatagtcgagctgatgagaaatcatgatagcgcagaatcattggtcattgtggcaagtgcttctgatctacttctacgtgccacagatggtatgcttgttgatggggaagcttgtactttaccacaactggagctgctggaagcaacagctagagcagttcagccggtactcgagtggggagaatcaggactggcagtagcagatggactttcaaacctgttaaagtgtcgtctaccagctacgactcgatgcctttctcatccaagcgcacatgttcgagctctcagcacatcagtccttcgcaatattttgcatataggttcaatcaattcaaaatctaaggtggaaatatatggtatccgtggtccctcttaccagttcttcaatataggtgccatcaactggcaaactgatatcgaaaagtgcttaacatgggaagtttatagtcagcttgcaagaggaatgactatacagttcctcgacactgctgccaaagaattaggatgtaatatttccatataacatcgattaactttcggattatcagtataaataccctttttctttttttaaaactgagaatacaaagaagacttagacttgcttcaaattgcttgaaccacatggttggggcagaaaatgcagctcatcgagtagtcctaggggatgaggatgaaggctttgaatgccatgaaactcttcaagcaaggttagtgtatgataaaaatgccacactgaggtttcatgtgtctaatcttactttgctttaagcttagctttgtaagatatttagactgagttttcgatttgtttgtcggattacgatatataatttcagtttaacttagtttatttcattagaatgatgaactgattggatgattcagttttttcttcagcatatatcagtacataaaatgtttagtcattgtttttggctgctttatttatattattaacctcgttgcttaa

SEQ ID NO: 6413 - DNA, 4273 bp, Vitis vinifera
gcttacacaaataaaaatcttagctttcatctccagagggaaaagcacagaaaaatcggggaatcagtgtgggagagtttccggaatttctaaattctcacacggaagaatcagaatatctgtttgtaccatacaaaatcagtgtaaattgaatctatgaatgtttactgttcagaggcaaggaggaatttgtagttgggacaggaacactggtgaaaattaatttttttttgttgggagagtacgatattttggtacttgattggtagctgtcgaagtggaagttagtggcttttagtgttggttctgttgtgtgttacttcttgtaattggcatcaaaggaagatatttatatggctagttcatgtgaaagatggatcgatggtctccaattctcctcattgttctggcctcccccgcaagatgtgcagcaacggaaggctcaaattactgcctatgttgactacttcggtcagttcacatcagaacaattccctgaagatattgctgagttgattcggagccgttatccgtcaaaggaacagcgcctttttgatgatgtcttggcaacgtttgttcttcatcatccggaacatgggcatgctgtcgttcttccaattatttcgtgtatcattgatggtacactggtgtatgataggtgtactcctccttttgcctctttcatttccttggtctgcccaagcagcgagaatgagtattctgaacaatgggctctggcatgtggggagattttgcgaattttaactcattacaatcgcccaatttacaaggtggaacatcagagcagtgaagcagatagaagcagcagtggcaggcatgctacaacaagtgactctgtagatgggaaatcctctcaaggaccgttactacaaaatgagaggaaaccttcaaggcctttgtctccctggattactgatatattgcttgctgcacctctgggtatcagaagtgactactttcgttggtgcggcggtgttatggggaaatatgcagctggagaactaaagccaccttcaactgcttctactcgtggatctggaaagcacccccagctcattccatcaactccaaggtgggctgttgctaatggtgcaggtgtgatattaagtgtttgtgatgaagaagtagctcgctatgagactgcaactttaacagcagctgcagttcctgcacttctgcttcctcctccaacaacagctttggatgagcatctagttgctgggcttccagccctggagccatatgctcgcctatttcatcgctactatgcaattgctactccaagtgccacacaacgacttcttctaggactactggaagcaccaccatcatgggctccagatgctcttgatgctgcagtacagcttgtggaacttcttcgggcagctgaagattatgcatcaggcatgaggctcccaaggaactggatgcatttgcatttcttgcgtgcaattggtactgcaatgtccatgagagcagggattgctgcagatgctgctgcagcattactttttcgcgtactttcacagcctgcattgctttttcctcctctaagacaagtcgaaggatttgaatttcagcatgaacctttagatggttatatttcatcctacaagaagcagatagaagtgcctgcaactgaagcaactattgaagccactgcccaagggattgcatcaatgctttgtgcacatggtcccgaggttgaatggagaatttgcaccatatgggaagctgcttatggcctaattcctttaagttcctcagctgttgatcttcctgaaattatagttgcaaccccattgcaacctcccattttatcatggaacctttatataccccttcttaaagtcctggaatatcttcctcgtggaagtccatctgaagcatgtctcatgaagatatttgttgctacagtggaatcaattcttcagaggacatttccagctgagtcctccagagaaaatatcagaaaaacaagatacctttttggaatagggtctgcctccaaaaacctggctgtggctgagcttcgtacaatggtccatgcactatttctagaatcatgtgcatctgtagagcttgcttcacgccttctttttgttgtgttaaccgtttgtgtcagtcatgaagctgctcagcagaatggaagcaaaagaccaagaggtgaagatagccatctttctgaggaaatcaccgaggacttgtcagatgcatctggaaatcagagagacacgaaaaccagaaaaatgaaaaaacaagggcctgtagcagcttttgattcttatgttcttgctgctgtttgtgctcttgcatgtgaacttcaattattccctttgattgctaggggaactaatcattcagcctctaaagatgtacagatcagagcaaagcctgcaaaattaaatggatcttctagtgaattccgcaatagcattgactctgccattcgtcatacccacagaatattagcaattttagaggcactcttttcactgaagccatcttctgttggcacctcttggagttacagttcaaatgaaattgttgctgctgctatggttgctgctcatgtttctgaactattcagacgatcaaaagcttgtatgcatgccctctctgtcttgatgagatgcaagtgggatgaagaaatctacaccagggcttcttcactctataacctcattgacattcatagcaaagctgttgcatccattgtcaacaaggcagaaccactagaagcacacttaattcatgcaacagtttggaaggacagccctgggcataaagatggcagcaaagaaaatgactgtgcaagcactagctgcttcaaatcagtgaatcccttgcttctgcactctgaagattcagcttattcaaaaagtttacctaaatttgagaaagcaccacatttaaatgaaggcacaggaaatagcttgggtaaaggtattgcaagcttcccattagatgcttcagaattggccaatttcctcactatggacaggcatataggatttagttgcagtgcacaagttcttctaagatcagtactcgcagagaaacaagagttatgtttctctgttgtttcacttctttggcacaagttaattgcagccccagaaacaaaacctagcgcagaaagcacttctgcccaacaaggatggagacaggtggttgatgcgctatgcaacgtcgtatcagcatcaccggcaaaagcagctacagcagttgttcttcaggctgagagggaattgcagccttggattgctaaagatgatgatctaggtcagaagatgtggagaatcaaccaaagaattgtaaaattgatcgtggagctaatgaggaatcatgatagacctgaatcgctagtaattttgtcaagtgcttcagatcttcttctacgtgccacagatggaatgcttgtggatggagaagcatgcacgttacctcaattggagcttctggaagcaacagctagagcagttcaacttgtactggaatggggagaatctggattggctgttgcagatggcctttcaaacctgttaaagtgtcgtgtaccagctaccatccgatgcctttctcatccaagcgcacatgtccgtgccctcagcacatcagttcttcgtgatgttctgcaaagtggctcaataaaacctcatatcaaacaagggggcagaaatggcatccactcttatcagtatgtaaatttaggcatcattgactggcaagcagatattgaaaaatgcttgacatgggaagctcatagcaggctagctactggaatgactaatcaattccttgatgctgctgccaaggaactaggctgtactatttccatttaacatcaactaagatttggcaacctctcttgcttttatgaatatattcatttccagtgagacttacaaatagaaacaacataaccaatcggcttggggatgttggtaggccagaggaataactgattaattctgttattctagttataaagccacagatgccactacaatcctcatgcaaggacaattgatgtacagttagactgtagactgggccaaaatggggctttgtatcgtgttgtattaatttcaactctgcccaggttagtttcttctgttataggcctgaatcacttcatgtaatttggttacctttgacagagatggcaaaatcaggtggtagcatcatgttgaatagattccacatcggctacattttgaaaaactcccactctttgttttgtttttcc

SEQ ID NO: 6414 - DNA, 4600 bp, Prunus mume
atcattgccacgtatgctcaaatctatgagagcaagcctaaggccttctaaagatctcctccctctctctctctctctctctctctcttctctagttctgtgtaccaaaactacagcctcttaaaaatattccaactagaaagataaaagggaaaacaaaataaaaactggttttacggtgccattttcttatcatagaaggatcacaaacatctcaaggaaaaagctttcagagaagtaccagcaatcagattgcagtacaaatttaaagttgtgaagctttcttcagaggcagagacttggagttgtgactaacagagggttgggctacaactttttcattattttctgggtcgctccagctttattgtttaattgtgggagattgacgcagtaattttatgctgggatgttaaactacaaaattttgattcttgattggtagcgggtacaagggaaagcttgtggactgtcttgtgtgatattttagttgtggttgcaaagtttgtggattggtgctgggttgaaggttagctgggagataaattttccatggctgctacatctgaaagatggattgatcgtctgcaattctcctcattgtttgggccgcccccacaagatgccctgcgacggaaggctcaagttactgcctatgtggactactttggtcagtttacatcagaacagtttcctgaggacattgccgagctgatccgtaaccgttatccatcggaggtgaagcgtctctttgatgatgtcctggctatgtttgtccttcatcaccctgagcatgggcatgctgttatccttccaattatttcatgtatcattgatggtacgctggcatatgaaaggatcagtccgccatttgcttctttcatatcgttggtctgcccaagcagtgagaatgagtattctgagcagtgggctctggcatgtggggagattttacgaatcttaactcattacaatcgccccatatacaaggtggagcaacagaatagtgaaacagaaagaagcagtagtggtagccatgctacaacaagtgactccgttgatggtgaatccagccatatacctttggtacaacaagagaggaaacctataaggcctttgtctccttggattactgatatattgcttgctgcccctctaggtatcagaagtgattacttccgctggtgtagtggggttatgggaaaatatgctgctggagaactcaagccaccatcaactgcttcttctcgtggatctggaaaacatccccagctcatgccatcgactccaagatgggcagttgctaacggtgctggagttatattaagtgtttgtgatgaggaagttgctcgctatgagactgctactttgacggcagtcgctgtccctgcacttctacttcctcctccaacaacagctttggatgagcacctagtggcggggttacctgctcttgagccatatgcacgcttatttcataggtattatgctattgctactccaagtgccacccaaagacttcttcttggccttctagaagcaccaccatcatgggctcctgatgcacttgatgcagctgtacagcttgtggaactccttcgtgctgctgaagattatgcatctggcataaggcttcctaggaactggttgcatttgcatttcttgcgtgcaattggaactgcaatgtccatgagagcgggtatagcagctgatgctgcggcagctttacttttccgaatactctcacagcctgcattgcttttccctccactaagacaagttgatggagttgaagttcagcatgagcctttgggtggttacatttcaagctacaagaagcagattgaagttcctgaggccgaagcaacaattgaagctactgcccaagggattgcttctatgctctgtgcccatgggcctgaggttgaatggcgaatttgtaccatatgggaagctgcttatggcctcattcctttaagttcttctgcagttgaccttcctgagatcattgtcgccactccattacaacctccaatattatcatggaatctgtatatacccctccttaaggtcttggaatatcttcctcgtggaagtccgtctgaggcatgccttatgaagatatttgttgccactgttgaagcgattcttcagagaacatttccgcctgagtcctcaagagagcaaaacaggaaaacaaggtatctttttggcataggttcgacctccaaaaacctggctgtggcagagcttcgtacaatggttcattcactattcttggaatcatgtgcctcggtagagcttgcttcacgcctactgtttgttgtgctaactgtatgcgtcagtcatgaagctcagtccaatggtagcaagaaagcaagagttgaagaaagctacccagccgatgagagcgttgaagaatcacaaaagatgtcggataagcagagaaacagaactaaaaagacaaaaaaacaggggcctgtagcagcatttgattcttatgttctggctgctgtttgtgctcttgcatgtgaacttcagttgttccctttgatttcaaaggggactaatcatgctcgctcgaaagatgcaaaaaatgtggcaaagcctgccaaagaaaatgtatgtactaatgagtttcggagtagtgttgactcagcagtttgtcacacacgcagaatactaaccattttggaggcacttttcttgctgaagccatcttccattggcactacgtggagttacagttcaaatgagataattgcagcagccatggttgcagctcatgtttctgaattatttagatggtcaaaagcttgcatgcatgcactctctgtcttgatgcgatgtaagtgggacagtgaaatttgctccagagcctcatcattatacaacctcattgatttccacagtaaggctgttgcatctatcgttaacaaggctgaaccattggaagcacacttgaggcaagttccaatttggagggattcctttgttcgttttgaaggcagaaaactaagtcaagatggaaacagtagatgcttaaatgtagggcagccatctgccttgcagtgtgaggattcagcacattcagaaactaaacacaaatctgagagtgcatcacattcatttgaggggtccggaaatacctttggtaaaggtgttgcaagtttcccattagatgcttcagatttggccaactttcttactatggacaggcatataggatttaattgcagtgcacaggttcttctaagatcagtactcacagaaaaacaagagctatgtttctcagttgtgtcactgttgtggcacaagttaattgcagctcctgaaacccagccttctgcagaaagcacttctgctcaacaaggatggcggcaggtcgttgatgcattatgcaatgttgtgtcagcaacaccagcaaaagcagccactgcagtggttcttcaggcggagagggaattgcagccttggattgccaaagatgatgatcaaggtcagaagatgtggagaatcaaccagaggattgtaaaattgattgtggagttgatgagaattcatgatagcccagagtcattggtaattttgtcaagtgcctcagatctacttttgcgtgccactgatgggatgcttgttgatggagaagcttgcaccttaccccaactagagctactggaagcaacagctagagcaattcagcctgtgctcgagtggggagaatctgggctggcagtcgcagatggcctttcgaacctgttaaagtgtcgtctgccagctaccatccgatgcctttctcatccgagtgcacatgttcgtgctctgagcacatcagttcttcgtgatattttgcaaaccagttcaattagacctaaccctaatccggtggaaataaatggtattcatggtccttcctacaagtattttaacttagatgtgattgactggcaagctgatgtggaaaagtgcttgacatgggaagctcatagccgacttgcgactggaatgcctataaaatttcttgatactgccgccaaagaattgggttgtagtatttccatataaaattgattagcttcaggtgtataatttttttttctttttcatgtgagacttgtcttacacaatagatacttgcatctttattgccttgaaagatgagtttgcaggttagtagatattcatttgttcttctgggtccaaggtgttagtcatactgtcaagattttcttttctgaccgcccctcatggaaggatatttgtgtaaatgagaattgtggtttaattgtcaccctagtcatcctaatttggatcttaaaccagtcttctaatgcattgattttgtttcctctaattcactaataaattatgcacttgagacttgagtacgtattcaaaaatccaatggcgtggacagcaaaccagttgaaatgtgttatgttcattttatcagtctcttctttgtacaccatctgttttcttaaaattttccctgacatttaagacgttagatctcatatttcatagtttttattccaccttacctaataccctcggatggaaggcagcccttcattgaaaaataccttaatatattttc

SEQ ID NO: 6415 - DNA, 4164 bp, Prunus persica
gaaagataaaagggaaaacaaaataaaaactggttttacagtgccattttcttatcatagaaggatcacaaacatctcaaggaaaaagctttcagagaagtaccagcaatcagattgcagtaaaaaatttgaagttgtgaagtactcttcagaggcagagacttggagttgtgactaacagagggttgggctacaactttttcattattttctgggtcgctccagctttattgtttaattgtgggagattgatgcagtaattttatgctgggatgttaaactacaaaattttgattcttgattggtagcgggtacaagggaaagcttgtggactatcttgtgtgatatttttgttgtggttgcaaagtttgtggattggtgctcggttgaaggttagctgggagataaattttccatggctgctacatctgaaagatggattgatcgtctgcaattctcctcattgtttgggccgcccccacaagatgccctgcgacggaaggctcaagttactgcctatgtggactactttggtcagtttacatcagaacagtttcctgaggacattgccgagctgatccgtaaccgttatccatcggagttgaagcgtctctttgatgatgtcctggctatgtttgtccttcatcaccctgagcatgggcatgctgttatccttccaattatttcatgtatcattgatggtacgctggcatatgaaaggaccagtccaccgtttgcttctttcatatcgttggtctgcccaagcagtgagaatgagtattctgagcagtgggctctggcatgtggggagattttacgaatcttaactcattacaatcgccccatatacaaggtggagcaacagaatagtgaaacagaaagaagcagtagtggtagccatgctacaacaagtgactccgttgatggtgaatccagccatatacctttggtacaacaagagaggaaacctataaggcctttgtctccttggattactgatatattgcttgctgcacctctaggtatcagaagtgattacttccgctggtgtagcggggttatgggaaaatatgctgctggagaactcaagccaccatcaactgcttcttctcgtggatctggaaaacatccccagctcatgccatcgactccaaggtgggcagttgctaacggtgctggagttatattaagtgtttgtgatgaggaagttgctcgctatgagactgctactttgacggcagtcgctgtccctgcacttctacttcctcctccaacaacagctttggatgagcacctagtggcggggttacctgctcttgagccatatgcacgcttatttcataggtattatgctattgctactccaagtgccacccaaagacttcttcttggtcttctagaagcaccaccatcatgggctcctgatgcacttgatgcagctgtacagcttgtggaactccttcgtgctgctgaagattatgcatctggcataaggcttcctaggaactggatgcatttgcatttcttgcgtgcaattggaactgcaatgtccatgagagcgggtatagcagctgatgctgcggcagctttacttttccgaatactctcccagcctgcattgcttttccctccactaagacaagttgatggagttgaagttcagcatgagcctttgggtggttacatctcaagctacaagaagcagattgaagttcctgaggctgaagcaacaattgaagctactgcccaagggattgcttctatgctctgtgcccatgggcctgaggttgaatggcgaatttgtaccatatgggaagctgcttatggcctcattcctttaagttcctctgcagttgaccttcctgagatcattgttgccactccattacaacctccaatattatcatggaatctgtatatacccctccttaaggtcttggaatatcttcctcgcggaagtccctctgaggcatgccttatgaagatatttgttgccactgttgaagcgattcttcagagaacatttccgcctgagtcctcaagagagcaaaacaggaaaacgaggtatctttttggtataggttcgacctcaaaaaacctggctgtggcagagcttcgtacaatggttcattcactattcttggaatcatgtgcctcggtagagcttgcttcacgcctgctgtttgttgtgctaactgtttgcgtcagtcatgaagctcagtccaatgggagcaagaaagcaagagttgaagaaagctacccagctgatgagagcgttgaagaatcacaaaagatgtcagataagcagagaaacagaactaaaaagacaaaaaaacaggggccggtagcagcatttgattcttatgttctggctgctgtttgtgctcttgcatgtgagcttcagttgttccctttgatttcaaaggggattaatcatgctcactctaaagatgcaaaaaatgtggcaaagcctgccaaagaaaatgtatgtactaatgagtttcggagtagtgttgactcagcagtttgtcacacacgcagaatactagccattttggaggcacttttcttgctgaagccatcttctgttggcacttcgtggagttacagttcaaatgagataattgcagcagccatggttgcagctcatgtttctgaattatttagatggtcaaaagcttgcatgcatgcactctctgtcttgatgcgatgtaagtgggacagtgaaatttgctccagagcctcatcattatacaacctcattgatttccacagtaaggctgttgcatctatcgttaacaaggctgaaccattggaagcacacttgaggcaagttccaatttggagggattcctttgtttgttttgaaggcagaaaactaagtcgtggtggaaacagtagatgcttaaatgtagggcagccatctgcctcgcagtgtgaggattcagcacattcagaaactaaacaaaaatctgagagtgcatcacattcatttgaggggtccggaaatacctttggtaaaggtgttgcaagtttcccattagatgcttcagatttggccaactttcttattatggacaggcatataggatttaattgcagtgcacaggttcttctaagatcagtactcacagaaaaacaagagctatgtttctcagttgtctcactattgtggcacaagttaattgcagctcctgaaacccagccttctgcagaaagcacttctgctcaacaaggatggcggcaggtcgttgatgcattatgcaatgttgtgtcagcaacaccagcaaaagcagccactgcagtggttcttcaggcggagagggaattgcagccttggattgccaaagatgatgatcaaggtcagaagatgtggagaatcaaccagaggattgtaaaattgattgtggagttgatgagaattcatgatagcccagagtcgttggtaattttgtcaagtgcctcagatctacttttgcgtgccactgatgggatgcttgttgatggagaagcttgcaccttaccccaactagagctactggaagcaacagctagagcaattcagcctgtgctcgagtggggagaatctgggttggcagtcgcagacggcctttcgaacctgttaaagtgtcgtctgccagctactatccgatgcctttctcatccgagtgcacatgttcgtgctctgagcacatcagttcttcgtgatattttgcaaaccagttcaattagacctaaccctaatccggtggaaataaatggtattcatggtccttcctacaagtattttaacttagatgtgattgactggcaagctgatgtggaaaagtgcttgacatgggaagctcatagccgacttgcaactggaatgcctataaaatttcttgatactgccgccaaagaattgggttgtagtatttccatataaaattgattagattcaggtgtataattttttttctttttcatgtgagacttgtcttacacaatagatacttgcatctttattgccttgaaagatgagtttgcaggttagtagatattcatttgttcttctgggtccaaggtgttaaatcatactgtcaagattttcttttctgacgagacacggcagtccctcatggaaggagatttgtgtaaatgagaattgtggtttaattgtca

SEQ ID NO: 6416 - DNA, 4072 bp, Fragaria vesca
ttgtgggtagcaccagtgttttcgcttaatttgtgggagatttttgggatgttaaactacaaacttttaattcttgattggtagcggattgaagagaaagcttgtggaattacttgtgttctatcattgttttggttgcgaagttgtgaattggtgtttcgagtttctatggcttgttcatcagaaagatggattgatcgactccaattctcctcattgtttgggcctccccctcaagatgctccacgacgaaaggctcaaatcacggcctatgtggagtacttcggtcagtttacatcagaacaatttccagaggatatttctgagctgatccgtaaccgctacccttccgaggtgaagcgtctctttgatgatgtgttagctatgtttgtccttcatcatcctgagcatgggcatgctgttgtccttcccattatttcatgcatcattgatggcactctgccctatgaaaggactagtccaccatttgcttctttcatatcattagtctgccccagtagcgagaaggagtactctgagcagtgggctctggcatgtggggagattttacgaatcttaactcattacaatcgcccaatatacaaggttgaacaacagaatagtgagacagagagaagcagtagtggcagccatgctacaacaagtgattctgttgatggtgaatccagtcatgtaccatcagtacagcaagagaggaaacctatacgacctttgtctccctggattactgatatattgcttgctgcacctctgggtattagaagtgattatttccgctggtgcagtggagttatgggaaaatatgctgcgggagaactgaagcctccgtcaactgcttcttctcgtggatctggaaaacatcctcaactcatgccatccactccaaggtgggctgttgcaaatggtgctggagttatattaagtgtttgtgatgaagaagtttctcgttatgaaactgctacattaacagcagtagctgtccctgcacttctacttcctcctccaacaacagctttagatgagcatctagtggctgggctaccagctcttgagccatatgcacgtttatttcacaggtattatgctattgctactccaagtgctacccaaagacttcttcttggacttctagaagcaccgccatcatgggcacccgatgctcttgatgcagctgtacagcttgtggagcttcttcgcgctgctgaagattatgcatctggaatacggcttccacggaactggatgcatttgcatttcttgcgagcaattgggactgcaatgtccatgagagccggtatagcagctgatgctgcagcagctttacttttccggatactctctcaacctgcattgctttttcctccactaagacaagttgagggagttgaagttcaacatgagcctatgggtagccgtgtctcaagctacaggaagcagatagaagttcctgcggctgaagcaacaattgaagctactgcccaagggattgcttctatgctttgtgcccatggacctgaggttgaatggagaatctgtactatatgggaagctgcctatggtctaattcctttaagttcctcagcagttgaccttcctgagatcattgttgcaactccattgcagcctccaatattatcctggaatctgtatatacccctacttaaggtcttggaataccttcctcgtggaagtccttctgaagcatgtcttatgaagatatttgttgccacagttgaagcgattcttcaaaggacatttccacctgagtcctcaagagagcagaacagaaaaacaagatacctttttggcatagggtctgcctcaaaaaacctggctgtggcagagcttcggacaatggttcattcactgttcttagaatcatgtgcatctgtagagcttgcttcacgtctattgtttgttgtgttaactgtatgcgttagtcatgaagctcagtccagtgggagtaagaaagcacgagttgaagaaagctacccacttgaggaatgtgttgaggaatcacgagaaatgtctggaaaacagggagacagaaaaaaaaccaaaaaacaaggacctgtagcagcatttgactcttatgttctagccgctgtttgtgctcttgcctgtgagcttcagttgttccctttggtttcaagggggagcaaccaatcacactcaaaagatgctaaaaatattgcaaagcctgcaaaaccaattgggtctgccaattcttacaaacaaataaatggatcttctaatgagtttcaaagtagcgtggactcagcaatttgccacacgcgcagaatattggtcattttggaggcattgtttttgctgaagccatcttctgttggcacctcctggagttacagttcaaatgagattgttgccgcagctatggttgccgctcatgtatctgaattatttagatggtcaaaggcttgcatgcatgcactctgtgttttaatgcgctgcaagtgggataatgaaatttcatctagagcatcatcactgtataacctcattgatattcacagcaaggctgttgcatcgattgttaacaaggctgaaccactggaagcacacttgatgcaagtgccgatttggagggattctttagtgtgttctgaaggtagaaagctaagtcgatgtgaaaagagtaaatgcattaatgttggacagtcatctgtctcgcaatatgagggttcagcgtattcagaaactagagtcaaatctgtgacgccgtcacattctaatggtggttccggaacatttggtaaaggtcttgcaaacttaccattagatgcctcggaattggccaacttccttactatggacaggcatataggatttagttgcagcgcacaggttcttctaagaacggtactgacagagaaacaagagctatgtttttcagttgtctcactgttgtggcacaagttaattgcgtctcctgaaacccaacctactgcagaaagcacttctgctcaacaagggtggcggcaggttgttgatgcattatgcaacgttgtatctgcaacaccaactaaagcagccacagcagttgttcttcaggcggagagggaattgcagccttggattgccaaagatgatgatcaaggtcagaagatgtggagaatcaaccagaggattgtgaaattgattgtagagttgatgagaattcatgatagcccagaatcattggtaattttgtctagtgcgtcagatctacttctgcgtgccactgatgggatgcttgttgatggagaagcttgcactttaccgcagctggagctactggaagcaactgcgagagcagttaagcctgtgctggagtggggagaatctgggcttgcagttgcagatggcctttcaaacctgttaaagtgtcgtctgtcagctactatccgatgcctttctcatcctagtgctcatgttcgcgctttgagcgtatcagttcttcgtgatattttgcaaaccagttcagttagacctaaccctaatccagtgcaaataaatggtatccatggtccttcctataagtattttaacttagatgttattgattggcaagctgatattgaaaagtgcctgacatgggaagctcacagccgacttgcaactggaatgcctattaaatttcttgatactgctgccaaggaattgggttgtactatttctgtataatgtaaactagcatcaggtggatcatttttcatgtgagatttaccaatagacatgcatcttttattgccttgaaagatatgggtttccactttccaggtataagtaaatatacctttttctttatccttgtgggttacaaggtttctgttgtcaaattattcttttctggtgggacgtgacggtttctcacttaaggggatgacttgtgtaaaatgagaggtgagacaatggatttcattgctgatgaaaccctgaggaggcattatgttgtggtcttcaattgttgttaaaaccatgtttgatctgtgtcatgttcatatgggtccgatctcagcccaggttggtagtttattaagacattaatttg

SEQ ID NO: 6417 - DNA, 4864 bp, Vitis vinifera
ctcggggggaacaccgagatgcctctcacctcttttgtctccctttcatctcctccacacacttttgacttcaaacgcaagcctcatgcatcatgagatggttatgatagggatgatggtaagccatcatgtccacgccatgcccatgccatcttcatgcccagccactcaggctgaaggaaaatatcatagccacgtatgcacgcattcttttgctaggagaccggctaaagatctctctttctctctctactttctctctctatactccacatacttccacaactacagcctcttaaaatctaaagaaacaaggagcccataaagcttacacaaataaaaatcttagctttcatctccagagggaaaagcacagaaaaatcggggaatcagtgtgggagagtttccggaatttctaaattctcacaccgaagaatcagaatatctgtttgtaccatacaaaatcagtgtaaattgaatctatgaatgtttactgttcagaggcaaggaggaatttgtagttgggacaggaacactggtgaaaattaatttttttttgttgggagaggtgcaatagttccctctttttttcttggattcttttaatacaattttttgtaatgcatttgggctcactgcttcttgttaattgattatttcagagacttggggccgtgcaatgcggggaacggtgaagtacgatattttggtacttgattggtagctgtcgaagtggaagttagtggcttttagtgttggttctgttgtgtgttacttcttgtaattggcatcaaaggaagatatttatatggctagttcatgtgaaagatggatcgatggtctccaattctcctcattgttctggccccccccgcaagatgtgcagcaacggaaggctcaaattactgcctatgttgactacttcggtcagttcacatcagaacaattccctgaagatattgctgagttgattcggagccgttatccgtcaaaggaacagcgcctttttgatgatgtcttggcaacgtttgttcttcatcatccggaacatgggcatgctgtcgttcttccaattatttcgtgtatcattgatggtacactggtgtatgataggtgtactcctccttttgcctctttcatttccttggtctgcccaagcagcgagaatgagtattctgaacaatgggctctggcatgtggggagattttgcgaattttaactcattacaatcgcccaatttacaaggtggaacatcagagcagtgaagcagatagaagcagcagtggcaggcatgctacaacaagtgactctgtagatgggaaatcctctcaaggaccgttactacaaaatgagaggaaaccttcaaggcctttgtctccctggattactgatatattgcttgctgcacctctgggtatcagaagtgactactttcgttggtgcggcggtgttatggggaaatatgcagctggagaactaaagccaccttcaactgcttctactcgtggatctggaaagcacccccagctcattccatcaactccaaggtgggctgttgctaatggtgcaggtgtgatattaagtgtttgtgatgaagaagtagctcgctatgagactgcaactttaacagcagctgcagttcctgcacttctgcttcctcctccaacaacagctttggatgagcatctagttgctgggcttccagccctggagccatatgctcgcctatttcatcgctactatgcaattgctactccaagtgccacacaacgacttcttctaggactactggaagcaccaccatcatgggctccagatgctcttgatgctgcagtacagcttgtggaacttcttcgggcagctgaagattatgcatcaggcatgaggctcccaaggaactggatgcatttgcatttcttgcgtgcaattggtactgcaatgtccatgagagcagggattgctgcagatgctgctgcagcattactttttcgcgtactttcacagcctgcattgctttttcctcctctaagacaagtcgaaggatttgaatttcagcatgaacctttagatggttatatttcatcctacaagaagcagatagaagtgcctgcaactgaagcaactattgaagccactgcccaagggattgcatcaatgctttgtgcacatggtcccgaggttgaatggagaatttgcaccatatgggaagctgcttatggcctaattcctttaagttcctcagctgttgatcttcctgaaattatagttgcaaccccattgcaacctcccattttatcatggaacctttatataccccttcttaaagtcctggaatatcttcctcgtggaagtccatctgaagcatgtctcatgaagatatttgttgctacagtggaatcaattcttcagaggacatttccagctgagtcctccagagaaaatatcagaaaaacaagatacctttttggaatagggtctgcctccaaaaacctggctgtggctgagcttcgtacaatggtccatgcactatttctagaatcatgtgcatctgtagagcttgcttcacgccttctttttgttgtgttaaccgtttgtgtcagtcatgaagctgctcagcagaatggaagcaaaagaccaagaggtgaagatagccatctttctgaggaaatcaccgaggacttgtcagatgcatctggaaatcagagagacacgaaaaccagaaaaatgaaaaaacaagggcctgtagcagcttttgattcttatgttcttgctgctgtttgtgctcttgcatgtgaacttcaattattccctttgattgctaggggaactaatcattcagcctctaaagatgtacagatcagagcaaagcctgcaaaattaaatggatcttctagtgaattccgcaatagcattgactctgccattcgtcatacccacagaatattagcaattttagaggcactcttttcactgaagccatcttctgttggcacctcttggagttacagttcaaatgaaattgttgctgctgctatggttgctgctcatgtttctgaactattcagacgatcaaaagcttgtatgcatgccctctctgtcttgatgagatgcaagtgggatgaagaaatctacaccagggcttcttcactctataacctcattgacattcatagcaaagctgttgcatccattgtcaacaaggcagaaccactagaagcacacttaattcatgcaacagtttggaaggacagccctgggcataaagatggcagcaaagaagatgactgtgcaagcactagctgcttcaaatcagtgaatcccttgcttctgcactctgaagattcagcttattcaaaaagtttacctcaatttgagaaagcaccacatttaaatgaaggcacaggaaatagcttgggtaaaggtattgcaagcttcccattagatgcttcagaattggccaatttcctcactatggacaggcatataggatttagttgcagtgcacaagttcttctaagatcagtactcgcagagaaacaagagttatgtttctctgttgtttcacttctttggcacaagttaattgcagccccagaaacaaaacctagcgcagaaagcacttctgcccaacaaggatggagacaggtggttgatgcgctatgcaacgtcgtatcagcatcaccggcaaaagcagctacagcagttgttcttcaggctgagagggaattgcagccttggattgctaaagatgatgatctaggtcagaagatgtggagaatcaaccaaagaattgtaaaattgatcgtggagctaatgaggaatcatgatagacctgaatcgctagtaattttgtcaagtgcttcagatcttcttctacgtgccacagatggaatgcttgtggatggagaagcatgcacgttacctcaattggagcttctggaagcaacagctagagcagttcaacttgtactggaatggggagaatctggattggctgttgcagatggcctttcaaacctgttaaagtgtcgtgtaccagctaccatccgatgcctttctcatccaagcgcacatgtccgtgccctcagcacatcagttcttcgtgatgttctgcaaagtggctcaataaaacctcatatcaaacaagggggcagaaatggcatccactcttatcagtatgtaaatttaggcatcattgactggcaagcagatattgaaaaatgcttgacatgggaagctcatagcaggctagctactggaatgactaatcaattccttgatgctgctgccaaggaactaggctgtactatttccatttaacatcaactaagatttggcaacctctcttgcttttatgaatatattcatttccagtgagacttacaaatagaaacaacataaccaatcggcttgggggatgttggtaggccagaggaataactgattaattctgttattctagttataaagccacagatgccactacaatcctcatgcaaggacaattgatgtacagttagactgtagactgggccaaaatggggctttgtatcgtgttgtattaatttcaactctgcccaggttagtttcttctgttataggcctgaatcacttcatgtaatttggttacctttgacagagatggcaaaatcaggtggtagcatcatgttgaatagattccacatcggctacattttgaaaaactcccactctttgttttgtttttcccgttcattactctgtcatattagttcttaatgaagattgtagtggtagaactagggttgtcatctcaccatccaggcactgaaagcttaaacttggtttgtatcttgataacctcttacagaacctttatcttcc

SEQ ID NO: 6418 - DNA, 4523 bp, Gossypium raimondii
tatgtaagctatgtagtattcatgccatcaccatgggatggatgggggtatcatgcatggtgacatgacatggggagtctgcgagacgagaggaaaatatcattgccacgtcatcagcaatcttaagcgaacagcccttctaaagatctcctctttctctctctcactcgccaaaaactgtaccacctcctcatattttccataaattttatttatttttcctttaaatttactgtcacatttgtttaaaacagagcgttaaatctaaattaattcaggaaaatacttagcatctgataaccgaagcccagtcaagttagagattctgattataagttaaacaacagttgtcttataaggctttggacggttaaaggctgagacgttgtagagactaattttactgttgtgaattttcagtccttttagagagagatgcaatagtttcttctgttgaatttcgtacagttgcagagtggaagcataggtcctggtgtgttgttgttgattattctggtgattgattcaaaaaggtatacttggaagataaatattgtttactctaaatggctaatccatctaagaggtggattgacggtcttcagttctcatcgctgttctggccgccgccgcaagaccctcaagaacgaaggttcaaattactgcatatgtcgagtattttggtcagttcacatcagaacaattccctgaggatattgctgagcttattcgcacccgctatccatctaaggagcaacgcctttttgatgatgttctggcaacttttgtccttcaccatccagaacatgggcatgcagttgttcttccaattatttcaggaatcattgatggttcgctggtgtatgataagagttccttgccctttgcgtcattcatctccttagtttgcccaagtagtgagaatgagtattctgaacagtgggctctagcatgcggagagatcttgcgaattctgactcattacaaccgtccaatatataaaatggagccacaaaataatgaaacagatagaagccacagcagcagccaagctacgacaagtgaatctgtagatggggaaccatcctttcagatacctttgatgcaacaggagaggaagcctttaaggcctttgtctccctggattactgatatattgctcgctgcacctctgggtataagaagtgattacttccgttggtgcagtggtgttatgggcaaatatgcagctggagacctcaagccacctactactgcttcttctcggggatctggaaagcatcctcagcttatgccatcaaccccaagatgggccgttgcaaatggtgctggtgtcattttaagcgtatgcgacgaagaggttgcacgctacgaaactgctagtttaacggctgcagcagtccctgcacttctacttcctcccccaacaacagctttggatgagcatctagttgctgggttaccggctcttgaaccatatgcacgtttatttcatcggtactatgccattgcaactccaagtgcgacccaaagacttcttcttgggcttcttgaagcaccaccatcatgggctccagatgcacttgatgctgctgtacagcttgtggaacttcttcgtgctgccgaagattatgcaactggtataaggcttcctcgaaattggatgcatttgcactttttgcgggcaattgggactgcaatgtctatgagggcaggtattgctgctgatgctgctgcagctttactttttcgcatactttcacagcccgcactactttttcctccaataagacaagttgagggagtagaagttcaacatgaaccttctggtggttatatctcatgttacagaaagcagattgaggtgcctgcagctgaagcaactattgaagctactgctcaagggattgcatcaatgctttgcgctcatggaccggaggtggaatggagaatatgtacaatatgggaagctgcttatggtctgattcccttgagctcttcagctgttgatcttccagaaattattgtttcaaccccattgcagcctcccatactatcatggaatctatacatacctcttcttaaggtgctcgaataccttccacgtggaagtccttctgaagcatgtctcatgaagatatttgtggcgactgtagaagctattcttcagagaacatttccacctgaatcccccagggagcaaaccagaaaaacaagatacagcataggttctgcctcaaagaatctcgctgtggcagagcttcgtacaatggtgcattcgctgtttttagaatcatgtgcttctatagagctcgcttcacgcctactttttgttgtcttaactgtgtgtgttagtcatgaggctcagttcagtgggagtaagagaccaagaggtgaagaaagttatcctcctgatgagggcgttgaggagtcacaggcacaatctgaaaagctgaaagacattaaacctagaaaagcaaaaaaacaagggcctgtagctgcgtttgattcttatgtgctggctgctgtctgtgctcttgcctgcgagcttcagttgttccccttggttacaagaggaaatactcattcaactgctaaagatgttcaagctatggccaaccctgcaaaagtaaatggatcttctatagagtatggacatggtattgactctgctattcatcatactcacagaatcttagcaattttagaggcacttttttcgctgaagccatcttctgttggcacctcatggggttatagttcaaatgaaatagttgctgcagctatggttgctgctcatatttctgaactatttagacggtcaaaggcttgcatgtatgcactctctgttctaatgcgctgcaagtgggacaatgaaatttacaccagggcatcatcgttatataatctcatcgatattcacagcaaggctgttgcatccattgttaacaaggccgaaccattagaagcacaattgatatatgcacctgttagaaaatattccccttgtttagatgacagaaaacaaaacaagtattcaagtgccacttgctttgatcctgggcaattatctgcttcagaatgtgaagattcaacttgttcagacaataatctcagatctgagaaactgttagcatcagatgaaggcttaggaaattctttgggcaaaggtatagcaggtttcccattagatgcctcagatttggccaattttctcaccagggaccggcacataggattcaattgcagtgcacaaattcttctgagatcagtgcttgtggagaaacaagagttatgtttctctgtagtttcactactgtggcataagctgatagcagcgcctgaaacacaacccagtgccgaaagcacatctgcccagcagggatggagacaggtggttgatgcgttgtgcaatgtcgtatcagcatcaccgacaaaagcaactacagctgttgtacttcaggcggatagggaattgcagccttggattgccaaagatgacgaccaaggtcagaagatgtggagaatcaaccagcgaattgtaaaattgatagtcgagctgatgagaaatcatgatagcgcagaatcattggtcattgtggcaagtgcttctgatctacttctacgtgccacagatggtatgcttgttgatggggaagcttgtactttaccacaactggagctgctggaagcaacagctagagcagttcagccggtactcgagtggggagaatcaggactggcagtagcagatggactttcaaacctgttaaagtgtcgtctaccagctacgactcgatgcctttctcatccaagcgcacatgttcgagctctcagcacatcagtccttcgcaatattttgcatataggttcaatcaattcaaaatctaaggtggaaatatatggtatctgtggtccctcttaccagttcttcaatataggtgccatcaactggcaaactgatatcgaaaagtgcttaacatgggaagtttatagtcagcttgcaagaggaatgactatacagttcctcgacactgctgccaaagaattaggatgtaatatttccatataacatcgattaactttcggattatcagtataaataccctttttcttcttttaaaactgagaatacaaagaagacttaagacttgcttcaaattgcttgaaccacatggttggggcagaaaatgcagctcatcgagtagtcctaggggatgaggatgaaggctttgaatgccatgaaactcttcaagcaaggttagtgtatgataaaaatgccacactgaggtttcatgtgtctaatcttactttgctttaagcttagctttgtaagatatttagactgagttttcgatttgtttgtcggattacgatatttaatttcagtttaacttagtttatttcattagaatgatgaactgattggatgattcagttttttcttcagcatatatcagtacataaaatgtttagtcattgtttttggctgctttatttatattattaacctcgttgcttaa

SEQ ID NO: 6419 - DNA, 3962 bp, Phaseolus vulgaris
atgtctgtttcaatggctgcttccagtgaaaggtggattgaccgtcttcagttctcctcgttgttctggcctcccccactggaagatcaacaaagaaaggatcaaattgctgcgtatgttgaatacattggtcaatttacatcagaacaatttcctgatgatattgctgagttgatccgcaatcggtatccatcaaaagaaatgctcctctttgatgaagttttggcggtacttgtccttcatcatcctgagcatgggcacgcagttgtgcttccaatcatttcatgtattattgatggtacgctggtctatgacaagactagtcctccatttgcttctttcatttctttagtctgcccaaaaaatgagaatgaatattcagaacaatgggctctggcatgcggagaaattttgcgtatcttaactctttacaatcgccccatatacaaaatggaaagacaatactgtgaagcagaaggaagcagtggcgggagccatgcaatggttaatgattccgcatatggggagtctggccataactctatgatgcagcaggagaagaagcctacaagaccgttgtccccgtggattactgatatattattggctgcacctttaggcattagaagtgactattttcggtggtgcagtggtgttctgggtaaatatggcgcaggagaactccagccacccatgattgtttctgcacgtggttctgggaagcatcctcaactgatgccgtcaactccaagatgggcagttgctaatggtgctggtgttatattaagtgtttgtgataatgaagttgctcgttatgagactgctactttaacagcagttgctgtccctgcactactacttcctcctccaacaacagctttggatgagcatcttgttgctggattaccagctctagaaccatatgcacgtttatttcacagatattatgccattgcaactcccagtgcaactcaaaggcttcttcttggactgttagaagcacccccatcatgggctccggatgcacttgatgctgctgtgcagcttgtagaacttcttcgagctgctgaagaatatgcttgtggaataaggctccctagaaattggatgcattttcatttcttgcgggccataggcactgcaatgtccatgagatctggtgtagctgcagatgctgcagctgcattgcttttccgaatactttctcagcctgctttacttttccctccattaaggcaagttgatggagttgaaattcaacatgaacctttgggtggctatatttcttccaacagaaagcagattgaagctgctgctgctgaagccaccattgaagccacagcccagggcattgcctcaatgctttgtgctcatggtccagaggttgagtggagaatttgtaccatatgggaggctgcttatggcttgattccattaaattcttcagctgttgatctaccagaaattgtggtcgcaacaccacttcaacctcccatactctcatggaatttgtacatacccctactcaaggttttggaatatcttcctcgtggaagtccatctgaagcatgtctcatgaaaatatttgttgctacagtggaagctattcttcagaggacatttccagctgagcccattagtgatcaaaaaagaaaaacacgatactattttgtgggctctgcctctaaaaaccttgccgtggcagaacttcgtaccatggtgcattcacttttcttagaatcatgtgcatctgttgagcttgcttcacgcctactatttgttgtcttaactgtctgtgttagtcatgaggtcaaattcaatggaagcaagaaaccaagaggtgaagataattatttggaggaagtgattgaggatttatttccagtgtctgaaagccagaaagaaacaaaaaatcggaaaataaagaagcaaggtcctgtatcagcatttgattcttacgttctggctgctgtttgtgctcttgcctgtgagcttcagttgttccctacggtttcgcgaggaaacaatcgttcagtcctcaataaagtagaaaagatagccaagccttccaaaatagatgaatcttcccatgcattgcagaaatgcatagattcagcaatacgccatacccatagaattttagcaattttagaggcgctattttcattgaagccctcttctgttggtacctcatggagttacagctcaaatgaaatagttgcagcagctatggttgctgcacatatttctgaactatttagacggtcaaaagcttgcatgcgtgctctgtctgttttgatacgttgcaaatgggatgatgaaattcactctagggcatcgtcattgtacaatctcatagatattcacagcaaagctgttgcatccatagtaaacaaggcagaaccattcggagcaaccttaattcatacccctatttgtaaagacccctgtggtagtattaaaggacaaaaccagtttgaaaatagtagccacctggaccctgggcagacatctacttcaatctctacagattcatcccccttggaactcggtaaaagatgtgatagaacttcatattcaaatgaagcatcgggatgtacctttggaaaaggagccacaagtctcgcattcgatgcttctgatctagccaacttcctaactatggacaggcatataggattcaattgcagtgcccaaatttttcttagatccaggctcgcagagaagcaagagttatgcttctctgtagtatcactactatggcagaagttgattgcatctcctgagactcaaccttgtgcagaaagcacttctgctcaacaggggtggagacaggttgttgatgcattatgccaggttgtatctgcatcacctatgaaagcagctacggcagttgttcttcaggccgaaaaggaattgcagccatggattgctaaagatgacaatcttggtcagaagatgtggagaatcaatcagcggattgtaaaattgataattgaactaatgaggaatcatgatagtttagaatcattagtagttgtggcaagtgcatcagatttactactacgagccaccgacggtatgctagtggatggagaagcttgcactttaacacagcttaagctattggaagcaaccgctaaagcggttcagcctgtgattgagttgggagaatctggtttcgcggtggcagatggcctttcaaacctgctaaagtgtcgcctaccagctacaatcagatgcctttctcatcctagtgcacatgtccgtgctctcagcacttcagttcttcgtgatattttgcatacttgttcaattagaagatacagtcctaagagaccgcaaaagaatgacatccataatcaatacttcaatttggatgtcattgactggcaagctgacataaacaaatgcttgacatgggaagctcacagccagcttttaaatggaatgtctattgaatatcttaacacagctgcgagggatttaggctttggaatttctatctaaaatgaaaccatgctacccatttagtctatggcatttaccgtaagtagcaatgcgaaaagcgccttttctgagacacacttttggacacactcctttattggttaaaatttattgaaaaacacaaaattgtaagtttcacgtcttatttaatgaatctcgtaattttgtaatttttaacaaattctgaccaataagaaagtgtcttagaaaaggtgtcttagacaatgttgctagcacttctcttataagatttgtagatttatgtttaggaaattaatggtttgcaaataagtaaaccttcttgttttgttagtttcttttagcaagtcacaaaaagacccattcctcttttccccaaacatgatatcaaacattgatgaccgtgtatataaactagttttgtattatgcttgttatgtttacttaaaccagcttgcttcatgatgtgtaaa

SEQ ID NO: 6420 - DNA, 4093 bp, Phaseolus vulgaris
gctatacaggaaatgttgaattacgatattttaattcttgattggtagccagttttggctggatttggattgttggttttgatatcagaagcagaaaggaataagttaagaattgaaagtgaaggcagatgtctgtttcaatggctgcttccagtgaaaggtggattgaccgtcttcagttctcctcgttgttctggcctcccccactggaagatcaacaaagaaaggatcaaattgctgcgtatgttgaatacattggtcaatttacatcagaacaatttcctgatgatattgctgagttgatccgcaatcggtatccatcaaaagaaatgctcctctttgatgaagttttggcggtacttgtccttcatcatcctgagcatgggcacgcagttgtgcttccaatcatttcatgtattattgatggtacgctggtctatgacaagactagtcctccatttgcttctttcatttctttagtctgcccaaaaaatgagaatgaatattcagaacaatgggctctggcatgcggagaaattttgcgtatcttaactctttacaatcgccccatatacaaaatggaaagacaatactgtgaagcagaaggaagcagtggcgggagccatgcaatggttaatgattccgcatatggggagtctggccataactctatgatgcagcaggagaagaagcctacaagaccgttgtccccgtggattactgatatattattggctgcacctttaggcattagaagtgactattttcggtggtgcagtggtgttctgggtaaatatggcgcaggagaactccagccacccatgattgtttctgcacgtggttctgggaagcatcctcaactgatgccgtcaactccaagatgggcagttgctaatggtgctggtgttatattaagtgtttgtgataatgaagttgctcgttatgagactgctactttaacagcagttgctgtccctgcactactacttcctcctccaacaacagctttggatgagcatcttgttgctggattaccagctctagaaccatatgcacgtttatttcacagatattatgccattgcaactcccagtgcaactcaaaggcttcttcttggactgttagaagcacccccatcatgggctccggatgcacttgatgctgctgtgcagcttgtagaacttcttcgagctgctgaagaatatgcttgtggaataaggctccctagaaattggatgcattttcatttcttgcgggccataggcactgcaatgtccatgagatctggtgtagctgcagatgctgcagctgcattgcttttccgaatactttctcagcctgctttacttttccctccattaaggcaagttgatggagttgaaattcaacatgaacctttgggtggctatatttcttccaacagaaagcagattgaagctgctgctgctgaagccaccattgaagccacagcccagggcattgcctcaatgctttgtgctcatggtccagaggttgagtggagaatttgtaccatatgggaggctgcttatggcttgattccattaaattcttcagctgttgatctaccagaaattgtggtcgcaacaccacttcaacctcccatactctcatggaatttgtacatacccctactcaaggttttggaatatcttcctcgtggaagtccatctgaagcatgtctcatgaaaatatttgttgctacagtggaagctattcttcagaggacatttccagctgagcccattagtgatcaaaaaagaaaaacacgatactattttgtgggctctgcctctaaaaaccttgccgtggcagaacttcgtaccatggtgcattcacttttcttagaatcatgtgcatctgttgagcttgcttcacgcctactatttgttgtcttaactgtctgtgttagtcatgaggtcaaattcaatggaagcaagaaaccaagaggtgaagataattatttggaggaagtgattgaggatttatttccagtgtctgaaagccagaaagaaacaaaaaatcggaaaataaagaagcaaggtcctgtatcagcatttgattcttacgttctggctgctgtttgtgctcttgcctgtgagcttcagttgttccctacggtttcgcgaggaaacaatcgttcagtcctcaataaagtagaaaagatagccaagccttccaaaatagatgaatcttcccatgcattgcagaaatgcatagattcagcaatacgccatacccatagaattttagcaattttagaggcgctattttcattgaagccctcttctgttggtacctcatggagttacagctcaaatgaaatagttgcagcagctatggttgctgcacatatttctgaactatttagacggtcaaaagcttgcatgcgtgctctgtctgttttgatacgttgcaaatgggatgatgaaattcactctagggcatcgtcattgtacaatctcatagatattcacagcaaagctgttgcatccatagtaaacaaggcagaaccattcggagcaaccttaattcatacccctatttgtaaagacccctgtggtagtattaaaggacaaaaccagtttgaaaatagtagccacctggaccctgggcagacatctacttcaatctctacagattcatcccccttggaactcggtaaaagatgtgatagaacttcatattcaaatgaagcatcgggatgtacctttggaaaaggagccacaagtctcgcattcgatgcttctgatctagccaacttcctaactatggacaggcatataggattcaattgcagtgcccaaatttttcttagatccaggctcgcagagaagcaagagttatgcttctctgtagtatcactactatggcagaagttgattgcatctcctgagactcaaccttgtgcagaaagcacttctgctcaacaggggtggagacaggttgttgatgcattatgccaggttgtatctgcatcacctatgaaagcagctacggcagttgttcttcaggccgaaaaggaattgcagccatggattgctaaagatgacaatcttggtcagaagatgtggagaatcaatcagcggattgtaaaattgataattgaactaatgaggaatcatgatagtttagaatcattagtagttgtggcaagtgcatcagatttactactacgagccaccgacggtatgctagtggatggagaagcttgcactttaacacagcttaagctattggaagcaaccgctaaagcggttcagcctgtgattgagttgggagaatctggtttcgcggtggcagatggcctttcaaacctgctaaagtgtcgcctaccagctacaatcagatgcctttctcatcctagtgcacatgtccgtgctctcagcacttcagttcttcgtgatattttgcatacttgttcaattagaagatacagtcctaagagaccgcaaaagaatgacatccataatcaatacttcaatttggatgtcattgactggcaagctgacataaacaaatgcttgacatgggaagctcacagccagcttttaaatggaatgtctattgaatatcttaacacagctgcgagggatttaggctttggaatttctatctaaaatgaaaccatgctacccatttagtctatggcatttaccgtaagtagcaatgcgaaaagcgccttttctgagacacacttttggacacactcctttattggttaaaatttattgaaaaacacaaaattgtaagtttcacgtcttatttaatgaatctcgtaattttgtaatttttaacaaattctgaccaataagaaagtgtcttagaaaaggtgtcttagacaatgttgctagcacttctcttataagatttgtagatttatgtttaggaaattaatggtttgcaaataagtaaaccttcttgttttgttagtttcttttagcaagtcacaaaaagacccattcctcttttccccaaacatgatatcaaacattgatgaccgtgtatataaactagttttgtattatgcttgttatgtttacttaaaccagcttgcttcatgatgtgtaaagga

SEQ ID NO: 6421 - DNA, 4096 bp, Gossypium hirsutum
gtacagttgcagagtggaagcgtaggtcctggtgtgttattgttgattattctggtgattgattcaaaaaggtatacttggaagctaaatattgtttactctaaatggctaatccatctaagaggtggattgacggtcttcagttctcatcgctgttctggccgccgccgcaagaccctcaagaacgaaaggttcaaattactgcatatgtcgagtattttggtcagttcacatcagaacaattccctgaggatattgctgagcttattcgcacccgctatccatctaaggagcaacacctttttgtatgatgttctggcaacttttgtccttcaccatccagaacatgggcatgcagttgttcttccaattatttcaggaatcattgatggttcgctggtgtatgataagagttccttgccctttgcgtcattcatctccttagtttgcccaagtagtgagaatgagtattctgaacagtgggctctagcatgcggagagatcttgcgaattctgactcattacaaccgtccaatatataaaatggagccacaaaataatgaaacagatagaagccacagcagcagccaagctacgacaagtgaatctgtagatggggaaccatcctttcagatacctttgatgcaacaggagaggaagcctttaagggctttgtctccctggattactgatatattgctcgctgcacctctgggtataagaagtgattacttccgttggtgcagtggtgttatgggcaaatatgcagctggagacctcaagccacctactactgcttcttctcggggatctggaaagcatcctcagcttatgccatcaaccccaagatgggccgttgcaaatggtgctggtgtcattttaagcgtatgcgacgaagaggttgcacgctacgaaactgctagtttaacggctgcagcagtccctgcacttctacttcctcccccaacaacagctttggatgagcatctagttgctgggttaccggctcttgaaccatatgcacgtttatttcatcggtactatgccattgcaactccaagtgcaacccaaagacttcttcttgggcttcttgaagcaccaccatcatgggctccagatgcacttgatgctgctgtacagcttgtggaacttcttcgtgctgccgaagattatgcaactggtataaggcttcctcgaaattggatgcatttgcattttttgcgggcaattgggactgcaatgtctatgagggcaggtattgctgctgatgctgctgcagctttactttttcgcatactttcacagcccgcactactttttcctccaataagacaagttgagggagtagaagttcaacatgaaccttctggtggttatatctcatgttacagaaagcagattgaggtgcctgcagctgaagcaactattgaagctactgctcaagggattgcatcaatgctttgcgctcatggaccggaggtggaatggagaatatgtacaatatgggaagctgcttatggtctgattcccttgagctcttcagctgttgatcttccagaaattattgtttcaaccccattgcagcctcccatactatcatggaatctatacatacctcttcttaaggtgctcgaataccttccacgtggaagtccttctgaagcatgtctcatgaagatatttgtggcgactgtagaagctattcttcagagaacatttccacctgaatcccccagggagcaaaccagaaaaacaagatacagcataggttctgcctcaaagaatctcgctgtggcagagcttcgtacaatggtgcattcgctgtttttagaatcatgtgcttctatagagctcgcttcacgcctactttttgttgtcttaactgtgtgtgttagtcatgaggctcagttcagtgggagtaagagaccaagaggtgaagaaagttatcctcctgatgagggcgttgaggagtcacaggcacaatctgaaaagctgaaagacattaaacctagaaaagcaaaaaaacaagggcctgtagctgcgtttgattcttatgtgctggctgctgtctgtgctcttgcctgcgagcttcagttgttccccttggttacaagaggaaatactcattcaactgctaaagatgttcaagctatggccaaccctgcaaaagtaaatggatcttctatagagtatggacatggtattgactctgctattcatcatactcacagaatcttagcaattttagaggcacttttttcgctgaagccatcttctgttggcacctcatggggttatagttcaaatgaaatagttgctgcagctatggttgctgctcatatttctgaactatttagacggtcaaaggcttgcatgtatgcactctctgttctaatgcgctgcaagtgggacaatgaaatttacaccagggcatcatcgttatataatctcatcgatattcacagcaaggctgttgcatccattgttaacaaggccgaaccattagaagcacaattgatatatgcacctgttagaaaatattccccttgtttagatgacagaaaacaaaacaagtattcaagtgccacttgctttgatcctgggcaattatctgcttcagaatgtgaagattcaacttgttcagacaataatctcagatctgagaaactgttagcatcagatgaaggcttaggaaattctttgggcaaaggtatagcaggtttcccattagatgcctcagatttggccaattttctcaccagggaccggcacataggattcaattgcagtgcacaaattcttctgagatcagtgcttgtggagaaacaagagttatgtttctctgtagtttcactactgtggcataagctgatagcagcgcctgaaacacaacccagtgccgaaagcacatctgcccagcagggatggagacaggtggttgatgcgttgtgcaatgttgtatcagcatcaccgacaaaagcaactacagctgttgtacttcaggcggatagggaattgcagccttggattgccaaagatgacgaccaaggtcagaagatgtggagaatcaaccagcgaattgtaaaattgatagtcgagctgatgagaaatcatgatagcgcagaatcattggtaattgtggcaagtgcttctgatctacttctacgtgccacagatgggatgcttgttgatggggaagcttgtactttaccacaactggagctgctggaagcaacagctagagcagttcagccagtactcgagtggggagaatcaggactggcagtagcagatggactttcaaacctgttaaagtgtcgtctaccagctacgactcgatgcctttctcatccaagtgcacatgttcgagctctcagcacatcagtccttcgcaatattttgcatataggttcaatcaattcaaaatctaaggtggaaataaatggtatctgtggtccctcttaccagttcttcaatataggtgccatcaactggcaaactgatatcgaaaagtgcttaacatgggaagtttatagtcagcttgcaagaggaatgactatacagttcctcgacactgctgccaaagaattaggatgtaatatttccatataacatcgattaactttcggattatcagtataaataccctttctttttcttcttttaaaactgagaatacaaagaagacttaagacttgcttcaaattgcttgaaccacatggttggggcagaaaatgcagctcatcgagtagtcctagaggatgaggatgaaggctttgaatgccatgaaactcttcaagcaaggttagtgtatgataaaaatgccacactgaggtttcatgtgtctaatcttactttgctttaagcttagctttgtacgatatttagactgagttttcgatttgtttgtcggattacgatatataatttcagtttaacttaggatttgatgattcagtttatttcattagaatgatgaactgatttgatgattcagtttatttcattagaatgatgaactgattggatgattgagtttcttcttcagcatatatcagtgcataaaatgtttagtcattgtttttggctgcttaga

SEQ ID NO: 6422 - DNA, 3845 bp, Manihot esculenta
aaaatatctttttatggcaagttcttctgagagatggattgatggtcttcagttctcatcattgttttggccacctccacaagatgcccagcaacgaaaggcacaaattactgcatatgttgagtactttgggcaattcacatctgaacagtttcctgatgatattgctgagctgattcgtaatcgttatccatcaaaggagaaacgcctctttgatgatgttttggctacatttgttctccatcatccggagcacgggcatgcagttgttcttccaattatttcatgtttaatagatggactggtgtatgataggagtagtcctccatttgcctctttcatttccttggtctgcccaagcagtgagaatgaatattctgaacaatgggctttggcatgtggagagattttgagaattttgactcattacaatcgcccagtatataaggtggaacaacagaatagtgaaacagagagaagcaatggtggcaaccatgctacaagtagtggctcagtagatagggaatcctgtcccacgccttcagtacaacaggagaggaaacctttaaggcctttatccccgtggatcactgacatattacttgctgcacctttgggtattagaagtgattacttccgatggtgtagtggtgttatgggtaaatatgcagctggagagctcaagccacctataactgcttcatctcgcggatctgggaagcatcctcagctcatgccatcaacccctagatgggctgtagccaatggtgctggggttatattaagtgtgtgcgatgatgaagtggctcgttatgaaactgctacattaactgcagctgctgtccctgctcttttacttcctcctccaacaacagctctagacgaacatttagttgctgggctaccagctcttgagccatatgcacgtttatttcatagatattatgccattgcaactccaagtgccacccagcggcttcttcttggacttttagaagcaccaccttcatgggctccagatgcacttgatgctgctgtacaacttgtggaactcctccgagctgctgaagattatgcatctggcataaggcttcccaggaactggatgcacttgcatttcttgcgtgcaattgggatcgcaatgtccatgagagcaggaattgctgctgatgctgcagcagctttactttttcgcattctctcacagcctgcgttgctttttcctccactaaggcaagttgagggagttgaagttcaacttgaacctctgggtggttatttttcaagctacagaaagcagattgaagtgcctgcagctgaagcaactatagaagcaactgcccaagggattgcatctatgctttgtgcccatggccctgaggttgaatggagaatttgcaccatatgggaagctgcttatggcctgattcctttaggttcctcagcagttgatcttcctgaaatcgtagtagcaactccattgcagcctcctatattatcatggaacctgtacatacctctcctcaaggtcttggaataccttcctcgtggaagtccatctgaagcatgtcttatgaagatatttgttgctactgttgaagctatacttacaagaacatttccacctcagtcttcccgagagcaaaccagaaaagctagatatttttctggcttgggatctgcctccaaaaatcttgctgtggcagagcttcggacaatggtccattctctctttttagaatcatgtgcttctgtagagcttgcttcacgcctactatttattgtattaactgtgtgtgttagtcatgaagctcaatccaaagggagtaagagaccaagagatgaggaaagtcttccaacagatgatagcaatgagccctcacaactaacatctgaagtgcaaaaaaacatgaaatataggaagttgaaaaaacaaggtcctgttgccgcatttgattcttatgttcttgccgctgtatgtgctcttgcctgcgagcttcaattgttcccctttatttcaaggggcagtaatcattcaagttctaaaaatgcacggactttggccaagcctgtaaaattaaatggatgcaatggatctagtagcgagttccaaagtagctttgactctgctgttcaccatactcatagaatcttagcaatcttggaggcactgttttctttgaaaccatcttctgttggtacctcttggagttacagttcaaatgagatagtggctgcagctatggttgctgctcatgtttctgaactattcagacggtcaaaggcttgtatgcatgctctctctgttttgatgcggtgcaagtgggataatgaaatttacaccagggcatcatcactatataacctcattgacattcacagcaaagctgttgcatccatagttacaaaagctgagcctttagaggcacacttgcaagtacctgtttggaaagattcccttgtgtgttttgatggcaaaaggcaaaataaaaaattaagcattcgctgctttgattcaggtcagtcatctgcttcacagtgtgtagaatccactcattcagacgctactattataactgagagatcatcatgctcgaaagaaggttcaggaagtaccttgggcaaggatattgcagctttcccattagatgcttcagatttggccaatttcttaacaatggacaggcacattggattcaacttcagtgcacaagttcttttaagaaccttgcttgtggagaaacaggagttatgtttctctgttgtctcacttctatggcacaaaatgattgcagcaccagaaactcaacctagtgcagtaagcacttctgcacaacaaggatggagacaggttgtggatgcactttgcaatgttgtatcagcatcgcccacaaaagcagctacagcaattgttcttcaggcggagagggaattgcaaccttggattgccaaagatgacgaccagggtcagaagctgtggagaatcaaccagagaatagttagattaatggtagaactgatgagaaatcatgatacaccagaatcattggtaattttggcaagtgcgtctgacctacttttacgggccacagatgggatgcttgtggatggagaagcttgcactttaccacagctggagttactggaagcaacagctagagcagttcagcctgtgctagagtggggagaatctggatttgcagttgcagatggcctctcgaatcttttgaagtgtcgtctaccagctacaatccgatgcctttcgcacccaagtgcccatgtccgtgctcttagcacatcagttcttcgcagtattttgcatacctgttcgataaaacctacagctaaccaagcagacataaatgatattcgcggaccctcttatcagttattcaaggtagatgtcatcgattggcaagctgatatagagaagtgcttaacttgggaagctcatagccgacttgcaacaggaatggcaattcaatttcttgaaactgctgcaaaggaactaggctgtactgtttccatttgacatcaactagcttttggtaacaatttcaggttgatctgtattatttctttccttatgagtgagacatttacaggtagaaaaagaccttagtaattggatttgaaggacatgtttggccagagaaataactttcactttattcttctaggtttaaggcctcaaggataacagtgtatagtgaaaacagtagacagggccatgataaaatttcagagacattcttaaagctataccagatgtgtatgtcagctaaaaaggcctgggtgtaacattgttgtgtagattatcagatataatttatatttcttttcac

SEQ ID NO: 6423 - DNA, 4861 bp, Populus trichocarpa
atgatactcagtaacggatgggttggatgaaaatggtcacccttacaaattttacatttacgtccagcactacaacatcatttagtccatgttatcatgtcatgatgtatgtatgaatgtacatgcgtaaattaacatagcaaagattgacatgacgtggttctctaaggttagaggaaaatatcattgccacgtacgcaagacaatctcagaccatctaaaagatctcctcttcctctctaccgaaactacaacctcttaaaaaaagaaaagaactgtcaaggaaattagagtgataaaaaaaatctcaaaaaatcaaactaggcagcttaagttcagatacctgaaatacggtacccagacacaactaccagagcagtagattcaagtatttgtttggattgcaagacactgtgtagaagcatattgggtgagaggcggaaatacagaaactaacaaactaagataattttttttgatcgagaaattctgggggattcagggagtaatccgaggggatgttaaatgatgatatattgatcttgattggtagtggctggaagaaaaaaattgttgttggtttttggtaattgaaaggacagacaactttttaatggctagttcttcttctgagagatggattgatggtcttcaattctcttcattgttctggcctccacctcaagatgcccaacaaagaaaggcacaaattactgcctatgtcgactactttgggcagtgcacatcggaacactttccagatgatatttctgagttgattcgcaatcgttatccatcaaaggacaaacgcctttttgatgatgttttggctacgtttgtccttcatcatccagagcatggacatgctgttgttcttccaattatttcatgtattatagacggtacactagtttatgataggagtagccctccatttgcctctttcatttccttagtctgccctggtagtgagaatgaatattctgaacaatgggctctggcgtgcggagagattttgcggattttaactcattacaatcgcccaatatacaagagggaacaacagaataatgaaacagacagaagcagtagtgacagccacgctacaagtagtgaatcagcagaagggaaatccaccagcatgcctttggtacaacaagagaggaaacctttcaggcctctgtctccctggatcaccgatatattgcttgctgcacctctgggtattagaagtgactactttcgttggtgcagtggtgttatgggtaaatatgctgcgggagagctcaaaccaccaacaaccacttcttcacgtgggtctggaaaacatcctcagctcatcccatcaactccaaggtgggctgtagcaaatggtgctggggttattttaagtgtgtgtgatgaggaagttgctcgttatgagactgctacattaactgcagctgctgttcctgcacttttactccctcctccaacaacagctttggatgagcatctagttgctggcctacctgctcttgagccatatgcacgtttatttcaccggtattacgccattgcaactccgagtgccactcaacgacttcttcttggacttcttgaagcaccaccatcatgggctccagatgcacttgatgctgctgtacaacttgtggaacttcttcgagctgctgaagattatgcatctggaataaggcttcccaggaactggatgcatctgcatttcttgcgtgcaatagggactgcaatgtccatgagagcaggtatagcagctgacgcagctgcagctttacttttccgcattctctcacagcctgcattgctttttcctccactaaggcaagttgaaggggtggaagttcaacatgaacctttgggtggttacatttcatgctacaggaagcagatagaagtgcctgcagctgaagcgactattgaagcaactgcccagggaattgcatccatgctttgtgcccatggacctgaggttgaatggagaatttgtaccatttgggaagctgcttatggtctgattcctttaagttcctcagcagttgatcttcctgaaatcatagttgcaacaccattgcaacctccattattgtcatggaatctgtatatacctctccttaaggtcctggaatatcttcctcgtggaagtccatccgaagcatgcctcatgaagatatttgttgccactgtggaagcaattcttcagagaacatttccgccggagtcttctagagaacagaccagaagaacaagatatttttctagcttagggcctgcctccaaaaaccttgctgtggcagagcttcgtactatggtccactcactctttctagaatcatgtgcctcagtagagcttgcatcgcgactactatttgttgtgttaactgtgtgtgtcagtcacgaagctcattcccgtgggagcaagagaccaagaggagaagaaaacgatctgcctgaggatggcacagaggactcacaatcaacatccgaaatgcgaagaaacatgaaatctagaaggatgaagaaacaaggtccagttgcagcatttgattcttatgttctggctgctgtatgtgctctggcttgtgagcttcaaatattcccctttgtttccagggggagtaaccattcaacttctaaacattcagagactgtagccaagcctgcaaaactgaatggagctgttagtgagttccaaactagtctcaactctgcaatccatcatactcacagaattttatctattttggaggcacttttttctctaaaaccatctactattggcacatcttggagttatagttcaaatgagatagtagctgcagctatggttgctgctcatgtttctgaactatttagacgttctaaggcttgcatgcacgcactctctgttttgatgcgatgcaagtgggataatgaaatttacaccagggcatcctcactatataacctcattgatgttcacagtaaggctgttgcatccatagttaacaaagctgagccattaggagcacatttgcacgcaccagtgtggaaagattctcttgtgtgttctgatggtaacaagcaaaatagaagtgcaagcactggctgctttaattcagggcaatcatctgccctgcagtccacagaattagttcattcagaaactaaacttaaatgtgggagagcatcacattcagaagaaggctctggaagcacttcgggaaaaggtattgctggactcccattggatgcttcagatttggccaatttcttaacaatgcacaggcatattggattcaattgcagtgcacaagttctattgagatcagtgcttccagagaagcaagagttatgtttctctgttgtttctctattgtggcaaaagttaatagcatcacccgaaactcaacctagtgcagaaagcacttctgctcaacaaggatggagacaggttgttgacgcactatgcaatgttgtatcagcatcgccaacaatagcagccacagcagttgttcttcaggcggagagggaattgcagccttggatcaccaaagatgatgattcaggtcagaagatgtggagaatcaaccagcggattgtcaagttgattgttgagctgatgagaaatcatgataccccagaatcgttggtaattttggctagtgcatcagatctacttctccgcgccacagatgggatgcttgttgatggagaagcttgcactttaccacagcttgagctactagaagcaacagccagagcagttcagccagtgctgcagtggggagagtctggatttgcagttgcagatggcctttcaaacctcttaaagtgtcgtctgccagcgactatacgatgcctttctcatccaagtgctcatgtccgtgctctgagcacatctgttcttcgtgatattcagcatactggttcaataaaacccgcttctaaactcacacacaggaatggaatccatggaccctcttatcaatatttcagatcagatgtcatcaactggcaagctgatatagaaaagtgcctaacatgggaagcccatagccgactcgcgacaggaatgcctgttcatcatcttgatactgccgccaaggagttaggctgtactatttccatttaacattgatgagctcttgccagccattacaggttttatcattgctctttccatgagtgagacttacagatataagtagaccatgttaagttgattgaaggatctgatggccagagaattaactttcactttgttctaggtttaaaacctgaggtataacagtgtatagtgaaacaaatcaacatggccatattaattttatctagttcgaatagatacctattttcacgccaaagttcaacatggatggtttaggtttccttcaacagattggtgtacagcagaggggacaagtcagattggtgtacagcagaggggacaggttctatctgaatttccatagcataggttgagaaggcatcgggttctatctgagtttccagaacttgattgtttttgtatttctgtccactgttgatcttagtttagtctctggttgcaagaacaataactacttatccctggttctgcttggaactctgaaccaagacatggccttcaaagaaatgaccctttttcccattcagagcagaaaacaaggacatcaagccatggaaataaattctgatacccaaagagtaagagaaaaaagggtatggatatgaagataatttatttttttctgatattaaaatttaattatctttcgtggaaaacctagtggattataaaaattgcaagcgactagctttgaattcgttcagaaataagatcttgatgcttattgaatgctaa

SEQ ID NO: 6424 - DNA, 1499 bp, Cicer arietinum
ttttaatactaaaatatttttaagaaacccatgctgttaagagttttattaattagacaccaacgttgacccattcattcgctaccatcgccattgaaacaaaacaaggtagtgtcagtcaaacttgcttggttcacctcatcggcgattacattaaggttcaaagattcaatcttttcatctactgagctgtgttgtgttgtgttgtgatggatctaactaaattaaatgctgcacagcttactctgtatggatctgcattttgtgtcatgctttctatgcatttcactttgcagttactttctcagcatctcttctattggaagaacccaaaagaacaaagggctattgttattataatcctcatggctcctatctatgctattgtttcatttgttggtctattggatgttagaggaagtaaagagtttttcactcttttggagtctgttaaagagtgctatgaagctcttgttattgctaagtttttgtctttgatgtatagttacttgaagatatctattagtaaaaatattgttcctgatgaaattaaaggaagggaaattcatcactcctttccaatgacactttttcagcctcattctgttcggctgaaccaccataatctgaagcttctgaaatattggacatggcagtttgttgttatccgtcctgtgtgttccattttgataatttcattacagctacttggactctatcctaattggttgagctgggtcttcaccatcattctcaatgtttctgtctccttggccttgtattctctggtgatcttttaccatgtgtttgctaaagaattggcaccgcataaacctctagcgaaattcttgtgcatcaaaggaattgttttcttctgcttttggcagggaatggtgctggacattttagtagcagctggcgtcattaaatctcgtcatttgaagttagatgtggagcatattgaggaagcaatgcagaacattttggtatgtattgagatggtggtcttttctgttcttcaacagtatgcttatcatgcttcaccatatagtggggaagttgaaaaaatgcttaaacaaaacaagaaaaatgagtgatatggtcaaaagataaagactcaagctataaagatgtattgaagagttatttattgtggcactagaaacatgaaaacattgatgatatgtgtatgtgttgttttgataaagaataatatttgtataattgtattgtactctgccgccataaactcaccttcttcttggtgactgtaattttccagctctactaaataaactttgcttttatttaatcctcacttgatatctactatctagcttgtgacagtttgcttaaagatgaaaattgtttctgattagtgtcagatgcgtttatggtttgaatcattgaacaatagattcaataacttgtgtttcatgcatacatgaatatagtcttgataaaagtctagcaatagtaatctcagcagcaactttaag

SEQ ID NO: 6425 - DNA, 1227 bp, Trigonella foenum-graecum
gccattgaacacaaaacaacgttgtgagtcaaacaagcttgcttcatctcaccggcgattacattaaggttcaaagattcaaacttgagttgtgttgtgctgtgatggatctaactcaactcagtcctgcacagcttactctgtatggatctgcattttgtgtcatgctttctatgcatttcactttgcaattattgtcacagcatcttttctattggaagaatccaaaagaacaaaaagctattatcattatcattcttatggctcctatttatgctattgtttcctttgttggtcttttggatattagaggaagtaaagagtttttcactcttttggagtctattaaagaatgttatgaagctcttgttattgctaagtttttggctttgatgtatagttacctgaatatttccattactagaaatattgtgcctgatgaaattaaaggaagggaaattcatcactcttttccaatgacactttttcagcctcattctgtccggctgaaccaccataatctgaagcttttaaagtattggacatggcagtttgttgtcatccgtccagtgtgctccattttgatgattacattacagctagttgggctctatccaaattggttgagctggacaattaccatcattctcaatacttctgtgtccttggcattgtattctctggtgatcttttaccatgtgtttgctaaagaactggaaccacacaaacctctagcgaaatttctgtgcatcaaaggaattgttttcttctgcttttggcagggattggtgctggacggtttagtagcagttggcgtgattcaatctcgtcatttgaagttagatgtagaacacattgaagaagcaatgcagaacattttggtttgtatagagatggtggtattttctgttcttcaacagtatgcttatcacgcttcaccatatagtggggaagttgaaaaaatgcttaaacaaaacaacaagaaaaatgaatgatatggtcaaaaagataaaagactcaagctatagagatgtatttaagagttatttattgttcccctataaacataaaaactttggatgctatgtgttcttttgataaagaatattattattattatttgtataattataatgtagcagactgtccatcatcctttaccgcaataaactcgccttattggtgacgataattttccagctctacctaaagaaacttggcttttac

SEQ ID NO: 6426 - DNA, 1262 bp, Medicago truncatula
caacattgaccatttcactctttggcagtgccattgaaacaaaacaacgttgtgagtcaaacaagtttgcttcacctcaccggcgattacattaaggttcaaagattcaatcttgagttattgtgttgtgatggatctaactcaactcaatcctgcacagattactgtgtatggatctgcattttgtgtcatgctttctatgcatttcactttgcaattattgtctcagcatcttttctattggaagaatccaaaagaacaaaaagctattatcattatcattctcatggctcctatttatgctattgtttcctttgttggtctcttggatattagaggaagcaaagagtttttcactcttttggagtctattaaagaatgttatgaagcttttgttattgcaaagtttttgtctttgatgtatagttacttgaaaatttccattactaaaaatattgtgcctgatgaaattaaaggaagggaaattcatcactcttttcctatgacactttttcagcctcactctgttcggttgaaccaccataatctgaagcttttaaaatactggacatggcagtttgttgtcatccgtccagtgtgctccattttgatgattacactacagctagttgggttctatccaaattggttgagctggataattaccatcattctcaatatttctgtgtccttggcattgtattctctggtgatattttaccatgtctttgcaaaggaactggaaccacacaaacctctagcgaaatttctttgcatcaaaggaatcgttttcttctgcttttggcaggggttggtgctggacggtttagtagcagttggcgtgattcaatctcgtcatttgaagttagatgtagaacatattgaggaagcaatgcagaacattttggtttgtatagagatggtggtattttccgttcttcaacagtatgcttatcacgcttcaccatacagtggggaagttgaaaaaatgcttaaacaaaacaacaagaaaaatgaatgatatggtcaaagataaaaggctcaagctacagagatgtatttaaagagttattcattgtgccaccagaaacataaaaacattcgatgttgtatgttcttttgataaagaatattattattattattattatcatttgtataattgtaatgtagtaggctgtccatcatcctttaccgccataaactcaccttattggtgactgtaattttccagctctacctacagaaacttggcttttatt

SEQ ID NO: 6427 - DNA, 1394 bp, Medicago truncatula
gttgaacaccaacattgaccatttcactctttggcagtgccattgaaacaaaacaacgttgtgagtcaaacaagtttgcttcacctcaccggcgattacattaaggttcaaagattcaatcttgagttattgtgttgtgatggatctaactcaactcaatcctgcacagattactgtgtatggatctgcattttgtgtcatgctttctatgcatttcactttgcaattattgtctcagcatcttttctattggaagaatccaaaagaacaaaaagctattatcattatcattctcatggctcctatttatgctattgtttcctttgttggtctcttggatattagaggaagcaaagagtttttcactcttttggagtctattaaagaatgttatgaagcttttgttattgcaaagtttttgtctttgatgtatagttacttgaaaatttccattactaaaaatattgtgcctgatgaaattaaaggaagggaaattcatcactcttttcctatgacactttttcagcctcactctgttcggttgaaccaccataatctgaagcttttaaaatactggacatggcagtttgttgtcatccgtccagtgtgctccattttgatgattacactacagctagttgggttctatccaaattggttgagctggataattaccatcattctcaatatttctgtgtccttggcattgtattctctggtgatattttaccatgtctttgcaaaggaactggaaccacacaaacctctagcgaaatttctttgcatcaaaggaatcgttttcttctgcttttggcaggggttggtgctggacggtttagtagcagttggcgtgattcaatctcgtcatttgaagttagatgtagaacatattgaggaagcaatgcagaacattttggtttgtatagagatggtggtattttccgttcttcaacagtatgcttatcacgcttcaccatacagtggggaagttgaaaaaatgcttaaacaaaacaacaagaaaaatgaatgatatggtcaaagataaaaggctcaagctacagagatgtatttaaagagttattcattgtgccaccagaaacataaaaacattcgatgttgtatgttcttttgataaagaatattattattattattattatcatttgtataattgtaatgtagtaggctgtccatcatcctttaccgccataaactcaccttattggtgactgtaattttccagctctacctacagaaacttggcttttatttgatcacttgatgtctactatctagtctgtatcattttgcttagaatgataattgtttgtgatttttgttagatgtgtttatggttgaatcaagtgaataatctatcaatagatgaataaaag

SEQ ID NO: 6428 - DNA, 1206 bp, Lotus japonicus
ggcagcgccgttgaaagcttgtggagagtcaaagctaatccgatcagttcagttcagttcagttcatcgccgattaaggctcagagatttaagcatttcatatcaggatggatctaagtaaaatgaatcctaggcagctcactacggtgggatcggcgtttggcgctatgctttcgatgcatttcaccacacagttactgtctcagcatctcttctattggaagaaccccaaagagcaaagggctattatcattatcatcctcatggctcctatctatgcagttgtctcctttgtgggactgttggatattgaaggaagcaaggagtttttcacttttttggagtctgttaaagaatgctatgaagctcttgtcattgctaagtttttggctttgatgtatagttacttgaacatatcaattagtaaaaacattgtgcctgatgagattaaaggcagagaaattcaccactcttttccaatgaccctttttcagcctcatactgttcggttgaaccaccatactctgaagcttctaaaatattggacatggcagtttgttgtcgtccgccccgtgtgctccattttgatgattctgttacagctaattggtctatatccaacttggttgagctggacattcaccatcattctcaacatttctgtgtcattggccttgtattctctggtgatcttttaccatgtgtttgctaaagaacttgctccacacaaacctcttgcgaatttctgtgcatcaagggaattgttttcttctgcttttggcagggaatggttctcgatggtttagcatcatttggcatccttcaatctcttccttataaattagacgtggagcacgttgaggaagcaatgcagaatatgttggtaatcatagagatggttgtcttttctgttcttcagcagtatgcttatcatgtcgcaccatacagtggagaagttgaaaaaatgcttaaacaaaacaagaagaatgaatgatatggtcaaaagatgaaaaggcaggctatagcgatgtatttaggagttactcaccctggcggtataaacatgtaaacattgataccaagtagatgtgtcgtttctatgaagaatatcagtttattgtataaggccacctttccaccaccactactccttcttggttgctgtattttcccaatcttctaatggaacttagctcttgtttcgtt

SEQ ID NO: 6429 - DNA, 1237 bp, Theobroma cacao
caatcagcagggacgcatcaaattcgacctctacctcggacttctacttcatctgtaaactgagtttccatttcctcaatccccttctcaaaggtttcattgatcagattcttgctttgggtttctgttctcttacctgaaaccatggactttagccatttaaatcgcgggcaaattactctgatgggatctgcattctgtgtgatgctcacgatgcatttcacgttgcagcttctgtcgcagcatcttttttactggaaaaacccaaaggagcagaaagctatactaattattatccttatggctcctatttatgctattgactcctttgtggggttattggatgttcgaggaagcaaagcgttcttcatgtttttggaatcagtcaaggaatgttatgaggctttggtgattgctaagttcttggcattgatgtatagttacttgaatatatctattagcaaaaatattgtgcctgatgaaatcaaaggaagagagattcaccactcatttccaatgacccttttccagcctcgaacagttaggctgaaccaccgcacactaaagcttctcaagcattggacatggcaattcgtcgtcatccgccctgtgtgttctatcttgatgataatattgcaggtccttggggtttatccttcttggttgagctggacattcactatcatcctcaatatttctgtttcattagcattatactctttggtaatcttttaccatgtttttgcaaaagagttggcacctcacaagccacttgcaaagttcatgtgcatcaaggggattgttttcttctgcttttggcagggagtggtgctggacatactcgttgcaatgggcatcattcgatctcatcatttctggttggatgtggagcaccttgaggaagctcttcaaaacgtgttggtgtgtctagagatggttgttttctctgttctccagcagtacgcataccatgttgcaccttatagtggagaagttgaagctaagatgaagctaggcaagaaaaatgaatgatattttgatgcctaggtgtaattgggagacaatatatattcacataatgcttatactctgttgtatcatcacttttgtctatcaaacatgaaatttgagctgcaagagaaaacatttctgttgaggaacttctagtctaccaagtgcaaagctaaagaaacttttaaaacctttaatgtgtaactggatataacatatgacagag

SEQ ID NO: 6430 - DNA, 1506 bp, Theobroma cacao
gttagggttaggattgtgggataagcgcatttaatattctaaaccgaccctgatccatagacccgtgacgtcgaattcagactctcctacaccatttactcgagctcacgtggcaaaatcagagtatgtctcgtgttattttacacatttaaaacgcgttaatcggtggttggtagatgctaaagctgcaattattatattagatcagcaatcagcagggacgcatcaaattcgacctctacctcggacttctacttcatctgtaaactgagtttccatttcctcaatccccttctcaaaggtttcattgatcagattcttgctttgggtttctgttctcttacctgaaaccatggactttagccatttaaatcgcgggcaaattactctgatgggatctgcattctgtgtgatgctcacgatgcatttcacgttgcagcttctgtcgcagcatcttttttactggaaaaacccaaaggagcagaaagctatactaattattatccttatggctcctatttatgctattgactcctttgtggggttattggatgttcgaggaagcaaagcgttcttcatgtttttggaatcagtcaaggaatgttatgaggctttggtgattgctaagttcttggcattgatgtatagttacttgaatatatctattagcaaaaatattgtgcctgatgaaatcaaaggaagagagattcaccactcatttccaatgacccttttccagcctcgaacagttaggctgaaccaccgcacactaaagcttctcaagcattggacatggcaattcgtcgtcatccgccctgtgtgttctatcttgatgataatattgcaggtccttggggtttatccttcttggttgagctggacattcactatcatcctcaatatttctgtttcattagcattatactctttggtaatcttttaccatgtttttgcaaaagagttggcacctcacaagccacttgcaaagttcatgtgcatcaaggggattgttttcttctgcttttggcagggagtggtgctggacatactcgttgcaatgggcatcattcgatctcatcatttctggttggatgtggagcaccttgaggaagctcttcaaaacgtgttggtgtgtctagagatggttgttttctctgttctccagcagtacgcataccatgttgcaccttatagtggagaagttgaagctaagatgaagctaggcaagaaaaatgaatgatattttgatgcctaggtgtaattgggagacaatatatattcacataatgcttatactctgttgtatcatcacttttgtctatcaaacatgaaatttgagctgcaagagaaaacatttctgttgaggaacttctagtctaccaagtgcaaagctaaagaaacttttaaaacctttaatgtgtaactggatataacatatgacagagtttcatgtatgataatcatcacatttttcttggaaatttgcaataaacatacgatataagt

SEQ ID NO: 6431 - DNA, 1549 bp, Lupinus angustifolius
gggtaggatctaatggatggcacgtggaacttaattattaagattgaagctgtcacaagtacaccattcctgactccatctttcttcaactaatcccataaatcttttcattcaaacaaatccttcagttgactcaaacaaacataagattctaagatttggaaggtttcatctgagattattataataagtagagatgggttttaatctactggctgcactgaatcctgcactggctcacctcaatcctgcacaactcactctaatgggatctgcattttgtgttctggcttctatgcatttcactacacagttgatgtcacaacatcttttctattggaagaacccgaaagagcaaaaggctattcttatcataatccttatggctcctatatatgctgctgtctcctttgttggtcttttggatatcaaaggatcaaaagagtttttcatgtttctggaatctgttaaagaatgttatgaagctcttgtgattgccaagtttttggctttgatgtatagttacttgaacatatcaattagcagaaatattgtgcctgatgaaattaagggcagggaaattcaccacacttttccaatgacactttttcagcctcattctgttcggctgaaccagcagaagctgaagcttctaaaacaatggacatggcagtttgttatcatccgaccagtgtgttccattttgatgattgctttacagcttcttgggctgtatccaacttggttgagctggacattcaccgccattctaaatatttctgtatcgttggccttgtattctctggtgatcttttaccatgttttcgcaaaagaactggcaccacataaaccactagcaaagttcctctgcatcaaaggaattgtgttcttctgcttttggcagggaatggttctcgacattttagcggcaacgggagtccttaagtctcttcccttcaagttagatgtggagcacattgaggaagcaatgcagaatattttggtatgtgtagagatggttgtcttttctgttcttcaacagtatgcttatcatgcttcaccatacagtggacaagttgaacaaatgctcagacaaaacaagaaatatgaatgatatcatatgcattatctaccttataccatttgcttactatatattataagtgtttctcatcactttttcagatactttatggtttgtattaagaaataactgttcatgctcatttcttcatgaattttatgagggagtcaccattagttgaaaatgttggttttgatagagtcactatgcatcatataatttggtgcattttaagtagatcaatgaaaccacttttgtgaagcttgataaggagactttggttgcagttttttttccctagtgcattaaaatttgggtcattggtttgatatgaggaacatgtgggatggtttatgggacaaggatctgctgtcccaaaccctgtcccagaccaatcatattatgtcatgttaattaaaaaaaaattaaatatttataactttatcagttttgcttcattgtgaa

SEQ ID NO: 6432 - DNA, 1746 bp, Ricinus communis
gtggcccatatcattgattaattggaattttacttctgtttattgaaagtaatatctccattttcatttcttgcatccccacctgcgttagttccagaagctagtctttgatcaaatcattctctctaagtacactcgatcttcttctatctctgcctcttgttgatctgattcatacttctcaaactcagtcttgtataatggatatatccactttgaatcgtgggcaactcacattaatgggatctgcattctgtacaatgcttagtatgcattttacagtacagctcctatcacaacatctattttactggaaaaacccaaaagaacaaaaggcaatacttattatcatccttatggctcccatttatgccatcgactcttttgtgggtttgttggatatccggggtagtaaagcattcttcatgtttttggattccattaaggagtgttatgaggctttggttattgccaagttcttggctttgatgtacagttacctgaatatatccattagcaaaaatattgtgccagatgaaataaaaggaagagaaattcaccattctttcccaatgacacttttccagcctcacactgtccggctggaccatcgtactctgaggctcctcaaatattggacatggcagtttgtaatcattcgaccaatatgctctgtcttgatgataacactacaaattcttggcacatacccgacatggctgagttggaccttcaccattatcctcaacatttcagtttctctggcactgtattctctggtggtgttttaccatgtgtttgcaaaggagttgacaccacacaagcctcttgcgaagttcttgtgcattaaggggattgtcttcttttgcttttggcagggggtggtgcttgacatacttgtggccattggtataatacgatctcatcatttctggttggatgtcgagcacattgaggaagcccttcagaatgtcttggtatgcctagagatggttgtattttctgttctccaacagtatgcataccatgtggcgccatatagtggagatattgaaagaaagatgaaacttaataaaaatgaatgatatgaccagacaactaaactttggagaggacacttttacatttgcatatggaatattttctaatttgcttttctgcttctgttaaaaagagaaaagggcagatgcctccaaatttgcttagatgcgcagactgacattttataaagaatggctccttgtgttgcctaatggttaggaagtaagacccgtctgtcattaagctataatactttgcttgtaataaaagtatcataagttgtgactcttggattgataggaagggctggccttcctttatggatgttgttcttgacaaatttgctcttattgtatagcatcgaactctatttgctggaaggatctgtcgagttattatttctatcttgcactcagaatgcatagtaagaagttagaaattgatagtattagtgttgtaagagggctgctgaaacagcaaacagagaatggcaagcagcatgcatggtgcaacttgaaatgtgtttctggggtgattgtcttgtggaacacagatcgtgccattccttttgaattttcccctacattcatcagtgagtgcagctctgtacacgtcagatgcaatatagggatcagattccgtttcctggttctgcaatgatgttttagttgaaccagacccagtatcaatatcatattgtttttt

SEQ ID NO: 6433 - DNA, 1315 bp, Manihot esculenta
gggcccacgttattaacttggaatttactcctgaattctgaatttctgatgttcaatcaggactattggaggattttattttcttgcatccacagagcggtcaacagcccaagaagcaagaacaagtgcctttcaaatcattgttcaagttcagtcgatctccgttttctcgttcactctaccttgatttgatccgagacttctcagcttgctgttcaataatggatataaccactttgaacccaggacagctcacactaatgggatctgcattctgtacgatgataacaatgcattttaccctgcagctcctatcgcagcatcttttttactggaaaaacccaaaggaacagaaggccataataattattatccttatggctccaatatatgccatagactcgtttgtgggtttattggatattcaggggagtaaggcattcttcatgtttttggactcaattaaggaatgttatgaggctttggtgattgccaaattcctagctttgatgtacagttacctgaatatatccattagtagaaatattgtaccagatggaataaaaggaagagaaattcaccattctttcccgatgacacttttccagcctcgcactgtccggctggaccaccgtacactaaggcttctcaaatactggacatggcaatttgttatcatccgcccgatatgttccattttgatgataacactacaacttcttgggttttacccttcttggttgagttggacattcaccattatccttaacatttcggtttctctggcattgtattctctggtggttttttaccatgtgtttgcaaaggagttggcaccacacaatccacttgcaaagttcttatgcatcaaggggattgtcttcttttgcttttggcagggagtggtgcttgacatactagttggcttgggtataattcgatctcatcatttttggttggatgtggagcacattgaggaagctcttcagaatgtcttggtatgtttggagatggttgtgttctctgttctccaacagtatgcataccacgtttcgccgtatagtggagaagtggaaacaaagttgaaactaaataagaaagattgatatgatcagacagtaactagagttatatatgcaaatggaatatttagtagattgttctattgaaagaaggacaggagatgtaccttaatattttgcttagatgtccatgtagaatgacatttataaagtagaatggcatatgaaccctcctagtgcagtgtctttgcagctgcaagtcctatgcaattttagtagtcattttgaatttc

SEQ ID NO: 6434 - DNA, 1103 bp, Euphorbia peplus
gttcatcttcccgtctccgactcaatcttcttgaccttgatctgattacagattctcaactgctgttaaaatgatcgattttaatgctttggaccgggggcaaatcacgttgcttggatctgcattttgtacaatgcttacaatgcattttacactgcagctcctctcacagcatatgttttactggaaaaacccgaaagagcaaaaggccataattattattatccttatggctccaatatatgccatcgactcctttgttggtttgttagatatccaggggagcaaggaattcttcatgtttttggactccattaaggaatgctatgaagctttggtgattgccaagttcatggccttgatgtatagttacctgaatatatccattagcggtaaagttgttccggatgaaataaaaggaagagaaatccatctttcttttccaatgactcttttccagccccggaccctcctgctaaaccacaagactttgaagctcctgaaatactggacatggcaatttgttgtcatccgcccgatatgttctattctaatgataagccttcagcttcttgggatataccctacttggttgagctggacatttactattatcctcaatgtctcagtttcattagctctgtattccttggtgttgttttatcatgtatttgctaaggagttagcaccacataatccacttgcaaagttcatgtgcatcaaggggattgtcttcttttgcttttggcagggagtggtgcttgatattctagttgccgctggttttataaaatctaatcatttctggttggatgtggagcacattgaggaagctttacagaatgttttggtatgtttggagatggttgtcttctctgttcttcaacaatatgcttatcatgttgccccgtacagcggagaagtggaaagcaagttcaaactgaacaaaaaaagagaatgatatgagtatgaatatacgctagtaaactcgagaaattacttagatatggaaatggatcctcatattttatagcttcttgtatacatttgaaattacttatgagccacactgatgatcgatcgaagacacatgtactacgtgc

SEQ ID NO: 6435 - DNA, 1345 bp, Prunus mume
aacagcggcagccagcagggccaggccctgtctgcgagtaaatgaatgccataattgggagggggttggtgggcttgtgataaatgaggactgatgtatgagcactcacacaaagaccctcaagacgagactgaaacaatctgattcttcactcaaattcaatcacaaaagggtatcttgggtttattggaccgctcgattgctccgattcgattccaaccttgggctccatctcactgctgaataatggatttaagtacaatggatcggggccaattgacgctgctaggatctgcatcttgtgtgatgcttacaatgcatttctcagtccagttactgtcacaacatctcttttactggaagaacccgaaggagcagaaggctataataattattattcttatggctccaatatatgcagttgactcatttgtgggcttattggatattcagggaagcaaaacttttttcatgtttttggactctattaaggagtgttatgaggctctggtgattgctaagttcttggctctaatgtatagttacctgaagatatccataagcaagaatatagtgccagatgaaatcaaaggaagagaaattcaccactcgtttcctatgactctttttcagcctcacaccgttcggctaaaccaccataccctgaagctactcaaatattggacttggcagtttgtcatcatacgcccagtttgttctgtcttgatgataacactgcaagcacttggactctaccccagttggttgagctggacattcactatcattcttaatgtttcagtttcattagcgttatactctctagtggtgttttaccatgtgtttgcaaaggaattggcaccacattccccccttgcaaagttcctgtgcatcaagggaatagtcttcttctgcttttggcagggagtggtgattgacgtattagctgctgtaggcgtcattcgatctcatcatttctggttagacgtggagcacattgaggaagctattcagaatgtcttgatatgtctggagatggtggtgttttctgttctccagcaatatgcataccatgttgcaccttacagcggagacgtagaatcaaagatgaaattaaacaagaagagggagtgatttgaatagttttcatataaactatatacaagagtgtgatttcttttttcagttttagtaaaatgtatcacctctcaacaataatatgacgtgtgtttggaccaactttgaactactttgaactatcttccttaaaagatgaggtgttcaattggatcatgcatttcatacaaatttttttttcaggataatttattctatttcctctgtt

SEQ ID NO: 6436 - DNA, 1348 bp, Prunus persica
aacagcagcagccagcagggccaggccctgtctgcgagtaaatgaatgccaaaattgagaggggttggtgggcttgtggtaaatgaggactgatatgtacgagcactcactcaaagaccctcaagacaagactgaaacaatttgattcttcactcaaattcaatcacaaaagggtatcttggatttattggaccgctcgattgctccgattcgattccaaccttgggctccatctcactgctgaataatggatttaagtacaatggatcggggccaattgacgctgctaggatctgcagcttgtgtgatgcttacaatgcatttctcagtccagttactgtcacaacatctcttttactggaagaacccaaaggagcagaaggctataataattattattcttatggctccaatatatgcagttgactcatttgtgggcttattggatattcagggaagcaaaacttttttcatgtttttggactctattaaggagtgttatgaggctctggtgattgctaagttcttggctctaatgtatagttacctgaagatatccataagcaagaatatagtgccagatgaaatcaaaggaagagaaattcaccactcgtttcctatgactctttttcagcctcacaccgttcggctaaaccaccataccctgaagctactcaaatattggacttggcaatttgtcatcatacgcccagtttgttctgtcttgatgataacactccaagcacttggactctaccccagttggttgagctggacattcactatcattctaaatgtttcagtttcattagcgttatactctctagtggtgttttaccatgtgtttgcaaaggaattggcaccacattccccccttgcaaagttcctgtgcatcaagggaatagtcttcttctgcttttggcagggagtggtgattgacgtattagctgctgtaggcgtcattcgatctcatcatttctggttagatgtggagcacattgaggaagctattcagaatgtcttgatatgtctggagatggtggtgttttctgttctccagcaatatgcataccatgttgcaccttacagcggagacgtagaatcaaagatgaaattaaacaagaagagggagtgatttgaatagttttcatataaactatatacaagagcgtgatttcttttttaagttttagtaaaatgtatcacctctcaacaataatattacgtgtgtttggaccaactttgaactactttgaactatcttccttaaaagatgaggtgttcaattgggtcatgtatttcatacaaattttttttttcaggataatttattctatttcctctgttt

SEQ ID NO: 6437 - DNA, 1126 bp, Euphorbia esula
  misc_feature (9)..(9): n is a, c, g, or t
  misc_feature (97)..(97): n is a, c, g, or t
  misc_feature (397)..(397): n is a, c, g, or t
  misc_feature (430)..(430): n is a, c, g, or t
  misc_feature (463)..(463): n is a, c, g, or t
  misc_feature (473)..(473): n is a, c, g, or t
  misc_feature (502)..(502): n is a, c, g, or t
  misc_feature (505)..(505): n is a, c, g, or t
  misc_feature (634)..(634): n is a, c, g, or t
  misc_feature (641)..(641): n is a, c, g, or t
  misc_feature (655)..(655): n is a, c, g, or t
gttcatctncccgtctccgactcaatcttcttgaccttgatctgattacagattctcaactgctgttaaaatgatcgattttaatgctttggaccgngggcaaatcacgttgcttggatctgcattttgtacaatgcttacaatgcattttacactgcagctcctctcacagcatatgttttactggaaaaacccgaaagagcaaaaggccataattattattatccttatggctccaatatatgccatcgactcctttgttggtttgttagatatccaggggagcaaggaattcttcatgtttttggactccattaaggaatgctatgaagctttggtgattgccaagttcatggccttgatgtatagttacctgaatatatccattagcggtaangttgttccggatgaaataaaaggaagagaaatncatctttcttttccaatgactcttttccagccncggaccctcntgctaaaccacaagactttgaagctcctnaantactggacatggcaatttgttgtcatccgcccgatatgttctattctaatgataagccttcagcttcttgggatataccctacttggttgagctggacatttactattatcctcaatgtctcagtttcnttagctntgtattccttggtnttgttttatcatgtatttgctaaggagttagcaccacataatccacttgcaaagttcatgtgcatcaaggggattgtcttcttttgcttttggcagggagtggtgcttgatattctagttgccgctggttttataaaatctaatcatttctggttggatgtggagcacattgaggaagctttacagaatgttttggtatgtttggagatggttgtcttctctgttcttcaacaatatgcttatcatgttgccccgtacagcggagaagtggaaagcaagttcaaactgaacaaaaaaagagaatgatatgagtatgaatatacgctagtaaactcgagaaattacttagatatggaaatggatcctcatattttatagcttcttgtatacatttgaaattacttatgagccacactgatgatcgatcgaagacacatgtactacgtgcaaaaaatttaaaacttttcatat

SEQ ID NO: 6438 - DNA, 3059 bp, Glycine max
ggattgttcggtctcatggagcgaaacagcgtattcggccgtgatagataaaggcatgaagcaagaagcaagaagcaagaagcaagcacccatccactgtaagaatggagcaaaacctaatgctggccgcagaagcagagcgcgaaaaaagcaaagccatgtctgattccgacgagaggatgaaggaaaccctagccctgaccgcagaagcagagcgtgacagagacaactccatgtctgatttcgacgactctgattctgaggacgaagctcagcagaacctccaactcgaatctctccagaccgagcttgttactaatccctctaactacgatgctcatttgcaatatataacgcttctgaggagaatgggtgatgttgataaactgtcaagagccagggaagctatgagtgaactctttccgttgagccctgcaatatggcgccaatggatcaaagatgagctttctctcaacactgctactcgacccgaggctttctctagaattctgaagctttacgaacgaggggtgtttgattatctgtctgtctctctatggtgtgactacattaattttgtacaagagtttgatccaatggtacgccaatgttcacctactggtatttccaaggcaagggatctgtttgagagtgcccttactgcagccggtctgcatgttgctgaaggcagtaaaatatgggaagcatacaggaaatatgagcaggctatacttctaaccttcgatgatattgatgcacaggccaaagaaaagcaagttcaaagcattcgtagtttattccaccgccagttgtctgttccccttgctggtatgagttcaacaattactgcctataagacttgggaggtggaacaaggaagtcttcaagatgttgaatccattgacttggttgatatttatcctcatgttgcggcttcataccagaaggccttggatatgtataatgctcgttttcatcttgaagaacagattttgagcccgaatgtttctgattcagaaagattacaacactacatgaactatttgaaatttgagcagtcttctggaacgccagccagaattcaagttctatatgaacgagccattactgactttcctataacacctgatctttggctggattatacttgcaatttggacaacactttgaaggttggtaatattgtcaacaatgtttattctagggcgactaagaactgcccttgggttggagaactttgggttcgatgtatgctttcattggagcgtggtcatgcttctgaaaaagacttgtctgaaatctttgaaaagtcccttcagtgtaccttttcaactcttgacgagtatcttgatttgtttcttacccgggtagatggcttaaggcgaagaatggcatccagcaatgaagaggatttggaatataaaataataagggagacctttcagcgtgcatcggattatctgtcgccatacttgaagaatacagagggtttgctacatttacatgcttattgggctcgtttggaaacaaaacttgggaaagatataactgcagctcgtggagtttgggagaattgtctgaagatatgtggttcaatgttggagtcatggactggttatatagcaatggaagtggaattgggtcacataaatgaagcaaggtccatatacaagagatgctacagtaaaagattttctggaactggttcagaggacatatgccaatcatggttacgctttgagagggaatttggcaagttggaagattttgatcatgcattacacaaggttacccctcggctggaagagctaaagttatttaggatacagcaggaatccaagacagcagaggaaagtgaaaagaatcctaagagaaatgctcgtgaaaagagaaagctgggatccgatataactgaagaacagtatccaacaaagagatttagagatgttggaaatccaaagaaagcacctgaggagaataaatatcaactgcagaacacttctcaggtgacaaaagtggaaggggccaattggaagaatactaaaattgatgataacccaagtgagcaacagtttaaccacgaaaagaacagggcatactctgaccagtgcaccgtttttatatcaaatcttcatcctacggcaaattatgaacatattcgtaatttcttcggcgatgatggtggaattgttgccatccgcatcctacatgataaattcactggaaaatcaaggggactagcatatgtggactttttggatgaagaacaccttgctgctgcaatagctaagaacaggcaaaagttaattggaaagaagctaagtattgctcggtctgacccaaagcgaggtggaaaggaatcttctaatccaaaaacatggacagaacatgcacgtgccactaatcattctagtcaaaaaggtttcgtatccaaagagactgatgatactcacaagggagatgtaaaggatgcgaagttctcttctagaaagccaggaaatgataacatccagcttaaagggaagaatacttttgccgtgcctagaaatgtcaaaccacttggttttactgcaaataaactaaaagcagaagagggggatgaaaagccaaaatctaatgaagaattcagaaagatgttcattcgttaaggattttgtgcccctaatttgtgactccgaagatggcagttatctttcaaattttaggcaaaggtggaaatgacacaagttattttgtctccagtatggctctttgttctgtctgttgcattactaattagatcagtctacctagattaacctttcggtagtctctactgtttacaaattacaattgatttacacaatattttttggttgcggctgtatagtgtccgtacttgaaattttcacagtacaattctctgatagatgttagatattttacattgtaatacaattgggctatattttcccccaagtttataccagtcacttgtgtgcacataacaggcaaataaagtgtattatgctgtgatgggatattaattatattccgttgattaaaaagtggagtgtgtt

SEQ ID NO: 6439 - DNA, 2968 bp, Glycine max
atccatatggagcgaagcggcctgaagcaagaagcaagaagcaccatccactgtagaaatggagcaaaacctaaacctgaccgcagaagccatgtctgattccgacgagaggatgaaggaaaccctagccctgtcctcagaagcagagcgtgacagagacaaatccatgtctgattctgattctgaggacgaagctcagcagaacctccaaatcgaatctctacagaccgagcttgttactaacccctctaactacgatgctcatttgcaatatatacggcttctgaggagaatgggtgatgttgataaactgtcaagagccagggaagctatgagtgaactctttccgttgagccctacaatgtggcgtcaatggatcaaagatgagctttctctcaacactgctgctcgacccgaggctttctctagaattctgaagctttacgaacgaggggtgtttgattatctgtctgtctcactttggtgtgactacattaattttgtacaagagtttgatccaatggtacgccaattttcacctactggtatttctaaggcaagggatctgtttgagagtgcccttactgcagctggtctgcatgttgctgaaggcagtaaaatatgggaagcatacaagaaatatgagcaggacatacttttaaccttcgatgatactgatgaacaggccaaagaaaagcaagttcaacgcattcgtagtttattccaccgccagttgtctgttccccttgctggtatgagttcaacaattactgcctataagacttgggagatggaacaaggaagtcttcaagatgttgaatccattgatttggttgatatttatcctcatgttgcggcttcataccagaaggccttggagatgtataatgctcgttttcatcttgaagaacagattttgagcccgaatatttcagattcagaaagattacaacactacatgaactatttgaaatttgagcagtcttctggaatgccagccagaattcaagttctatatgaacgagccattactgactttcctataacacctgatctctggctggattgtactcgcaatttggacaacactttgaaggttggtaatattgtcagcaatgtttattctagggcaactaagaactgcccttgggttggagaactttgggttcgatatatgctttcgttggagcgtggtcatgcttcggagaaagacttgtctgaaatctttgagaagtccctgctgtgtaccttttcaactcttgacgagtatcttgatttgtttcttacccgggtagatggcttaaggcgaagaatggcatccagcagtgaagaggatttggaatataaaataatacgggagacctttcagcgtgcatcggattatctgtcgccttacttgaagaatacagagggtttgctacatttacatgcttattgggctcgtttagaaacaaaacttgggaaagatataactgcagctcgtggagtttgggagaattgtcttaagctatgtggttcaatgttggagtcatggactggttatatagcaatggaagtggaattaggtcacataaatgaagcaaggtccatatacaagagatgctacagtaaaagattttctggaactggttcagaggacatatgccagtcatggttacgctttgagagggaatttggcaagttggaagattttgatcatgcattacacaaggttacccctcggatggatgagctgaagttatttaggatgcagcaggaatccaagtcagcagaggaaagtgaaaagaatactaagagaaatgctcgtgaaaagagaaagctgggatcagatataactgaagaacagtctccatcaaagcgatttagagatgttggaaatccaaagaaagcacctgaggagaataaatatcatgtgcagaacatttctcaggtgacaaaagtggaaggggtcaattggaagaatactaaaattgatgataatcccagtgagcaacagtttagccacgaaaagaacaggggatactctgaccagtgcaccgcatttttatcaaatcttcatcctacggcaaactatgaacatattcgtaatttcttcagtgatgttggtggaattgttgccatccgcatcctacatgataaattcactggaaaatcaaggggactagcatatgtggactttttggatgaagaacaccttgctgctgcaatagctaagaacaggctaaagttaattggaaagaaactaagtattgctcgatctgacccaaagcgaggcggaagggaatcttctaatccaaaaacattgacagaacatgcagatgccactaatcattctagtcaaaaggcttccggatccaaagaaaccgatgatacttacaagggagatgtaaaggatgtgaagttctcttctagaaagccaggaaatgataacatccagcttaaagggaagaatacttttgccgtgcctagaaatgtcagaccacttggttttactacaaataaaccaaaagcagaagagggggatgaaaagccaaaatctaatgaggaattcagaaagatattcattcgttaaggattttgtgcccttaatttgtgactccgaagatggcagttatctttcagattttaggcaaaggtggaaatgatataaattattgtctccaggatggctgtctgttctgtctgttgcattactaattaaatcagtctacctagattaacttttcggtagcctgtactctttaaaaattacaattgatttacaaaatattttttggttgcggctctgtatagtgtccgtacttgaaattttcacagtacaattctctatgatagatgttacattttacgttgtaatacaaatgggctatatttccccccaagtttatacgagtcacttgtgtgcgcataaccggcaaataaagtgtattatgctgtgatgggatattaattatattcggttgattta

SEQ ID NO: 6440 - DNA, 2295 bp, Cajanus cajan
gtttctgggattttgttttcatgggactgtgtcatggaaaacccattgaaacctcacaaagtgaaggtgggcaccatgttttccctggcgagaaggaggtggtggcgagtcccaaaaccaccacaaaaggttcaaagtttccgttttacagcccaagtccgttgccgagcctcttcaagaactcgccggcgaactcgagcgtgagttcgacccctctgcgcctcttcaagcgcccctttccgccgccgtcgccggcgaagcacattcgggctctgctggcccggcgccacgggtccgtcaagcccaatgaggcctccatccccgaagggagtgagtgtgaagttgggctggacaagagcttcggcttctccaaccacttccaggctcactatgagcttggacccgaggtgggccgtggccactttggctacacttgctctgccaaggggaagaaaggcaccttcaagggccatgatgttgctgtcaaagtcattccaaaatccaagatgacaacagcaattgctattgaggatgtaaggagagaagtaaagatattgcgagctctgagtgggcataaaaatttggtgcaattctacgaagcctatgaagacaatgacaatgtttatatagttatggagttatgcaaaggaggtgaactgctagataagattctttccaggggtggaaagtactcagaagaagatgccagagttgttatgattcagatattgagtgtggtagctttttgtcatctgcagggtgttgttcaccgtgatctgaagccagagaattttctttatgtttctaaggatgaaaactccactctgaaggtcattgattttggattgtctgactatgtaaagccagatgaaaggctgaatgacattgttggaagtgcatattatgtagctcctgaagttttgcatagatcttacgggacagaagcagatatgtggagcattggtgtaattgcttatattcttttatgtggaagccgacccttttgggccaggacagaatctggcatatttcgggccgtcctgaaggcggatccaagttttgatgaagctccttggccatctttatcagctaatgcaatagattttgtaaagagactgttgaataaggattatcgtaaaaggctaactgcagctcaggctctcagtcacccatggctcgccaatcattctgatgatgtgaagataccttttgatatgataattcacaagcttgttaaagcttatatatgctcatcttcattacgcaaatcagcattaggggcccttgctaagacattaacattagtgcagctagcatatctgagagaacaatttaatatcttaggcccgaacaaaagtgggttaatctccatgcagaacttcaagacgggtattttaaggagtgccactgatgcctcaaaggattcacgtgtcttagattatgtgaacatggttagttcaatccaatatcggaaattagattttgaagaattttgtgctgctgctataagtgtccatcaactagagggaatggaaagctgggagcaacatgcaagacgtgcctatgagttgtttgataaggaaggaaatagaccaattatgattgaagagcttgcatcggaacttgggcttagcccatcagtgcctattcatgtggtactccaagattggataagacactcagatgggaagcttagcttcttggggtttgttagacttctgcatggagtttcttctcgcacatttcagaaggcttgagagaaaacacacatgattgctattattttttgtcccccttattgatcataaaccttttgaatgcatgactcatgagcaaactccaacagcaggtttcttcatcttgattggcttcagcaaagccaaaagctatagcttgaagggagtttgttgcctctgaagtgacttgcaacatcttgatgagttctacaaacacaaaacacttcatcagattgattggtggtgctggagttaaggcttgtacagatgaaagtagagcacaggttgtacttagaactagtggaacttccataaagtgagttgtgttttcgggtttatcccatgtgtacccatggcgcacttgtcaataaactatttctacttatgtgaactcctttatagtagacatttttctgttatcaaaaaaaaggaaagctgaacagttaatactcatggatgcatggaaaatataaaaaagtataatgtgtaactatgtattgtagctccttgaatgagcaggatcaatgataattttatataactaaaactttataataaa

SEQ ID NO: 6441 - DNA, 2290 bp, Lotus japonicus
gtttctgggtatctgaattcatgggactctgccatggaaaacccattgaaaccacaagacatcatgaaggtgcagcagcaaacccagaattcccaaatgccaacgagattcttccactgccaccatctactcacagcacaaaatcctccaagtttcaattcttcagtccaagtcccttgccgagtttcttcaagaactcgccggcgaactccagtgtgagctcaacgcctctacgcatcttcaagcggccgtttccgcctccttcgccggcgaagcatatccgggccttgctggcccggcgacatgggtcggtgaagcctaatgaggcttctatccctgaagggagtgagtgtgaggttgggttggataagagctttggattctccaagaacttcttggctcattatgagcttggacaggaagtggggcgtggccattttggttacacttgtgctgccaaggggaagaagggtagcttcaagggtcatgatgttgctgtcaaagtcattccaaaatctaagatgacaacagcaattgctatagaggatgtaaggagagaagtaaagatattgcgagctctaactgggcataagaatctggtgcaattctatgaagcctatgaagatgacgaaaatgtttatatagttatggagttatgcaaaggaggggaactgctggataagattctttccaggggtggaaagtactcggaagaggatgccagagttgttatgactcagatattaagtgttgtagcttactgtcacctgcaaggtgttgttcaccgtgatctcaagccagagaattttctctttgcttctgaggatgaaaattcctcattgaaggcaattgattttggactgtctgactatgtaaagccagatgagaggttaaatgatattgttggaagtgcatattatgttgctcctgaagttctgcatagatcttatgggacagaaggagatatgtggagcattggtgtaattgcttatatacttttatgtggaagccgacctttttgggccaggacagaatctggcatattccgggctgtcttgaaggcagatccaagttttgatgaagctccttggccttctttatcggctgatgcgatagattttgtaaagaggctgttgaataaagattatcggaaaagactaactgcagctcaggctctcagtcatccatggctggtgagtcacagtgatgatatcaaaataccctttgatatgataatccacaagcttgttaaagcatacatatgctcatcttctttacgcaaatcagcgttaggggctcttgcaaagacattaacattagtgcagctagcatatctcagagaacaatttactcttctggggccaaacaaaaatggattaatctcaatgcagaacttcaaaatggctattttaaggagcgccactgatgcctccaaggattcacgggtcttagattatgtgaccatgattagttcaatccaatatcggaaattggattttgaggaattttgtgctgctgctataagtgtccatcaactagaaggaatggacacctgggagcaacatgcaaggcgtgcctatgagctgtttgaaaaggatggaaatagaccaattatgattgaagagcttgcctcggaacttgggcttagcccatcagtacctattcatgtggtactccaagactggataagacactcagatgggaagctaagtttcttggggtttgtcagactcctgcatggagtttcttctcgcacatttcagaaggcttaagagaacgaacacacatgtgattgctattgtctttttaattattcttgcacttagtgatcataaatcttttgatggagtatgaatgcatgactcatgagcaacctccaactgcttcagcaagccaaaatcgttatagatgggagttgcgcgggaagctatatgcaaacatctcatgtcgttaagagccctcttcaagagttctacaaactgaagacactttctccaccccgtttcttaagtttaaggttggtgctgctggagttaaaaggctctgtacagatgaaagtagagcacaaacacaaagtgtacttagaagtagaggaacttggttaaaatgagtcgtgttttcgggtttatttatcatcccttgtgtaccaatggaacttatcaataaactatttccacttatgtgaactcctttttctttgggtacgaactccgtgattagttgacagtgcaatttgttttaagataggtgaaatgtttgacaggaaggaatgtgcatgtgcttgtggatt

SEQ ID NO: 6442 - DNA, 2658 bp, Cajanus cajan
ggttcgtgatttaatgggaatctgccatggcaaacccatcgagacccaacaacaagaaagttctcatgagttcccaaacgaggttgcaccttcgactacaaagcccacgaagcccgctaagttcccgttctacagcccaagcccgctgccgagttggttcaaaaactcgccatcgtcgaactcgaacccgggcagcgtgggctcgacgccgctgaggatcttcaagcggccctttccccctccctctccggccaagcacatccgggccctgctggcccgccgccacggctccgtcaagcccaacgaggcctccatccccgaagggcccgagtgcgagcttgggctcgacaagaccttcggcttcgccaaacacttctcggcccactacgagctcaacgaagaagtgggccgcggccatttcggttacacctgctccgccaagcccaagaaggggcccttcaagggcatcgatgtggccgtcaaagtcattccaaagcccaagatgaccacagcaattgccatagaggatgtaaggagagaagtgaagatattgcgtgctctaacaggacataagaatctggtgcaattctatgaagcctatgaagatgatgataatgtttatatagttatggagttatgcaaaggaggagaattgctagataggatactttcaaggggtggaaagtactcagaagaggatgccagagttgttatgattcaaatattaagcgtggtagctttttgtcatctgcagggtgttgttcatcgcgatctcaagccagagaattttcttttcacttctaaggatgaaaattccacgttgaaggccattgattttggactgtctgactatgtaaagccagatgagaggttgaatgatattgtgggaagtgcttattatgtagctccagaagttttgcatagatcttatgggacagaagcagatatgtggagcattggtgtaattgcttatattcttttatgtggaagtcgtcccttttgggcccggacagaatctggtatatttcgggctgtattgaaggcagatccaagttttgatgaggctccttggccttctttatctaccgatgcaaaagattttgtaaagaggttgttgaataaggattatcgtaaaagattgactgcagctcaggcacttagtcatccgtggttggtgaatcatcatgatgatatgaggatacctttggatatgataatccacaagcttgttaaagcttacatttgctcgtcttctttacgcaaatccgctttaggggctcttgcaaagacgttaacagtaactcagctagcttatctcagagatcaatttactctgttagggccaaacaaaagtgggttaatatctatgcagaacttcaagacggctattttgaggagctctactgatgcctcaaaggattcacgggtcttagattatgtgaacatggttagttctatccaatataggaaattagattttgaggaattttgtgctgctgctataagtgtgcatcaacttgagggaatggagagctgggagcagcatgcaagacgtgcctatgagctttttgaaaaggatggaaatagaccgatcatgattgaagagcttgcctcggaacttgggcttagtccatcagtacctgttcatgtagtacttcaagattggataagacactcagatgggaagcttagtttcttggggtttgtcaggcttctgcatggggtttcttctcgtgcatttcagaaggcttgagagaatgcacacatagttgatattatttttgcttgccccttttaccttaaaatattttaatggaaactaaatgcatgagctaactccatcagcaaccactatgatggcttctgcaagttaaagacagtagctgataggaatttgtagctgatgaagctgtatgcaacatcatatattaatcccacttttccaagatttcaaacacaaccttttccccaccttgtttctcactcactttaggttggtggttctggagttagaagcttgtacagatgaaagctagaccagaaattgtacttaggaccatcagaacctctgaaaaatgatgagttgttttaagggtttaccccttgtgtacccatgacacttatcaataagcattcttatcacgtgaactctttgatagtcgacagattttagcttttcttgttgtatttatgttattattattattcaaagccacaagggatggtactttttatatacaatagcagcatggagttttgaatctataacttgcaaactaagcaaatacaaaacccttttcctcaggtatggttggcatttgattaatgagctatgcacagtatctttaaatggttccaaacttctaatgatatcagtgtaaagttttgcagacactcgaaagcttctggagttcaattttcaatatgttggtgattaagtcttaattttaggataattatttcagatttctagcattaaaattccatttcgtatagctagaagagcattaatttttattatcttaagatgtcttgtatacagtttcctattttagtttgctatctttaagagaagaatgccttctgttagtgtagaactattgatctatattcctatttatctcccttgtaatgaatcattcataccaaaatataatt

SEQ ID NO: 6443 - DNA, 2867 bp, Arachis hypogaea
ttttttttttcagtcttcttttcttttcttgcagagtctgctaagcatctttgcctcactttttttcatccttcttttttttgccctttttttttggggttcttccttgccacttctgcattcttctctaattttatttgttatttttaaccaagttctatttggtataagctgcttctactattactcttattagcagcatcatattccttgcctcttctactcacagatattgcttgttctttaggtgaattcttggtggtgtttcctctctattattctttacttactcacaagaaggccttgttctgttcccttttccttcacatgattttacattatcaataatatccctagcttcttaaatttctctcatctttattacaattgaaatgataagttttctgatcttttctgggtttcattgatcaacccagaaaggaagaaaagaccttttttttttcttcttccaggtgttttaacagcttcagaaaaagctctcatttttttgttgggttcctcactctaagtagttcattttcttctccaactgatctaaaaaatctaaactttctcactgttcagctaccaattttggattttgcttctggttttcagcccctcatgggactctgccatggaaaacccattgaaacctcacagagaggagtaggaggaagaggggaagacccttcatcattcattgatgagaaaggtgtggttgtttcactgccaccaccaacaccaagttcccaaaccacaaaaccctcatcaaagttcccatttttcagcccaagccctttgccaagcttcttcaagaactcacctgcaccaggttcaaatccttcaagtgtgagttcaacacctttgaggatcttcaagaggccattccctcctccttctccggcaaagcacataagggctttgcttgcgaggaggcatggctctgtgaagcccaatgaggcatcaattcctgaagggagtgagtgtgaggttggattggacaagagctttgggttctctaagcagtttttggttcactatgagcttggggaagaagtggggcgtggccattttgggtacacttgctctgccaagggtaaaaaaggaaccttcaagggccatgaggttgctgtcaaagtcatcccaaaagcaaagatgacaactgcaattgctattgaggatgtgaggagagaagtaaagatattgcgagctttaaccgggcataaaaacctggtacaattctatgaagcctatgaagatgatgacaatgtttatatagttatggagttatgcaaaggaggcgaactgctagataagattctttccagaggtggaaagtactcagaagaggatgccagggttgtcatgattcagatattgagtgttgtagcctattgtcatctgcagggtgttgttcaccgtgatctcaagccagagaattttctttttgcttctaaggaagaaaattccactctgaaggcgattgattttggactctccgactatgtgaagccagatgagaggttgaatgatattgttggaagcgcatattatgtagctcctgaagttttgcatagatcttacgggacagaagcagatatgtggagcattggtgtaattgcctatattcttttatgtggaagtcgaccattttgggcacggacggaatctggcatatttcgagctgtcctgaaggcagatccaagttttgatgaagctccttggccttctttatccgctgatgcaatagattttgtaaagaggctgttgaacaaggattatcgtaaaagactaactgcagctcaggcactcagtcatccgtggctggcgaatcattgcgatgatttgaagatacctattgacatgataatccccaagcaagttaaagcttatatatgctcatcatctttacgtaaatcggcgttaggggcccttgcaaagacattaacattagtgcagctagcttatctcagagaacaatttactcagttaggaccaaacaaaaatgggacaatttctatgcagaatttcaagacgggtgttttaaggtgtgccactgatgcctcaaaggattctcgggtcttagattacgtgagcatggttagttcaatccaatatcggaaattagatttcgaggaattttgtgctgctgctataagtgtgcatcagctagagggaatggagacctgggaacaccatgcaaggcgtgcctatgagctgttcgaaaaggatggaaataggccaatcatgatcgaagagctagcatcggaacttgggcttagtccatcagtacctgtccatgttgtactccaagattggataagacactcggatgggaagcttagtttcctggggttcgtcaggcttctgcacggagcttcttctcgcacgtttcacaaagcttgacacgaattaatacatggtctttattatttttttcttgccatcattggccataaatcttttaggggatttgaatgcatgactcatgaggaaaaacaccatcagaagatgatagtgttgatcttgactgcaaaaaagatggatccttcatgcctaaaagtttgatgctgctgctgaagctattatatgcaacatctttctgtccagagttatgcaataaaaaacaaaccctttttcctcaatgctatttctaactctggtcagtgattggtggtgctgggagttagaagcttgtaagttgtacagatgaaagtagagcactgattgtacttaaaagactagaggaactactctacaaaaaaaaaaaagaatgagttagtgttttttgggtttgtcccttgtgtacccttgccacttttcaataaactcttgccaattcagtgagttgctttaaaacatga

SEQ ID NO: 6444 - DNA, 3010 bp, Cicer arietinum
aaactctttaagacttgttaaaagaaaaataaaaaaataaaaaaataaaaaaagacactcttacaaaagcagaataaaggtaagagagaatggtttcttttccttttctcttgcagactctgctaagcatctttgcctcactttcccatcctttttctcacctctcactccttctcattcccgttccaatttttaatttttaatttaatattttttttaaactaagtagttttctttgtttcatcttcttctattctacttcaccttcatattcctttcctaattctagctacaaattcccttcttctttactttcaaaatccttgcaaaattttcctctccgagatcaatttccttatctacaaaagaattcaaaaccccccttctcagatttctcatttttttacacagtaaatgaaagtcctaatcttttctcctgaaaaatcataacacatattaacccttttatgccctcaatttgtttcatctttttcaccttccattgatcttaaaaatctaaacttttttccattgggtgcttcatgggactctgtcatggaaaacccattgaaacctcacaaagagaaagagaaatttcatctttccaaagtgaagagattctgcaactaccaccaccacaaccaacaacaacaacaacaagttctcatcatcatgcaactactaaatcatcatcaaagtttccatttttcagtccaagtccattaccaagtttcttcaaaaactcaccagcaaattcaaattcaagtgtgagttcaacaccacttcggatcttcaaacgcccttttccacctccttctcctgcgaagcatattcgagcactgctcgctaggcgacatggttctgtgaagcctaatgaagccacaatacctgaagggagtgagtgtgaggttgggttggataagagttttggattttcaaagcactttgttactcattttgagcttggacaagaagtgggtcgtggccattttggttatacttgttcggctaagggtaaaaaaggaagttttaagggtcatgatgttgccgttaaagtcatttctaaatctaagatgacaacagcaatcgctatagaggatgtaagaagagaagttaagatattgcgagctctaactggacataagaatctcgtacaattctacgaatcctatgaagacgacgaaaatgtttatatagtcatggaattatgcaaaggaggcgaattactagataagattctttctaggggtggaaagtactcagaagaagatgccagagttgttttgattcagatattaagtgtggtagcatactgtcacctacaaggcgttgtacaccgcgatctcaagccagagaattttcttttttcttccgaggaggaaaattccacactgaaggccattgactttggactttctgactatgtaaagccagatgagagattgaacgatattgttggaagtgcatattacgttgcccctgaagttttgcatagatcttatggaacagaagcagatatgtggagcattggtgtaattgcttatattttgttgtgcggaagccgacctttttgggccaggacagaatctggcatatttcgggccgtccttaaggcagatccaagttttgacgaagctccttggccttctttatcgatcgatgcaaaagattttgtgaagaggttattgaataaagattatcgtaaaagactgactgcggctcaggctctcagtcatccatggctggcaaatcacactgaggatataaagataccatttgatatgataattcacaagcttgtcaaaacttacatatgctcgtcttctttacgcaaatcagcattaggggctcttgcaaagacattgacattggtgcagctagcatatctcagagaacaatttactcttttagggccaaacaaaagtggcctaatctccatgcagaacttcaagacggctattttaaggagcgccactgatgcctcgaaggattcacgggtattagattatgtgaacatggttagctcaatccaatatcgaaaattagattttgaggagttttgcgctgctgctataagtgttcatcaactggagggaatggaaagctgggagcaacatgcaaggcgtgcctacgagctgtttgaaaaggatggaaatagaccaattatgattgaagagcttgcttcggaactcgggcttagcccctcagtaccaattcacgtggtactccaagattggataagacactcagacgggaagcttagtttcttggggtttgtcagactcctgcatggagtttcgtctcgtacgtttcacaaggcttgagagaaaacatacatgattgctattgtttttttcttgaccctattgatcatgagatcttttgatgagatttgaatgcatgactcatgagaaaaaaaaactacaacaaatctcttcattatgattccaaacatggcttatgcaaaccaaaagcctatatatataacttgttgggagtttccttgtgatgctatatgcaagatgtcttgttgttaaagtgcttccttcaagagttctacaaactcaaaaaacactttcctccacccttgttgtattgctctctttaagtttgagatctatggtgctggagataagaggcttgtacagattaaagtagagagcacaagttctacttaggagtagtggaacttctataaaatgagttgttttttgagtttatctcttgtgtacccatggaacttatgaataaattatttccgatgtgtactcctttgatagttggcaatgcaacttttttttttcctaatcaaattttatatattaaatttgagtgtttattcttgaatttagtcaatgataatttgaagttgcagttgcaattgcgtccacattattgagaattttgaggtctttactttacaactggattatgattgtatgcttatgcatgtaatagctttgaaattgttgcctttcatagatccgacaagctacttctttactaagcc

SEQ ID NO: 6445 - DNA, 2488 bp, Phaseolus vulgaris
gatttgatgggaatctgccatggaaaacccatcgagacccaacaaagtgagagagaaaacccagaattcccgaacgatgttccatcatcaacgaacaccaaaccctcgaaattcccattctacagcccgagccctttgcccgggtggttcaaaaagtcgccggcgaactcaaaccctagcagcgtgagttcgacaccgttaaggatcttcaagcggcccttccctcctccgtcgccggcgaagcacattcgcgcgcttctggctcggcggcaggggtcggtgaagccgaacgaagcctccatacctgaaggcagcgagtgtgagattgggttggataagaggttcggcttcgccaaaaacttctcggcccattacgagatcagcgaagaagtgggccgtgggcatttcgggtacacctgctctgccaagcccaagaaggggccctccaaagccatcgaagttgccgtcaaagtcattccaaaatccaagatgaccacagcaattgctatagaggatgtaaggagagaagtgaagatattgcgggctctaacaggacacaagaatctggtgcagttctatgaagcctatgaagatgatgaaaacgtttatatagttatggagttatgcaaaggaggggaattgctagataggattctttccaggggtggaaagtacccagaaaatgatgccagagtagttatgatccaaatattaagtgtggtagctttttgtcatcttcagggtgttgttcaccgtgatctcaagccagagaattttcttttcacttctaaggatgaaaattccacgttgaaggccattgattttggattgtctgactatgtgaagccagatgagaggttgaatgatattgttggaagtgcttattatgtagctccagaagttttgcatagatcttatgggacagaagcagatatgtggagcattggtgtaattgcttatattcttttatgtgggagccgtcccttttgggctcggactgaatctggtatatttcgggctgtacttaaggcagatccaagttttgatgaggctccttggccttctttgtctgctgatgcaaaagattttgtaaagaggttgttgaataaggattatcgtaaaagattgacagcagctcaggcactaagtcatccatggctggtgaatcaccatgatgatatgaggatacctttggatatgataatccacaagcttgttaaagcttacatttgctcatcttctttacgtaaatctgctttacgggctcttgcaaagacattaacagtagctcagctagcttatctcagagatcaatttactctgttagggccaaacaagagtggattaatctctatgcagaactttaagacggctgttttgaggagctccacagatgcttcaaaggattcacgggtcttagattatgtgaatatggttagttctatccaatataggaaactagattttgaggaattttgtgctgctgctataagtatgcaccaactagagggaatggagagctgggagcagcatgcaaggcgagcctatgaactttttgaaaaggaaggaaatagaccaattatgattgaggaacttgcctcggaacttgggcttagtccatcagtacctgttcatgtagtacttcaagattggataaggcactcagatgggaagcttagtttcttggggtttgtcaggcttctgcatggggtttcttcccgtgcatttcagaaggcctgaatgaatagttgctataattttttcttgcctgttaccattaaatattttgataggataatgcttgagctaccctccatcagcattcctcaatgatggcttctgcaagttgaaggcagtggctgataggaatttgttgctgatgaagttgtatgcaacatcttcatgtatcaatcccacttttccaaaatttacaaacacacccttctcccccaccttgttctcactcactttaggttggtggttctgaagttagaggcttgtacagatgaaaactagaccacaaattgtacctagaaccatcagaacctctgaaaaatgatgattctcttggaggtttttatcccgtgttacccatggcacctatcaataaaccttgtgaactccttgatagttgacagatttttagcttttttgttgttgtatttatatgttattattcaaggcaacaagggatggtacttttcatatacaatagctttatggagttttgaatctataacttgttccaaactatgcacacacaaaacttatgggtggcttttggttaatcagttttgcacaatatctttagatggttccaagcttctaatgatatcagtgtaaagttttgcagtcactcaaaagcttctggatttcaattttcaacatgttggtcattgagtcttcattttaggatattaatttcagttttctagcattaaaactctaactggtatagttaggagaacattgttttcattgttttaaa

SEQ ID NO: 6446 - DNA, 3249 bp, Phaseolus vulgaris
tgtatttctacacaccactgtttgccaaggaaccactaacatatacacaaataaaataacctcaaaaaaagccttacaaaaagcagaaaaaggacccttgcttctcttttccttcagccttctgctaagcaagcatcttcctttccctcactttttctctctgctcttcttcctttccttgcttttcttaaattctcttcattcttgcaccctcataagcttcttctcctctgtaggatttctctcagatttccacttctcatccctcaaaacccccatctgctttctcaatctttcaccttcttttcattccagaaatttccctccctcatattttctgggttcattgatcaaccccacaaagaaaatcatttttttctctctccctctctctctagtacataactcactttcttttatacttttgattttctcaattatctatatttgagcttcaaaagcctctgaatttgacacttccctgatctcaagttttgaactttgctaaaatctctgcttcaaactctctaaacagccccttctctctcttttgcagtacataactcacttttttcttcttctctccttttgttattcaatagttgagcttcaaaatgctctgaattgggtaattgggcacttccctgatctcaaattgctcttttggtgaagtgttttcttctcctccttgttatcactgtttcttgaagtgatttgatgggaatctgccatggaaaacccatcgagacccaacaaagtgagagagaaaacccagaattcccgaacgatgttccatcatcaacgaacaccaaaccctcgaaattcccattctacagcccgagccctttgcccgggtggttcaaaaagtcgccggcgaactcaaaccctagcagcgtgagttcgacaccgttaaggatcttcaagcggcccttccctcctccgtcgccggcgaagcacattcgcgcgcttctggctcggcggcaggggtcggtgaagccgaacgaagcctccatacctgaaggcagcgagtgtgagattgggttggataagaggttcggcttcgccaaaaacttctcggcccattacgagatcagcgaagaagtgggccgtgggcatttcgggtacacctgctctgccaagcccaagaaggggccctccaaagccatcgaagttgccgtcaaagtcattccaaaatccaagatgaccacagcaattgctatagaggatgtaaggagagaagtgaagatattgcgggctctaacaggacacaagaatctggtgcagttctatgaagcctatgaagatgatgaaaacgtttatatagttatggagttatgcaaaggaggggaattgctagataggattctttccaggggtggaaagtacccagaaaatgatgccagagtagttatgatccaaatattaagtgtggtagctttttgtcatcttcagggtgttgttcaccgtgatctcaagccagagaattttcttttcacttctaaggatgaaaattccacgttgaaggccattgattttggattgtctgactatgtgaagccagatgagaggttgaatgatattgttggaagtgcttattatgtagctccagaagttttgcatagatcttatgggacagaagcagatatgtggagcattggtgtaattgcttatattcttttatgtgggagccgtcccttttgggctcggactgaatctggtatatttcgggctgtacttaaggcagatccaagttttgatgaggctccttggccttctttgtctgctgatgcaaaagattttgtaaagaggttgttgaataaggattatcgtaaaagattgacagcagctcaggcactaagtcatccatggctggtgaatcaccatgatgatatgaggatacctttggatatgataatccacaagcttgttaaagcttacatttgctcatcttctttacgtaaatctgctttacgggctcttgcaaagacattaacagtagctcagctagcttatctcagagatcaatttactctgttagggccaaacaagagtggattaatctctatgcagaactttaagacggctgttttgaggagctccacagatgcttcaaaggattcacgggtcttagattatgtgaatatggttagttctatccaatataggaaactagattttgaggaattttgtgctgctgctataagtatgcaccaactagagggaatggagagctgggagcagcatgcaaggcgagcctatgaactttttgaaaaggaaggaaatagaccaattatgattgaggaacttgcctcggaacttgggcttagtccatcagtacctgttcatgtagtacttcaagattggataaggcactcagatgggaagcttagtttcttggggtttgtcaggcttctgcatggggtttcttcccgtgcatttcagaaggcctgaatgaatagttgctataattttttcttgcctgttaccattaaatattttgataggataatgcttgagctaccctccatcagcattcctcaatgatggcttctgcaagttgaaggcagtggctgataggaatttgttgctgatgaagttgtatgcaacatcttcatgtatcaatcccacttttccaaaatttacaaacacacccttctcccccaccttgttctcactcactttaggttggtggttctgaagttagaggcttgtacagatgaaaactagaccacaaattgtacctagaaccatcagaacctctgaaaaatgatgattctcttggaggtttttatcccgtgttacccatggcacctatcaataaaccttgtgaactccttgatagttgacagatttttagcttttttgttgttgtatttatatgttattattcaaggcaacaagggatggtacttttcatatacaatagctttatggagttttgaatctataacttgttccaaactatgcacacacaaaacttatgggtggcttttggttaatcagttttgcacaatatctttagatggttccaagcttctaatgatatcagtgtaaagttttgcagtcactcaaaagcttctggatttcaattttcaacatgttggtcattgagtcttcattttaggatattaatttcagttttctagcattaaaactctaactggtatagttaggagaacattgttttcattgttttaaaatgccagagtagatattttccatgtaatccttcataattcatagtagaat

SEQ ID NO: 6447 - DNA, 2857 bp, Lupinus angustifolius
aaaaagaagaatcggttctcttcccctttttcttttttcttgcagacactgctaagcatatttgcttcacttttctcttctttttctttccctccttctccttcattcttgttggaatatttttaccaagttttatactaattcttctttgtttaagcatcatattcatatcctatacttgccacatatttcttcttctttaggtgaattctaccattttttttcatctctggaattcttttcttggccacaaaagtctacttgctttcttcaatagtttaaatcatcaaaacctctctattagatttcacatttttgtttcaatacataaactcaagttcccttaaagtttctgttaaaacccaacttacccttttgtttttctctcctaattccttcttcaaaaccctctcttttggtccttcactcactccttcttcttccaatgatccaaaatatttgaacttttccattacccttttgttttttacttccttggagcttcaaaagcctctcaaaatttgaactttctcattattttgtcaaaatctgctaattctgtagctgggtttcagttttcatgggactgtgccatgcaaaaccaattgaaacttcacaaactcaaagagaaaaccaaccattccaaaatgacaatgaggttttgccactgccaccaaggtcttcatcaaagtttcccttttacagtccaagccctttacataaattcttcaaaaactcaccttcaaacagcactccttctagtgtgagctcaacccctctgcgcctcttcaagaggccatttcctcctccatccccggccaaacacataaaggcgctgctcgcgagacgccacggttcagtgaagcctaatgaggccacaattcctgaaggaaatgagtgtgaggttggtttggataagagttttgggttttccaagcagtttgaggttcattatgaacttggagaagaagttgggcgtggccattttggatacacttgttctgccaagggaaagaagggaagcttgaaggggcatgaggttgctgtcaaagtcattccaaaatcaaagatgacaaccgcaattgctatagaggatgtgaggagagaagtaaagatattgcgagctctaaccgggcataagaatctggtgaaattctatgaagcttatgaggatgacaacaatgtttatatagtaatggagttatgtgaaggaggtgaacttctagataagatcctttccaggggtggaaagtactcagaagaggatgccaaggttgttatggttcagatattaagtgtggtagctttctgtcatctacaaggcgttgttcaccgtgatttgaagccagagaattttctttttacttctaaggatgaaaattccacactgaaggccattgattttggattatccgactatgtaaaaccagatgaaaggttgaatgatattgtgggaagtgcatattatgtagctcctgaagttttgcatagatcttatggaacagaagcagatatgtggagcattggtataattgcttatattcttttatgtggaagccgacccttctgggcccgtaccgagtctggcatatttcgagctgttttgaaggcagatccaagttttgatgaaggtccttggctttctttatcagctgatgcaactgattttgtgaagagactattgaacaaggattatcgtaaaagactaactgcagctcaggctctcagtcatccatggctgacaaatcacggtgatgatatgaagataccttttgatatgataatcccaaagcttgttaatgcttacatatgctcatcttctctgcgcaaaacggcattaagggctcttgcaaagacattaacattagtgcaactagcgtatctcaaggaacaatttactttgttaggaccaaacaaaagtggcctaatctctatgcagaacttcaagacggctattttaaagagcgccaccgatgcttcgaaggattcacgagtcttggattatgtgaacatggttagttcaatccaatatcgtaaactcgattttgaggaattttgtgctgctgctataagtgtccatcaactagagggaatggagagctgggagcaacatgcaaggagtgcctatgagctgtttgaaaaggatggaaatagaccaattatggttgaagagcttgcctcggaacttgggcttagtccatcagtgccagttcatgtggtacttcaagattggatacgacactcggacgggaagcttagtttcttggggtttgtcagacttctgcatggagtttcttcgcgaacacttcagaaggcttgacataacatacaaagttgctattatttttgttgccataaatcttttgatggatttcaatgcgtaactcatgagcaaaactccaccttgattgcaaatgtagcttcagcaagccgaaacctatgacttgatgagagcttcttgcttatgaagctatatgcaaatacaacatctcttgttgttaagccttttttctagagttctacaaacacaacccttttctaatcctatttctcactctctttaaggttggtggtgctggagttagaggcttgtacatataaaaatagagcacagattgtacttaggactagcagaacttctaaaaattgagttgtgttgagtattcatggaacttatcaataaactaatcccagttctgtgaacttgatagtttacatgtttttagtttttaatttatattttttgtgattttggttagctttcttttcttcatatttatacttttgcttaggacatggcattttgttaatgtaaaactataggtgataatatctttagatgagtccaatgatatca

SEQ ID NO: 6448 - DNA, 2716 bp, Medicago truncatula
actcttaacaaaaagcagaataaaggaaagagagattggtttcttttccttttctcttgcagactctgctaagcatctttgcctcactttcccatcctttttctctcttctcactccttctcattcctctcacaatttttaatttaatttcatttttttaacctaagttttcatttttatttcaccttcgtaatattccttccctattctagctacaaattcaattctaagataagtttcttagctaaataagttcatttcctttcttatatattttccataaacacaattcaaaacccttctcagatttctcaattttgatgcaagttttgatcttttctcttgaaaattgataaccctagtgacccttttgagtacttaatctaattcatctttcaaaccttgaattgatcttaaaaatctcatctttttctcattgggtgcttcatgggactctgtcatggaaaacccattgaaacgtcacgtagagaaagagaaagagaaagagaaaattcaacaaatgaagaaattcttcaacttccaccaccaccatcaagctctcatcatcatcatgcaccaactaaatcatcatcaaagtttccattttttagtccaagtccattaccaagtttcttcaaaaattcacctgcaaattcaactgtgagttcaaattcaacccctctgcgaacccctcttcggatcttcaagcgaccctttcctccgccttcaccggcaaagcacattcgagcactgctagctagaagacacggctctgtgaagcctaatgaagctactatacctgaagggagtgagtgtgaagttgggttggataagagttttggattttctaagcattttgtgacgaattttgagcttggacaagaagtgggtcgtggccattttggttatacttgctctgctaagggtaaaaaaggaagctttaagggtcttgatgttgctgttaaagtcattcctaaatctaagatgacaacagcaattgctatagaggatgtaagaagagaagtgaagatattgcgagctctaactgggcataagaatttggtacaattctacgaagcttacgaagacgaagaaaatgtttatgtagttatggaattatgcaaaggaggcgaattgttagataagattctttccaggggtggaaagtacccggaagaggatgccagagttgttttgattcagatattaagtgtggtagcttactgtcatctacagggtgttgtacaccgcgatctcaagccagagaattttctttttagttctgaggatgaaaattctacattgaaggccattgactttggactctctgattatgtaaagccagatgagagattgaatgatattgttggaagtgcttattacgttgcacctgaagttttgcatagatcttatgggactgaagcagatatgtggagcatcggtgtaattgcttatattctgttatgtggaagccgtcctttttgggccaggactgaatctggcatatttcgggctgtccttaaggcagatccaagtttcgatgaagctccctggccttctttatcggctgatgcaaaagattttgtaaaaaggctgttgaataaagattaccgtaaaagactaaccgctgctcaggctctcagtcatccgtggctggtgaatcacttagaggacataaagataccatttgacatgataatccacaagctcatcaaaacttacatatgctcgtcttctttacgcaaatcagcattaggggctcttgcaaagacattgacattagtgcagctagcatatctcagagaacaatttactctattagggccaaacaaaagtgggctaatctctatgcagaacttcaagacggctgttttaagaagcgccactgatgcctcgaaggattcacgggtcttagattatgcgaacatggttagctcaatccagtatcgaaaattagattttgaggaattttgcgctgctgctataagtgtccatcaactggagggaatggacacttgggagcaacatgcaaggcgtgcctacgagctgtttgaaaaggatggaaataggccaattatgatcgaagagcttgcctcggaacttggacttagcccctcagtacctattcacgtggtactccaagattggataagacactcagatggaaagctaagtttcttagggtttgtcagactcctgcatggagtttcttctcgcacatttcacaaggcttgagagaaaatacacatgtttgctattgtcttaacttgccgctattgatcataagatcttttgatgagatttgaatgcattactcatgagcaaaactacaacataaaatctctccattgtgatccaaacatggcttttgcaaagccaaaagtctatatatagcttgttgggagttgccatgtgatgttgctatatgcaacatctcttgttaaatgtcccttcgagtgttttacaaaccgaaaaacactttcctccacccttgttttattgctctctttaagtttgagatcgatggtgctggagttagaggcttgtacagattaaagtagagcacaagttgtacttaggactagtggaacttttataaaattagttgtgtttttttttgggtttatctcctgtgtacccttggaacttatgaataaactctattcaaatgtgaactccttcatagttaatgcaactttttatttatttatgtatt

SEQ ID NO: 6449 - DNA, 2688 bp, Medicago truncatula
caaaaagcagaataaaggaaagagagattggtttcttttccttttctcttgcagactctgctaagcatctttgcctcactttcccatcctttttctctcttctcactccttctcattcctctcacaatttttaatttaatttcatttttttaacctaagttttcatttttatttcaccttcgtaatattccttccctattctagctacaaattcaattctaagataagtttcttagctaaataagttcatttcctttcttatatattttccataaacacaattcaaaacccttctcagatttctcaattttgatgcaagttttgatcttttctcttgaaaattgataaccctagtgacccttttgagtacttaatctaattcatctttcaaaccttgaattgatcttaaaaatctcatctttttctcattgggtgcttcatgggactctgtcatggaaaacccattgaaacgtcacgtagagaaagagaaagagaaagagaaaattcaacaaatgaagaaattcttcaacttccaccaccaccatcaagctctcatcatcatcatgcaccaactaaatcatcatcaaagtttccattttttagtccaagtccattaccaagtttcttcaaaaattcacctgcaaattcaactgtgagttcaaattcaacccctctgcgaacccctcttcggatcttcaagcgaccctttcctccgccttcaccggcaaagcacattcgagcactgctagctagaagacacggctctgtgaagcctaatgaagctactatacctgaagggagtgagtgtgaagttgggttggataagagttttggattttctaagcattttgtgacgaattttgagcttggacaagaagtgggtcgtggccattttggttatacttgctctgctaagggtaaaaaaggaagctttaagggtcttgatgttgctgttaaagtcattcctaaatctaagatgacaacagcaattgctatagaggatgtaagaagagaagtgaagatattgcgagctctaactgggcataagaatttggtacaattctacgaagcttacgaagacgaagaaaatgtttatgtagttatggaattatgcaaaggaggcgaattgttagataagattctttccaggggtggaaagtacccggaagaggatgccagagttgttttgattcagatattaagtgtggtagcttactgtcatctacagggtgttgtacaccgcgatctcaagccagagaattttctttttagttctgaggatgaaaattctacattgaaggccattgactttggactctctgattatgtaaagccagatgagagattgaatgatattgttggaagtgcttattacgttgcacctgaagttttgcatagatcttatgggactgaagcagatatgtggagcatcggtgtaattgcttatattctgttatgtggaagccgtcctttttgggccaggactgaatctggcatatttcgggctgtccttaaggcagatccaagtttcgatgaagctccctggccttctttatcggctgatgcaaaagattttgtaaaaaggctgttgaataaagattaccgtaaaagactaaccgctgctcaggctctcagtcatccgtggctggtgaatcacttagaggacataaagataccatttgacatgataatccacaagctcatcaaaacttacatatgctcgtcttctttacgcaaatcagcattaggggctcttgcaaagacattgacattagtgcagctagcatatctcagagaacaatttactctattagggccaaacaaaagtgggctaatctctatgcagaacttcaagacggctgttttaagaagcgccactgatgcctcgaaggattcacgggtcttagattatgcgaacatggttagctcaatccagtatcgaaaattagattttgaggaattttgcgctgctgctataagtgtccatcaactggagggaatggacacttgggagcaacatgcaaggcgtgcctacgagctgtttgaaaaggatggaaataggccaattatgatcgaagagcttgcctcggaacttggacttagcccctcagtacctattcacgtggtactccaagattggataagacactcagatggaaagctaagtttcttagggtttgtcagactcctgcatggagtttcttctcgcacatttcacaaggcttgagagaaaatacacatgtttgctattgtcttaacttgccgctattgatcataagatcttttgatgagatttgaatgcattactcatgagcaaaactacaacataaaatctctccattgtgatccaaacatggcttttgcaaagccaaaagtctatatatagcttgttgggagttgccatgtgatgttgctatatgcaacatctcttgttaaatgtcccttcgagtgttttacaaaccgaaaaacactttcctccacccttgttttattgctctctttaagtttgagatcgatggtgctggagttagaggcttgtacagattaaagtagagcacaagttgtacttaggactagtggaacttttataaaattagttgtgtttttttttgggtttatctcctgtgtacccttggaacttatgaataaactctattcaaatgtgaactccttcatagttaatgcaac

SEQ ID NO: 6450 - DNA, 2715 bp, Glycine max
ccttggttttcaatattttttagcttcaaaagcctctgaatttgacacttccctgatctcaagttttatactttgttcaaatctttgcttcttcttcttctcctcatccttctctaatttctgctaacagtcccttctctctctgtctctcacagtacatactcacttttttttttcttttcaattttctatatttgagcttcaaaactcaagagcctctgaatttggcacttccctgatctcaagtttcactttagtagtgaaatctttgctcctcctccaccaccttcttcttattgttattcttttagaattctgatttgatgggaatctgccatgggaaacccattgaaacccaacaaagtcaaagagagaccaacaacccatcagaattcccaagtgaccacccaactcccacaaaaccccccaaagcctcatcaaaattcccattctacagcccaagccctctccccaattggttcaaaaactccccatcctcaaactcgaaccctagcagtgtcagctcaacacccttaaggatcttcaagcgccccttccctccgccctcgccggccaagcacattcgggcgctgctcgcccggcgccacggctccgtcaagcccaacgaagccgccataccggaggggagcgagtgcgaggtcggtcttgacaagagctttgggtttgctaagcagttttcggctcattatgagctcagtgacgaagtcggccgggggcattttgggtacacctgctctgccaagggcaagaagggggcgttcaagggcgtggatgttgccgtcaaagtcattcctaaagccaagatgaccacggcaattgctatagaggatgtaaggagagaagtgaagatattgcgggctttaacaggacataaaaatctggtgcaattctatgaagcctatgaagatgatgccaatgtttatatagttatggagttatgcaaaggaggggaattgctagataggattctttccaggggtggaaagtactcagaagaggatgccagagtagttatgatccaaatattgagtgtggtagcattttgtcatctgcaaggtgttgttcaccgtgatctcaagccagagaattttcttttcacttctaaggatgacaattcctcgttgaaggccattgattttggattgtctgactatgtaaagccagatgagaggttgaatgatattgtgggaagtgcttattatgtagctccagaagttttgcatagatcttatgggactgaagcagatatgtggagcattggtgtaattgcttatattcttttatgtggaagccgtcccttttgggcccggacagaatctggtatatttcgggctgtactgaaggcagatcctagttttgatgaggctccttggccttctttatcagttgatgctaaagattttgtaaagaggttgttgaataaggattaccgtaaaagattgactgcagctcaggcactaagtcatccatggctggtgaatcatcatgatgatatgaggatacctttggatatgataatccacaagcttgttaaagcttacatttgctcgtcttccttacgcaaatctgctttacgggctcttgcaaagacattaacagtagctcagctaacatatctcagagatcaatatactctgttagggccaaacaaaagtggattaatttctatgcagaactttaagacggctgttttgaggagctccacagatgcctcaaaggattcacgggtcttagaatatgtcagtatggttagttctatccaatataggaaattagattttgaggagttttgtgctgctgctataagtgtgcaccaacttgagggaatggagacctgggagcaacatgcaaggcgtgcctatgagctttttgaaaaggaaggaaatagaccaattatgattgaggagcttgcctcggaacttgggcttagtccatcagtacctgttcatgtagtacttcaagactggataagacactcagacgggaagcttagtttcttggggtttgttaggcttctgcatggggtttctgcccgtgcatttcagaaggcctgagagaatgcacacagttgctattgttttttcttgcccatgttacctttaattattttgatggtctgctgatgctaactccatcagcagacctcagtgatggcttctgcaagttgaaagcagtggctgataggaatttgtttctgaagctttatgcaacatatatcaatccctcttttccaagattttcaaacacaacctattcccctccttgtttctcactcactttaggttggtggttctggagttagatgcttgtacagttgaaagctagaccaaaaattgtacttaggaccatcagaacctctgaaaaatgttgagttgtcttaagggcttaccccttgtgtacccatggcacctatcaataaaccttatcacgtgaactccttgatagtagacaaatatttagctttttttttttttgtatttatatgttattattattcaaggcaacaaggaatggtacttttatatacaatagcattatggagttttgaatctataacttgcaaactatgcaaatgcaaaacctttttcctcatatatgggtggcatttggttaatgatccatacataatatctttagatgggaccaaacttctaacgatatcagtgtaaagttttgcagacattcaaaagcttc

SEQ ID NO: 6451 - DNA, 2737 bp, Glycine max
cctcacttttttttttctttttccttggttttcaatattttttagcttcaaaagcctctgaatttgacacttccctgatctcaagttttatactttgttcaaatctttgcttcttcttcttctcctcatccttctctaatttctgctaacagtcccttctctctctgtctctcacagtacatactcacttttttttttcttttcaattttctatatttgagcttcaaaactcaagagcctctgaatttggcacttccctgatctcaagtttcactttagtagtgaaatctttgctcctcctccaccaccttcttcttattgttattcttttagaattctgatttgatgggaatctgccatgggaaacccattgaaacccaacaaagtcaaagagagaccaacaacccatcagaattcccaagtgaccacccaactcccacaaaaccccccaaagcctcatcaaaattcccattctacagcccaagccctctccccaattggttcaaaaactccccatcctcaaactcgaaccctagcagtgtcagctcaacacccttaaggatcttcaagcgccccttccctccgccctcgccggccaagcacattcgggcgctgctcgcccggcgccacggctccgtcaagcccaacgaagccgccataccggaggggagcgagtgcgaggtcggtcttgacaagagctttgggtttgctaagcagttttcggctcattatgagctcagtgacgaagtcggccgggggcattttgggtacacctgctctgccaagggcaagaagggggcgttcaagggcgtggatgttgccgtcaaagtcattcctaaagccaagatgaccacggcaattgctatagaggatgtaaggagagaagtgaagatattgcgggctttaacaggacataaaaatctggtgcaattctatgaagcctatgaagatgatgccaatgtttatatagttatggagttatgcaaaggaggggaattgctagataggattctttccaggggtggaaagtactcagaagaggatgccagagtagttatgatccaaatattgagtgtggtagcattttgtcatctgcaaggtgttgttcaccgtgatctcaagccagagaattttcttttcacttctaaggatgacaattcctcgttgaaggccattgattttggattgtctgactatgtaaagccagatgagaggttgaatgatattgtgggaagtgcttattatgtagctccagaagttttgcatagatcttatgggactgaagcagatatgtggagcattggtgtaattgcttatattcttttatgtggaagccgtcccttttgggcccggacagaatctggtatatttcgggctgtactgaaggcagatcctagttttgatgaggctccttggccttctttatcagttgatgctaaagattttgtaaagaggttgttgaataaggattaccgtaaaagattgactgcagctcaggcactaagtcatccatggctggtgaatcatcatgatgatatgaggatacctttggatatgataatccacaagcttgttaaagcttacatttgctcgtcttccttacgcaaatctgctttacgggctcttgcaaagacattaacagtagctcagctaacatatctcagagatcaatatactctgttagggccaaacaaaagtggattaatttctatgcagaactttaagacggctgttttgaggagctccacagatgcctcaaaggattcacgggtcttagaatatgtcagtatggttagttctatccaatataggaaattagattttgaggagttttgtgctgctgctataagtgtgcaccaacttgagggaatggagacctgggagcaacatgcaaggcgtgcctatgagctttttgaaaaggaaggaaatagaccaattatgattgaggagcttgcctcggaacttgggcttagtccatcagtacctgttcatgtagtacttcaagactggataagacactcagacgggaagcttagtttcttggggtttgttaggcttctgcatggggtttctgcccgtgcatttcagaaggcctgagagaatgcacacagttgctattgttttttcttgcccatgttacctttaattattttgatggtctgctgatgctaactccatcagcagacctcagtgatggcttctgcaagttgaaagcagtggctgataggaatttgtttctgaagctttatgcaacatatatcaatccctcttttccaagattttcaaacacaacctattcccctccttgtttctcactcactttaggttggtggttctggagttagatgcttgtacagttgaaagctagaccaaaaattgtacttaggaccatcagaacctctgaaaaatgttgagttgtcttaagggcttaccccttgtgtacccatggcacctatcaataaaccttatcacgtgaactccttgatagtagacaaatatttagctttttttttttttgtatttatatgttattattattcaaggcaacaaggaatggtacttttatatacaatagcattatggagttttgaatctataacttgcaaactatgcaaatgcaaaacctttttcctcatatatgggtggcatttggttaatgatccatacataatatctttagatgggaccaaacttctaacgatatcagtgtaaagttttgcagacattcaaaagcttc

SEQ ID NO: 6452 - DNA, 2675 bp, Fagus grandifolia
taataaagcttacataaagtagaaaaaggaggacttgggtttctttccttttcttctttccttgctaactctgctaagcatcttttctttactttttccttctctctcttattctttccctcctcttgtagtagttttttactttggtttttttctttgtctttggtatttttctacaatcatttccttcctgcctctgctgcttcaaccataaattgcttcttgttttggtgagtcttctttatgggttttcctctctggcattgtttgtataatcataaaagttaatttgcttttcttgttattagttttccattcctgggattctcttttttggtcttgaatttcctttgaatttgatctcctgggaaaattcaggtgttgaatcctttctgggtttagttaatcataccctttagcttgcatagaacaattctctaccataaatctttttatttagcttaaagttactgaatttatagttttatagagacttctacttgttaactggtataaatttctttacttcactgttcatttcttggtcacaaaagtttgaaacttttgttgatttcttggcaattctgcaattctgctactctgctttattgggtttctgattccatgggactctgtcatggaaaacccattcaaaacccacaaacaatccaaacctggcatcccggcgagaacgagccggttccgaattcccagacaccaaaatcctccaactttcccttctacagcccaagtcctctgcccagtctcttcaagaactcgcctgcagtcaattcaagtgtgagttcaacccctctgcgcattttcaagcgcccatttccgcctccttctccggctaagcacatccgggcattgctggcacggcggcatggctcggttaagccgaatgaggcctcaatccctgaaggagatgagtgtgagattgccttggataagaattttgggtactccaaacagtttgtagctcattatgagcttggagaagaggtagggcgtggacatttcgggtttacttgctctgccaaggccaagaaagggagcttgaaaggtcaggatgtggctgtcaaggttataccaaaatcgaagatgaccacagcaattgctatagaggatgtacgaagagaagtgaagatattacgggcactaacaggacataagaacttagtgcagttctatgaggcctatgaagatgacgacaatgtttatgtagtgatggagttatgcaaaggaggtgaactgttagataagatactttcaaggggtggaaaatactcagaagaagacgccaaagaagttatggttcagattttaagcgtagttgcctactgtcaccttcaaggtgtggttcaccgtgacctgaagccggagtaattttctttttacttctaaggatgaaaattccccgcttaaagccattgattttggactctctgactatgtaaagccagatgagaggttgaatgatatagtaggaagtgcttattatgtggctcctgaagttttacatagatcatatgggacagaagctgacatgtggagtattggtgtaattgcttatattcttttatgtggaagccggtctttttgggcccggacagaatctggcatcttccgagctgtcctcaaggcagatccaagctttgatgaagccccttggccttctttgtctcctgatgcaatagactttgtaaagaggctgttgaacaaggattatcgtaagagattaactgctgctcaggctctaagtcatccatggctggccaatcatcatgatgtcaagataccattggatatgatagtgtacaagcttgttaaagcttatatatgctcatcttctctacgcaaatcagcattgggggctcttgcaaagacattaactgtagctcagctagcttatatgcgggaacaattcacactattagggcctaacaaaaatggattcatctctatgcagaactttaagacgggtatggtaaagaactccaccgatgcaatgaaggattcacgggccctggattacgccaacatgattagttctattcaatacagaaaattggattttgaagaattttgttcggctgccataagtgtgcatcagctggaaggaatggagagctgggaacaacatgcgaggcgtgcatatgagctgtttgagaaggatgggaacagaccgattatgatagaggaacttgcctctgaacttggactgagcccatcagtacctgttcatgtggttctccaggactggataagacactcagatggaaagcttagtttcttggggtttgtcagacttctccatggggtttcttccgctcatttcagaaggcttgaaattgaactgggctacacataaattttcccatcctcacttttctgatctgaaatgtctaaagggacaaaatgcaagctgagttcgagagctactgtaaatgagccagtgtttgcattagtcgagtggtgggatgttgcaaaccataaaactgtagctgctgttgcatttgatgctggtgaaaccataacagcatgtttctcatatctatttttctcccactaatataaggtcttttttctttttcttttaaatgtattggtgcttgttgaaatttagagaaatgtacagatgagggtacatttaagatgtatgtaacattagc

SEQ ID NO: 6453 - DNA, 2740 bp, Lupinus angustifolius
gatgctagcagaaataaaaaaataaagagccttacaaaaagcagaaaaagaagaatttggttcctcttccctttttctttttcttgcagactctgctaagcatctttgcttcacttttctcatctttttctttccctcccccttcttcattctacttggaatattttttactcagatttctattaattcttctttgtttaagcatcatattcatatcctatacttgccacagatagcttcttctttaggaaatgcatgtagaatcctctctatgctccattgatcaacacagaaaaaaacaaacacttcaagttccatgaacccttttgttgtctctccttaattccttccctagaaccttaaaaaacccttttcagttttgtccttcactcactccttctccttcccactgatctaaaaatttgaactttctcattatttcacttacccttttgttttttcttcttccttgcagcttcaaaagcctcaaaatctgaactttctcattattgagtcatcttttgctaattgtgtatctgggtttctgttttcatgggactgtgtcatggaaaaccaattgaaacctcacaaactcaaagagaaaaccaatcattccaaaatgataaagaggttgttttaccactaccaccaagatcttcatcaaaatttccattttatagcccaagccctttgcataaattcttcaagaactcaccttcaaactccactccctctagtgtgagctcaacccctctgcgcctcttcaagaggcctttccctcctccttcaccagcaaagcacataagggcattgctcgcgaggcgccacggttctgtgaagcctaacgaggccacaatccctgaagggagtgaatgtgaggttggtttggataagagttttgggttttctaaggagtttgaggttcattatgagcttggagaagagattgggcgtggccattttggatatacttgctctgcaaagggtaagaagggaagcttgaagggccaggaggttgctgttaaagtcattccaaaatccaagatgacaacagcaattgctatagaggatgtaaggagagaagtaaagatattgcgagctctaactgggcataagaatttggtgcaattctatgaagcttatgaggatgacaacaatgttcatatagttatggagctatgcaaaggaggtgaacttctggataagatcctttccaggggtggaaagtacccagaggaggatgccaaggatgttatgattcagatattaaatgcggtagctttctgtcatctacagggtgttgttcaccgtgatctgaagccagagaattttctttttacttctaaggatgacaattccactctgaaggccattgattttggactgtctgactatgtaaaaccagatgaaaggttgaatgatattgtgggaagtgcatattatgtagctcctgaagttttgcatagatcttatggaacggaagcagatatgtggagcattggtgtaattgcttatatccttttatgtggaagccgacccttctgggcccggacagaatctggcatatttcgtgctgttttgaagacagatccaagttttgatgaaggcccttggccttctttatcagctaatgctattgattttgttaagagacttttgaacaaggattatcgcaaaagattaactgcagcacaggctctcagtcacccgtggctagcaaatcactctgatgatataaggataccctttgatatgataatcccgaagcttattaaagcttacatatgctcatctcctttatgcaaaacagcattaggggctcttgcaaagacattaacgttagtgcaactagcttatctcaaagaacaatttactcttttaggaccaaacaaaagtgggttaatctctatgcagaacttcaagatggctgttttaaagagtgccactgatgcctcaaaggaatcgcgggtcttggattatgtaaacacgtttagttcaatccaatatcggaaattggactttgaggaattttgtgctgcttcgataagtgtgcatcaactagagggaatggagagctgggagcaacacgcaaggactgcttatgacctgtttgaaaaggatggaaatagaccaattatggtcgaagagcttgcctcggaacttgggcttagtccatcagtgcctgttcatgtggtactccaagattggataagacactcggatgggaagcttagtttcttggggtttgtccgacttctgcacggagtttcttcacgcacacttcagaaagcttgagacagcatacacgcggttgctattaatttttatagccataaatcttttgatgggatttgaatgcatgactcattagcaaaactccatcttgattgcaaagatagctgcagcaagccaaaagctatataactcgacccgagtttgatgcttctgaagctatatgcaagtaaacatctcttgttgttaagcctctttttccagagttcttcaaacacaaaaccctttacccaccatatttctcaatctctttatgcttggtggggctggagtttgaggcttgtatagatgaaagtagagcacagattgtacttaggattagtggaacttctaaaaatgagttgtgttttttcgggtttatcctttgtgtacccatggcacttatcaataaactcatcccaattatgtgaactcgtttatagtttacaagtttatagtttggttttcc

SEQ ID NO: 6454 - DNA, 2886 bp, Prunus mume
ggaaaatacaaggaaagaattcacagtgaacaagagtaatagaagaaacttccaccctctaaatgaaagtgatattgccacacacagaaaccattaacagaaaagcttacataaagcagaaaaaaggaggccttgggttttccttttccctttcttttcttttcttcctgcctctgctaagcatctttttcttcacttttttcacctctcctctcattccttccttcctcttggaatttttttttacttgagtttccctttgcttttgcttcccaccatcatttccttgtcttgctcacctataatttgcttcatgttctgctgaatttttgatggttctcctctctggcattgtttgtttaatcagaaaaagttgcattgcttttcttcttggtttctcagattgatttccctaattgtgtatctctcttttgctgtgaaaatccctttggaatttgattctgggattgacttcattcaatgatcctttctgggtttttcttgatcaattcagttctgctttaagaattccctcccttgaatatattctgtgtgaattttgtttcatgagcgccaagttcttgaatttagtctcactttcaccttcctaattgtctaaaaattcactgttttttcttttttcactcatcatactttgtgagctgtgtgatcttcattgttaattcttgcaaataaactttttcttctgtttgttgggtttgtgattcatgggactctgtcatggaaaacccacagaaaacccaaaagcccaatcgcaagattccacaattcccagtgaaagtgagccttatgcactcaattcccactccaccaaatcctcaaactttcccttttacagcccaagtccattgccaagtctcttcaagaactcccctgccaactccagcgtgagttcgacgcctctgcgcatttttaagcgacctttcccgcctccctctccggcgaaacacattcgggcattgcttgctcgcaggcatggctctgttaagcccaatgaagcctcaatccctgaaggaagtgagtgtgacgttgccttggataagaatttcgggttttctaaacagtttgtagctcattatgagcttggcgatgaagtggggcgtgggcattttgggtatacttgctctgccaaggccaagaaggggagcttgaagggccaggatgtggctgtcaaggttattccaaagtcaaagatgacaacggcaattgctatagaggatgtaagaagagaagtgaagatcctacgggcactaacacataagaacctagtgcagttctatgaagcctatgaagatgatgacaatgtttatgtggtgatggagttgtgcaaaggaggtgaactattggatagcatactttcaaggggtggcaaatattcagaagatgatgcaaaggctgttatggttcagattttaagtgtaactgcctactgccatctccaaggcgtggttcaccgcgatctcaagccagagaatttccttttcacttcaagtgatgagaagtcccccctgaaggccattgatttcggactctctgactatgtaaaaccagatgagagactgaatgatattgtaggaagtgcatactatgtagctcctgaagttctacacaggtcatatgggacagaggcagacatgtggagtattggtgtaattgcttatatccttttgtgtggaagccgacccttttgggcccggactgagtctggcatcttccgagctgtactaaaggctgatccaagctttgatgaagctccttggccttctctatcatctgatgcgagagattttgtaaagagactgctgaacaaggattaccgtaagaggctaaccgcgtctcaggctttgtgtcacccatggttagccaactgtcacgaggtcaagataccgatggatatgatagtgtacaaacttgttaaagcttatatatgctcatctgctctacgaaaatcagcattagggactcttgcaaagacattaagtgtagcacagctggcttatctccgggaccaatttacactgttagggccaaataaaagtggattcatctctatgcagaacttcaagacgggtgtaataaggaactcaactgatgccatgaaagattcacgggttctagattatgtcaacatgatcagctctatccgatatagaaagctggattttgaagaattttgtgcagctgccataagtgtgcatcagctggaagggatggagagctgggagcaacatgcaagacgagcatatgagctgtttgagaaggatggaaacagaccaattatgatagaggaacttgcctcggaattggggcttagcccatctgtaccagttcacgttgttctccaggactggataagacactcggatggaaaacttagttttctggggtttgttagactactacatggagtttcttcacgcacatttcagaaggcttaaactagaactggtctacatgcagttttgatacctccatccttactctcgaggacttggaatgccccaagggaacaaaatgtgtgcttaattggagaacttcattttgttttggtccctaggagggtctgcagtgcatgctcatgtcaatttttttaaattactttttctcctccctgttaagttatataaggtttttccttccctttcttctcttctctccatgattggtgctgttgaagtttagaggattgtacaggtgagagtagatcacagaatgtgtgtaggattaccgattacagaagtgttctaaactggagtgagttttgtggtctctggcgttcatccctcatgtagttatattgcgctttaattttcctaataaaatcttcctctgattttattgaaattataaagaaaatattgatta

SEQ ID NO: 6455 - DNA, 2523 bp, Amsonia hubrichtii
ttccaagcactcctcctatttcttcttcccattccttcagctgaaaaacacttgcttaattctgggattcttgctagcctttgtctatctggcattgatcatttcttcagaaagttgtattccttttcttctttaaatttctacttcttttgcccttcttgagcttttctctttcccttggacaattgtcaaggaatttcatttccttgacaaaaattgtttgctgatcctttctgggttctgctgatcaagcttggaaattccatcccgttgaggttttcgttccaaagattggaattttgtgaattcttttagcttatttgagtaaattagtcttagtttatatcttttccgtcagcttcaaattacgtggagttcactttctgcttcgttttctaatggtctaacttgctgtatattctgttattttcttcacaagttcgtaagtttcattctacctctttagttcctgtggattttgtcaaaattgagtttttgattccatgggactttgtcatggaaaaccaattgaacccccacaaaatctatcagaaaatcctacaattcctgctgacaatgaaccagcattgagtactcatactgggaaaacaccaaaatttccctttacagcccaagtccattgccaagtgctttcaagaactcaccagctaactctagtgtgagttcaacacctctgcgcctgtttaagcgcccatttcctccgccatcaccagctaaacatatacgggctttgctcgcgaggaggcatggctcggttaagcctaacgaggccacaattcctgaaggaagtgagtgcgagattgggctggataaaagttttggattcacgaagaattttgtaagccactatgagcttggagaagaagtggggcgtgggcattttggatatacttgttcagctaaggggagaaagggagtttgaaggggcaggatgtggctgttaaagttatcccgaaatcaaagatgaccacagcaattgcaatcgaagatgtcagaagagaagtaaaaatactacgcgctttaacagggcataagaacctggtgcagttctatgatgcttatgaggatgaagacaatgtttatatcgtgatggagttatgtagaggaggagaactattggatagaatactttcaaggggtggcaaatactcagaagaagatgctaaggctgtcatggtgcagattttaagtgtggttgcgtactgtcatcttcagggtgttgttcaccgtgacttgaaaccagagaatttccttttcacttctaaggacgaaaattctcctctcaaggccattgactttgggctctctgattatgtcaaacctgatgaaaggctgaatgatattgttggaagtgcatactacgtggcgccagaagttttgcatcgatcttatggaacagaagctgacatgtggagtataggtgtgattgcttatattcttctatgtggaagcagacccttttgggcacggacagaatctggaatcttccgagctgtccttaaggctgatccaagtttcgatgaagccccatggccctcattgtctgctgatgcagtagattttgtgaagagattgctgaataaggattaccggaagaggctcactgcagctcaggcactcagtcatccgtggttggctggtcatcatgatgtcaagatacctttggatatgataatatacaagcttgtaagagcttatacatgttcttcttctctgagaaaagcagctttaggggcacttgccgaaagtctgacagtgccacaactggcttatcttcgggaacaatttactatcctagggccaaacaagagtggatatgtatcattagcaaactttaaaactgctgtgtctaaatactccactgatgcaatgaaggattcgagggtttttgagtatgtcaacatggtgagttcaattcaatacaggaaaatggacttcgaagaattctctgcagctgctattagtgtgcatcagctagaaggaatggaaagctgggaacagcatgcacgccgtgcatatgagctttttgagaaggatgggaacagacctatcatgattgaggaacttgcctctgagcttggacttagtccttcagttcctgttcatgtagttctgcaggactggataagacactccgatggaaaactgagtttcttggggtttgtcagacttctgcatggagtttcttcacgtacatttcaaaaaacttgaaacagatccactctacacacgtatttattatcaatatgcttctctttgtcctcctcatgctacgaagtctcgaatatatgccaattaagtcgccatgaagaagcatgaagttcccttcagctgcactgctggtgacaaagggatgctgtaagtggaagtaatagcttaatcactggattctaaagccttggcagcatattgcatgttagtaggtatctgttaacttttgccattatagctcttcttctcccgagatttgatgctactaaaatttggaggatttgtacagat

SEQ ID NO: 6456 - DNA, 2080 bp, Prunus persica
gtttgttgggtttgtgattcatgggactctgtcatggaaaacccacaaaaaacccacaagcccaatcgcaagattccacaattcccagtgaaagtgagccttatgcactcaattcccactccaccaaatcctcaaactttcccttttacagcccaagtccattgccaagtctcttcaagaactcccctgccaactccagcgtgagttcgacgcctctgcgcatttttaagcgacctttcccgcctccctctccggcgaaacacattcgggcattgcttgctcgcaggcatggctctgttaagcccaatgaagcctcaatccctgaaggaagtgagtgtgacgttgccttggataagaatttcaggttttctaaacagtttgtagctcattatgagcttggcgatgagtggggcgtgggcattttgggtatacttgctctgccaaggccaagaaggggagcttgaagggccaggatgtggctgtcaaggttattccaaagtcaaagatgacaacggcaattgctatagaggatgtaagaagagaagtgaagatcctacgggcactaacacataagaacctagtgcagttctatgaagcctatgaagatgatgacaatgtttatgtggtgatggagttgtgcaaaggaggtgaactattggatagcatactttcaaggggtggcaaatattcagaagatgatgcaaaggctgttatggttcagattttaagtgtaactgcctactgccatctccaaggagtggttcaccgcgatctcaagccagagaatttccttttcacttcaagcgatgagaagtcccccctgaaggccattgatttcggactctctgactatgtaaaaccagatgagagattgaacgatattgtaggaagtgcatactatgtagctcctgaagttctacacaggtcatatgggacagaggcagacatgtggagtattggtgtaattgcttatatccttttgtgtggaagccgacccttttgggcccggactgagtctggcatcttccgagctgtactaaaggctgatccaagctttgatgaagctccttggccttctctatcatctgatgcgagagattttgtaaagagactactgaacaaggattaccgtaagaggctaaccgcgtctcaggctttgtgtcacccatggttagccaactatcacgaggtcaagataccgatggatatgatagtgtacaaacttgttaaagcttatatatgctcatctgctctacgaaaatcagcattagggactcttgcaaagacattaagtgtagcacagctggcttatctccgggaccaatttacactgttagggccaaataaaagtggattcatctctatgcagaacttcaagacgggtgtaataaggaactcaactgatgccatgaaagattcacgggttctagattatgtcaacatgatcagctctatccgatatagaaagctggattttgaagaattttgtgcagctgccataagtgtgcatcagctggaagggatggagagctgggagcaacatgcaagacgagcatatgagctatttgagaaggatggaaacagaccaattatgatagaggaacttgcctcggaattggggcttagcccatctgtaccagttcacgttgttctccaggactggattagacactcggatggaaaacttagttttctggggtttgttagactactacatggagtttcttcacgcacatttcagaaggcttaaactaaaactggtctacatgcagttttgatacctccatccttactctcgaggatctggaatgccccaagggaaccaaatgtgtgcttaattggagaacttcattttgttttggtccctaggagggtctgcagtgcatgctcatgtcaattttttttaattacttttttctcctccctgttaagttatataaggtttttccttccctttcttctcttctctccatgattggtgctgttaaagtttagaggattgtacaggtgagagtagatcacagaatgtgtgtaggattaccgattacagaaatgttctaaactggagtgagttatgtgg

SEQ ID NO: 6457 - DNA, 2283 bp, Malus domestica
ctcagattaatcttcttgggcatctctcttttgctctacaaattccttgggagtttgattgatatcctttctgggtttttgttgatcaattcagtccttctgctttaagaattctctcccttcccttgaatatattctctgtaaattatattttttcactcactgtacttttggagctctgctgttaacccatgggactctgtcatggaaaacccactgaaaacccacaaccccactctcaagaccttacaattccaggcgaaaacgaggcttttgatgcacccaattcccagtcctcaaaatcctccaacttcccattttacagcccaagtccattgccaagtctgttcaagaactctcctgccaactccagcgtcagctccacgcctctgcggttatttaagcggccattcccgcctccgtcgccggcgaaacacattcgggcattgcttgctcggaggcacggctctgtgaagcccaatgaggcctcaatccctgaaggaagtgagtgtgaggttgccttggacaagaatttcgggttttcaaaacagtttggaagccattatgagcttggtgacgaggtggggcgaggacatttcgggtatacttgctctgccaaggccaagaagggaagcttgaagggccaggatgtggctgtcaaggttattccaaagtcaaagatgaccacggcaattagtatagaggatgtaagaagagaagtgaagatcctaagggctctaactcataagaacctagtgcagttctatgaagcctatgaagacgatgacaatgtttatgtagcgatggaattgtgcaagggaggtgaactgctggatagcatactttcaagggatggaaaatattctgaggctgatgcaaaggctgttatggttcagattttaagcgtaactgcctactgtcatctccagggcgtagttcaccgggacctcaagccagagaatttcctttttacttcaagcgatgagaaatccccgttgaaagccattgatttcggactctctgactatgtaaaaccagatgagaggttgaatgatattgtaggaagtgcatactatgtcgctcccgaagttctacataggtcatatggggcagaagcagacatgtggagtatcggtgtaattgcttatatccttttgtgtggaagccgacctttttgggcccggaccgagtctggcatctttcgagctgtactaaaggctgatccgagctttgatgaagctccttggccttctttatcatctgatgcaatagattttgtaaagagactactgaacaaggactaccgtaagagattaaccgcggctcaggctctatgtcatccatggttagccaattatcatgaggtcaagataccgatggatatgatagtgtacaaacttgttaaagcttacatatgctcatctgctctacgaaaatcagcattaaggactcttgcaaagacgttaagtgtggcacagctggcttatctccgggaccaatttacattgttagggccaaataaaagtgggttcatcactatgcagaacttcaagatgggtctaacaaggaactcaaccgatgccatgaaggattcgctggttctagattacgtcaacatgatcagttctattcggtatagaaagctggatttcgaagaattttgtgcatctgccataagtgtgtatcagctggaggggatggagagctgggaacatcatgcaaggcgagcatacgagctgtttgagaaggacggaaacagaccaataatgatagaggaacttgccacggaattaggacttagcccgtcagtaccagttcatgttgttctccaggactggataagacactcagatggcaagctcagttttctggggtttgtcagactactgcatggagtttcttcgcgcacatttcagaaggcttgaactagaaccggtctacatgaagtcttgtttccaccatccttattctcgatgacctcgaacgtccctaggtgacaaaatttgtgcttaattggagaacttcattttacgagggtctggagcacatactcgtgtcattttttctttccgtttcccctccctctaacttgtacaaaggcggcttttcgtttccttgataaggttagaggagggttgtacaggtgagagtgggtagatctcagaatgcgtttaggatttacccttacagattacaaagctgtcctgttgtaaactggagttacttttgtggtctttatcaatatagttttgttaataaaatcttcctgtgatcttgcacaaa

SEQ ID NO: 6458 - DNA, 2339 bp, Gossypium hirsutum
tttttttttcttgatcaaagagttgaacttattattattattattattaatatttggttctgggggactaattcctataatgggactctgccatggaaaacccattgaaaaccaacaaaagcaatcaagggacatctcaatcccagctgaaaaggatgcagcaccaaattccaactcctcaaagtcatcaaatttcccattttacagtccaagtccattgcccagcctcttcaagacatccccagctgtacccagtgtgaattctactcctcttcgcttcttcaaacggccattccctcccccctctcctgcaaagcatatcaagtcattgctggcaagaaggcatggctcaattaagcctaacgaggcctcaatccctgaaggaagtgagtgtgaggttggtttgaataagagttttgggttttcgaagcattttacgtctcattatgagcttggtgaggaagtggggcgtggacattttggatatacttgctccgctaaggccaagaaaggaagcctcaaaggcaatgacgctgctgtcaaagttattcctaagtccaagatgaccactgcaattgccatagaggatgtaagacgagaggtgaagatactacgagctttaactggtcataagaacttggttcagttctacgatgcctatgaagatgatgaaaatgtttacatagtaatggaattgtgcaagggtggcgaacttctagatagaatactttcaaggggtggaaaataccctgaagaagatgctaaggctgtcatggttcagattttaagtgttgtggccttttgtcatctccaaggtgtagttcaccgtgaccttaagcctgagaattttcttttcactactaaagatgagggttctcctctaaaggcaattgattttggactttcagactatgtgaagccagatgaaagactgaatgatatcgtaggaagtgcatattatgttgctcctgaagtactacatagatcatatgggactgaggctgacatgtggagtatcggagtaattgcttatatacttctttgtggaagtcgaccattttgggcacgaacagaatctggcatctttcgagctgtccttaaagctgatccaagctttgatgaagccccttggccatctttatcccctgacgcgatagattttgtaaagagattgttgaacaaggactaccgtaagagactaactgctgctcaggctctgagtcatccatggttggcaaattgtcatgacataaagataccatcagatatgataatatgcaggctcgttaaagcttatataggctcctctacactacgaagagcagcactgggggctcttgcaaagacgttgactattccacagcttgcttatctccgggaacaattctcattgttagggcctaacaaaagtggatttattctgatgcagaattttaagacggtgatgttgaagaactctactgatgctatgaaggattcgcgggtccttgattatgtcaacatgattagttctattcagtatagaaaattggacttcgaagaattttgtgcttctgcaataagtgtgcatcagctagaaggaatggaaacatgggaacagcatgcaaggcgtgcatatgatttgtttgataaggatggaaacaggcccattatgatagaggaacttgcctcggaacttggacttagctcatcagtgccggttcacgttgttcttcaagactggattagacactcagatgggaagcttagtttcttgggatttgttagacttctacatggagtatcttctcgcacatttcagaaatcttgatgttgaattggaccacgttttatctcttctcctcactattgagaaaacaaatgcgtgctcaaatctgaagcaaagctaatgcgacatctgaattcaatcacggaagaaaagaaaatagagcttaaaggccaatctgacatgccctttatgtttctgcagcaagcagtttgcaccatcttttctcatcgtctctctctttttggggggtgtaggtctaggattgtttttcttcccactcttgcatatcttctctcagttgccaaaatagtaaaacaattattatatataataaatttgatcattgttgtttagtctttctcccaacccttagatgtttcatcctatcccttagttcaatttatttccttgaagcttgagactcaaattcaaatggatggagactccattggtttaactattttttctgtgtttaggcttgggtttgctttgtacctgaaacaaattgtagtggatggatggatggagtgtcatttatgtataaaattcacctcatttttaaaagggttgg

SEQ ID NO: 6459 - DNA, 3161 bp, Gossypium raimondii
gttagttatgaaatgtaaatgggaagcaaaaaggacaggctggatatatccaaagaccccaaccctaccatccaattaattgagggaaaccaatgaaaaagaaaaacatcccccattaacaaaaaataaagcttaccaaaagcactacacaaacaaccctccgtttcttccttttttctttttttttcctctgcttttcttgctgcctctgctaagcatctttaccttactttcccttttccttttttatttctttctctcatcttttccctcttccttattctttccttgttcgtggagtaatattttttctctctctctctctctctctctctctctctttttttactctttcattctcttcttcttcttcttcttccatcaaacaaaaattctgctcctccttcactagcttccggcattgtttttgtatgatcagtaaagttgaattgcttttttttacttactagttttttttccctaaagtaaattctccttcttgggtactcttttttttttttttgctttggaattttcttgggtttttttttctgaaacattttttagtgtgctcgatctttcccacttatacatatttttttcctttccttggatcgaactgtgaagctgaagtgtgttttcacctcaagaacacaccggattaaatccctttttctgtcttcagtttttcactttccgtttgatttcttgcccttttcctagttttttttttcttgatcaaagagttgaacttattattattattattattatttggttctgggggactaattcctataatgggactctgccatggaaaacccattgaaaaccaacaaaagcaatcaagggacatctcaatcccagctgaaaaggatgcagcaccaaattccaactcctcaaagtcatcaaatttcccattttacagtccaagtccattgcccagcctcttcaagacatccccagctgtacccagtgtgaattctactcctcttcgcttcttcaaacggccattccctcccccctctcctgcaaagcatatcaagtcattgctggcaagaaggcatggctcaattaagcctaacgaggcctcaatccctgaaggaagtgagtgtgaggttggtttgaataagagttttgggttttcgaagcattttacgtctcattatgagcttggtgaggaagtggggcgtggacattttggatatacttgctccgctaaggccaagaaaggaagcctcaaaggcaatgacgctgctgtcaaagttattcctaagtccaagatgaccactgcaattgccatagaggatgtaagacgagaggtgaagatactacgagctttaactggtcataagaacttggttcagttctacgatgcctatgaagatgatgaaaatgtttacatagtaatggaattgtgcaagggtggcgaacttctagatagaatactttcaaggggtggaaaataccctgaagaagatgctaaggctgtcatggttcagattttaagtgttgtggccttttgtcatctccaaggtgtagttcaccgtgaccttaagcctgagaattttcttttcactactaaagatgagggttctcctctaaaggcaattgattttggactttcagactatgtgaagccagatgaaagactgaatgatatcgtaggaagtgcatattatgttgctcctgaagtactacatagatcatatgggactgaggctgacatgtggagtatcggagtaattgcttatatacttctttgtggaagtcgaccattttgggcacgaacagaatctggcatctttcgagctgtccttaaagctgatccaagctttgatgaagccccttggccttctttatcccctgacgcgatagattttgtaaagagattgttgaacaaggactaccgtaagagactaactgctgctcaggctctgagtcatccatggttggcaaattgtcatgacataaagataccatcagatatgataatatgcaggctcgttaaagcttatataggctcctctacactacgaagagcagcactgggggctcttgcaaagacgttgactattccacagcttgcttatctccgggaacaattctcattgttagggcctaacaaaagtggatttattctgatgcagaattttaagacggtgatgttgaagaactctactgatgctatgaaggattcgcgggtccttgattatgtcaacatgattagttctattcagtatagaaaattggacttcgaagaattttgtgcttctgcaataagtgtgcatcagctagaaggaatggaaacatgggaacagcatgcaaggcgtgcatatgatttgtttgataaggatggaaacaggcccattatgatagaggaacttgcctcggaacttggacttagctcatcagtgccggttcacgttgttcttcaagactggattagacactcagatgggaagcttagtttcttgggatttgttagacttctacatggagtatcttctcgcacatttcagaaatcttgatgttgaattggaccacgttttatctcttctcctcactattgagaaaacaaatgcgtgctcaaatctgaagcaaagctaatgcgacatctgaattcaatcacggaagaaaagaaaatagagcttaaaggccaatctgacatgccctttatgtttctgcagcaagcagtttgcaccatcttttctcatcgtctctctttttggggggtgtaggtctaggattgtttttcttcccactcttgcatatcttctctcagttgccaaaatagtaaaacaattattatatataataaatttgatcattgttgtttagtctttctcccaacccttagatgtttcatcctatcccttagttcaatttatttccttgaagcttgagactcaaattcaaatggatggagactccattggtttaactattttttctgtgtttaggcttgggtttgctttgtacctgaaacaaattgtagtggatggatggatggatggagtgtcatttatgtataaaattcaccccattttaaaggtgttttgggacgtgtgattttgaggctaattaatattacacatcttaatttgtcatgtgtattaagtattgataatttttttatcaataggtagcgaaaggaggat

SEQ ID NO: 6460 - DNA, 2976 bp, Theobroma cacao
ttgctgcctatgctaagcatctttgccttacttttttctctgttcttttgcctctctccctcttattctttccttcttctaggagtaaattttttccctcttgtggtattgtttctttcctcttcattcacttcttgcagcgaaccaaaaatctgctactgcttcttttcttcttgagctctgtctttctttctatctggcattgtttttgtatgatcagtaaagttgaattgctttctcattatagttctgtttttatgtttttcaattaattctccttcttgggtactctttcttttttgctttggaattttcttggagtttgttcttctgcaaatttaacagtgctatttttttttctttcctttgatcaaattgtgaagtacgactttttttctcacatcaagaatacaccaaaatcaattgttttcttctttttggttgaattcagtttctcacttttccctcctcatggtttaatttcttgcacttttcctgttgtttcttgatcaaagcctttaacttgttcttggttcttttacaattcgactttttttctgtctatattttccttgggactttgtttccaatgggactctgccatggaaaacccaccgaacaccaacaaaatcaatcaagagacatatcaatcccaggtgaaaatgatccaccagcaaatgcccactccaccaagtcatcaaatttccctttttacagtccaagtccattgccaagcctcttcaagacatccccagcaatatcaagtgtgaattctactcctctgcgcatcttcaaacgcccatttcctcctccttctcccgcaaagcatatcagggcactgctggcaagaaggcatggctctattaagcctaatgaggcctcaattcctgaaggaaatgagtgtgacatcggtttggataagaattttggattttcaaagcattttatgtctcattatgagcttggtgaggaagtggggcgtggacattttggatatacttgcacggctaagggcaagaaaggaagcctcaaaggccatgatgtggccgttaaagttattccaaagtctaagatgacaacagcaattgccatagaggatgtaagacgagaagtgaagatattacgagctttaacaggtcataagaacttggttcagttctatgatgcctatgaagatgatgacaatgtatacatagtgatggagttgtgtagaggtggtgaattgctagatagaatactttcaaggggtggaaaatactcagaagaagatgctaagactgttgtggttcagattttaagtgttgtggccttttgtcatcttcaaggtgtagtccaccgtgacctcaagccagagaattttcttttcactagtaaacaagagaattcgcctctgaaggccattgatttcggactttcagactatgtaaagccagatgaaagattgaatgacatcgtaggaagtgcatattatgtcgctcctgaagtactacatagatcatacgggactgaggcagacatgtggagtattggagtaattgcttatatacttctttgtggaagtcgaccattttgggcacggacagaatctggcatctttcgtgctgtccttaaagctgaccctagctttgatgaagctccctggccttctttatcccctgaagcaatagattttgtaaagagattgttgaacaaggactaccgtaagaggctaactgctgctcaggctctgagtcatccgtggttggcaaattatcatgagataaagataccatcagatatgataatatgcaggcttgtaaaagcttatataggctcatctgcactacgaaaaacagcattgggcgcccttgcaaagacattaactgtaccgcagctagcttatctccgggaacaattcacattgttagggcctaacaaaaatggattcatttctatgcagaattataagacggcgctgatgaaaaattctactgatgctatgaaggattcgcgggtccttgattatgtcaacatgattagtactcttcagtatagaaaattggactttgaagaattttgtgctgcttccataagtgtgcatcagctagaaggaatggaaacctgggagcaacatgcaaggcgtgcatatgatttgtttgagaaggatggcaacaggcccattatgatagaggaacttgcctcggaacttggacttagcccatcagtaccagtgcacgtagttctccaagactggataagacattcggatgggaagcttagtttcttgggatttgttagacttctacatgggatttcttctcgcacatttcagaagtcttgaagtaggacccaactgtaaacacttttatctgttgatctcacttgagctgaactgtctggtcgaaacaaatgcctgtgtcatttgggagctagcctgaacaaagctagcataacatctggatcaggaaaaagacggtgcaagcaagttgatactataagccaatctgacatgccctgctagtgaagcaatttgcagcatcttctcatgtctttatttttgttcgtttttggggtttgttcctttttttttttttccgtttggccaggtactctctatccctacaactttgccttttttgtccattttagtatcaaatgattggtgtccttgaaacctagagggttgtacagatgaggttgggtcgcaaaatgtatctagtgtaaggcttttagcaaacagattctaagctactttttctggtttatgggttcatcccttgtgtaccaagatgtttattcctagttggttaccaaatttaatagcagtccatgagtcttcacatttacattagtcgatgccttgctgcttgtttcaatcactccattaccaaacgctattctgttggcccttgtgttttttaacttacattttgtatcatggataacacatacgtaggacatatggccctcaagttgatttgtctttttctatgtgga

SEQ ID NO: 6461 - DNA, 2954 bp, Gossypium raimondii
tccgtttcttccttttttctttttttttcctctgcttttcttgctgcctctgctaagcatctttaccttactttcccttttccttttttatttctttctctcatcttttccctcttccttattctttccttgttcgtggagtaatattttttctctctctctctctctctctctctctctctttttttactctttcattctcttcttcttcttcttcttccatcaaaccaaaattctgctcctccttcactagcttccggcattgtttttgtatgatcagtaaagttgaattgcttttttttacttactagttttttttccctaaagtaaattctccttcttgggtactcttttttttttttttgctttggaattttcttgggtttttttttctgaaacattttttagtgtgctcgatctttcccacttatacatattttttttcctttccttggatcgaactgtgaagctgaagtgtgttttcacctcaagaacacaccggattaaatccttttctctctcttcattttttgtactttccgtttgatttcttgcccttttcctagtgtttttttttcttgatcaaagagttgaacttattattattattattattatttggttctgggggactaattcctataatgggactctgccatggaaaacccattgaaaaccaacaaaagcaatcaagggacatctcaatcccagctgaaaaggatgcagcaccaaattccaactcctcaaagtcatcaaatttcccattttacagtccaagtccattgcccagcctcttcaagacatccccagctgtacccagtgtgaattctactcctcttcgcttcttcaaacggccattccctcccccctctcctgcaaagcatatcaagtcattgctggcaagaaggcatggctcaattaagcctaacgaggcctcaatccctgaaggaagtgagtgtgaggttggtttgaataagagttttgggttttcgaagcattttacgtctcattatgagcttggtgaggaagtggggcgtggacattttggatatacttgctccgctaaggccaagaaaggaagcctcaaaggcaatgacgctgctgtcaaagttattcctaagtccaagatgaccactgcaattgccatagaggatgtaagacgagaggtgaagatactacgagctttaactggtcataagaacttggttcagttctacgatgcctatgaagatgatgaaaatgtttacatagtaatggaattgtgcaagggtggcgaacttctagatagaatactttcaaggggtggaaaataccctgaagaagatgctaaggctgtcatggttcagattttaagtgttgtggccttttgtcatctccaaggtgtagttcaccgtgaccttaagcctgagaattttcttttcactactaaagatgagggttctcctctaaaggcaattgattttggactttcagactatgtgaagccagatgaaagactgaatgatatcgtaggaagtgcatattatgttgctcctgaagtactacatagatcatatgggactgaggctgacatgtggagtatcggagtaattgcttatatacttctttgtggaagtcgaccattttgggcacgaacagaatctggcatctttcgagctgtccttaaagctgatccaagctttgatgaagccccttggccttctttatcccctgacgcgatagattttgtaaagagattgttgaacaaggactaccgtaagagactaactgctgctcaggctctgagtcatccatggttggcaaactttcatgacataaagataccatcagatatgataatatgcaggctcgttaaagcttatataggctcctctacactacgaagagcagcactgggggctcttgcaaagacgttgactattccacagcttgcttatctccgggaacaattctcattgttagggcctaacaaaagtggatttattctgatgcagaattttaagacggtgatgttgaagaactctactgatgctatgaaggattcgcgggtccttgattatgtcaacatgattagttctattcagtatagaaaattggacttcgaagaattttgtgcttctgcaataagtgtgcatcagctagaaggaatggaaacatgggaacagcatgcaaggcgtgcatatgatttgtttgataaggatggaaacaggcccattatgatagaggaacttgcctcggaacttggacttagctcatcagtgccggttcacgttgttcttcaagactggattagacactcagatgggaagcttagtttcttgggatttgttagacttctacatggagtatcttctcgcacatttcagaaatcttgatgttgaattggaccacgttttatctcttctcctcactattgagaaaacaaatgcgtgctcaaatctgaagcaaagctaatgcgacatctgaattcaatcgcggaagaaaagaaaatagagcttaaaggccaatctgacatgccctttatgtttctgcagcaagcagtttgcaccatcttttctcatcgtctctctttttggggggtgtaggtctaggattgtttttcttcccactcttgcatatcttctctcagttgccaaaatagtaaaacaattattatatataataaatttgatcattgttgtttagtctttctcccaacccttagatgtttcatcctatcccttagttcaatttatgtccttgaagcttgagactcaaattcaaatggatggagactccattgatttaactattttttctgtgtttaggcttgggcttgctttgtacctgaaacaaattgtagtggatggatggatggatggagtgtcatttatgtataaaattcacctcattttaaaggtgttttgggacgtgtgattttgaggctaattaatattacacatcttaatttgtca

SEQ ID NO: 6462 - DNA, 2346 bp, Panax ginseng
ggaatgggttctttcccttttcttctcctctttgctttttcttgcggactctgcttaagcatctttggctcgcttttgttatcttttccccagtcctattctttaccttgttgaaatatttctgggttctcttgttctggcgtttcaagttcttctatatatttccattctgcagttgggtttctgattccatgggactttgtcatggaaaacccattgaaaactcccaaaaccaaccaggaaacccaattattcccagtgagaacgagctagtgctgaattctcaatctgggaaagcatcaaagtttcccttttacagcccaagtcctctgcccggcgcatacaaggactcacccgccaattcaagtgttagttcaacccctcttcgcactcctcttcgcttgtttaagcgtccattccccccgccttctccagcaaagcacattcgggcattgcttgcgcgaaggcatgggtcaattaaacctaacgaggcctcaattccggaaggaaatgagcttgagattggtttggataagagttttgggtattcaaagcaattgttaacccattatgagcttggtgaagaggtgggccgtgggcattttgggtatacctgttcagctaaggggaagaaagggagtttgaaggggcaggatgtggctgttaaagttattccaaaatcaaagatgactacagcaattgccattgaggatgtaagaagagaagttaaaatattacgggctctgacaggacataaaaaccttgtacaattttatgatgcctatgaggatgaagacaatgtttacgtagtgatggagttatgcaaaggaggggaattattagataggatactttccaggggtggaaaatacacagaagaggatgcaaaagccgtcatggtccaaattttaagtgttgttgcttactgtcatctccaaggagtggtccaccgggacttgaagcccgagaattttctttttgttttctaaagatgagcattccccactgaaagccatcgacttcggactctccgattatgtaaagccagatgaaaggctgaatgatattgtagggagtgcatactatgtagctccggaagttctgcatagatcatatggaaccgaggccgacatgtggagtattggtgtaattgcttatattcttctatgcggtagccgccctttttgggctcggacagaatctgggatcttccgagctgtccttaaagcagatccaagctttgatgaatccccgtggccttcgttgtcttctgatgcagtagacttcgtgaaaagattgttgaacaaggattaccgtaagagattaactgctgcacaggctcttagtcatccatggctggccaattaccatgatgtcaagatacctctggacatgataatttacaaggttgtaaaagcctatatctgttcatcttctctgagaaaagcagctttgggggctcttgctaaaacattgacaataccccagctagcatatctacgggaacaatttacattgcttggcccaagcaaaagtggattcatatctttacagaacttcaaattggctgtgacaaagaactgcaccgaggccataaaggattcacgggttctagattttgccaacatggtgagttcccttcagtatagaaaattggacttggaagaattttgtgccgcagcaataagtgtacatcagctggaaggaatggacagctgggagcaacatgcacgccgtgcctacgaactgtttgagaaagatggaaatagacctattatcatagaggaacttgcctccgagcttggactcagcccatcagtacctgttcatgtagtcctccaggactggataagacactcggatggaaaactcagtttcttggggtttgtgagacttctacatggggtttcttctcgtgcatttcagaaagcttgatatattaagcagccacacatactcatccttagaccctttttgttgtgtccttgaagtggattatatatatagcagacatattacttgccaaatcaagaacaaacctctagaacaaaagttattgttaagttgaaaaaccatatcagatgcggcatgaggagcagtcgaagcaaatcttatgtcattatgttttattaaaaagtttctttgccattgagatttagaggattgtacagatgaggtagatcataaaatgtttttaggagattagaaaccagcttaatgctgaagtgaatgttgtgcttttgggtgtatctcttgggtaccctgttcattttcttaataaattcatattgtgatagtaaaataaaaaaaacaaaaaaaaaaaaaaaaaaaaaaataaaaaaaaaa

SEQ ID NO: 6463 - DNA, 2721 bp, Panax ginseng
tttccccagtcctattctttaccttgttgaaatatttctgggttctcttgttctggcgtttcaagttcttctatatatttccattctgcaggtgaaatcttttgctaaatttcagtaaattttgatgggtttcatttctttgagcagaaagttcaatagctttctatttgtatgtttttcagttcttttttccattcttgggattctctttcttggaaaatttaatttattggggaattctttcctaatcctttctgggttctgttgatcaaactggaaaaaatatattatatttttgaatctttcaattcaagattttggaatcccttgtttcctagtcttctgggtttattcagtttaaagaaattccgtgattgggtcgagttttagttctttgttcaattcagtttctgatgctccaacttccctgaatttagttttcacctatttttcttctgtacctatggtttagattttactatttctcttgtttttacttgaaacacatgttctaaactttgtttttctctttgtggttggtttttgttattcttttacagttgggtttctgattccatgggactttgtcatggaaaacccattgaaaactcccaaaaccaaccaggaaacccaattattcccagtgagaacgagctagtactgaattctcaatctgggaaagcatcaaagtttcccttttacagcccaagtcctctgcccggcgcatacaaggactcacccgccaattcaagtgttagttcaacccctcttcgcactcctattcgcttgtttaagcgtccattccctccgccttctccagcaaagcacattcgggcattgcttgcgcgaaggcatgggtcaattaaacctaatgaggcctcaattccggaaggaaatgagcttgagattggtttggataagagttttgggtattcaaagcaattgttaacccattatgagcttggtgaagaggtgggccgtgggcattttgggtatacctgttcagctaaggggaagaaagggagtttgaaggggcaggatgtggctgttaaagttattccaaaatcaaagatgactacagcaattgccattgaggatgtaagaagagaagttaaaatattacgggctctgacaggacataaaaaccttgtacaattttatgatgcctatgaggatgaagacaatgtttacgtagtgatggagttatgcaaaggaggggaattattagataggatactttccaggggtggaaaatacacagaagaggatgcaaaagccgtcatggtccaaattttaagtgttgttgcttactgtcatctccaaggagtggtccaccgggacttgaagcccgagaattttctttttgtttctaaagatgagcattccccactgaaagccatcgacttcggactctccgattatgtaaagccagatgaaaggctgaatgatattgtagggagtgcatactatgtagctccggaagttctgcatagatcatatggaaccgaggccgacatgtggagtattggtgtaattgcttatattcttctatgcggtagccgccctttttgggctcggacagaatctggaatcttccgagctgtccttaaagcagatccaagctttgatgaatccccgtggccttcgttgtcttctgatgcagtagacttcgtgaaaagattgttgaacaaggattaccgtaagagattaactgctgcacaggctcttagtcatccatggctggccaattaccatgatgtcaagatacctctggacatgataatttacaaggttgtaaaagcctatatctgttcatcttctctgagaaaagcagctttgggggctcttgctaaaacattgacaataccccagctagcatatctgcgggaacaatttacattgcttggcccaagcaaaagtggattcatatctttacagaacttcaaattggctgtgacaaagaactgcaccgaggccataaaggattcacgggttctagattttgccaacatggtgagttcccttcagtatagaaaattggacttggaagaattttgtgccgcagcaataagtgtacatcagctggaaggaatggacagctgggagcaacatgcacgccgtgcctacgaactgtttgagaaagatggaaatagacctattatcatagaggaacttgcctccgagcttggactcagcccatcagtacctgttcatgtagtcctccaggactggataagacactcggatggaaaactcagtttcttggggtttgtgagacttctacatggggtttcttctcgtgcatttcagaaagcttgatatattaagcagccacacatactcatccttagaccctttttgttgtgtccttgaagtggattatatatatagcagacatattacttgcccaatcaagaacaactctagaacaaaagttattgttaagttgaaaaaccatatcagatgcggcaagaggagcagtcaaagcaaatcttatgtcattatgttttattaaaaagtttctttgccattgagatttagaggattgtacagatgaggtagatcataaaatgtttttaggagattagaaaccagcttaatgctgaagtgaatgttgtgcttttgggtgtatctcttgggcaccctgttcattttcttaataaaattcttactgtgatctgttagcaaatccgcgaagctcttgcagggaactgttcaaat

SEQ ID NO: 6464 - DNA, 1990 bp, Vinca minor
gtttttgattctccatgggactttgttatggaaaaccaaatgaacccccacaaaatctatcagaaaatcccaaaattccaactgataatgaaccagaagcattgagtagtagtactactcatactgggagaaaaacaccaaagtttccattttatagtccaagtccattagtaccaagtgctttcaagaattcaccagctaattctagtgtgagttctacacctttaaggttgtttaaacgcccctttcctccgccttcgccggctaagcatattcgggctttgcttgctaggaggcatggctcagttaagcctaatgaggccacaattcctgaaggaagtgagtgtgagattgggttggataagattttggattcactaagattttgtaagtcattatgagcttggtgaagaagtgggggagagggcattttgggtatacttgttctggtaaggggaagaaagggagcttgaagggtcaagatgtagctgttaaggttatcccaaagtccaagatgaccacagcaattgcaattgaagatgtcaggcgggaagtgaaaatgttacgtgctttaacggggcataagaaccttgtgcaattctatgatgcttatgaggacgaagacaatgtttatgttgtgatggagttatgtaggggaggcgaattattggatcggatactttcaaggggtgggaaatactcggaagaagatgcaaaagttgtcatggtgcagattttaagtgtggttgcctactgtcatcttcagggtgttgttcaccgggacttgaaacccgagaatttccttttcgcttcgaaggatgaaaattctccgctcaaggccattgacttcgggctctctgattatgtgaaaccagatgaaaggctgaatgatattgttggaagtgcatactatgtggcaccagaagttttacatcgatcttacggaacagaagctgacatgtggagtataggtgtcattgcctatattcttctctgtggaagcaggcccttttgggcacggacagaatccggaattttccgagctgtccttaaggctgatcctggtttcgatgaagccccgtggccctctttgtcttctgatgcagtagattttgtgaagagattgctgaataaagattaccggaagaggctcactgcatctcaggcactcagtcatccgtggttggctggtcatcatgatggcaaaatacctttggacatgataatatacaagcttgttcgagcttatacatgttcttcctctctgagaaaggcagctctggggggtcttgccaaaacccttaccgtgccacaactagcttatctgcgggaacaatttactatccttgggccaaacaagagtggatatgtgtccttacaaaactttaaatccgccgtgtcgaaatgctccactgatgcaatgaaagattcgagggtttttgagtacgtcagcatggtgagttctattcaataccgaaaaatggattttgaagaattctgtgcagctgctattagtgtgcatcaactcgaaggagcggatagctgggaacagcatgcacgccgagcgtatgaactgtttgagaaggatgggaacaggcctattatgatcgaggaacttgcttctgagctcggactcagtccttcagtccccgttcacgttgttctgcaggattggataagacactcagacggaaaactgagtttcttgggattcgtcagacttctacatggcgtttcttcgcgcacatttcaaaaatcttgaaatttgatccatttatttattactgggatgccaattgagtgaccgcggaattaaggatgcaggaaaaaaatttggatgcggtaagtgggaattaatagctgaaaatcactgcattctaacgcctttgccttttgccacatgttccgtgttagtgcatatttgttaacttttaccattttagcccttcttctcctgaggtgtttgattgccacgaaaaaatttggagga

SEQ ID NO: 6465 - DNA, 3055 bp, Vitis vinifera
cctctcagttgttttgggatcaataaggacaggctggaaggatccaaaacccaaccccactccattattgttacgagtcccctcccctctccatccctctaataaagtggtattttcacacataaccccatcaactacagaaaaaaaaggaaagttagcttacagaaaagcagaaaaaggaggctctgtatctttctttctttcgtttcttttctttttcttgcagcttatgctaagcatcttttcctcacttctcctctcttgtcattcttctttttcttcatacaaaatttttggggtttcttgctttgggcctgaaccttgcctgtctttcttcttctcttccttctcctgaaatttgcttcacgttgggcttattttaatgtcggtttctgcctggcattgtttgtttgctcaggaaagttgaattgctttttttttttttcctatttgtttcggggttgtatttttctttcttgggattctgtttttttcttttggaagtctctttacatttgaattttttagtgatatttcgttctgggttttgttcaatcaactgaaattttctgtctctggggtttgattttgatttcagagattggaaattaactttcctcttgtactgggttttctgtagattctgggtattttctttcttgaaaatcatttattgttcaagtttctctgtcgagctttgatcttctcgatttcgttttccacttttctttataattatccttgagaacttctgagttttcttgtctacttcctctgtcattcctctaattctcttttcttggttttaattccatgggactctgtcagggaaaacccattgaaaaccctcagacacagtcccaagaccttataattcccggtgatggcgagctttctaccaacacccaaaccaccaaaaccccaaaattccccttttacagcccaagtccactgcctagtggtttcaagaactcgccagccaattcaagcgtgagttccacccccttgcggatctttaagcggccgtttccgccaccttctccggcaaagcatattcgggcattgcttgctcgaaggcacggttcggttaagccgaatgaggccacaattcccgaaggaaacgagtgtgaagttggtttggacaagaactttgggttctcgaagcagtttgtagctcactacgagatgggtgaggaggtggggcgtggccattttgggtacacttcttccgccaaagccaagaaagggagcttgaaggggcaggatgttgctgtcaaggttatcgccaaatcaaagatgactacagcaattgctattgaagatgtgagaagagaagtaaaaatattacgagctctaactggacataagaacctagtgcaattctacgaggcctacgaagatgatgataatgtttatatagtaatggagttatgcagaggaggtgaacttttagatagaattcttgccaggggtggaaaatactctgaagaagatgcaaaggctgtcatggtccagattttgaatgtaactgccttctgtcatctccaaggtgtggttcaccgtgaccttaagccagagaattttcttttcatttccaaagaagagaattctccactgaaggctattgatttcggactttctgactacgtaaagccagatgagaggctgaatgatattgtaggaagtgcatattatgtagctcctgaagttcttcatagatcatatgggaccgaagctgacatgtggagtgttggtgtaattgcttatattcttctatgtggaagtcggcccttttgggcccggacagaatcaggcatcttcaaagctgtccttaaggcagatccaagctttgatgaagccccttggccttctttatcttctgatgcaatagattttgtaaagagattgttgaataaagattaccgcaagaggctaactgctgctcaggctctaagtcatccatggctggccaattatcatgatgtcaagataccattggatatgatagtatataaacttgtaaaagcttatatattctcatcttctctgcgaaaatcggctttggcggctcttgctaagacattgagtatagctcagctagcttattttcgggaacaatttacacttttggggccgaacaaaagtggattcgtatctctgcagaactttaagacggctgtgacaaagaactccactgatgccataaaggattcacgggtcctggaatatgtcagcatggtgggttctcttcaatatagaaagttggactttgaagaattttgcgcagcagccataagtgtgcttcagctggaaggaatggagagctgggagcaacatgcacggcgtgggtatgagctatttgagaaggatggaaataggcccattatgatagaggaacttgcttcagaacttggacttagcccatcggtacctgttcatgtagttctccaagactggataagacactctgatgggaagcttagcttcttagggtttgttagactcttacatggtccgtctcgtgcattccccaaagcgtaaaaacaaataccaagctacactggctacatcctcatcctttttctctccttgaactggaatgtctttaaggggataaaatgcatgcctaaaccgagagctactcttaacaagcaagtgttgtgtcttagctgcataaggggttgctgcaagttgaaattagagtaaatgcaaatgaccttaccaccgaagccaggcattgctggcatatctcatgttgggtatgctccttttttcttccttagttctcttttacttgttttcttgccttgtataatttttttccccatgtttggtgctattgcaatctagaggattgtacagatgagagtagatcacaatgtatttaggggttagtgaaaaactcagaagaactgaagtgagttttgtggtttttgggtttatccctggtgtacccaatgcactttggtttctcaataaattcttactgtgatctacagaagttgaatgactgataacttcttttgttatttgatgttgaggccattgtttctca

SEQ ID NO: 6466 - DNA, 3452 bp, Populus trichocarpa
acatccatcctggttattttgggatcaataaggacaggctggaaggatccaaactccaaccccacttccattattattttacaacaagagaagaagaagaagaagacaatcatcaatccacaaaattagctgatatttccctacacaaaaaaggccaaaaaccattgctaacacaaacacaaaaaagaaaaaaatgtaattgaaaacaaaattgaaaacaaagaagcaaagagagtttgcaaaaaagcaaggaaaagaagccttgtgcgctcttttttcccttttcttgctgcctctgctaagcatcttttcttcacttttccctgtgcttttgcccctctctctcgctccgttctttctctcctggaatataattccctcgcagttttctctcttttgtttctctcgtcctctgatcccttctcttctccaacaatttgctgcttatttatttgtctcttcctttctttccgagcacttgtttctttgatcagtaaagtccaattccttttctttttttcccaccctttcaatttctattttaaatttcccaccttttcaatccaaattagctggcaaattcttgtgctttggaatttacagtgccaatcatttctgggttctcttgatcatattgtaaaaatttagtcttgaattcagtttcttgctgacttctttttttttgttcaaattgtctagatatctgtaccttttttttaaaaactctccttcttgtataactcactgtgaaaatttctttctttagcctcaaatccttgaattttgtcactcactctctttgtttttttgttttcttcaaatggtctaaatctctttacttttctttgagtttcttgatcgaagttttaaacttccttgatttttaagtgatttcttgaattctctgttttgggttttgtttccatgggactttgtcatggaaaacccattgagctccaaaaaaatcaatccaaaaacaacacactctccattgaaacagactcaacacagccagcaaattcacacactagcaagacctcaaactttcccttttacagtccaagtccattaccaagtctcttcaagacttcacctgctatatcaagtgtaagctccactcctttgaggattttcaagaggccttttccacctccttctcctgcaaagcatatacgtgcattacttgcaagaaggcatggctctgttaagcctaacgaagcttcaattcctgagggaagtgaaagtgatattgctttggacaagaattttgggttttctaagcagtttgtgagtcactatgagcttggtgaggaagtggggcgtggacattttgggtatacttgctctgctaaggcaaagaaagggagcttgaaaggccaggatgtggcagtcaaagttattccgaagtccaagatgaccactgcaattgctatagaggatgtgagacgtgaagtgaaaatattacgggctctaacgggacataataatctagtgcagttctatgatgcctacgaagatgatgacaatgtctatgttgtaatggagttgtgcaaaggcggtgaattattggataggatactctcaaggggtggaaaatactcagaagaagatgcaaagactgttatggttcagatattaagtgtggttgcctactgccatctccaaggtgttgtccatcgagacttaaagcctgagaattttctctttaccaccaaggaggagaattccccattgaaagccattgattttggactctctgactatgtaaagctagatgagaggttaaatgacatcgtgggaagtgcatattatgtagctcctgaagttctacacagatcatatggaactgaggcagacatgtggagtattggtgtaattgcttatattcttctatgtggtagccgaccgttttgggcccggacagaatctggcatctttcgagctgttttgaaagcagatccaagctttgatgaagctccttggccttctttatcccctgaagcaatagattttgtgaagagactgttgaacaaggactatcggaagagactaaccgctgctcaggctctgagtcacccatggctggctaatcatcatgacttaaaaattccattggatatgatagtatacaagcttgtaaaagcttatataagctcatcttctcttcggaaatctgcattgggggctctggcgaagacattaacagttgctcagctagcttacctgcgggaacaatttacactgttggggccaagcaaaaatggcttcatttctatgcagaacttcaaaacagctgtaataaagcactctacagatgctatgaaggattccagggtccttgattatgttaatatgattagtactcttcaatacagaaaattggattttgaagaattttctgctgttgccataagtgtgcatcagctggaaggaatggattgttgggagcaacatgcaaggcgtgcctatgagttgttcgagaaggatggcaacagaccgattatgatagaggagcttgcctcggaacttggccttagcccatcagtaccagttcatgtggttctccaggactggataagacattcagatgggaaactaagcttcttggggtttgtcaggcttctccatggagtttcttcacgaacatttcagaaggcttgaaatgaatcctaccaacacgaactattttgtccactgtccttgttcaccaagaactgcaatgtcaacggcatgatcacccaaaacagtctcatgctctcttgatcatcacaaagggtgctgtaagctgaaacttcagtcaatacagcatgccctgccgatgaagccaaggcatgatgtcttgttaagtatgttttccaccttttttttcttgacctatataagtcttttttttttctctatgattggtgcacctgggattagaggattgtacagatgagggtagatcagaaaagtgtatttagggttagcagacagctttaaacttgaagtgagttgtgtttttgggtctatccttgtgtacccatcgcactaagttttctaataaatccttcatgtgatctgcatgaagttatcaaaccacagaacatcgattcagatggtttttacagcatttccaattccaagctaaaacagtaattcttcctgttgccatttcgctaccaactccgtcaaaacaaggggttcgaaatgactttcagaactgtagaatcacacattttcgtggtgtgtttcttgacttcctgtctctcaatgatgatctagacactggaacagtactgccatctgctcacgtctactttttatgatggtgcactgttgggatggcactcctcatgatgaccattgaactgccctcgtaataatgatcttcgcccactcagggagttcttaattcaactggtatctatgaagtttcgagttcaaatcctttttcttgtaaccaaaaaaaa

SEQ ID NO: 6467 - DNA, 2624 bp, Lupinus angustifolius
gaactttgaagagcaataaaagaaggtccaacttcaaagcttgagtttcccactacatcaattacttttctgggatcactcaggacagcctggaaggatccaaacccagccccactcactattattattattattagccaagaaacactataccatttaataacaagatattgatttaatgatattcgatcattatagttcgaaagagattagtagcagaattgataaccaaggaagcactagcagggagagaggggaaaagggagaattggttttgcttctgctaagcatctttgcctcacttttcttatcttttcccatcccactacttcattcctctatctctctgctttcttctcttcacttttctgcccacacatcatgttccttctgtagatcaattcttccctcatctcaaaatttgaacttgattctgggtttttgatttcatgggaatctgcaatggaaaacctattgagaccaaacaaatcactatagtagaaaacaacacagacaaagatgttcttccaagttccaacaaaaccaaatcagcctcaaagtttccattctatagcccaagccccttaccaagttggttcaagaactcaccagcaaactcaaactcaaactcaactccaacaacaatagtgttagttcaactccaacacctttgagaatcttcaagcgccctttccctcctccttccccagcaaagcacattcgggcattgctcgctcggcgccacggttctgtgaagccgaatgaggcatcaatccctgagggaagtgagtgtgaggttgttgggttggataagagttttggattcttaaagcaatttgtagtgaattatgagcttagtgaagaagttgggcgtggtcactttggttatacttgttctgcaatagggaagaagggtaccttgaagggacttgatgttgctgtcaaaatcattccaaaatcaaagttgacaacagcaattgctatagaggatgtaaggagagaagtaaagatattgcgtgctcttacagtacataagaatttggtgcaattctatgaagcctatgaagatgatgacaatgtttttatagttatggagttatgcaaaggaggtgaacttctggataggattctttccaggggaggaaagtacccggaagaggatgccaaagttgttatcattcaaatattaagtgcggtagctttttgtcatctccagggtgttgttcaccgtgatctcaagccagagaattttctttttacttccaaggatgaaagttccacattgttgaaggtcattgattttggattgtctgactatgtaaagccagatgagagactgaatgatattgtgggtagtgcatattatgtagctccagaagttttgcatagatcttatgggacggaagcagatatgtggagcattggcgttattgcttacattctattatgcggaagtcgtccattttgggctcgaacagaatctggcatatttcgggctgtcctgaaggcagaaccaagttttgatgaagctccttggccttctttatcagctgatgcaatagattttgtaaagaggctgttgaataaggattatcgtaaaagattaactgctgctcaagctctcagtcacccatggctggtgaatcatcgcaatgatatgaagatacctttggatatgatagttcacaagcttgttaaagcttacatatgctcatcttcattacgtaaatcagcattaggggctcttgcaaagacattaacagtagctcagctagcttatctcagagatcaatttactatgttagggccaaacaaaagtgggtttatctctatgcagaactttaagacggctgtttggaggagctccaccgatgcttcaaatgattcacgggtcttagattacgtgaattcggttagttctatccaatataggcaattagattttgaggaattctgtgctgctgctataagtgtgcaccaactagagggactggagagctgggagcaacatgcaaggcgtgcgtatgagctttttgataaggatggaaatagaccgatcatgattgaagagcttgcctcggaacttgggcttagtccttcagtacctgttcatgtggtacttcaagattggataagtcacccagatgggaagcttagtttcatggggtttgtgagacttctgcatgggatttcttctcgcacatttcagaagccttcacagaaaacacacggttgatatcattttttattggaatttaaatgcatcagctaactccatcaacacataccattgaatgcaacatctcaaaacatgttaatcctactttttcccaagttttacaaacacaaaccattccccaccttgtttcttattaggttggtgggttatggagttagaggcttgtacatatgtaaaccaataatgttttcctttaatacccaaggcacctatcaattatgccaactcttttattgattaagccctcaagggatgctatttttttacttggaatgccagggtagaattctgaatgtacaacaccatgcaataccattttctcatttatggatgtacttttttgttagattacctttatttacttctcataatattactgagggtg

SEQ ID NO: 6468 - DNA, 2468 bp, Citrullus lanatus
ttgctttacttgtgggttttctcttttctcctctcatcatcatatcattggaatatttggatgataatctctctacccatttgctgatctccctgatttggctgatcaactccaaaattcttccccaattgggtttataactgtagaattcagccaatttttttgtgagtattgggaatggtataagaacattgcaactgcaggagttgtggtaaaccaggagtccaaggtgtgaagtctaatctgtgagtggttttagttttgtgttgaagtggatttcggattccatgggactgtgtcatggaaagcccactgaagaaaaccaaaaacccaattcagaaaaccccaattcagtgattcaaactgaaacccccaaaaccccaagcaatttcccattctacagtcccagccctttgcccaatctcttcaagaactcctctcccgccaactccagcctctcctccacccctctccgccttttcaagcgccccttcccgccgccttctccggccaagcacattcgggctcttctcgctcgccgccatggctccgtcaaacccaatgaggcttctatccctgaaggaagcgagtgcgatgtagccttggataagaactttggctactccaagcactttgccgctcactatgaccttggcgacgaagtgggccgcggccatttcggctacacttgctctgccagagccaaaaagggctccctcaaaggccaacaagtcgctgtcaaaatcatccccaaatcaaagatgactacagcaatagctatagaggatgtgagaagggaagtgaaaatactgcgagccctcaccggacataaaaacttggtgcagttctatgattcatatgaagatgaagataatgtctacgttgtgatggagttatgtgaaggaggcgaacttctcgataggatactttcgaggggtggcaagtactcagaggaagatgcaaaaattattatggttcagattttgagtgtggtcgcctactgtcaccttcaaggtgtggttcaccgtgacctcaagcctgagaatttcctttttacgtcgaaggatgagaattccactcttaaggctattgatttcgggctttccgattatgtaaaaccagatgagagattgaatgacattgtaggaagtgcttattatgttgctcccgaggttttacatagatcatacggaaccgaggcagacatgtggagtattggtgtaattgcttatatcctcttgtgtggaagtcgaccattttgggcccgaacagaatccggtatttttcgagctgttttaaaggcggatccgaacttcgatgaagccccatggcctagtttatctactgatgcaattgattttgtgaagagactgttgaacaaggactatcgcaagcgattgactgctgctcaggccctatgccatccatggttagctgatcatcaagatatcaagataccgttagatacaattacttacaagcttgtcagaagttatatctgctcatcttcactgcgtaaatcggcattgggtgctcttgcaaagacattaagtgctgttcaactaggttatcttcagaagcaatttacactgttagggcctaacaagaatgggttcatttccatgcaaaacttcaagacggcgttaattaagaattcaacggacgcaataaaggactcgagagttctcgattatgccaacgtggttagttccattcagtacagaaaattagattttgaagaattctgtgcggctgccataagtatatatcaacttgagggaatggaaaactgggatcaacatgcccgacatgcttacgatcttttcgacaaggatggaaaccgaccaataatgattgaggaacttgcctcggaactcggacttagtccctcggtaccggttcatgtggttctccaagactggatcagacactcggatgggaaacttagcttcctgggatttgttagacttctacatggtgtctcttctcgtgcatttcaaaaggcataaaacaaacccagataaacaaacccaaaaaattttctcttgtcaaatttcctcgaccaaaatcattgaaggaattcaatatcatcattctgaactcggtcctgccgtagtgaagaactgtaataatatgatcctgctcagaaggaacagggctgcagaagttgttgcctatgaagcttgttggtgcatgttgtgatgtgggtgtaatttgttgtagttgtgtaagttgtttctcttacgttttgtcagtgattggtggggttgaaatttagaggattgtacagtggaagaatagaggaagataatgtacccagctttagccaactacttaaaactcaagagttaagaagaatggccattcatggccctttggcttttactgctttagtacctttttttttttttttttttttttttttttttttttttttttttttcatcatgtagaaaggttaaactccc

SEQ ID NO: 6469 - DNA, 2385 bp, Vinca minor
actatgtgtgattccaagttctcctcctatttcttcaatcccatttcttcaccttacttaattcattgattcttgcttgcttgcctttgtctatctggcatttcttgatcattttttcaagaaagttctattactttttcttcctttcaatttggacaattgtcaaggaatttcatttccttgacaaaattgtttgttgatcctttatgggttttgctgatcaagcttggaaatcctgttttcttgaggttttcagtccaaagattggaactttgtgaagaaatcttgaaatccttatttctccaatttctgttgaatcatggtctaacttgctgtttagtctgttaatttttccataacttcagaaattttacctcatattgggatttttataaaaatttgagtttttgattctccatggggctttgtcatggaaaaccaattgaacccccacaaaatctatcagaaaataccacaattccaactgataatgaaccagcattgagtagcagtactactcatactggtagaaaaacaccaaaatttcccttttatagcccaagtccattagtaccaagtgctttcaagaattcaccagctaattctagtgtgagttcaacacctttaaggttgtttaaacgccccttccctccgccttcgccggctaagcatattcgggctttgcttgctaggaggcatggctcagttaagcctaatgaggccacaattcctgaaggaagtgagtgtgacattgggttggataagaatttcggattcactaggaattttgttagttattatgagcttggtgaagaagtggggagagggcattttgggtatacttgttctggtaaggggaagaaagggagcttgaagggacaagatgtagctgttaaagttatcccaaagtccaagatgacaacagcaattgcaattgaagatatcaggcgagaagtgaaaatattacgtgctttaacagggcataagaacctggtgcaattctatgatgcttatgaggatgaagacaatgtttacgttgtgatggagttatgtaaaggaggagaactattggataggatactttcaaggggtgggaaatactcggaagaagatgcgaaggttgtcatggtgcagattttaagcgtggttgcttactgccatcttcagggtgttgttcaccgtgacttgaaacctgagaatttccttttcacttctaaggatgaaaaatctccactcaaggccattgacttcgggctctctgattacgtgaaaccagatgaaaggctgaatgatattgttggaagtgcatactatgtggcaccagaagttttacaccgatcttacggaacagaagcggacatgtggagtataggtgtgattgtctatattcttctctgtggaagcagacccttttgggctcggacagaatcgggaattttcagagctgtccttaaggccgatccaggtttcgatgaagtcccatggccttctttgtcccccgaagcagtagattttgtgaaaggattgctgaataaagattaccgaaagaggctcactgcagctcaggcactcagtcatccgtggttggctggtcatcacgacgacaaaataccattggacatgataatatacaagtttgtaagagcttatacatgttcttcctctctgagaaaagcagctttgggggctcttgccaaaactcttaccgtgccacaactagcttatctgcgggaacaatttactatccttgggccaaacaagagtggatatgtatccttacaaaactttaaatctgctgtgtcgaaatgctccactgatgcaatgaaagattcgagagttttcgagtatgttagcatggtgagttctcttcaatacagaaaaatggactttgaagaattctctgcagctgctatcagtgttcatcagctcgaaggagcgcaaagctgggaacagcatgcacgccgtgcatatgagctgtttgagaaggacgggaaccggcctattatgatcgaggaacttgcttctgagctcggactcagtccttcagtccctgttcacgtcgttctgcaggactggataagacactcagacggaaaactgagtttcttgggatttgtcagacttctacatggagtttcttcgcgtacatttcaaaaatcttgaaatttgattcgtttctacaccgcgaaattaaggatacagtagaaaattggacgcgataagtggaattaatagctgaaaatcactgcattctaaaaccttcgcgacatattattaacgtgttagtacgtatttgttaacttttgtcattttagctcttgtaactcctgaggtgtttgattgccacgaaaaaaatttggaggatttgtacagatgagggtagaa

SEQ ID NO: 6470 - DNA, 2291 bp, Euonymus alatus
tcttacttgttccgtgaattatcactctatccgtcttaacctctttagattgtacagagtttcgattttttttgaccaattactctcttttttctgcttctctgtttcaatgggactttgtcatgcaaaacccattgaacacccacaaaaccaacccaataactttacaatcagtaccgagagtgatccaccaccgaattcgcgctctaacaagtcctcaaacttccccttctacagcccaagccctcttccaagcctattcaagaactcgccggcgatatcgagcgtgatttccactcccctgcgtctgttcaaacgcccctttccgcctccatctccggccaagcacatacgtgcattgcttgcccggagacaaggctctgtcaagcccaacgaggcctcaatcccagagggaagtgagggagagatcggtttggacaagaattttgggtattctaaacagtttgtgtcacattatgagattggcgaggaggtggggcgtgggcatttcgggtatacttgctctgccagaggcaagaaaggaagcttgaaggaccagtatgtggcagtcaaagttatgccaaaatctaagatgaccacagctattgctattgaggatgtaagacgagaggtgaaaatattacgggctttgacaggacataagaacctagtacagttctatgatgcctatgaggatgatgagaacgtttatattgcaatggagttgtgcgaaggcggtgaactattggatagaatactctcgaggggtggaaaatactcagaagaagatgcaaagattgttttggttcaaatactaagtgttgttgccttctgtcatctccaaggagtggttcatcgcgacctcaagcccgagaattttctttttaccaccaaagaggagaattccactttgaaggccattgattttggactctccgactatgttaagccagatgaaaggctgaatgacattgtgggaagtgcatattatgtagctcctgaggttctgcatagatcatatgggacagaggctgacatgtggagtattggtgtaatagcttatattcttttatgtgggagccgaccattttgggctaggatggaatccggcatcttccgagctgtccttaagtcagatccaagctttgatgaagctccttggccatctttatcgcccgaggcaatagattttgtgaagaggttgttaaataaggattaccgtaaaagattaactgcatctcaggctctgagtcatccatggcttgccaatcatcatgacctaaagataccattagacatgatagtgttcaagctagtaagagcttatacatgctcatcttcgttacgaaaatcagcgctgggggctcttgcaaggactttaacggtatctcagctagcttatctccgggaacaatttacactgttagggccaaccaaaaatggtttcatttctatgcagaactttaaaatggcagtagtgaggaactccacgcacgccatgaaggattcacgggtccttgattatgtccagatggttggttccattcagtacagaaaactggatttcgaagaattttgtgcagctgccataagcgtgcatcagctggaaggaatggattgttgggagcaacatgcaactcgtgcttatgagttgtttgagaaagatggaaacagacctattatgatagaagaacttgcctcggaacttgggctgagcccctctgttccagttcatgtagttcttcaggactggataagacactcggacgggaagctcagtttcttaggttttgtaagacttcttcacggtgcttcctctcggtcatttcagaaggcttaaaatgaagcccggctaagcgcatactattaattccgcttttattataactctcccttgtgctgctgaaatagtgaaatgtcttgagaagatgaacatcattcccggtgtgatcggaaacaaaccaaccttaacctgatcttgatcgcaacaaagcggttgctacactcggttgctgcaagttcaagatatagatagccttcatgcatcatttgaagcagcaccattattagcacattttctccgtcagtctacaaagctctcgcccctcgaattttcatgttttgtgcttgtttagatgatatgtacagatgagggtagaatgagagtatattttaggggatttagaaaatagattgggactgaagtgagttgtggtttcatgggtttatctcttatgtacccatcttacctttttttgagttttaataataaattcctcttcctgtgatca

SEQ ID NO: 6471 - DNA, 2475 bp, Chenopodium quinoa
accccttttgaatttctgggttttcccttcagttttagttttttctagtacccagatttattggctaagttagagtgattaataatttgttcaataatgtttcctctttatcttctttaagagttaattgtatttttgtgggggtagatttctgcaaaaatctgggtctttttttcttgtttttctggggtttgagttagtagtgattcaatttcaatgggattatgtcatgcaaaacccattaaaatcccagaaacccagtatgaaaatggagaaattaatggagaaattcaaccccaaaatagtggaagtgggaaaaccccaaaattcccattttacagcccaagtccattgccaagtgcttttaagaactccccagcaaattctagtgtaacatcaacccctcttaggttctttaagcgcccctttccaccaccgtctccggcgaagcacattcgggctttgctagctcggagacatggttctgtgaagcctaatgaggcctcaattcctgaagggagtgagtgtgacattggattggataaaaatttcgggttttcaaaacaatttgctaatcattttgagattggtgaagaggttgggaggggccattttgggtatacttgttatggtaaagggaagaaaggtagcttgaaggggctagatgttgctgtcaaagtcattcccaaagcaaagatgactacagctattgcaatcgaagatgtcagaagagaagtcaaaatattacgagctcttactggccataagaatctggtgcagttctatgagtcttatgaagatgatgacaatgtatatgttgtgatggagctgtgtcaaggtggagaattgttggaccgcatactttcgagaggtggaaaattctctgaagaagacgcaaaggctgtcatggtccagattttgagtgttactgcctactgtcatcttcaaggggtggttcaccgagacctcaagcccgagaattttctatttacatccaaagatgagaatgcccctcttaaggctattgacttcggattgtctgactatgtaaagccagatgagagattaaatgatatcgtaggaagtgcttattatgtagctcctgaagttctccacagagcctatgggactgaggcagatatgtggagcattggggtaattgcttatattctactatgtggaagccgtcccttctggtctcgtacagaatctggaattttccgggctgtcttgaaggctgaccctagttttgatgaagccccttggccttccttatcaccagaggcaatcgactttgtcaaaagattattgaacaaggattaccgaaagcgattaactgctgctcaggcacttagtcatccatggctttctggctatcaccaggacgataagatcccccaggatatgatagtgtacaggcttgtaagagcttacatatgctcatcttctttgcggaaagcagctcttggggctcttgcaaagacgttaactgtgcctcaactagcttatatgaaggaacaatttcagatgctatctccaagcaaaaatggctacatatcaatgcaaaattttaagacagctgtattgagaaatgctacagatgctatgaaggattcccgagttattgaatatgtcaacctggttagctcaatccagtacagaaagatggattttgaagaattttgcgccgcagccataagtgtgcatcaactagaagcaatggaaacctgggagcaacatgcacgacgtgcttatgagctgtttgaaaaggatggtaacagaccaataatgattgaagaactggcctcggagcttggactcagtccatcagtacccgtgcacgtggttcttcaagattggattagacattctgatggaaagcttagttttctcgggtttgttagacttctacatggagtctcttctcgcacatttcagaaggcataactggtgtacgaacacttctacagtctgagtttcttaatactcagcgggtaaatttcctcacagcaaaccatcttttcttaagatgaaaggttcctattcatgaaagctcggctgcacattaatgttaacccttatatctgacaactaatgagcctctgaaagctcctggattatttcagtctttttcttttctttgcttccttcaaaatcatataaatgtttcgtctaggatagtgtttgctggtgctggaacttaaaaggtagagaaatgtacagatggaaatttagatttttagagtagtgaactgctggaagcgaaaatcaaggttttgttattttttaggtacatcctgtgtactctatgcatatgtttttctcagtaattaggggaaaaattgtgcctgatcacgtcagtagcaatatggactgaccgacgtataagccgaagatgatccatggcatattatgtaacgagacttgctattgtattttgcttatactgatatacataacttcatcatgaattgt

SEQ ID NO: 6472 - DNA, 1964 bp, Tabernaemontana elegans
acagcccaagtccattgcgaagtgctttcaagaattcaccagctaactctagtgtgagttcaacgcctttacggttgtttaagcgcccatttcctccgccatcaccagctaagcatatccgggctttgcttgcgaggaggcatggttcagttaagcctaatgaggccacaattcctgaaggaagtgagtgcgagattgggttggacaagaattttggattcacgaagaattttgcaagccactatgagcttggagaagaagtgggacgtggacattttggatatacttgttcagctaaggggagaaaagggagcttgaaggggcaggatgtggctgttaaagttatcccaaagtcgaagatgactacagcaattgcaattgaagatgtcagacgagaagtgaaaatattacgtgccttaactgggcataagaacctggtgcaattctatgatgcttatgaggatgaagacaatgtttatgttgtgatggagttatgcaaaggaggagaactattggataggatcctttcaaggggtggcaaatactctgaagaagatgctaaggctgtcatggtgcagattttaggtgtagttgcctactgtcatcttcagggagttgttcaccgtgacttgaaaccagagaatttccttttcacttctaaggatgaaaattctcctctcaaggccattgactttggcctctctgattacgtgaaaccagatgaaaggctgaatgatattgttggaagtgcatactatgtggccccagaagttttgcatcgatcttatggaacagaagctgacatgtggagtataggtgtgattgcctatattctgctctgtggaagcagacccttttgggcacggacagaatctggaattttccgagctgtcctaaaggcggatccaagttttgatgaagccccatggccctcattgtcttctgatgcagtagattttgtgaagagattgctgaataaggattatcgaaagaggctcaccgcagctcaggcactcagccatccatggttggctggtcatcatgatgttaagatacctttggatatgataatatacaagcttgtaagagcttacacatgttcctcttctctgagaaaagcagcgttgggggctcttgccaaaactttgacggtgcaacaactagcttatctccgggaacaatttactatcctgggcccaaacaagagtggatatgtatccatacagaacttcaaaactgctgtgtctaaatactccactgatgcaatgaaggattcgagggtttttgagtatgtcagcatggtgggttctattcaatacagaaaaatggactttgaagagttctctgcagctgctattagtgtgcatcagctcgaaggaatggaaagctgggaacagcatgcacgtcgtgcatatgagctgtttgaaaaggacgggaacagacctattatgattgaggaacttgcctctgagcttggactcagtccctcagttcccgtccatgtagttctgcaggactggataagacactctgatggaaagctgagtttcttggggtttgtgagacttctccacggagtttctacccgtacatttcaaaaagcttgaaataggccccctctaaacacatcaaactatcaaaatgcttctcctttcctcctcatgttgccaagtcttgaaagaatgccaatttaagtcgccatgaagaagcatgatgaagttccttttagctacactgctgcagataaagggatgccactagtggaattaatcgctaaatcactgcattccaaagccttggcagcatattcgcatgtcagtacgtatctgttaacttttgccattatagatcttcttcctcccctaggtttggtcgccactaaaatttgggaagggtatgtacagatgagggtagaaaaaaaaatgtatgtaaaataggaaacagctgaaagctgaaagtaagtt

SEQ ID NO: 6473 - DNA, 2778 bp, Chenopodium quinoa
cccccccccccccccctatccctctcgtgcccttgcctccctaccgtactaattttcttctctccttttcctactctatattcttccttttgtttcttttgtcttagttttagtcattttgtttgttttgtattcataaagtttactaccttttttatttcttcaattgagtagttttcacttctaattgtgctaaaaatttgtatcttggttaaaaattctcaaccctttttcctttgtatttttgtacccctttttgtaatttctgggttttcccttctaattttagtttttttttagttacccagatttattggctaagttagagtggttaataatttgctcaataatgtttcctccttatcttctttaagaactttttgtatttttgttggggttgatttctgcaaaaatctgggtcttttttcttgtttttctggggtttgaattagtggtgattcaatttcaatgggattatgtcatgcaaaacccattaaaatcccagaaacccagtatgaaaatggagaaattaatggagaaattcaaccccaaaacagtggaagtgggaaaaccccaaaattcccattttacagcccaagtccattgcctagtgcttttaagaactccccagcaaattcaagtgtaacatcaacccctcttcggttctttaagcgcccctttccaccaccgtctccggcgaagcacattcgggctttgctagcccggagacatggttctgtgaagcctaacgaggcctcaatccctgaaggaagtgagtgtgacattggattggataaaaatttcgggttttcgaaacaatttgctaatcattttgagattggggaagaggttgggaggggccattttgggtatacttgttatggtaaagggaagaaaggtagcttgaaggggctagatgttgctgtcaaagtcattcctaaagcaaagatgacaacagctattgcaatcgaagatgtcagaagagaagtcaaaatattacgagcacttactggccataagaatcttgtgcagttctatgagtcttatgaagatgatgacaatgtatatgttgtgatggagctgtgtcaaggtggagaattgttggaccgcatactttcgagaggtggaaaattctctgaagaagacgcaaaggctgtcatggtccagattttgagtgttactgcctactgtcatcttcaaggtgtagttcaccgagacctcaagcccgagaattttctatttacatccaaagatgagaatgcccctcttaaggctattgacttcggattgtctgactatgtaaagccagatgagagattaaatgatatcgtaggaagtgcttattatgtagctcctgaagttctccacagagcctatgggactgaggcagatatgtggagcattggggtaattgcttatattctactatgtggaagccgtcccttctggtctcgcacagaatctggaattttccgggccgtcttgaaggctgaccctagttttgatgaagccccttggccttctttatcaccagaggcaatcgactttgtcaaaagattattaaacaaggattatcgaaagcgattaactgctgctcaggcacttagtcatccatggctttctggctatcaccaggacgataagatcccccaggatatgatagtgtacaggcttgtaagagcttacatatgctcatcttctttgcggaaagcagctcttggggctcttgcaaagacgttaactgtgcctcaactagcttatatgaaggaacaatttcagatgctatctccaagcaaaaatggctacatatcaatgcaaaattttaaggcagctgtattgaggaatgctacagatgctatgaaggattcccgagttattgaatatgtcaacctggttagctcaatccagtacagaaagatggattttgaagaattttgcgccgcagccataagtgtgcatcaactagaagcaatggaaacctgggagcaacatgcacggcgtgcttatgagctgtttgagaaggatggtaacagaccaataatgattgaagaactggcctcggagcttggacttggtccatcagtacccgtgcacgtggttcttcaagattggattagacattctgatggaaagcttagttttctcgggtttgttagacttctacatggagtctcttctcgcacatttcagaaggcataactggtgtaagaaaacttctatggtctgagtttcttaatactcagcgggtaaatttcctcacagcaaaccatcttttcttcagatgaaaggttcctattcatggaagctcagctgcacattaatgttaacccttatatctgacaactaatgagcctccgaaagctcctgcattatttcagtctttttcttttcttttctttgcttccttcaaaatcatataaatgtttcgtcttaggatagtgtttgctggtgctggaacgtaaaaggtagagaaatgtacagatggaaatttagatttttagagtagtgaactgctggaagcgaaaatcaaggttttgttattttttaggtacatcctgtgtactctatgcatatgtttttctcaataattaggggaaaaaattgtgcctgatcaagtcagtagcaatatggactgaccaacgtataagccgaagatgatccatggcatattatgtaatgagacttgctattgtattttgcttatactgatatacataacttcatcatgaattgtcctcatttatttagtcgtcgcctcaacagtgaacaacatcaagc

SEQ ID NO: 6474 - DNA, 1759 bp, Cucumis sativus
tcaactggatttcggattccatggggctctgtcatggaaagcccattgaacaaaacccaaaacccaattcagaaaaccccaattcagtgattcaatctgaaacccccaaaacgccaaccaatttcccattctatagcccaagtcctctgcccaatctcttcaagagctcctctccggccaactccagcatcacctccacccctctccgccttttcaagcgccccttcccgccaccatctccggccaagcacattcgggctcttctcgctcgccgtcatggctccgtcaaacccaatgaggcatctatccccgaaggaagcgagtgcgatgtagccttggataagaacttcggctattccaagcactttgccgctcactatgaccttggtgacgaagtgggtcgcggccatttcggctatacttgctctgccagagctaaaaaaggctccttcaaaggccaacaagtcgctgtcaaaatcatccctaaatccaagatgactactgcaatagcgatagaggatgtgagaagggaagtgaaaatactgcgggccctcactggacataaaaacttggtgcagttctatgattcatatgaagatgaagaaaatatttacgttgtgatggagttatgcgaaggaggtgaacttcttgataggatactttcgaggggtggcaagtactcagaggaagatgcaaaagttatcatggttcagattttgagtgtggtcgcttactgtcaccttcaaggtgtggttcatcgtgacctcaagcctgagaattttctttttacatcaaaagatgagacttccactcttaaagctattgatttcggcctttctgattatgtaaaaccagatgagagattgaatgacattgttggaagtgcttattatgttgctcctgaagttttacatagatcatatggaaccgaggcagacatgtggagtattggtgtaattgcttatattctcttgtgtggaagtcgaccattttgggcccgaacagaatctggtatttttcgagctgttttaaaggcagatccaaactttgaggaagccccatggcctagtttatctattgatgcaattgattttgtgaagagactgttgaacaaagactatcgcaagagattgactgctgctcaggccctgtgccatccgtggttagctgatcaccaagatatcaagataccattggatacgattactttcaagcttgtcagaagttatatttgctcatcttcactgcgtaaatcagcgttgggtgctcttgcaaagacattaagtgctgttcaactaggttatcttcagaagcaatttacactgttggggcctaacaagaatgggctcatttccatgcaaaacttcaagacggctttaattaagaactcaacagaagcaataaaggattcgagagttcttgattatgccaacgtggttagttccattcagtacagaaaattagattttgaagaattctgtgcggctgccataagtatataccaactagagggaatggagagctgggagcaacatgcccggcatgcttatgatcattttgacaaggacggaaaccgaccaataatgatcgaggaacttgcttcagaacttggacttagtccttcggtaccggtccatgtggttctccaagactggatcagacactcagatgggaagcttagcttcctgggatttgtcagacttctacatggtgtctcttctcgcgcatttcagaaggcataaagaaaaacccagataaa

SEQ ID NO: 6475 - DNA, 2592 bp, Eutrema parvulum
tcattggagtgaaatctcgcttctttcgtttcttcttcttcttcccatattcatcttctctttcactcttcacgattcggttttgatttatcttcttctatttcattcatctcgcaactctctctcgattctggaaagtcgaattgcttttccttttccttttctgatttctgggattacgtttctccactcttttcccggggaaaatttcgtatctttcccgggaagttctccccttttcgttatttctatctctgggtttcttcacacagcgtttgttttccgtttctctgctcagtattcaaatttgattcaataaaatcttcgacatttcgttgttgttgttgttgttgtgtgaaagcatcgtcttttctatcttctgcttaccgttatcatcgaactgctctcaaactttgagcttcattgatggggctctgtcatggaaaacctatcgaacagcaatcgaagaagagcttcccaatctccaacgaaaccgatgaggaggcacctaagagttctttgcaggcagcgaaatcatcagggtttccgttttatagccctagtacattacctagcctcttcaaaacctcacctgccgtatcctcctcgagcgtgagctccacgccacttcgcatcttcaagcgacctttcccacctccatcacccgccaagcacatacgcgctctcctcgcgcgtcgtcacggctccatcaaacccaacgaagcctcgatcccagaaggcagcgagtgcgaggttggcctcgacaagaaattcggattctcaaagcagtttgcttcacactacgagattgacggtgaggtgggtcgaggtcattttgggtatacttgctctgctaaggggaaaaaaggtagcttgaaaggtcaagatgtggctgtcaaagttattcccaaatcgaagatgactacggcaattgcaattgaagatgttagaagagaagtgaagatattgcgggctttgactggtcacaagaacctggtccagttctatgatgcctttgaagatgatgaaaatgtttacattgtcatggagttatgcaaaggaggcgaactcttggacaaaatacttcaaaggggaggtaaatactcagaagaagatgctaaaaacgtaatggttcagattcttagtgtagtagcgtactgccatcttcaaggcgtggttcaccgtgacctcaaacccgagaattttctcttcactacaaaggacgagacttctcctctgaaagccatagatttcggcctctccgactatgtcagaccagatgagaggttgaatgacattgtaggaagtgcttactatgtggccccggaagttttacaccgtacatatggaactgaggcagatatgtggagtattggagtgattgcttatatacttctctgtggtagccgacccttttgggctcgttctgaatctggaatcttccgagctgttcttaaagcagaacccagtttcgaagaagctccttggccatctctttcacctgaagctgtagattttgtgaaacgtttgctaaacaaagattaccgtaagagactgactgctgcacaggctttgtgccatccgtggctggctggttcacatgaattaaagataccatctgatatgatcatttacaagctcgtaaaagtatacataatgtcctcttctttgaggaaatccgctttatcggctcttgccaaaacattaacagtaccgcagctgagttatctgcgggagcaatttaatctgttgggaccaagtaaaaacggatatatctcgatgcagaactacaaaacagcgatcatgaagagctcgacagaggctacaaaggattcaagagtcttggattttgtacacatgattagttgtctccagtacaagaaattagactttgaagagttttgtgcttcggctttaagtgtttatcagctagaagcaatggaaacttgggaacaacacgcacgccgtgcatatgagttgtttgagaaggatggaaacagagtcatcatgatcgaggaacttgcgtcggaactcggtctgggtccatcagtcccagttcaagttgttcttcaggattggataagacattctgatggcaagcttagtttcttgggttttgtcagactcttacacggtgtgtcctctcggacattgcagaaagcgtagagaagcttcttacctccactcacacatctacttctccttggatctgaaagggcctgcctttaggacaggaaccttacacctagtctaaagattatgaccttagagggaacccgagaggaactcgtgatcaaatcgactgttgcagagctaccacatttgtcagatgaagttgcagcctaggatatgtagctctggttcgatctaggttctttttactctgtttcatggtcgtctttttttctcttttttgtttcggtaaagatcgagtctgtatgatttaaaagtggtgttaatgagatctaaggggattgtacagaagaagaaacatattcaattctccattaaaatggtctctttctccttgttcctttgtaatacgaaaacacacctcattaactcaattcttaacagaagtatcaatctact

SEQ ID NO: 6476 - DNA, 2461 bp, Eutrema halophilum
gttgctactgcgaaagcatcttcgtcttcctttttttttcattctcaacactttgcttttgcttcgtgaagtgtctttaattaactttccttctaattggaataaaactcgcttctttccttcttcttcttcttcttcttcttcttcttcttcttcttcttcttcttcttcttcctcctctttgcgtgtgggtttatcttcaatcttcatctaatctcctgatctcggcttaattctctcccaattcccatgtgaaatcgaatttgcttacctctctctgatttctaggttttgattgagcctcgattcttcttcctagaattacttattctcactatttttcccgggaaaattataccacatgatattgctcttcgttcgttactaactgattcctctgagtgaatccatattcttcagtcttcttcaccaagttttaagctttcgttttaaatcctcaattcataactcatggggatttgtcatggaaaacccatcgaacagcaatcgaggaatagcctcccagtttccggcgaagtcgatgaaactccgacggattcgcagccggcgaaatcctccggctttccgttttacagcccgagccctttacctagcctattcaaatcctcaccggccatatcctcgagcgtgagctcaacgcctcttcgcatcttcaagagacctttcccgcctccatctcccgcaaagcacatacgcgctttcctcgcgcgtcgcagcggctcaacgaagcccaacgaggcctcgattcctgaaggtaaagaattcgagatcggtctcgataagagttttgggttctcgaaacatttcgcttcacactacgagattgatggcgaggtgggtcgtggtcattttggatatacttgctctgcaaaaggtaaaaaaggcagcttgaaaggtcaagaagttgctgttaaagtcattcccaaatccaagatgacaactgcaattgcaattgaggatgttagtagagaagtgaagatattgcgggctttgactggtcacaaaaacttagtccagttctatgacgcgtttgaagatgatgaaaatgtttatattgtgatggagttatgcaaaggtggtgaactcttggacaaaatacttcaaaggggtggcaaatactcagaagatgatgctaaaaaagttatggttcagattcttagtgtagtagcttactgtcatctacaaggtgtggttcaccgtgaccttaaacccgagaactttctgttcagtactaaggacgagtcgtctcctctaaaagcaattgactttggtctctctgattatgtcaagccagacgagaggttgaatgatattgtaggaagtgcatattacgtggccccggaagttttacaccgtacatacggaacagaagcagacatgtggagtattggagtgattgcttatattcttctttgtggcagtagacccttttgggcccgtactgaatccggaatctttcgagctgtccttaaggcagagcccaattttgaagaagctccttggccatccctttcacctgatgctgtagattttgtgaaaagattgctaaacaaagattaccgtaaaagactaactgcggcccaggctttgtgtcatccgtggctagttggctcgcatgaactaaagataccatctgatatgatcatatacaagcttgtaaaagtgtacataatgtctacttcactgagaaaatcagctttagcggctcttgctaagacattgactgtaccacagttagcttatctgcgggagcaatttacattgttggggccaagcaaaaatggatatatttcgatgcagaactacaaaacagcaatcttaaagagctcaacagatgctacgaaggattcacgagtcttagattttgttcacatgataagttgtcttcaatacaagaaactagactttgaagagttctgtgcatcagccttaagtgtttatcagctcgaagcaatggaaacatgggagcaacacgcacgtcgtgcttacgagttgtttgagaaagacgggaatagacctatcatgattgaggaacttgcatcggaacttggactagggccatcagtccctgtgcacgttgttctccaggattggataagacattcggatgggaagcttagtttcttgggttttgtcagactactacacggcgtgtcttctcggacattacagaaagcttgagagcaatgacattgttagataagaaagatgcagctagctgtagatcatggtttcttctttttaccatttctttatagcttttttttttttttcctattcaatcatgggtaaaggttttgagtcaaagattcgataattatgtcagtgtgtgtatttctgtgtggtggggaaggaatgggtttcagatgaagaggaatgtacagaatgagacatatactatattccaatatctctgtaactttggtttttcttaagtcgg

SEQ ID NO: 6477 - DNA, 2178 bp, Manihot esculenta
tttcttgggtttctgtcccaatgggactctgccatggaaaacccattgagaatcaaaaccacgaatccaacaaccatacactctccattgaaacagattcccaaccaacaaattcccacaccagcaaatcttctaaccctttttacagtccaagtcccttgccaagccttttcaagtactcacctgcaatatcaagtgtgagttccactcctttgcggattttcaagaggccgtttccacctccttctcctgcaaagcacattcgtgcattgcttgcaagaagacatggctctgttaagcctaatgaggcaactatccctgagggtaatgagagtgagatcgctctggacaagaattatggcttctccaagcagtttgtgagccattatgaccttggtgaggaggtggggcgtggtcattttgggtatacttgctctgccaaggccaagaaaggcaacatgaaaggccaggatgtggcggtcaaagttattcccaagtctaagatgaccactgcaattgctattgaggatgtaagacgagaagtacaaatattacgagcgctatctggacataagaacctggtacagttctatgatgcctatgaagacgacgagaatgtctatgttgtgatggagttgtgcaatggtggtgaactattggataggattctttcaaggggtggaaaatactcagaagacgacgcaaagactgttatggttcagatattaaatgtagttgcctactgtcatctccaaggtgtggttcaccgtgatctgaagccagagaattttttgttcgctaccaaggaggagaattctccattgaaggccattgattttgggctgtctgactatgtaaagccagatgaaaggttgaatgacattgtaggaagtgcatattatgtagctcctgaagttctacatcgatcatatgggactgaagctgacatgtggagtattggtgtaattgcttatattcttctatgtggcagccggcccttttgggcacggacagaatctggcatctttcgagctgtccttaaagcagatccaatttttgatgatgctccttggacttctttatcccctgaagcaatagattttgtgaagaggttgttgaacaaggactatcgtaagagactgactgctgctcaggccctaagtcatccttggttagccaatcatcatgagataaagatcccattggatatgattgtatacaagcttgtaaaggtttatatctgctcatcttctctgaggaaatctgcactgggggctctggcgaagacattgactgtagctcagctagcataccttcgggaacaatttacactgttggggccaagcaaaaatggattcatatctatgtcaaactttaagttggctgtaataaagaattccacagatgcagtgaaggattcaagggtccttgattatgttagcatggttagttctcttcaatacagaaaattggattttgaagaattctgtgctgctgccattagtgttcatcaactagaagccatggattgttgggagcaacatgcaaggcgtgcctatgagttttttgagaaggatggcaatagacctattatgatagaggaacttgcttcagagcttggtcttggcccatcagtaccagttcatgtggttctgcaagactggataagacatgcagatggcaagctaagtttcttggggtttgtcaggcttcttcatggggtttcttcgcgcacatttcagaaggcttaaaaatacagaatattttcagtcttttttttttcccactgatttcgctctcatcgacccgaaacaattcaaggggaaccaatggcatgcccagttttactcaaaacaggcaagtgttctgttgatcaatatgaagagtgctgcaagttaaaaatttagcaggtgtgcatgcctatgctatgttaaatggaaccatcttgacatgatttcatgtcaaatatgttgttcctccctgttcttacctatatgaatggtgccactggaattataggattgtacagatgaggtagatcaaaatatgtatttaggtttaacaaacagcttttaactgaagtggattttttctttctctttttcatctttctttctctttcatgatcttatcaaacaattccatctctgtgtatttataataagtagtttctataat

SEQ ID NO: 6478 - DNA, 1759 bp, Eutrema halophilum
gatggggctctgccatggaaaacctatcgaacatcaatcgaagaagagcctcccaatctcttccaacgacaccgatgaggaagcacctaagccatcgaaatcatcagggtttccgttttacagccctagcccattacctagcctcttcaaaacctcacctgccgtatcctcatcgagcgtgagctccacgccacttcgtatcttcaagcgacctttcccacctccatcacctgcaaagcatatacgcgctctcctcgcgcgtcgtcacggttccatcaagcccaacgaagcatccatccctgaaggcagcgagtgcgatgttggcctcgacaagaaatttggattctccaagcagttcgcttcacactacgagattgatggtgaggtgggtcgaggtcattttgggtatacttgctctgctaaggggaaaaaaggtagcttgaaaggtcaagatgttgctgtcaaagttattcccaaatccaagatgactacggcaattgcaattgaggatgttagaagagaggtgaagatattgcgagctttgactggtcacaagaacctaatcgagttctatgacgcctttgaagatgatgaaaatgtttacattgtcatggagttatgcaaaggtggtgaactcttggataaaatacttcaaaggggaggcaaatactcagaagaagatgctaaaaaagtaatggttcagattcttagtgtagttgcatactgtcatcttcaaggcgtggttcatcgcgatctcaaacccgagaattttctattcaccacaaaggatgagacttctcctctaaaagccattgattttggtctctccgactatgtcagaccagatgagaggttgaatgacattgtaggaagtgcttattacgtggctccggaagttttacaccgtacatatggaactgaggcagacatgtggagtattggagtaattgcttatatacttctctgtggtagccgacccttttgggcccggtctgaatctggaatcttccgagctgttcttaaagcagaacccaatttcgaagaagctccttggccatctctttcacctgacgctgtagattttgttaaacgtttgctgaacaaagattaccgtaagagactaactgctgcacaggccttgtgccatccgtggctggctggctcacatgaattaaagataccatctgatatgatcacttacaggctcgtaaaagcatacataatgtcgtcttctttgaggaaatcagctttatcggctcttgccaaaacattaactgtaccacaactcgcttacttgcgggagcaatttaatttgttggggccgagcaaaaatggatatatctcgatgcagaattacaaaacagcaatcctgaagagctcgacagaggctacaaaggattcaagagtcttggattttgtacacatgattagctgtcttcagtacaagaaactagactttgaagagttttgcgcttcggctttaagtgtttatcagctagaagcaatggaaacttgggagcaacacgcacgccgtgcatatgagttgtttgagaaagatggaaacagagtcatcatgattgaggaacttgcatcggaactcggactcggtccgtcagtccctgttcaggttgttcttcaggattggataagacattctgatggcaagcttagtttcttgggttttgtcagactcttacacggcgtgtcctctcggacattgcagaaagcgtagaggagcttctctccttaactcacacat

SEQ ID NO: 6479 - DNA, 1837 bp, Arabidopsis thaliana
atggggctgtgtcatgggaaacctatcgaacaacaatcgaagaatctcccaatctccaatgaaatcgaagagacacctaagaattcatctcagaaggcgaaatcttcaggctttccgttttatagtccaagccctttacctagtctcttcaaaacctcacctgctgtgtcatcctccagcgtgagctccacgccacttcgtatctttaagcgacctttcccacctccatcaccagctaagcatatacgagctctcctcgcgcgtcgtcacggttctgttaagcccaatgaagcttcgatccctgaaggtagtgaatgtgaggttggcttggacaagaaatttggtttctctaagcagtttgcttcacactacgagattgacggtgaggtgggtcgagggcattttggttatacttgctctgctaaggggaaaaaaggtagcttgaaaggtcaagatgtggctgtcaaagttattcccaaatccaagatgactacggcaattgcaattgaggatgttagaagagaagtgaagatattgcgggctttaactggtcacaagaacctagtccagttctatgacgccttcgaagatgatgaaaatgtttacattgtcatggagttatgccaaggcggtgaactcttggacaaaatacttcaaaggggaggcaaatactcagaagtagatgctaaaaaagtaatgattcagattcttagtgtagtagcctactgtcatcttcaaggcgtggttcaccgtgacctcaaacctgagaattttctcttcaccacaaaggatgagtcttcccctttgaaagccattgattttggtctctccgactatgtcaggccagatgagaggttgaatgacattgtaggaagtgcttattacgtggcccctgaagttttacaccgtacatatggaactgaggcagatatgtggagtattggagtgattgcttatatactactctgtggtagccggcccttttgggcccgttctgaatctggaatctttagagctgttcttaaagcagaacccaatttcgaagaagctccttggccatctctttcacctgacgctgtagattttgtgaaacgtttgttaaataaagattaccgtaagagactaactgctgcacaggctttatgccatccgtggctggttggctcacatgaattaaagataccatctgatatgatcatttacaagctcgtaaaagtatacataatgtcgtcttctttgagaaaatcggctttagcggctcttgccaaaactttaacagtaccgcagctgacttatttgcaagagcagtttaatctgttaggaccaagcaaaaacggatatatctcgatgcagaattataaaacagcaatcttgaagagctccacagaagctacaaaggattcacgagtcttggattttgtacacatgattagttgtcttcagtataagaaactagactttgaagagttttgcgcttcagctttaagtgtatatcagctagaagcaatggagacttgggagcaacatgcacgccgtgcatatgagttgtatgagaaggatgggaacagagtcatcatgatcgaagaacttgccacggaactcggactaggtccatcggtgcctgttcatgttgttcttcaagattggataagacattctgatgggaagctaagtttcttgggttttgtcagactcttacacggcgtctcctctcgtacattgcagaaagcgtagaagagaattagattaaagatttgaaaaaagaaacaaaagagagcaaaatttgtgaacataattgttttgaaaaagatttgaacaagttattttacaaactaag

SEQ ID NO: 6480 - DNA, 1959 bp, Arabidopsis thaliana
gagaaatttcgtttctttcccgggaagtttgtccatagtggaaattgaatctaaattcgacattgtgttgttgtgtgaaaccataaagttctctctttacgctcaatttgatctccattgatggggctgtgtcatgggaaacctatcgaacaacaatcgaagaatctcccaatctccaatgaaatcgaagagacacctaagaattcatctcagaaggcgaaatcttcaggctttccgttttatagtccaagccctttacctagtctcttcaaaacctcacctgctgtgtcatcctccagcgtgagctccacgccacttcgtatctttaagcgacctttcccacctccatcaccagctaagcatatacgagctctcctcgcgcgtcgtcacggttctgttaagcccaatgaagcttcgatccctgaaggtagtgaatgtgaggttggcttggacaagaaatttggtttctctaagcagtttgcttcacactacgagattgacggtgaggtgggtcgagggcattttggttatacttgctctgctaaggggaaaaaaggtagcttgaaaggtcaagatgtggctgtcaaagttattcccaaatccaagatgactacggcaattgcaattgaggatgttagaagagaagtgaagatattgcgggctttaactggtcacaagaacctagtccagttctatgacgccttcgaagatgatgaaaatgtttacattgtcatggagttatgccaaggcggtgaactcttggacaaaatacttcaaaggggaggcaaatactcagaagtagatgctaaaaaagtaatgattcagattcttagtgtagtagcctactgtcatcttcaaggcgtggttcaccgtgacctcaaacctgagaattttctcttcaccacaaaggatgagtcttcccctttgaaagccattgattttggtctctccgactatgtcaggccagatgagaggttgaatgacattgtaggaagtgcttattacgtggcccctgaagttttacaccgtacatatggaactgaggcagatatgtggagtattggagtgattgcttatatactactctgtggtagccggcccttttgggcccgttctgaatctggaatctttagagctgttcttaaagcagaacccaatttcgaagaagctccttggccatctctttcacctgacgctgtagattttgtgaaacgtttgttaaataaagattaccgtaagagactaactgctgcacaggctttatgccatccgtggctggttggctcacatgaattaaagataccatctgatatgatcatttacaagctcgtaaaagtatacataatgtcgtcttctttgagaaaatcggctttagcggctcttgccaaaactttaacagtaccgcagctgacttatttgcaagagcagtttaatctgttaggaccaagcaaaaacggatatatctcgatgcagaattataaaacagcaatcttgaagagctccacagaagctacaaaggattcacgagtcttggattttgtacacatgattagttgtcttcagtataagaaactagactttgaagagttttgcgcttcagctttaagtgtatatcagctagaagcaatggagacttgggagcaacatgcacgccgtgcatatgagttgtatgagaaggatgggaacagagtcatcatgatcgaagaacttgccacggaactcggactaggtccatcggtgcctgttcatgttgttcttcaagattggataagacattctgatgggaagctaagtttcttgggttttgtcagactcttacacggcgtctcctctcgtacattgcagaaagcgtagaagagaattagattaaagatttgaaaaaagaaacaaaagagagcaaaatttgtgaacataattgttttgaaaaagatttgaacaagttattttacaaactaagaa

SEQ ID NO: 6481 - DNA, 2585 bp, Eutrema halophilum
gtcattggaagtgaaatttcgcttctttcctttcttcttcttcccatatctctatcttctctctcactctcttcgtttttcggattttgtctattcccttgattcgcattctctctcgatttcggaaagtcgaattgctttcccttttctaatttctgggttttgtttctctactctcttcccggagaaaatttcgtttctttcccgggaagttcttcccttttcgtgtttttattaacttgtgggtttcttctcacgttgttttgtttttcgtttcactgctcagtaatcaaactgattcaatctccgacattttgttgttgtgttaaaagctcgagtttttctttcttttgcttcccttataatcgaattactctcaatttgatctccacagatggggctctgccatggaaaacctatcgaacatcaatcgaagaagagcctcccaatctcttccaacgacaccgatgaggaagcacctaagccatcgaaatcatcagggtttccgttttacagccctagcccattacctagcctcttcaaaacctcacctgccgtatcctcatcgagcgtgagctccacgccacttcgtatcttcaagcgacctttcccacctccatcacctgcaaagcatatacgcgctctcctcgcgcgtcgtcacggttccatcaagcccaacgaagcatccatccctgaaggcagcgagtgcgatgttggcctcgacaagaaatttggattctccaagcagttcgcttcacactacgagattgatggtgaggtgggtcgaggtcattttgggtatacttgctctgctaaggggaaaaaaggtagcttgaaaggtcaagatgttgctgtcaaagttattcccaaatccaagatgactacggcaattgcaattgaggatgttagaagagaggtgaagatattgcgagctttgactggtcacaagaacctaatcgagttctatgacgcctttgaagatgatgaaaatgtttacattgtcatggagttatgcaaaggtggtgaactcttggataaaatacttcaaaggggaggcaaatactcagaagaagatgctaaaaaagtaatggttcagattcttagtgtagttgcatactgtcatcttcaaggcgtggttcatcgcgatctcaaacccgagaattttctattcaccacaaaggatgagacttctcctctaaaagccattgattttggtctctccgactatgtcagaccagatgagaggttgaatgacattgtaggaagtgcttattacgtggctccggaagttttacaccgtacatatggaactgaggcagacatgtggagtattggagtaattgcttatatacttctctgtggtagccgacccttttgggcccggtctgaatctggaatcttccgagctgttcttaaagcagaacccaatttcgaagaagctccttggccatctctttcacctgacgctgtagattttgttaaacgtttgctgaacaaagattaccgtaagagactaactgctgcacaggccttgtgccatccgtggctggctggctcacatgaattaaagataccatctgatatgatcacttacaggctcgtaaaagcatacataatgtcgtcttctttgaggaaatcagctttatcggctcttgccaaaacattaactgtaccacaactcgcttacttgcgggagcaatttaatttgttggggccgagcaaaaatggatatatctcgatgcagaattacaaaacagcaatcctgaagagctcgacagaggctacaaaggattcaagagtcttggattttgtacacatgattagctgtcttcagtacaagaaactagactttgaagagttttgcgcttcggctttaagtgtttatcagctagaagcaatggaaacttgggagcaacacgcacgccgtgcatatgagttgtttgagaaagatggaaacagagtcatcatgattgaggaacttgcatcggaactcggactcggtccgtcagtccctgttcaggttgttcttcaggattggataagacattctgatggcaagcttagtttcttgggttttgtcagactcttacacggcgtgtcctctcggacattgcagaaagcgtagaggagcttctctccttaactcacacatctacttctccttggatcttaaagggcctgcctttaggacaggaaccttacaccaagtctaaagattatgaccttaaggtaacctgaaaggaactcgtaataaaataggctgttgcagagagctaccacactgtcagatgaagttgcagcctagggatagctctggttcgatctgggtttcgttttgttacgtttcttgctagtcctttttttgtctgtttggtaaagattgagtctttaagatttaagaatggtgttgtacagaagaagaaatacccgaatctccattaaagatggtccctttctacgtccttgttccaatgttgtccatctatggctttaggctaaggggctttctttctcttttgtaataagaacacatctcagtaatcaccttaacaaaggtttatgatgaacaaaaatcttggtttacc

SEQ ID NO: 6482 - DNA, 2544 bp, Mimulus guttatus
gagagaggagtgaaaaagcaggggaaagaaagaaaggaggtttctgctgatcaatctttgaaaggattgtgccaaagattgagtttttacagcaattttgggggaaaaaaaactgttcttgattctaatctatttgttgttccaaaagattaagtttttaaagcaatttgggggaaaaaactgttcttgattataatctatttcttgctccaacttcccttcaaatggtttgaagctcctccattttcttgaattcacaagctgtttaattttccaacttttttgctgtattacatactttcttgattccatgggactttgtcatggaaaacccaacgaacccccgaaaaacctgtccgaaaacccaataatcccagctgaaagcaatgatccaacactgaacaatccctcaactgggaaaacacccaaattcccattttacagcccaagtccactccacagtgcattcaagaattccccggctaattcgagcagtgccctttcgacccctctccgtttctttaagcgtccatttccgcccccatcgccagctaagcacattaaggccttgcttgcaaggaggcatggctccgttaagccgaacgaggctactatacccgaagggagtgagtgtgagattattgggttggataaaaatttcgggttttcgaagaatttcgttagccactatgaacttggggaagaagtgggtagagggcactttgggtacacttgttatgctaaaggaaagaagggaagcatgaaagggcaagatgtggctgttaaagttattcctaaatcaaagatgactacagcaattgccatagaagatgtgagaagagaagtaaagattctacaagcgctgactggacataagaacttagttcaattctacgatgcctatgaagatgaagacaatgtctacgcagtgatggagttatgcaaaggaggagaactacttgatcgtatactttcgaggggtggaaaatactcggaagaggatgcgaaaatcattatggtgcagattttgagtgttgtggcatattgccatcttcaaggtgtcgttcaccgagacctaaaacccgagaattttctctttgttacgaaagacgagcattcctctttgaaggcaatcgactttggactctctgattacgtaaagccagatgaaaggctgaacgatattgttggtagtgcgtattatgtggcgcccgaagttttgcatagatcgtacggcacagaggctgacatgtggagcattggtgtgattgcttatattcttctttgtggaagtagaccgttctggtcaagaacagaatccggaatcttccgggctgtaataaaggctgaccctaatttcgaggaagccccatggcccacactttctctcgaagccatagattttgtgaaacagttattaaacaaggactatcgtaaaaggctaactgcagctcaggctctctgtcatccatggctgactggacaccacgaagagaaaattccaatggatatgataacgtataagtttgtgaaagcttatatatgttcgacttctttgaggaaaacagctttaggggctcttgcacgaacattgacagtaccgcagttagcctatctccgagatcagtttgcaatgttaggaccaaataagagtggttttgtatccctacaaaacttcaaaactgctatggcgaagatttcgactgatgcaatgaaagaatcacgtgttgtggattatgtcaatgtggtgagttctcttcagtacagaaaattggatttcgaagaatactgcgctgcagcgataagcgtgcatcagctagaaggatcggaaggctgggagcaacacgcacgcaacgcttacgaactttttgaaaagaacggaaatcggcccattatgatcgaagaacttgcctctgagctcggacttagtccatctgtaccagtgcacgtagttctgcaggattggataagacactcagacgggaaactaagcttcttgggctttgtaagacttctgcatggagtgtccgcacgaacatttcagaaggcgtgaaactgaattctctattcttttgggacataattgcccctgaaaatcaacagtatttttgccccgattaaaagggccgtttggaagaaagaagcatgggattattattgcatgttaaatttttgcacagaaggtcgatggaagttgtagctgtagccatttgcagcaaaactcggttcagaatatgtttcgttttcgtgtaattttttttttcctttcggtgagagttgtacagatgagtgtagatgggaaaaaaagagtgtattttagagcaagaagactgatgcaagctctagtggggttgtgtgtggtgacttttaaaataaaatcgtatattcttttacgctttgccgaacggtttttatctcaaccttcatttaaatcgaatcggtaagttttaatttaaaaacttgcgtgctcgaagttaattgccaaaagtacgaacttaaggctacgtacgtagctgctacacgatataaattacaattggattt

SEQ ID NO: 6483 - DNA, 2612 bp, Aquilegia formosa
cactctgcagtagacctttgtgaatgaagcatcttctttctttctttctttcttaccttgggttttagttttattctctacacaatttgatttccattatctcttcctctgtttcaattgattctatcttgggttttcttatttgactttttattcattagtaaagttgctaattttttcctttttacttccttttatggtttttaagagtagaattggcataaatttgggttttcgctttgtgggtattcttccttttggtttctcttgttgaaaaattgaaactttgatcttgggtcgtttttaagttctgagttttagtttgtttggttttcaagttttgagcttttttttttttgttgattttggtttggttttcgattcaatgggaatttgtcatggaaaacaaactgaagctcctgagattcaatcagaaaaccctataattcccaatgatgttgatgtttcgacgaacacagataccaaaaaagcttcaagtttccccttttatagccctagtccactaagaaatgtattcaaaaattctcctgctaattcaagtgtgagttcaacccctcttcggatcttcaaacgaccttttccccctccatcaccagcaaagcatatcaaagcattgctcgctcgcagacacggttctgtgaagcccaatgaagcttcaattccagaaggaagtgaggttgaagttggtttagataagaattttgggtatttgaagcaattctacaccaagtatgagcttggagaagaagtggggcgtggacattttgggtatacttgttctgcagtggcaaagaaaggggatttgaagggacaagaagtggccatcaaagttattccaaaatcaaagatgaccactgccattgcaattgaggatgtacgaagagaagtgaagatattacgtgctttaacgggacataagaatttagtacagttctatgatgcctacgaagatgaggacaatgtgtatgtagtgatggaattatgcaaaggaggtgaactgttggataggatacttgcaaggggaggaaaatactcagaggaagatgcgaagactatcatggtccagatactaagtgttgtagccttctgtcatctccaaggcgtagttcatcgtgaccttaagccagagaacttcctttttagttcaaaagatgaggattcctcactgaaggccattgattttggattatctgattttgtaaagccagatgaaaggttgaacgatattgtaggaagtgcatattatgtagctccagaagttcttcacagagcatatggcacagaggcagacatgtggagtatcggtgtgattgcatacattcttctctgtggaagtcgccctttctgggctcggactgagtcaggcatattccgagctgtgctgaaggcggaacccagctttgaagaagccccttggccttctttgtcttccgatgccaaagattttgtcaaaggattgttaaacaaggatttccgtaagagatttactgctgcacaggctctcagtcatccttggctgtccagtaatcaagttatgaagattccactggatatcataatatacaagtttgtaaaagcgtatatatgctcatcttctttgcggaaatcagctttgggggctctggcaaagacattgacagtggctcaactagcttacttccatgagcagttttcattgctagggccaaacaaaagtggatatatttctatgcaaaattttaagacggcattggtaaagaactccactgatgccatgaaggattcacgggttcttgattatgccaacatggtgagttcacttcattatagaaaattagattttgaagaattttgtgctgctgcaattagtgtgcaccagctggaaggaatggaaagctgggagcagcatgcacgtcgtgcatatgagctctttgaaaaagacgggaacagagcaataatgattgaggaacttgcttcggaacttgggcttagcccatcagtacctgttcatgtagttctccaggattggctaagacatacagatggcaagctcagtttcttgggatttgtcagacttcttcatggcctatcttcacgtgtactccagaagtcttgaaataaaactagaagttaatacaatggttaatcatgctatatctttccgacaactacctcccatgactgagaaatttgaaggttacgatttttagtgctggaagatgcctaaccagaggtaaaggtggtctgaactctgacccatggtcggctgactaaattagcaaagtcaagactagtgaacaaaacataagccatatttggcatattcacacattcggtgtgtgttttgtatccagtgttatgtccaaacgtgtagaatgttccttaggtatcccatgcttgtgaattgagttaaatgaggattgtacagatgaggtcaaatagtagatgttcaaaataagagaaagtttaggtgagttttgtgctttgtggttgagaccttgcgtaattgctttgtgggtcttcccctgatgctttacacaacataacaattttttttcaacattcttctacttcctgttggttgtgtatgtatattgtgaatcagaaacagt

SEQ ID NO: 6484 - DNA, 2782 bp, Solanum lycopersicum
aaaggaggtttagcttctttccttttccccccttccacctttattttcttcctgctattgcttaagcatctttttttctcactttttgctcttcttatcattcttgttcactctttggtaaaaaaataataatatatattttttttccttgctttactttgattccatacttccccactacctcctatatttctttacatttcttcagctaaaacctgttagtaaaatctttgattcttgatagttgttgttgttgcctatctggcattgatcatttgatcacaaagtttaattcctttttcttgggatttgctctttttcctagaaattgtcttggaccttaaataccataagcttaattctttgttgatcccttcttggttctgctgtttcaagcttaaaaatctcatctttctagttttgcagtcccaagattgtaactttcttacttctttagctgtttgggtttctgggaattcctccttttcttgtatttttgtttcttgagaatttactcccctttgtaatggtctagttccctgtgtttcctctgtgtaaaaaagttcttatctttactgttcttcttttgattattaactgatttgtgtgttgtaaaattgggttgttgattccatgggactttgtcatgggaaacctattcaatccccacaaaacctgtctgaaaatcccataattcccattgataatgagcaagaattgaattcccacactgggaaaacaccaaaattccctttttatagtccaagtcctttgcctagtgcattcaagaactctcctgctaattctagtgtgacttcaacacctttgagatttctcaaacgtgtaccaccatcaccagctaagcatattagggcattacttgctagaaggcatggctcaattaaacctaatgaagctacaattccagaagggagtgaatgtgatattggtttggataagatatttgggtactcaaagaattttgatagtcactatgatcttggagaagaagtgggaagaggacattttggttatacttcagcagctaaggggaaaagagggagcttgaaagggcatgatgtagctgtaaaagttatcccaaaatcaaagatgactacagcaattgcaattgaggatgtaaggagagaagtcaaaatattgcgcgctttaacaggacataggaatctggttcaattctatgatgcctatgaggacgaggaaaatgtttatatagtcatggagttatgtaaaggaggagaattgctggaccggatacttgcaaggggtgggaaatactcggaagacgatgccaaagctgtcatggtacaacttctaagcgtggtctcgtattgtcatcttcaaggggttgttcatcgcgacctaaagcctgagaattttcttttcgtttctaaggatgagaactctcctttaaaagccattgactttggtctctctgattatgtaaaaccagatgaaaggcttaatgatattgtcggaagtgcatactatgttgcacctgaggttttgcatagatcttatggaacagaagctgacatgtggagtattggtgtcattgcatacattcttctttgtggaagcagacctttctgggctcggacagagtccggtatatttagggccatcctgaaaactgatccaaactttgatgaagccccttggccctctttgtcttctgatgcagtggactttgtaaaaagattgctgaataaggattatcgcaaaaggctaactgcagctcaggctctcagtcatccttggttggctggtcatcatgatgtgaagattcctttggatatgatagtatataagcttgtaaaagcttatgtatattcttcttctcttagaaaaactgctttaagggctcttgctaagacattgactataccacaactagcttatcttcgtgatcagtttacactattagggccaagcaaaagtggactagtagctctatcaaacttcaaaatggctgtgatgaagaactccaccgatgcgatgaaggattcaagggttttcgactttgttaatacggtgagttctcttcaatacagaaaattggattttgaagaattctgtgctgcttcgataagtgtacatcagcttgagggaatggaaagctgggagcaacatgcacgtcgtggctatgagttctttgaaaaggaggggaacagacctattatgatagaggaacttgcttcggagctcgggctgtctccttccgtaccagttcatgtagttctgcaggactggattagacactcagatggaaagctcagtttcttgggatttgtccggcttctacatggagtttcttcgcgcacatttcaaaaagcttaaagagtataacctatcttattgaacttcccagtgtttcatccagctttcagactattcatcactcgaagaatcaaagtcttgttgcttgatcaaatgatctgttgaaaggcggaaacagctagtttacaacaaaactacagatccagtttgaaaatacatgacactagcagcagtatatttggtgtcaaatcttattttgtcatgtaattcttgtattcttcaaatgttggatcacattccactttaagaggattgtacagatgaggataatcagaagaaaaaaagttgtaagtagtttgtcagaaaagacagctgaaagctgagatgagttcttgtggcttcttggtgtaacctgtttaccattttgctttagcataataaattctctttattgtgtctctaaccttatatccgctgaattttt

SEQ ID NO: 6485 - DNA, 1998 bp, Eutrema parvulum
ctcaaatcacaattcatggggatctgtcacggaaaacccatcgaacaccaatcgaagcagagcatcccagtttcaggcgaaaccgatgaagctccgacgaattcacagccgccggtgaaatcctccgggttcccgttttacagcccaagccctttacctagcttatttaaatcctcaccggccatatcgacaagcgcgagctccacgcctcttcgcatcttcaagagacctttccctcctccttcacctgcgaagcacatacgcgctttcctcgcgcgtcgcaacggctccaccaagcccaacgaggtctcgattcctgaaggtaaggagttcgagatcggtctcgacaagagtttcgggttctcgaaacatttcgcttcacactacgagattgatggcgaggtgggtcgtggacattttgggtatacttgctctgcaaaggggaaaaaaggcagcttgaagggtcaagaagtagctgttaaagttattcctaaatccaagatgacaactgctattgcgattgaggatgttagcagagaagtgaagatattgcgggctttgactggtcacaacaacttagtccagttctatgatgcgtttgaggatgatgaaaatgtttatatcgttatggagttgtgtaaaggtggtgaactcttggataaaatacttcaaaggggtggcaaatactcagaagatgatgctaaaaaagttatggttcagatacttagcgtagtagcttactgtcatctacaaggtgtggttcaccgtgatcttaaacccgagaactttctgttcagtactaaggacgagacttctcctctaaaggcaattgattttggactctctgattatgtcaagccagacgaaaggttgaatgatattgtaggaagtgcttattacgtagccccggaagttttgcaccgtacatacggaacagaagctgacatgtggagtattggagtgattgcttatattcttctctgtggcagtagacccttttgggcccgtactgaatccggaatctttcgagctgttcttaaggcagaacccaattttgaagaagctccttggccgtctctatcacctgatgctgtagattttgtgaaaagattgctaaacaaagattatcgtaaaagactaactgcggcccaggctttgtgtcatccgtggctggttggctcgcatgaactaaaaataccatctgatatgatcatatacaagcttgtaaaagtgtacataatgtcaacttcattgagaaaatcagctttagcggctcttgccaagacattaactataccgcagttagcttatctgcgggagcaatttacattgttggggccaagcaaaaatggatatatctcgatgcagaattacaaaacagcaatcctaaagagctcaacagatgctacgaaggattcacgcgtctttgattttgttcacatgataagctgtcttcaatacaagaaactagactttgaagagttctgtgcttcagcattaagcgttcatcagctcgaagcaatggaaacatgggagcaacatgcacggcgtgcttacgagttgtttgagaaagacgggaacagacccatcatgattgaagaacttgcatcggagctcggactcgggccatcggttccagtgcacgttgtacttcaggattggataagacattcggatggaaagcttagtttcttgggttttgtcagactactacacggcgtgtcttctcggacattacagaaagcttgagagcaatgacattgttttagataagaaaagatgcaactaagtgtagatctggtttcttcttttcaccatttcttgatagcatctattattcacgggtaaagattttgagtcaaagattcgataattatgtcagtgtgtgtatgtgtatgtgtgtggtggggaaagaagggtttcaaatgaagaggaatgtacagaatcagacatattccataacttctttgttttctaatccattttaaattcggaaca

SEQ ID NO: 6486 - DNA, 2148 bp, Arabidopsis thaliana
tttcttgcttctcacatgaatctgtttcgcaacctaacttattcatcggagtgatatcgatattcttctcaaattttgaagcttttcgtttcgaattgacaattcatggggatctgtcatggaaaacccgtcgagcaacaatcaaaaagcctcccagtttccggcgaaactaatgaagctccgacgaattcacagccaccggcgaaatcctctggctttccgttttatagcccgagtcctgtacctagcttattcaaatcctcaccatctgtatcttctagcgtgagctcaacgcctcttcgtatcttcaagagacctttccctcctccttctcctgctaagcacatacgagctttcctcgcgcgtcgctatggctctgtcaagcctaatgaggtttcgattcccgaaggtaaagaatgtgagatcggtctcgataagagttttggcttttcaaaacagtttgcttcacactatgagattgatggtgaggtgggtcgtggacattttggatatacttgctctgctaagggtaaaaaaggtagcttgaaaggtcaagaagttgctgttaaagttattcctaaatcaaagatgacaactgcaattgcgattgaggatgttagtagagaagtgaagatgttgcgggctttgactggtcataagaacctagtccagttctatgacgcgtttgaagatgatgaaaatgtttatattgtcatggaattatgcaaaggtggtgaactcttggacaaaatacttcaaaggggtggaaaatactccgaagatgatgctaaaaaagttatggttcagattctcagtgttgtggcttactgtcatctacaaggtgtggttcaccgtgaccttaaacccgagaactttcttttctctaccaaggatgagacttctcctctgaaagcaattgattttggtctttctgactatgtcaagccagacgagaggttgaatgatattgtagggagtgcttactatgtggccccggaagttttacaccgtacatatggaacagaagctgacatgtggagtataggagtgattgcttatattcttctctgtggcagtcgacccttttgggcccgtactgaatccggaatctttcgagctgtactaaaggcagaaccgaattttgaagaagctccttggccttctctatcacccgaagctgtagattttgtgaagagattgctaaacaaagattaccgtaaaagactaactgcggcccaggctttgtgtcatccctggctggttggctcgcatgaactaaagattccatctgatatgatcatatacaagcttgtaaaagtgtacataatgtcaacttcattgagaaaatcggctttagcggctcttgccaaaacattaactgtaccgcagttagcgtatcttcgggagcaattcacattgttggggccaagcaaaaatggatatatctcgatgcagaattacaaaacagcaatcctaaagagttcaacagatgctatgaaggattctcgagtgtttgattttgttcacatgataagttgtcttcaatacaagaaactagactttgaagagttttgtgcttcagcattaagcgtttatcagctcgaagcaatggagacatgggagcaacatgcacggcgtgcttacgagttgtttgagaaagacgggaataggcccatcatgattgaagaacttgcatcggaactcggactagggccatcagtgccggtgcacgttgttcttcaggattggataagacattctgatggcaaacttagtttcttagggtttgtcagattgctacatggcgtgtcttctcggaccttacaaaaagcttagagtaacgccattgttagatgagaaaagatgcaactaggtggagtagatctggtttcttctttcctctccacttcttgatagtttttttagttttctttttctattcatggttaagcttctgagtcaaagattcgataattatgtctgtgagtgtatttgtgtgtggtgggaaggaaaggtttatgaagaagaggaatgtacagaatgagacatatccgattggtgtttttaatccagtgatgtttacgtgtgaagcactcttttaatggcagccggaaaaaacaatttgtctttgtgccatcgttggatcag

SEQ ID NO: 6487 - DNA, 2090 bp, Arabidopsis thaliana
tttcttgcttctcacatgaatctgtttcgcaacctaacttattcatcggagtgatatcgatattcttctcaaattttgaagcttttcgtttcgaattgacaattcatggggatctgtcatggaaaacccgtcgagcaacaatcaaaaagcctcccagtttccggcgaaactaatgaagctccgacgaattcacagccaccggcgaaatcctctggctttccgttttatagcccgagtcctgtacctagcttattcaaatcctcaccatctgtatcttctagcgtgagctcaacgcctcttcgtatcttcaagagacctttccctcctccttctcctgctaagcacatacgagctttcctcgcgcgtcgctatggctctgtcaagcctaatgaggtttcgattcccgaaggtaaagaatgtgagatcggtctcgataagagttttggcttttcaaaacagtttgcttcacactatgagattgatggtgaggtgggtcgtggacattttggatatacttgctctgctaagggtaaaaaaggtagcttgaaaggtcaagaagttgctgttaaagttattcctaaatcaaagatgacaactgcaattgcgattgaggatgttagtagagaagtgaagatgttgcgggctttgactggtcataagaacctagtccagttctatgacgcgtttgaagatgatgaaaatgtttatattgtcatggaattatgcaaaggtggtgaactcttggacaaaatacttcaaaggggtggaaaatactccgaagatgatgctaaaaaagttatggttcagattctcagtgttgtggcttactgtcatctacaaggtgtggttcaccgtgaccttaaacccgagaactttcttttctctaccaaggatgagacttctcctctgaaagcaattgattttggtctttctgactatgtcaagccagacgagaggttgaatgatattgtagggagtgcttactatgtggccccggaagttttacaccgtacatatggaacagaagctgacatgtggagtataggagtgattgcttatattcttctctgtggcagtcgacccttttgggcccgtactgaatccggaatctttcgagctgtactaaaggcagaaccgaattttgaagaagctccttggccttctctatcacccgaagctgtagattttgtgaagagattgctaaacaaagattaccgtaaaagactaactgcggcccaggctttgtgtcatccctggctggttggctcgcatgaactaaagattccatctgatatgatcatatacaagcttgtaaaagtgtacataatgtcaacttcattgagaaaatcggctttagcggctcttgccaaaacattaactgtaccgcagttagcgtatcttcgggagcaattcacattgttggggccaagcaaaaatggatatatctcgatgcagaattacaaaacagcaatcctaaagagttcaacagatgctatgaaggattctcgagtgtttgattttgttcacatgataagttgtcttcaatacaagaaactagactttgaagagttttgtgcttcagcattaagcgtttatcagctcgaagcaatggagacatgggagcaacatgcacggcgtgcttacgagttgtttgagaaagacgggaataggcccatcatgattgaagaacttgcatcggaactcggactagggccatcagtgccggtgcacgttgttcttcaggattggataagacattctgatggcaaacttagtttcttagggtttgtcagattgctacatggcgtgtcttctcggaccttacaaaaagcttagagtaacgccattgttagatgagaaaagatgcaactaggtggagtagatctggtttcttctttcctctccacttcttgatagtttttttagttttctttttctattcatggttaagcttctgagtcaaagattcgataattatgtctgtgagtgtatttgtgtgtggtgggaaggaaaggtttatgaagaagaggaatgtacagaatgagacatatccgattggtgtttttaatccagtgatgtttacgtgtgaa

SEQ ID NO: 6488 - DNA, 2219 bp, Brassica rapa
tctaccttttttcttcttgttgttactgtgaaagcatcttcttttctctcttttttcatcctcgagaacactttgcttttgcttcgcctagtgtatttactcaactttcccttctctttggtatgaatctcgcttctctccttcacctcctccttcctctttgcgtgtgatctaatccctaaactgacttctcgaaagtttctatctttctcgtcgttcgaatcgaaaagtctcaatctttctccccttctcaagccatggggatgtgccacggcaaacccatcgagcaccaatcaaaacagagcctcccagctcccgacgaacctcagcctcctcctcctcctcctccggcgaaatcctccggctttccgttttacagcccaagccctttacccagcttgttcaaatcctcccccgccgtctcctcgagcgcgagctccacgcctctccgcatcttcaagagacctttccctcctccttcccctgccaagcacatacgcgccttcctcgcgcgtcgccacggctcctccgccaagccccccagcgaggtctcgatccccgaaggggaggagttcgagatcggtcttgataagagcttcgggttctccaagcacttcgcgtcgcattacgagattgatggggaggtgggtcgggggcattttgggtatacttgctctgccaagggtaaaaagggaagcttgaagggtcaggaagttgctgttaaagtcatccctaagtcaaagatgacgactgcaattgcaattgaggatgttagtagagaagtgaagatactgcgagctctgactggtcacaagaacttagtccagttctatgacgcttttgaagatgaagaaaatgtttatattgtgatggagttatgtaaaggtggtgaactcttggacaaaatacttcaaaggggtggcaaatactcagaagatgatgctaaacaagttatggttcagattcttagtgtagtagcttactgtcatctacaaggtgtggttcaccgtgaccttaaacccgagaattttctcttcagcactaaggatgagacttctcctctaaaagcaatagactttggtctctctgattatgtcaagccagacgagaggttgaatgatattgtaggaagtgcttattacgttgccccagaggttctgcaccgtacatacggaacagaagctgacatgtggagtataggagtgattgcttatattcttctctgtggcagtagacccttttgggcacgtactgaatccggaatctttagagctgttctcaaggcggaaccaaactttgaagaagctccttggccttcactgtcacctgatgctgtagattttgttaaaagattgctaaacaaagattaccgtaaaagactaacagcagctcaagctttgtgtcatccgtggctagttggctcccatgaacttaagataccgtcggatatgatcatatacaagcttgtgaaagtgtacataatgtcaacttctttgagaaaatctgctttgcaggctcttgccaagacattgactgtaccacagctagcttatctgagggaacagtttacattgttggggccaagcaaaaatggatatatctccatgcaaaattacaaaacagcaattgtaaagaccgcaacagatgctactaaagactcacgagtattagattttgttcacatgataagttgtcttcaatacaggaagctggactttgaagagttctgtgcatcagcattaagcgtttatcagctggaagcaatggaaacttgggagcaacacgcacgccgtgcttacgagttgtttgagaaagatgggaatagacccatcatgattgaggaacttgcatccgaactaggactggggccatcagtaccagtgcacgttgtgcttcaagattggataagacattcagatgggaagcttagtttcttgggttttgtcaggctactacacggcgtttcttctcggacgttacataaagcttagaggagcaacgaacattgtttttagattgagaaaaaaaaaagatgcaaactaaaaaagtgtagttctgtgtttcttcttcttgtgttcatgtggtaatattttgagtctaaaagattcaataattatgtgtgtgtaatgtgtgtggtttcagataaagaggaatgtgacattccatattatctcttacacaatcatattgaatatgtcacccttaaagggattgctcca

SEQ ID NO: 6489 - DNA, 2909 bp, Citrus clementina
acacaacacgcataataaacccattcacaaaaaaagcttacaaaaagcagaaataaagaagcattgttgcttcttttcttttctttaactccttttcttgttgcctctgcttagcatctttacctttctttttcttttattctttcattttatttttatttttttttacccttttcctttttctttcctctgttcttttgcccctcattctattctttccttcgtctttgagtaaattttcttgctttgtttcctatcattctcttcgcttgcctctaccaaattgccttcttgtttatttgattagtaaagtagagttgctttagtttttaagtaattttctcatctgggttctctctttcttattttgctttgaatttgatcttcttggggattttacagtgatgatcttttctgtgttctgctcatcaaactgtaaaataactcaagaagaagcaaattttctttgttgggggagttcattttttttcttgctgctactactacggtctaaaattgttttactttctttgtttttcttgtagtttcttgatcaaaatacttaaagttgttaacttttgttgaggatccttgagtttcttatagctacagttctctgttaacatgggactctgtcatggaaaaccagttgaaaactcacaaaacagatcacaaaacgaggcactcccttatgaaaacgaacctcagccaaattcccagaaatcaaaagcatcatattttccattttacagcccaagtccactaccaagtctcttcaagaactcaccagcaataccaagtgtaaattcaactcctttgcgctttttcaagcgcccatttcctcctccttcgcctgcaaagcatatccgttcattgcttgcaaggaggcatggttctgtgaagcctaatgaggcctcaattcctgaaggaaatgaaagtgatattggtttggataagaattttggattttcaaagcagttcgttgctcattatgagcttggagaagaagtggggcgtgggcattttggatatacttgctctgccaaggctaaaaaaggaagtttgaaaggccaggatgtggctgtcaaagttattcctaagatgattggagtcattttccttcaggttcatcgtcccaagcatgaaaatcaccaattcaccattcttgatgagtactgttgtctgtttatgactactgcaattgccatcgaggatgtgagacgagaagtgaagatattgcgagctcttacagggcataagaaccttgtgcagttctatgatgcttatgaagatgatgacaacatttacatagtaatggaattgtgcaaaggtggcgagctattggatagaatactttcaaggggtggaaaatattcagaagaagacgcaaagattgttatggttcaaattttgagtgtggtagcgttttgtcatttccaaggtgtggtccaccgtgatctcaagccagagaattttctttttacttctaaggaagagaattcatccctgaaggccattgattttggactctctgactatgtaaagccagatgaaaggctgaatgacatagtagggagtgcatattatgtagctcctgaagtactacatcgatcatatggcactgaagctgacatgtggagtattggtgtcattgcttatattctgttatgtggaagccgtcctttttgggctagaactgaatctggaatctttcgagctgtccttaaagcagatccaagctttgacgaagccccttggccttctttatcccctgaggcgattgattttgtgaagagattattaaacaaggactaccgcaagagactaactgctgctcaggctctgagtcatccatggctggccaattctcatgatgtgaagataccatcagatatgattgtatacaagctcataaaggcttatattagctcgtcttctctacgtaaagcagcactgggggctcttgcaaagacattaacagtgcctcagcttgcttacctccgggaacaatttacgttattggggccaaacaagaatggattcatttctatgcagaactataaaatggcagtgtcgaagaactccactgacgcaatgaaagactcacgggttttagactatgttaacatgattggttctctccaatatagaaaactcgattttgaagaattttgtgctgctgccataagtgtgcatcagctggaaggaatggagacttgggagcaacatgcaagacatgcctatgatttatttgataaagatggcaacagacccataatgattgaagaacttgcctcggagctgggactcagcccatcagtacctgttcacgttgttcttcaagactggataagacactcagatggcaagcttagtttcttggggttcgttagacttctacatggggtctcctctcgcacatttcagaaagcttgaacaatagaaactgtttttctttctttctcactccaacgtctcaacgggacaaaatgcatgcccggctagcttgagagctaccatgaataactcggcattcatctcaattgtcgaaatgggtgcctcaagttagaagtacggccaatcggcatgcattactcgcgaagccatccttggcaagtcatcatctaaagtttttcttagtcttcttccccatattatatgaggttttggtttcaaggatttagttttgtggttgtcattgaaaagtagaggattgtacagattaagagtagttgggccaaaatgtatgtagtgtagaaaagagcttaaaacttgagtgagttctgtggctttggggtttatcccctggtgtaccccttgcctctgtctctcataataaattattcttgtgccctatctatgatgaacatttattccatggtaatttttccggctccttaatttttctt

SEQ ID NO: 6490 - DNA, 2286 bp, Eutrema parvulum
taccacttttttttttattgttgctactgtgaaagcatcttcttcccttttttttttcattcttcactttgcttttgcttcgtgtagtgtctttacttaacttttccttctgattggaatgaaactcgcttctctccttcttcttcttcttcctctttgcgtgtggtttatcttcttctataactgattcctcaaagtttttttttcgtgtggtgtgaatcgaacaattcttcagtcgtcttcgccttctctgtagcttctcaaatcacaattcatggggatctgtcacggaaaacccatcgaacaccaatcgaagcagagcatcccagtttcaggcgaaaccgatgaagctccgacgaattcacagccgccggtgaaatcctccgggttcccgttttacagcccaagccctttacctagcttatttaaatcctcaccggccatatcgacaagcgcgagctccacgcctcttcgcatcttcaagagacctttccctcctccttcacctgcgaagcacatacgcgctttcctcgcgcgtcgcaacggctccaccaagcccaacgaggtctcgattcctgaaggtaaggagttcgagatcggtctcgacaagagtttcgggttctcgaaacatttcgcttcacactacgagattgatggcgaggtgggtcgtggacattttgggtatacttgctctgcaaaggggaaaaaaggcagcttgaagggtcaagaagtagctgttaaagttattcctaaatccaagatgacaactgctattgcgattgaggatgttagcagagaagtgaagatattgcgggctttgactggtcacaacaacttagtccagttctatgatgcgtttgaggatgatgaaaatgtttatatcgttatggagttgtgtaaaggtggtgaactcttggataaaatacttcaaaggggtggcaaatactcagaagatgatgctaaaaaagttatggttcagatacttagcgtagtagcttactgtcatctacaaggtgtggttcaccgtgatcttaaacccgagaactttctgttcagtactaaggacgagacttctcctctaaaggcaattgattttggactctctgattatgtcaagccagacgaaaggttgaatgatattgtaggaagtgcttattacgtagccccggaagttttgcaccgtacatacggaacagaagctgacatgtggagtattggagtgattgcttatattcttctctgtggcagtagacccttttgggcccgtactgaatccggaatctttcgagctgttcttaaggcagaacccaattttgaagaagctccttggccgtctctatcacctgatgctgtagattttgtgaaaagattgctaaacaaagattatcgtaaaagactaactgcggcccaggctttgtgtcatccgtggctggttggctcgcatgaactaaaaataccatctgatatgatcatatacaagcttgtaaaagtgtacataatgtcaacttcattgagaaaatcagctttagcggctcttgccaagacattaactataccgcagttagcttatctgcgggagcaatttacattgttggggccaagcaaaaatggatatatctcgatgcagaattacaaaacagcaatcctaaagagctcaacagatgctacgaaggattcacgcgtctttgattttgttcacatgataagctgtcttcaatacaagaaactagactttgaagagttctgtgcttcagcattaagcgttcatcagctcgaagcaatggaaacatgggagcaacatgcacggcgtgcttacgagttgtttgagaaagacgggaacagacccatcatgattgaagaacttgcatcggagctcggactcgggccatcggttccagtgcacgttgtacttcaggattggataagacattcggatggaaagcttagtttcttgggttttgtcagactactacacggcgtgtcttctcggacattacagaaagcttaggagcaacgacattgttttagatgagaaaagatgcaattaagtgtagctctggtttcttcttttcaccatttcttgatagtatctattattcacgggtaaagattttcagtcgaagattcgataattatgtcagtgtgtgtatgtgtaatgtgtgtggtcggtgaagaagggtttcaaatgaagaggaatgtacagaatcagacatattccataacttctttgttttctaatccattttaaattcggaacaagattttctgcatgaacgtgtaattaca

SEQ ID NO: 6491 - DNA, 2758 bp, Solanum lycopersicum
ggaggtttagcttctttccttttccccccttccacctttattttcttcctgctattgcttaagcatctttttttctcactttttgctcttcttatcattcttgttcactctttggtaaaaaaataataatatatattttttttccttgctttactttgattccatacttccccactacctcctatatttctttacatttcttcagctaaaacctgttagtaaaatctttgattcttgatagttattgttgttgcctatctggcattgatcatttgatcacaaagtttaattcctttttcttgggatttgctctttttcctagaaattgtcttggaccttaaataccataagcttaattctttgttgatcccttcttggttctgctgtttcaagcttaaaaatctcatctttctagttttgcagtcccaagattgtaactttcttacttctttagctgtttgggtttctgggaattcctccttttcttgtatttttgtttcttgagaatttactcccctttgtaatggtctagttccctgtgtttcctctgtgtaaaaaagttcttatctttactgttcttcttttgattattaactgatttgtgtgttgtaaaattgggttgttgattccatgggactttgtcatggaaaacctattcaatccccacaaaacctgtctgaaaatcccataattcccattgataatgagcaagaattgaattcccacactgggaaaacaccaaaattccctttttatagtccaagtcctttgcctagtgcattcaagaactctcctgctaattctagtgtgacttcaacacctttgagatttctcaaacgtgtaccaccatcaccagctaagcatattagggcattacttgctagaaggcatggctcaattaaacctaatgaagctacaattccagaagggagtgaatgtgatattggtttggataagatatttgggtactcaaagaattttgatagtcactatgatcttggagaagaagtgggaagagggcattttggttatacttcagcagctaaggggaaaagagggagcttgaaagggcatgatgtagctgtaaaagttatcccaaaatcaaagatgactacagcaattgcaattgaggatgtaaggagagaagtcaaaatattgcgcgctttaacaggacataggaatctggttcaattctatgatgcctatgaggacgaggaaaatgtttatatagtcatggagttatgtaaaggaggagaattgctggaccggatacttgcaaggggtgggaaatactcggaagacgatgccaaagctgtcatggtacaacttctaagcgtggtctcgtattgtcatcttcaaggggttgttcatcgtgacctaaagcctgagaattttcttttcgtttcaaaggatgagaactctcctttaaaagccattgactttggtctctctgattatgtaaaaccagatgaaaggcttaatgatattgtcggaagtgcatactatgttgcacctgaggttttgcatagatcttatggaacagaagctgacatgtggagtattggtgtcattgcatacattcttctttgtggaagcagacctttctgggctcggacagagtccggtatatttagggccatcctgaaaactgatccaaactttgatgaagccccttggccctctttgtcttctgatgcagtggactttgtaaaaagattgctgaataaggattatcgcaaaaggctaactgcagctcaggctctcagtcatccttggttggctggtcatcatgatatgaagattcctttggatatgatagtatataagcttgtaaaagcttatgtatattcttcttctcttagaaaaactgctttaagggctcttgctaagacattgactataccacaactagcttatcttcgtgatcagtttacactattagggccaagcaaaagtggactagtagctctaccaaacttcaaaatggctgtgatgaagaactccaccgatgcgatgaaggattcaagggttttcgactttgttaatacggtgagttctcttcaatacagaaaattggattttgaagaattctgtgctgcttcgataagtgtacatcagcttgagggaatggaaagttgggagcaacatgcacgtcgtggctatgagttctttgaaaaggaggggaacagacctattatgatagaggaacttgcttcggagctcgggctgtctccttccgtaccagttcatgtagttctgcaggactggattagacactcagatggaaagctcagtttcttgggatttgtccggcttctacatggagtttcttcgcgcacatttcaaaaagcttaaagagtataacctatcttattgaacttcccagtgtttcatccagctttcagactattcatcactcgaagaatcaaagtcttgttgcttgatcaaatgatctgttgaaaggcggaaacagctagtttgcaacaaaactacagatccagtttgaaaatacatgacactagcagcagtatatttggtgtcaaatcttattttgtcatgtaattcttgtattcttcaaatgttggatcacattccactttaagaggattgtacagatgaggataatcagaagaaaaaaagttgtaagtagtttgtcagaaaagacagctgaaagctgagatgagttcttgtggcttcttggtgtaacctgtttaccattttgctttagcataataaattctctttattgtgtctctaa

SEQ ID NO: 6492 - DNA, 2684 bp, Solanum phureja
ttctttccttttccccccttctacctttcttttcttcctgctattgcttaagcatcttttttctcactttttgctcttcttatcattcttcttcactctttggtaaaaaaaaaaattatatttttttccttgctttactttgattccatacttcccactacctcctatatttctttacatttcttcagctaaaacctgttagtaaaatctttgattcttgatagttgttgtagttgcctatctggcattgatcatttgatcacaaagtctaattcctttttcttgggatttgctcttttcctagaaattgtcttggaccttaaataccttaagcttaattctttgttgatcccttcttggttctgctgtttcaagcttaaaaatctcatctttcttgttttgcagttccaagatagtaacttttttacttcttcagctgtttgggtttctgggaattcctccttttcttgtatttctgtttcttgagaatttactcttgtttccccccttttgtaatggtctagttccctgtgttttctctgtgtaaaaaagttattaactttactgttcttcttttaactattaactgatttctgtgctgaaaattgggttcttgattccatgggactttgtcatggaaaacctatccaatccccacaaaacctgtctgaaaatcccacaattcccattgataatgagcaagaattgaattcccacactgggaaaacaccaaaattccctttttatagtccaagtcctttgcctagtgcattcaagaactctcctgctaattctagtgtgacttcaacacctttgaggtttctcaaacgtgtaccaccatcaccagctaagcatattagggcattacttgctagaaggcatggctcaattaaacctaatgaagctacaattccagaagggagtgaatgtgatattgggttggataagatttttgggtactcaaagaattttgatagtcactatgatcttggagaagaagtgggaagagggcattttggttatacttctgcagctaaggggaaaagagggagcttgaaagggcatgatgtagctgtaaaagttatcccaaaatcaaagatgactacagcaattgcaattgaggatgtaaggagagaagtcaaaatattgcgtgctttgacaggacataggaatctggttcaattctatgatgcctatgaggatgaggaaaatgtttatatagtcatggagttatgtaaaggaggagaattgctggaccggatacttgcaaggggtgggaaatactcggaggacgatgccaaagctgtcatggtgcaacttctaagcgtggtctcgtactgtcatcttcaaggggttgttcatcgcgacctaaagcctgagaatttccttttcgtttctaaggatgagaactctcctttaaaggccattgactttggtctttccgattatgtaaaaccagatgaaaggcttaatgatattgtcggaagtgcatactatgttgcacctgaggttttgcatagatcttatggaacagaagctgacatgtggagtattggtgtaattgcatatattcttctttgtggaagcagacctttctgggcgcggacagagtctggtatatttagggccatcctgaaaactgatccaaactttgacgaatccccttggccctctttgtcttctgatgcagtagactttgtaaaaagattgctgaataaggattatcgcaaaaggctaactgcagctcaggctctcagtcatccttggttggctggtcatcatgacgtgaagattcctttggatatgatagtatataagcttgtaaaagcttatgtgtattcttcttctcttagaaaaactgctttaagggctcttgctaagacattggctataccacaactagcttatcttcgtgatcagtttacactattagggccaagcaaaagtggacttgtagctctaccaaacttcaaaatggctgtgatgaagaactccaccgatgcgatgaaggattcaagggttttcgactttgttaatacggtgagctctcttcaatacagaaaattggattttgaagaattctgtgctgcttcaataagtgtacatcagcttgagggaatggaaagctgggagcaacatgctcgtcgtggctatgagttctttgaaaaggaggggaacagacctattatgatagaggaacttgcctcggagctcgggcttagtccttccgtcccagttcatgtagttctgcaggactggattagacactctgatgggaagctcagtttcttgggatttgttcggcttctacatggagtttcttcgcgcacatttcaaaaagcttaaagagtataacctatcttaatgaaacttcccaatgctttcagactattcatcactcgaagaatcgaagtcttgttgcttgatcaaatgatctgttgaaaggcggaaacagctagtttacgacgaaactacagatccagtttgaaaatacatggcactaggagcagcagtatatttggtgtcaaatcttattttgtcatgtaattcttgtattcttcaaatgttggatcacattccactttaagaggattgtacagatgaggataatcagaagaaaaagttgtaagtagtttctcagaaaagacagctgaaagctgagatgagtttcttgtggcttcttg

SEQ ID NO: 6493 - DNA, 2180 bp, Arabidopsis lyrata
gattacttattctctctcccgggaaaattaaacccacatgaatctgtttcgtaacttaactgattcatcggcttgaaatagatattcttcacaaagtttcaagcttttcgttttgaattctctcaattgaaaattcatggggatctgtcatggtaaacccatcgagcaacaacaatcaaaaagcctcccagtttccggcgaaaccgatgaagctccgacgaattcacagccaccggcgaaatcttccggctttccgttttacagcccaagtcctgtaccaagcttattcaaatcctcaccttccgtatcttcgagcgtgagctcaacgcctcttcgtatcttcaagagacctttccctcctccttctcctgctaagcacatacgagctttcctcgcgcgtcgctacggctctgtcaagcccaatgcggtttcgattcccgaaggtaaagaatgtgagattggcctcgataagagttttgggttttcgaaacagtttgcttcacactacgagattgatggtgaggtgggtcgtggacattttgggtatacttgctctgctaagggtaaaaaaggtaccttgaaaggtcaagaagttgctgttaaagttattcctaaatcaaagatgacaactgcaattgcgattgaggatgttagtagagaagtgaagatgttgcgggctttgactggtcataagaacctagtccagttttatgacgcgtttgaagatgatgaaaatgtttatattgtcatggagttatgcaaaggtggtgaactcttggataaaattcttcaaaggggtggaaaatactcagaagatgatgctaaaaaagttatggttcagattctcagtgttgtggcttactgtcatctacaaggtgtggttcaccgtgaccttaaacccgagaactttcttttctcaacgaaggatgagacttctcctctgaaagcaattgattttggtctttctgactatgtcaagccagacgagaggttgaatgatattgtaggaagtgcttactacgtggccccagaagttttacaccgtacatatggaacagaagctgacatgtggagtataggagtgattgcttatattcttctctgtggcagtcggcccttttgggctcgtactgaatctggaatctttcgggctgtcctaaaggcagaaccgaattttgaagaagctccttggccatccctatcacctgacgctgtagattttgtgaaaagattgcttaacaaagattaccgtaaacgactaactgcggcccaggctttgtgtcatccctggctggttggctcgcatgaactaaagattccatctgatatgatcatatacaagcttgtaaaagtgtacataatgtcaacttcattgagaaaatcggctttagcggctcttgccaagacattaactgtaccgcagttagcttatctgcaggagcaattcacgttgttggggccaagcaaaaatggatatatttcgatgcaaaactacaaaacagcaatcctaaagagttcaacagatgctatgaaggattcacgagtgttagattttgttcacatgataagttgtcttcaatacaagaaactagactttgaagagttttgtgcttcagcattaagcgtttatcagcttgaagcaacggaaacatgggaacaacatgcacggcgtgcttacgagttgtttgagaaagacgggaatagacccatcatgattgaagaacttgcatcggaactcggactcgggccatcagtgccggtgcacgttgttcttcaggattggataagacattctgatggcaagcttagtttcttaggctttgtcagattactacatggcgtgtcttctcggaccttacaaaaagcttagagtaacgccattgttagatgagaaaagatgcaactaggtggagtagatctggtttcttcctttctttccacttcttgatagtttttttagttttctttttctatttatgggtaagcttctgagtcaaagattcgataattatgtctgtgagtgtatgtgtgtgtggtgggaaggaaaagtttatgaagaagaggaatgtacagaatgagacatatccgatgattattttaatccagtgatgtttacgtgtgaagcactcttttaatgaccgccggaaaaacaatttgtctgtgtgacatctttggatcag

SEQ ID NO: 6494 - DNA, 2300 bp, Vitis vinifera
atatgtggcctaaaaaaaagcaagcaaataatgtttgttgtttgttttaacaatgtcgcttcccaaattagtaagcttggatggcataacttaactgcaggaaaacccattgaaaaccctcagacacagtcccaagaccttataattcccggtgatggcgagctttctaccaacacccaaaccaccaaaaccccaaaattccccttttacagcccaagtccactgcctagtggtttcaagaactcgccagccaattcaagcgtgagttccacccccttgcggatctttaagcggccgtttccgccaccttctccggcaaagcatattcgggcattgcttgctcgaaggcacggttcggttaagccgaatgaggccacaattcccgaaggaaacgagtgtgaagttggtttggacaagaactttgggttctcgaagcagtttgtagctcactacgagatgggtgaggaggtggggcgtggccattttgggtacacttcttccgccaaagccaagaaagggagcttgaaggggcaggatgttgctgtcaaggttatcgccaaatcaaagatgactacagcaattgctattgaagatgtgagaagagaagtaaaaatattacgagctctaactggacataagaacctagtgcaattctacgaggcctacgaagatgatgataatgtttatgtagtaatggagttatgcagaggaggtgaacttttagatagaattcttgccaggggtggaaaatactctgaagaagatgcaaaggctgtcatggtccagattttgaatgtagttgccttctgtcatctccaaggtgtggttcaccgtgaccttaagccagagaattttcttttcatttccaaagaagagaattctccactgaaggctattgatttcggactttctgactacgtaaagccagatgagaggctgaatgatattgtaggaagtgcatattatgtagctcctgaagttcttcatagatcatatgggaccgaagctgacatgtggagtgttggtgtaattgcttatattcttctatgtggaagtcggcccttttgggcccggacagaatcaggcatcttcaaagctgtccttaaggcagatccaagctttgatgaagccccttggccttctttatcttctgatgcaatagattttgtaaagagattgttgaataaagattaccgcaagaggctaactgctgctcaggctctaagtcatccatggctggccaattatcatgatgtcaagataccattggatatgatagtatataaacttgtaaaagcttatatattctcatcttctctgcgaaaatcggctttggcggctcttgctaagacattgagtatagctcagctagcttattttcgggaacaatttacacttttggggccgaacaaaagtggattcgtatctctgcagaactttaagacggctgtgacaaagaactccactgatgccataaaggattcacgggtcctggaatatgtcagcatggtgggttctcttcaatatagaaagttggactttgaagaattttgcgcagcagccataagtgtgcttcagctggaaggaatggagagctgggagcaacatgcacggcgtgggtatgagctatttgagaaggatggaaataggcccattatgatagaggaacttgcttcagaacttggacttagcccatcggtacctgttcatgtagttctccaagactggataagacactctgatgggaagcttagcttcttagggtttgttagactcttacatggtccgtctcgtgcattccccaaagcgtaaaaacaaataccgagctacactggctacatcctcatcctttttctctccttgaactggaatgtctttaaggggataaaatgcatgcctaaaccgagagctactcttaacaagcaagtgttgtgtcttagctgcataaggggttgctgcaagttgaaattagagtaaatgcaaatgaccttaccaccgaagccaggcattgctggcatatctcatgttgggtatgctccttttttcttccttagttctcttttacttgttttcttgccttgtataatttttttccccatgtttggtgctattgcaatctagaggattgtacagatgagagtagatcacaatgtatttaggggttagtgaaaaactcagaagaactgaagtgagttttgtggtttttgggtttatccctggtgtacccaatgcactttggtttctcaataaattcttactgtgatctacagaagttgaatgactgataacttcttttgtta

SEQ ID NO: 6495 - DNA, 3883 bp, Arabidopsis lyrata
aattctcaatctttatgctaaattgaatctccttatccttctctgctttctgggttctcgagtctcgatttctgggattacttattctctctcatgaatctgtttcgtaacttaactgattcatcggcttgaaatagatattcttcacaaagtttcaagcttttcgttttgaattctctcaattgaaaattcatggggatctgtcatggtaaacccatcgagcaacaacaatcaaaaagcctcccagtttccggcgaaaccgatgaagctccgacgaattcacagccaccggcgaaatcttccggctttccgttttacagcccaagtcctgtaccaagcttattcaaatcctcaccttccgtatcttcgagcgtgagctcaacgcctcttcgtatcttcaagagacctttccctcctccttctcctgctaagcacatacgagctttcctcgcgcgtcgctacggctctgtcaagcccaatgcggtttcgattcccgaaggtaaagaatgtgagattggcctcgataagagttttgggttttcgaaacagtttgcttcacactacgagattgatggtgaggtgggtcgtggacattttgggtatacttgctctgctaagggtaaaaaaggtaccttgaaaggtcaagaagttgctgttaaagttattcctaaatcaaagatgacaactgcaattgcgattgaggatgttagtagagaagtgaagatgttgcgggctttgactggtcataagaacctagtccagttttatgacgcgtttgaagatgatgaaaatgtttatattgtcatggagttatgcaaaggtggtgaactcttggataaaattcttcaaaggggtggaaaatactcagaagatgatgctaaaaaagttatggttcagattctcagtgttgtggcttactgtcatctacaaggtgtggttcaccgtgaccttaaacccgagaactttcttttctcaacgaaggatgagacttctcctctgaaagcaattgattttggtctttctgactatgtcaagccagacgagaggttgaatgatattgtaggaagtgcttactacgtggccccagaagttttacaccgtacatatggaacagaagctgacatgtggagtataggagtgattgcttatattcttctctgtggcagtcggcccttttgggctcgtactgaatctggaatctttcgggctgtcctaaaggcagaaccgaattttgaagaagctccttggccatccctatcacctgacgctgtagattttgtgaaaagattgcttaacaaagattaccgtaaacgactaactgcggcccaggctttgtgtcatccctggctggttggctcgcatgaactaaagattccatctgatatgatcatatacaagcttgtaaaagtgtacataatgtcaacttcattgagaaaatcggctttagcggctcttgccaagacattaactgtaccgcagttagcttatctgcaggagcaattcacgttgttggggccaagcaaaaatggatatatttcgatgcaaaactacaaaacagcaatcctaaagagttcaacagatgctatgaaggattcacgagtgttagattttgttcacatgataagttgtcttcaatacaagaaactagactttgaagagttttgtgcttcagcattaagcgtttatcagcttgaagcaacggaaacatgggaacaacatgcacggcgtgcttacgagttgtttgagaaagacgggaatagacccatcatgattgaagaacttgcatcggaactcggactcgggccatcagtgccggtgcacgttgttcttcaggattggataagacattctgatggcaagcttagtttcttaggctttgtcagattactacatggcgtgtcttctcggaccttacaaaaagcttagagtaacgccattgttagatgagaaaagatgcaactaggtggagtagatctggtttcttcctttctttccacttcttgatagtttttttagttttctttttctatttatgggtaagcttctgagtcaaagattcgataattatgtctgtgagtgtatgtgtgtgtggtgggaaggaaaagtttatgaagaagaggaatgtacagaatgagacatatccgatgattattttaatccagtgatgtttacgtgtgaagcactcttttaatgaccgccggaaaaacaatttgtctgtgtgacatctttggatcagaccaatgatacgacacgtgactgtgtctcacattgtcggagacaaccacgtgactttgacctcagatctctgatctcatcttaatctctctacctaaccgtcgcaaagattctttctttctttcttcttcctctgatctagctacaacagtttcattaatggcgacaatgagcaaaacccatcataggtcaaaagccactccgagatctcaaagacttgttctgttatgtatagtcgccgttgcatttctcttccttttcacttcggtgatctccaccggaggattggctttaccgtatcggacaaccctaattggttatttcgtgaggtcatctcgaagcaagagacaacatagtttgtctgacaagtacttgtattggggaaacagaatcgattgtcctggtaagaactgcgagacctgtgccggtttaggtcaccaagaatctagccttagatgtgcccttgaagaagccatgtttcttaacaggacttttgtaatgccatctcggatgtgcatcaatccaatacataacaagaaaggtatacttaatcgatctgataatgaaactacagaggaaagttgggaagttagctcgtgtgcaatggaatcactgtatgatattgatcttatctctgagaagatacctgtgatcttggatgactcagaaacatggcatattgtgctatcgacgagtatgaaattgaaagaacgagggagtgcgcatgtatatggggctaacaggaatgagctaaataactccagccactttacaaatcttttgctcattaaccgaactgcaagtccccttgcatggtttgttgaatgcaaggatcgaggtaatcgtagcgacgtcatgcttccttattcatttctcccgaatatggcagcatcaagattgagagatgctgccgaaaagataaaggcacaacttggtgtttacgatgcaatccatgttcgtcgaggtgacaaactgaaaacaagaaaagacaggtttcgcgttgaaagaactcagtttccacatttagacagagacacacggccagagttcatcattggcagaattcagaagcaaatcccaccaggacggactctttttatcggttctaatgagagaacccctggattcttttcacctctagctatcaggtataaagtggcttattcatcgaattttagtgagattttggatccgataatcgaaaacaattatcagttgttcatggtggagaggctgataatgatgggtgcaaagacattcttcaaaacatttagagagtacgaaacggatctcactttgacagatgatccgaaaaagaacaagaattgggaaataccagtttacaccatggataaaggcaaagaagcagcaagctaaactatccatgatctcactagcaaagactacacaacgattcagacaagagtctcatcacttttcaattacttggagttaaaatcctaatcttgtctgaagattctattgccggtactcgaagaaatctgtgtatgtgacaccagagactaacagactagagcactttcttgctacttggctgtttcatttttgtgtaaatcaatctgtttattgttactttaatgttgattttcatcagagatagtttgtttcaaataaaacattcgagtta

SEQ ID NO: 6496 - DNA, 1813 bp, Arabidopsis lyrata
atggggctgtgtcatgggaaacctatcgaacagcaatcgaagaatctccaaatctccaatgaaatcgaagagtcacctaagaattcatctcagaaagcgaaatcttcaggctttccgttttatagtccaagtccattacctagtctcttcaaaacctcaccagctgtgtcatcctcgagcgtgagctccacgccacttcgtatcttcaagcgacctttcccacctccctcaccagctaagcatatacgagctctcctcgcgcgtcgtcacggttttgttaagcccaatgaagcttcgatccctgaaggtagtgagtgtgaggttggccttgacaagaaatttgggttctctaagcaatttgcttcacactacgagattgatggtgaggtgggtcgagggcattttgggtatacttgctctgctaaggggaaaaaaggtagcttgaaaggtcaagatgtggctgtcaaagttattcccaaatccaagatgactacggcaattgcaattgaggatgttagaagagaagtgaagatattgcgggctttgactggtcacaagaacctagtccagttctatgacgccttcgaagatgatgaaaatgtttacattgtgatggagttatgccaaggcggtgaacttttggacaagatacttcaaaggggaggcaaatactcagaagtagatgctaaaaaagtaatggttcagattcttagtgtagtagcctactgtcatcttcaaggcgtggttcatcgtgacctcaaacccgagaattttctcttcactacaaaggatgagtcttctcctctgaaagccattgattttggtctctctgactatgtcaggccagatgagaggttgaatgacattgtaggaagtgcttattacgtggcccctgaagttttacaccgtacatatggaactgaggcagatatgtggagtattggagtgattgcttatatacttctctgtggtagccggccattttgggcccgttctgaatctggaatcttccgagctgttcttaaagcagaacccaatttcgaagaagctccctggccatctatttcacctgacgctgtagattttgtgaaacgtttgttaaataaagattaccgtaagagactaactgctgcacaggctttgtgccatccttggcttgttggctcgcatgaattaaagataccatctgatatgatcatttacaagcttgtaaaagtatacataatgtcgtcggctttgagaaaatcggctttagcggctcttgccaaaactttaacagtaccgcagctgacttatttgcaagagcagtttaatctgttaggaccgagcaaaaacggatatatctctatgcagaattacaaaacagctatcttgaagagctccacagaagctacaaaggattcacgagtcttggattttgtacacatgattagttgtcttcagtacaagaaactagactttgaagagttttgcgcttcagctttaagtgtatatcagctagaagcaatggaaacttgggagcaacatgcacgccgtgcatatgagttgtttgagaaggatgggaacagagtcatcatgatcgaagaacttgccacggaactcggactcggtccatcggtgcctgttcaggttgttcttcaagattggataagacattctgatgggaagctaagtttcttggggtttgtcagactcttacacggcgtgtcctctagaacattgcagaaagcgtagagaattagattaaagatttgaaaaagaaacaaaagagaggaaatttgtaaacataattgttttgaaaaagatttgaacc

SEQ ID NO: 6497 - DNA, 1915 bp, Arabidopsis lyrata
aattgaatctaaattcgacattgtgttgttgtgtgaaaacataaagtttctctctttactcttaatttgatctccattgatggggctgtgtcatgggaaacctatcgaacagcaatcgaagaatctccaaatctccaatgaaatcgaagagtcacctaagaattcatctcagaaagcgaaatcttcaggctttccgttttatagtccaagtccattacctagtctcttcaaaacctcaccagctgtgtcatcctcgagcgtgagctccacgccacttcgtatcttcaagcgacctttcccacctccctcaccagctaagcatatacgagctctcctcgcgcgtcgtcacggttttgttaagcccaatgaagcttcgatccctgaaggtagtgagtgtgaggttggccttgacaagaaatttgggttctctaagcaatttgcttcacactacgagattgatggtgaggtgggtcgagggcattttgggtatacttgctctgctaaggggaaaaaaggtagcttgaaaggtcaagatgtggctgtcaaagttattcccaaatccaagatgactacggcaattgcaattgaggatgttagaagagaagtgaagatattgcgggctttgactggtcacaagaacctagtccagttctatgacgccttcgaagatgatgaaaatgtttacattgtgatggagttatgccaaggcggtgaacttttggacaagatacttcaaaggggaggcaaatactcagaagtagatgctaaaaaagtaatggttcagattcttagtgtagtagcctactgtcatcttcaaggcgtggttcatcgtgacctcaaacccgagaattttctcttcactacaaaggatgagtcttctcctctgaaagccattgattttggtctctctgactatgtcaggccagatgagaggttgaatgacattgtaggaagtgcttattacgtggcccctgaagttttacaccgtacatatggaactgaggcagatatgtggagtattggagtgattgcttatatacttctctgtggtagccggccattttgggcccgttctgaatctggaatcttccgagctgttcttaaagcagaacccaatttcgaagaagctccctggccatctatttcacctgacgctgtagattttgtgaaacgtttgttaaataaagattaccgtaagagactaactgctgcacaggctttgtgccatccttggcttgttggctcgcatgaattaaagataccatctgatatgatcatttacaagcttgtaaaagtatacataatgtcgtcggctttgagaaaatcggctttagcggctcttgccaaaactttaacagtaccgcagctgacttatttgcaagagcagtttaatctgttaggaccgagcaaaaacggatatatctctatgcagaattacaaaacagctatcttgaagagctccacagaagctacaaaggattcacgagtcttggattttgtacacatgattagttgtcttcagtacaagaaactagactttgaagagttttgcgcttcagctttaagtgtatatcagctagaagcaatggaaacttgggagcaacatgcacgccgtgcatatgagttgtttgagaaggatgggaacagagtcatcatgatcgaagaacttgccacggaactcggactcggtccatcggtgcctgttcaggttgttcttcaagattggataagacattctgatgggaagctaagtttcttggggtttgtcagactcttacacggcgtgtcctctagaacattgcagaaagcgtagagaattagattaaagatttgaaaaagaaacaaaagagaggaaatttgtaaacataattgttttgaaaaagatttgaacccttaattaatctctcacaaacta

SEQ ID NO: 6498 - DNA, 2128 bp, Medicago truncatula
cacatacaaaccctttataacaatgccatcttccatattttttcatcacattcaattccttctttttttggtccacatttacattcttagccaaaacatatcatattgttatatatccctctacctcaattataagcacttgagaaaaacataaattatttccactttgtttcattttgagtatacaaaccaatcaagtccttataaattttccaagagttagttacttcaatttcaatactcatggaagatcacaaaaaccaatcagtttcttttgaatcacctcaagaaagaagaaaacttccaaattttcttctatcagtgagacttaaatatgtgaaacttggttaccattacttaatctcaaaagctatgtatcttttactcataccactttttggagcagcttcagctcatttatcaactatatcataccatgatattattcaactgtatgaaaatctcaaattcaatcttgtatcagtaacactatgtactagtcttatggtatttcttgtgacactttacttcatgagtcgtccaagaggtgtatacttggttgattttgcatgttacaaaccaaaacaagaatacacatgtactagagaaattttcatgaataggtctgaattaacaggtacattttctgatgaaaatttggcttttcaaaagaaaatacttgagaggtctggtttaggtcaaaagacttatttgcccccagcaatattgagtgttccaccaaatccttgtatggctgaagcaaggaaagaagctgaggaagttatgtttggtgctattgatgagcttttggagaaaactggtgttaaggctaaggatattgggattttggttgtgaattgtagtttgtttaatcctacaccttctctttctgctatgattgtgaatcattataagttaagagggaatgttcaaagttataatcttggtggtatgggttgtagtgctggacttatctctattgaccttgctaagcagctcctacaggttcatccaaactcttatgcattagtggtgagcatggagaacatcacactcaactggtatttcggcaatgacagatcaatgttagtatcaaattgtctgtttagaatgggaggatcagcaattctcctctccaacaaagcttctgacagcaaaagagctaaataccaactgatccacaccgtccgaacacataaaggcgcggacgacagatcatatggttgtgtcttccaagaagaagatgagaagaaatcaattggtgtatcactctcaaaagatttaatggcggttgccggagaagcactgaaaaccaacatcacaacacttggtccattggtacttcctatgtcagaacagcttctgtttttcgcaactttggttgcaagaaaagctttcaagatgaagataaaaccctacattcctgattttaaattagcttttgagcatttttgtattcatgctggtggaagagctgttttggatgaattagagaaaaatcttgaccttagtgattggcatatggaaccatcaagaatgacactaaatagatttggtaatacttctagtagttcattatggtatgaattggcttatactgaagctaaagggaggattagaaaaggtgataggacttggcaaattgcatttggttctggatttaaatgtaacagtgctgtgtggcgtgcattgaggaccgttgatccagctaaggagaaaaatccatggatggatgagattcatgagtttcctgttcatgtgcctaaagtggcaaccattggttcatcaagttaggaagaaatttgtttaaggaatttaattaattccacatttaatctttaggaaagagtgtgcaaaaatacaagattaattactttcagcagatatgtttgatagtttagcagcttgttctatagtgtgttgaagttgaaacagtcataattattgtccatttgaacatttgttacatgattttttgttgccttcataaaatgtgtactatgaaattgacatttcaatgatatcttaaattcatttaaagctgcttcttgagttgaggagtgaacagatctaagaaagaaaagtgttatccaaagttgttcaggtttgactaaagttgtttcttaaa

SEQ ID NO: 6499 - DNA, 2093 bp, Cicer arietinum
atccatctcgttgtaaacacacccttaatttaaaacactctcatctttcatatttttacattacattcatttcctccttttcttttttcacatttacatgtttaggcaaacatatcatatgatatatttctagcttccaaaatttagtactttagaaccaaaaaaattattgccattaagagaaccaaaaaaaataaaaagaaaagaaaaatcacacaaagccattctcttttgaaagagttttttcaaaattttcaacaccaatggcagatgaaaagaatcaaacagtttctgttgaatctccacaagaagaaagaatgaaacttccaaactttcttctatcagtgaaactcaaatatgtgaaacttggttatcattacttaatctcaaaagctatgtatctttttcttataccactttttggagcagcttcagctcatttatcaactatatcataccatgatgttgttcatctttatgaaaatctgaaattcaatcttgtatcagtaactttatgttcaagtttaatggtatttctagtgaccctttacttcatgagtcgtccaagaggtgtttacttggttgattttgcatgttataagccaaaacaagattacacatgcacaagagagattttcatgcataggtctgagttaacaggtactttttctgatgagaatttagcttttcaaaagaagattattgagaggtctggtttaggacaaaagacttatttgcccccagcaattttgagtgttccaccaaatccttgtatggctgaagcaaggaaagaagctgaggaagttatgtttggagctattgatgagcttttggagaaaactggtgttaaggctaaggatattgggattttgattgtgaattgtagtttgtttaatcctacaccatctttatctgctatgattgtgaatcattataagttaagagggaatattcaaagttataatcttggtggcatgggttgtagtgctggacttatctctattgaccttgctaagcagctcttacaggtacatccaaactcatatgcattggtggtaagcatggaaaacataacactgaactggtattttggcaacaacagatcaatgttagtatcaaactgtcttttcagaatgggtggttcagcaattctactctccaacaaaacatcagacagcaaaagagcaaaataccaactgatccacacagtaaggacacacaaaggtgcagatgacaaatcatacggttgtgtgtttcaagaagaagatgacaaaaaaacaattggtgtttcactatcaaaagacttaatgtcagttgctggagaagctctcaaaaccaacatcacaacacttggtccattagtccttccaatgtcagaacagcttcttttttttgcaactttggttgcaagaaaagtcttcaaaatgaagattaagccatatattcctgattttaaacttgcttttgagcatttctgtattcatgctggtggaagagcagtgttagatgaattggagaaaaatcttgatcttagtgattggcatatggaaccatcaagaatgacactttatagatttggtaacacttctagtagttcactgtggtatgaattggcttatgctgaatctaaaggaagaattagaaaaggtgatagaacttggcaaattgcatttggttctggatttaagtgtaatagtgctgtgtggcgtgcattgaggaccgttgatcctcttcaggagataaatccttggatggatgagattcatcaatttcctgttcatgtgcctaaagtggcaactattacttaggtgtttgtttggggaatttttacatttaatcttttttttaggaagtgtgcaaaaatagaagaaaaagattaattacttgataaatttttagtttgccaacttgttctagtgtgttgatgttgaacaagtggataattattgtccaattgaacatttattacatgattttttcttcttcataatttttatctataatctaagtctcttgttctaaagttgttcatgtttgactaaagctgttcatttaatattgatatggttggatgtaattaatgtgaaactcat

SEQ ID NO: 6500 - DNA, 2161 bp, Cicer arietinum
agttgtatcaactaccctctcttccaactttcactctttataatcattttcacatcttccaaaaatctcacaactcaaatgatcttctcttctaccttttgtttcttattcgtattttcaatatcctcttttccaaattccacttcttttaccttaaacttttccctttcataaccaaaaaatattaatcaagtaacatttgtctttgttgtcttcttttgtggtcttttaaattttctcttttataaaaattataagcccgttacattattttatatcaaaaccaataataattctataaattaacacccttaattaatggaagaacaaagaaataaacttcctaattttctactatccgtgaaacttaaatatgtgaaacttgggtaccattatttaatttccaatgctatgtaccttgttttaattcctctacttggagtagtttcaacacatttagcaacattttcactaaaagatttaattcaattatgggaaattctaaaattcaactttgtgtcggttacactatgttcaagtttaatagtatttttagctacactttattttatgagtcgtccaagaagtatttacttagtggattttgcatgctacaaaccacaagaagattgcatttgcacaagggaaacttttattgaaaaagcatatttgtttggacaatttggtgatgaaattctttcatttcaaaagaaaattgttgagaggtcaggtttaggacaaaaaacatattttccatcgtcactaatgagagtgccaccaaattattgtatggaggaagcaaggaaagaagctgaagaagttatgtttggagcaattgatgaacttcttgaaaaaactggtgtgaaggctaaggatattggaattttgattgtgaattgtagcttgtttaatccaacaccttctctttcagctatggttgttaatcattataaattaagagggaatattttgagttataatcttggtggtatgggttgtagtgctggtcttatctctattgaccttgccaaacacctccttcaggcaaatccaaactcttatgccttagtagtaagcatggagaacataactctaaatttgtatctcggcaacaaccgatcgatgctagtgtcgaattgtctcttcagaatgggcggagccgcaatcctcctctcaaacaaaccttctgatcggcgcagatcaaaatatcaattagttcacaccgtccgaacacataaaggcgcagacgacaaatcatacggttgtgtcttccaaaaagaagacgacacgaaaaaagtcggagtagcactctcaaaagacctaatggccgttgccggagaagccctcaaaacaaatatcacaacattaggtccattagtccttccaatgtcggagcagctattatttttcgtcacattggtcggtcgaaaaattttcaagatgaaaataaagccatatatacctgattttaaattagcttttgaacatttttgtattcatgccggaggaagggcagttttggatgaattagaaaagaatcttgatttaagtgaatggcatatggagccatcaagaatgacactttatagatttggcaacacttctagtagttctttgtggtacgaattggcttatacagaagctaaaggaaggatcaaaaaaggtgataggacttggcaaattgcatttggttctggatttaaatgtaatagtgctgtttggaaggctttgaagactataaatcctgaaaaggagaagagtccttggattgatgaaattcatgagtttcctgttcatgtgcctcaagtggcaaaaattgattcttaactattaatatttatgtttgttatatctatgtttaggaatgtctttaaattgaagaaacttgtctattgtatggttagttaaatttaggagatgtggaagaattgaaaggaataactttgcctatttgtttgttcttgttatgagtagtttgcttagaattattacctcaagttgttatttatttttgttttttctttgtgttaaatgtatcaattgaccatataattaaatgtatgtcaattaattttcaaagttgtgtgttgttgactttttttttaacatgtgttaaggttataaacaaaaactatctataatatttaattcaaaatctaaa

SEQ ID NO: 6501 - DNA, 724 bp, Vigna unguiculata
aagttacggtggtgacacaagaaaacaagagagaaagcagaaagaatatgggaagattctttgtgatggagcttgagggaaggtcttatagatgcaagttttgtagtactcacttggcccttgcagatgatctcatttcaaggttgtttcattgccggaggggaaaagcatacctattcaataacgttgtcaacttcacactcggagcaccagaagaaaggcagatgctttcaggattacatactgtggcagatatcttttgctgttgttgtggtcaaataattggctggaaatacgaatctgcacacgagaagagtcaaaagtataaagaagggaagtttgttcttgaaagaggaaggatagttgatgaagttgagttctctactgaattctacatcgatagtcgtgtctgcgtgagtgatggtgacgaggcttaaaagatatgctgctggacttgttctgtatatgattaacaataaaggtgacccttgaaaaatgttcaagatcagtgaaggtttttttttcatttacatgtggtatatgaaatgagagttgccaatggtgtgtgaattgtggagaaagaaaaagatgaaacattgaaatggtagtttcagatttgctgcaaaatacttggaatgaacttgactgtgtactcggtgtcagtatagacctcttaaaagaacttatatattagtaaaaaacttgtttgaatttttctatgaag

SEQ ID NO: 6502 - DNA, 807 bp, Glycine max
acacgtgtctgtttgaacagctagtgtccattgacagtgccattgctattgttgtttctctttccatctaccgctatgagcaactcaacaaagagactgtggttacatcaaaacaaagcaaagcaaagaaagaagaaagaaaatggggagaatctttgtggtggagcttgagggcaggtcttatagatgcaagttctgcagaactcacttggcccttgcagatgatctcatctccagggcctttcattgccggagggggaaagcatacctattcaataatgccgtgaacttcacaattggaacaccagaagaaaggatgatgctttcaggattacatactgtcgcagatattttttgctgttgctgcggtcaaataattggctggaaatatgaatctgcacacgagaagagccaaaagtataaagaagggaagtttgttcttgaaagaggaaggattgttgatgaagttgatttctccactgagttctacatcgatagtcatgccagcatgagtgatgctgaagaaccttaaaacatgcgggctggccttgttggatcatgagaaagaatgcactgcttctgtatacgaacaataataatggtgacccatgaaaatgttcagaattaatagtttattttggttttgttttattagtattatatatatatatatatatatatatatatatatatatatatatatattatatgtggtatatgaaaatgagagttgccaatagtgtgtatattgtggggaaagatagagatgaaacggtagtctcagatttgctgcaaaacatatggaaa

SEQ ID NO: 6503 - DNA, 825 bp, Glycine max
gccattgctattgttgtttctctttccatctaccgctatgagcaactcaacaaagagactgtggttacatcaaaacaaagcaaagcaaagaaagaagaaagaaaatggggagaatctttgtggtggagcttgagggcaggtcttatagatgcaagttctgcagaactcacttggcccttgcagatgatctcatctccagggcctttcattgccggagggggaaagcatacctattcaataatgccgtgaacttcacaattggaacaccagaagaaaggatgatgctttcaggattacatactgtcgcagatattttttgctgttgctgcggtcaaataattggctggaaatatgaatctgcacacgagaagagccaaaagtataaagaagggaagtttgttcttgaaagaggaaggattgttgatgaagttgatttctccactgagttctacatcgatagtcatgccagcatgagtgatgctgaagaaccttaaaacatgcgggctggccttgttggatcatgagaaagaatgcactgcttctgtatacgaacaataataatggtgacccatgaaaatgttcagaattaatagtttattttggttttgttttattagtattatatatatatatatatatatatatatatatatatatatatatatattatatgtggtatatgaaaatgagagttgccaatagtgtgtatattgtggggaaagatagagatgaaacggtagtctcagatttgctgcaaaacatatggaaagaacttggctgttaacttggtgtctaattgtctatataggacctcttcaacgctgg

SEQ ID NO: 6504 - DNA, 881 bp, Cajanus cajan
atatataaaaaataataagttatttcagtaagaattttggcgagcaggaacagcaacacgtgtctctttcaacaggagtgttccattgacagttccactgctatgctaatattgttccttctctttccatctacccttctgagcaattcaacatagtgacggtggtgacgtcaaaattcgaagccaatagaaagaagatgggaagaatcttcacggtggagctcgagggcaggtcttatagatgcaagttctgcagaactcacttggcccttgcagatgatctcatctccagggcgtttcattgccgcaggggaaaagcatacctattcaataatgctgtgaacttcacaattggagcatcagaagaaaggatgatgctttcaggattacatactgtggcagatattttttgctgttgctgtggtcaaataattggttggaaatatgaatctgcacacgagaagagtcaaaagtataaagaagggaagtttgttcttgaaagaggaaggattgttgatgaagttgatttctcagctgaattctatatcgatagtcgtgcctgcatgagtgatactgaagatgcttaaaacatgctagccttgttggataaggagaaagaatgtactacttgtgtgtatggacaataataatggtgacctgagaaagtgttcaaaattaatatagattattttggttttagtttttattttactttatttttagtagtacatgaaaattgaaaatgagagttgtcaaatgtcaatggtgtgtaaaagtaaaacattggaaaagaaagagatgaaatggtaatttcagattttctgcaaaatatttggctctttacttggtgtctgtatagaacctcttcaaaggtggaggca

SEQ ID NO: 6505 - DNA, 847 bp, Arachis hypogaea
gcagtggtatcaacgcagagtctcttctgttcgtacacagcacaattgacttttcgtctaccctttgggtggtggttacaacaaagaagagcttctcagaacctcctccttcaacaaaaataaagatctcaaacgacgatgggaagagtgtttgtggtggagcttgagggaagatcttatagatgcaagttctgcaaaactcacttggcccttgctgatgatctcatctctcgggcatttcattgccggaggggaaaagcatatctcttcaacaatgctgtgaacttcacaatgggtgtactagaggaaaggatgatgctttcaggactgcataccgtggctgatattttttgctgttgctgtggtcaaataattggttggaaatatgaatcggcgcatgagaagagccaaaagtataaagagggaaagtttgttcttgaaagagggaggattgttgatgagattgatttctccactgaattctacattgacacccgtgccagcatgagcgatggtgaagattagcatcctaaatcttctgtacctgttggacccggggaaagaacagtgcactgttttctgtacatgaaaataaaaatggtgaaccatgaaaatatttataatcaagaaagttcgttatgctcttttttcctccttctcctcctagaagtagcaatgtggcgtatgatgaaagggttctgaatagtgtgtataatgtgtgaaaggaaaaatatgaaaaagttgtttcagatttttctctagaagacatgaaggagacacatgtccatcatgattcaaatatactctgacagattaccataatgcacgaagcattatcggtttttta

SEQ ID NO: 6506 - DNA, 900 bp, Arachis hypogaea
gggggggaggagtcttcacttccaagttcttctgttcgtacagaacacaattgacttttcttctgccctttgggtggtggttacaacaaagaagagcttctcagaacctcctccttcaacaaaaatcaagaactcaaacaacgatgggaagagtgtttgtggtggagcttgagggaagatcttatagatgcaagttctgcaaaactcacttggcccttgctgatgatctcatctctcgggcatttcattgccggaggggaaaagcatatctcttcaacaatgctgtgaacttcacaatgggtgtactagaggaaaggatgatgctttcaggactgcataccgtggctgatattttttgctgttgctgtggtcaaataattggttggaaatatgaatcggcgcatgagaagagccaaaagtataaagagggaaagtttgttcttgaaagagggaggattgttgatgagattgatttctccactgaattctacatcgacacccgtgccagcatgagcgatggcgaagattagcatcctaaatcttctgtacctgttggacccgggaaaagaacagtgctttgctttctgtacatgaaaataaaaatggtgaaccatgaaaatgtttataatcaagaaagttcgttatgctcttttttcctccttttcctcctagaagtagcaatgtggcgtgtgatgaaagagggttctgaatagtgtgtataatgtgtgaaaggaaaaatatgaaaaagttgtttcagatttttctctagaagacatgaaggagacacatgtccatcatgattcaaatatactctgacagattaccataatgcacgaagcattatcggttttttagagatgtttttgtttggtaaatgagtaaatcaaaagaattatgatc

SEQ ID NO: 6507 - DNA, 820 bp, Arachis hypogaea
gaggagtcttcacttccaagttcttctgttcgtacagaacacaattgacttttcttctgccctttgggtggtggttacaacaaagaagagcttctcagaacctcctccttcaacaaaaatcaagaactcaaacaacgatgggaagagtgtttgtggtggagcttgagggaagatcttatagatgcaagttctgcaaaactcacttggcccttgctgatgatctcatctctcgggcatttcattgccggaggggaaaagcatatctcttcaacaatgctgtgaacttcacaatgggtgtactagaggaaaggatgatgctttcaggactgcataccgtggctgatattttttgctgttgctgtggtcaaataattggttggaaatatgaatcggcgcatgagaagagccaaaagtataaagagggaaagtttgttcttgaaagagggaggattgttgatgagattgatttctccactgaattctacatcgacacccgtgccagcatgagcgatggcgaagattagcatcctaaatcttctgtacctgttggacccgggaaaagaacagtgctttgctttctgtacatgaaaataaaaatggtgaaccatgaaaatgtttataatcaagaaagttcgttatgctcttttttcctccttttcctcctagaagtagcaatgtggcgtgtgatgaaagagggttctgaatagtgtgtataatgtgtgaaaggaaaaatatgaaaaagttgtttcagatttttctctagaagacatgaaggagacacatgtccatcatgattcaaatatactctgacagattacca

SEQ ID NO: 6508 - DNA, 1105 bp, Glycine max
attaatattaatattttttttgtttaaataagaatttctgggagcaggaacaccaacacgtgtctgtttgaacagctagtttccattgacagtgccagtgctattgttgtttctctttccatccactgccatgagcaattcaacaaagtgacggtggtgacatcaaaaccaacacaaagcgaagaaagaaaatgggaagaatctttgcggtggagcttgagggcaggtcttatagatgcaagttctgcagaactcacttggcccttgcaaatgatctcatctccagggcctttcattgcctgaggggaaaagcatacctattcaataatgtcgtgaacttcacaattggaacaccagaagaaaggatgatgctttcaggattgcatactgtggctgatattttttgctgttgctgcggtgaaataattggctggaaatatgaatctgcgcacgagaagtgtcaaaagtataaagaagggaagtttgttcttgaaagaggaaggattgttgatgaagttgatttctccactgagttctacatcgatagtcatgccagcatgagtgatgctgaagaaccttaaaacatgccggcattgttggatcaggagaaagaatgcactgcttctgtatatgaacaataataatggtgacccgtgaaaatgctcaaaattaatgaagtttattttggttttggttttattatttataagtggtgtatggaaatgagagttgccagtagtgtgtaaactatggggaaagaaagagatggaacggtagtttcagatttgcttcgaaatatttggaaagaacttggctatttactttgtgtttatatagaacatcttcaacgctggaggcagcaagcatatgtttgaacgcttagaagttaaaacaccgtgtgttatgcttggattagaagtaaaatagagaaaagaaaaagaaagataaaagtagaaggcaaatagaatagaaaagatatgttaaaataaattgaaataaggagaaaagaaatagagtaattttctttggttttttggaggactgaataatttgctgctgtcatcgagaattctgtaacattggtgttgatgccttattccaaaaa

SEQ ID NO: 6509 - DNA, 1165 bp, Glycine max
gggaaattttcatagactcgtgtatataacatgccatcaaatacatggttaggaatccaactatctgctaactttgaaacttgttggatgagaatttctgggagcaggaacaccaacacgtgtctgtttgaacagctagtttccattgacagtgccagtgctattgttgtttctctttccatccactgccatgagcaattcaacaaagtgacggtggtgacatcaaaaccaacacaaagcgaagaaagaaaatgggaagaatctttgcggtggagcttgagggcaggtcttatagatgcaagttctgcagaactcacttggcccttgcaaatgatctcatctccagggcctttcattgcctgaggggaaaagcatacctattcaataatgtcgtgaacttcacaattggaacaccagaagaaaggatgatgctttcaggattgcatactgtggctgatattttttgctgttgctgcggtgaaataattggctggaaatatgaatctgcgcacgagaagtgtcaaaagtataaagaagggaagtttgttcttgaaagaggaaggattgttgatgaagttgatttctccactgagttctacatcgatagtcatgccagcatgagtgatgctgaagaaccttaaaacatgccggcattgttggatcaggagaaagaatgcactgcttctgtatatgaacaataataatggtgacccgtgaaaatgctcaaaattaatgaagtttattttggttttggttttattatttataagtggtgtatggaaatgagagttgccagtagtgtgtaaactatggggaaagaaagagatggaacggtagtttcagatttgcttcgaaatatttggaaagaacttggctatttactttgtgtttatatagaacatcttcaacgctggaggcagcaagcatatgtttgaacgcttagaagttaaaacaccgtgtgttatgcttggattagaagtaaaatagagaaaagaaaaagaaagataaaagtagaaggcaaatagaatagaaaagatatgttaaaataaattgaaataaggagaaaagaaatagagtaattttctttggttttttggaggactgaataatttgctgctgtcatcgagaattctgtaacattggtgttgatgccttattccaaaaa

SEQ ID NO: 6510 - DNA, 495 bp, Glycyrrhiza uralensis
gacttccttttgattttgaactaagtgtcttcgctgtgatcgacagtaacatcagtgagtattcaaatcctttgagtcgagtctttatcaaaacaaaacacaaatctgaaagaacatgggaagaatctttgtggtggagctggagggaaggtcttatagatgcaagttctgcagaactcacttggcccttgttgatgatctcatctctcgggcatttcattgccggaggggaaaagcatacctattcaataatgctgtgaacacaacagttggagcaccagaagaaaggatgatgctttcaggattgcatactgtggcagatatcttttgctgttgctgtggtcaaataattggttggaaatatgaatctgcacatgagaagagtcagaagtataaagaagggaagtttgttcttgaaagaggaaggattgttgatgacgttgatttctcagccgagttctacattgatagtcatgccagcatgagtgatgctga

SEQ ID NO: 6511 - DNA, 703 bp, Medicago truncatula
caccaactggtctctatctatctaatagtacattttctccaacgcatcatcaaattcaatatctgaattctgaaacttccattcccttttgaagtgagagaaaatgggaagaatctttgtggttgagctggagggcaggtcctatagatgcaaattctgcagaactcatttggcccttgctgatgatctcatttctcgggcgtttcattgtcggagggggaacgcatacctattcagtaaagccgtgaacaccacaactggaacaccggtggaaaggatgatgctttcaggattgcacactgtgacagatatcttttgttgttgctgtggtcaaattgttggctggaaatatgaatctgcacatgagaagagtcagaagtataaggaagggaagtttgttcttgaaagaggaaggattgttgacgatgttgattcctcaacggagttttatatcgatagtcatgtcagcatgagtgatggcgaagatgcttagcatcttgaaaccttgtggagtaacttattggatcttgagaaaagatattgctcttcctctatacatgaacaatgataataacggcgaccagagaaaatgcttagaatcaaagaagttttcttttagttttttccttttgtttatatgacaaaagagaaatctcaatggtgtataaacagtgttgaaggaatgagatggaacagttttttt

SEQ ID NO: 6512 - DNA, 860 bp, Medicago truncatula
tagtacattttctccaacgcatcatcaaattcaatatctgaattctgaaacttccattcccttttgaagtgagagaaaatgggaagaatctttgtggttgagctggagggcaggtcctatagatgcaaattctgcagaactcatttggcccttgctgatgatctcatttctcgggcgtttcattgtcggagggggaacgcatacctattcagtaaagccgtgaacaccacaactggaacaccggtggaaaggatgatgctttcaggattgcacactgtgacagatatcttttgttgttgctgtggtcaaattgttggctggaaatatgaatctgcacatgagaagagtcagaagtataaggaagggaagtttgttcttgaaagaggaaggattgttgacgatgttgattcctcaacggagttttatatcgatagtcatgtcagcatgagtgatggcgaagatgcttagcatcttgaaaccttgtggagtaacttattggatcttgagaaaagatattgctcttcctctatacatgaacaatgataataacggcgaccagagaaaatgcttagaatcaaagaagttttcttttagttttttccttttgtttatatgacaaaagagaaatctcaatggtgtataaacagtgttgaaggaatgagatggaacagtttttttagatttgcagcaaaatctttagaaaggacttgtttagaatctttctcatgtttaaaatgataaccctactcattgggctttcaatgaatatggttatcattctaaacgtttagaatccagttgggtgacaatgttctagaaagaaatctttctctaacatactcatgacttgcacattctca

SEQ ID NO: 6513 - DNA, 816 bp, Trigonella foenum-graecum
gaattctgaaacttccattccttttgaagtgagagaaaatgggaagaatctttgtggtggagctggagggaaggtcctacagatgcaagttctgcagaactcacttggcccttgcaaatcatctcatctctcgggcgtttcattgccggaggggaaaagcatacctattcactaatgctgtaaacaccacaactggaacgcccgaagaaaggatgatgctttcaggattgcatactgtggcagatatcttttgctgttgctgtggtcaaatagttggctggaaatatgaatctgcacatgagaagaatcagaagtataaggaagggaagtttgttcttgaaagaggaaggattgttgacgatatcgatttctcaactgaattctttattgatagtcatgccagcatgagtgatggtgaatatgcttagcatcttgaaaccttatggatgcgagcaacataataacggcaacccgagaaaatgttcagaatcaaggaagtttttttttttttaaatatgacagaagagaaatctcagtgttgtgtaaactgtgtggaaggaaaaagatgcatcatgaaagagttgtttctgatttgctgcaaaatctttagaaataacttgtttaaaataagattcaaacttcaatgctccaataaacacaaataaactatccacctttgcttgcaaaatatagatcaatgtaactcattctgattaactttataaggtataaccattataattagtgcctaactaaccatggtatcaagttatttcactagtgcagtgagtaatatctaatactcacttgatgact

SEQ ID NO: 6514 - DNA, 795 bp, Cyamopsis tetragonoloba
ttgttggagcttgagggaaggtcctacagatgcaagttctgcaaaactcacttggctctagcagaggatctcatctctcgggcatttcattgccggaggggaaaagcctacctattcaataatactgtgaacgtcacaattggagcatcagaagaaaggatgatgctttcaggattacatactgtggcagatattttttgctgttcctgtggccaaataattggctggaaatatgaatctgcacatgagaagagtcaaaagtataaagaagggaagtttgtacttgaaagagggaggattattgatgaagttgatttctccactgatttttacatcgatagtcgcgccagcatgagtgatgctgaagatgcttagcatcttgaaacccgttgttggattatgcggaaaaaatgcactgcttctgtaaatgaacagtaataatggtgatccatgaaactgtccaaatcaagaaaatttatttagtttatgatcacaagatgagttatcaatgtttgtgtgtaccctttgtccaagagaattgatctgatgaaacagatgtttcagatttggtggttaatctttggaaagaaaaaaaagctggaaccaaatcttcccttgatgctgtctcttgagaatgtgtctgatccaaaacaaactgtagagtgctctctttcttttcctgtcatgttgtacttggagcatttagtgcatatgaacactggaaaggttcacggatggctttgtgtggtttaatgtatatcggtccgtgaaactggggaattgtttcttctcccc

SEQ ID NO: 6515 - DNA, 775 bp, Gossypium raimondii
tccaaattttcttttaacaccttttctccatcgtagaaactagaatccaagattttgccatagcagtgtaaagaacaaaaggaaaaaagagaagaaaagaaaagaaaagaatatatatataaagaggaaaaatgggaaggatatttgtggttgagcttgatggaaggtcttatagatgcaagttttgtagaactcacttggctctccctgatgatcttgtttccaggtctttccattgtcgccgggggaaagcctacctcttcaataatgcggtgaacataacagttggagccttggaagagagggtgatgctatctggaatgcatactgtggctgatatattttgctgctgttgtggacaaattgttggctggaaatacgaggctgcacatgagaagagtcaaaagtacaaagaaggaaagtttgttcttgagaggggaaggatcgtggatgaaattgacttctcgtcggaagtatacattgatacccgtcctagtatgagcgatggcgaagacgcgtaggatgtaaaccactgtttctgagctagatctagaaatataatatagtagcagcaggtgtaatgtatgtacatacatatatgcaaggaaataatgtaagaaattggcgtggaagatttggtgtttgcaacttgatccatctgacaaagtacttgtatgttagttccatgatgtgtctggtacaaacattcttatgttctgttgggcatgcatataactcaagattcaggctttatcaaagttcctttttttagttg

SEQ ID NO: 6516 - DNA, 749 bp, Lotus japonicus
ggggtagtaaacagtgagcggtgagtcggttgcatcaaagggtctctcaaaatcgaagaaaatgggaagaatctttgcagtggagctggagggtaggtcatatggttgcaagtcttgcaaaacccacctggcactcgcagatgatctcatctctcggggattttattgccagcggggaaaagcatacctcttcaataatgttgtgaacttcacaattggagagctagaggaaagggcgatgctttcaggattgcacaccgtggcagatattttttgctgttgctgtggacaaataatcggctggaaatatgaatctgctcatgagaagagccaaaagtataaagaggggaagtttgttcttgaaagaggaaggattgttgatgaaattgatttctccactgaattccgcgtggacagctgtatcagcatgagtgattctgaagatgcttaagcatattaaaatcatctgtacttgttgaatcaggtgaaagaagcgttgttgtgttatgtgaaaaataaggtagaaccatgaatgtgttcagagtcagaataagagtgagtttttcttttttacaatttgtttgttgtagtagtagtagtaaatagaatgtagagttctcaatggtgtgtaatgtcagtggacagaaggaaatgaaaccatttgtttcagatttgcccctagctctttttcaaacagaggcgaggctagaaatgtaacttaattttttttctttttattatataagaat

SEQ ID NO: 6517 - DNA, 943 bp, Castanea mollissima
cctatcccctgtgtgccttgcctaccacctgttgcgtgtctcaggggaacaaaagggtaaaagctcgtttgattctgatttccagtacgaatacgaaccggtaaatttatataccgggcctagctttagcaagtggctaacacgcgtgtggccactgcacagtcacactatctttcatcttagttctaatccagtagtttcagatatctcttaaaaaaagttttgatttttgcaatttggtgaagtgggtatccagtaaaagaaagcaagcagggaggtgatatagatgggaaggatatttgtggtggagctggagggaaggtcatacagatgcaaattctgcaagacccacttggctcttgctgaagatcttgtctctcgggcttttcattgtcgacggggaaaagcatacctcttcaataatgcggtgaaccttatagttggagcattagaggagaggctgatgctttccggtttgcatactgtggcagacatattttgttgctgttgtggacagattgtcggctggaaatatgaggctgcacatgagagaagtcagaagtataaggaagggaagtttgttcttgaaagagggaggatcgttgatgaagttgactttgctactgaattctatattgatacccgccctagcatgagcgacgctgaagatgcataggatccaacttcatttctttaaatagttctactagacatttagactattcagaagagatttattgcttgtgtatataactcactaaatttgaactgtgattgttgctatccttctgggaacttttttttagattgagctccacaacctacattgattatgctaccacctataacatgtcaagttttactgttcatcatccaggtggacgggacggtaagtttagtttttttggcgactaataagtaaaagtttaaaggttttaaaaaa

SEQ ID NO: 6518 - DNA, 637 bp, Gossypium hirsutum
tgggaaggatatttgtggttgagcttgatggaaggtcttatagatgcaagttttgtagaactcacttggctctccctgatgatcttgtttccaggtctttccattgtcgccgggggaaagcctacctcttcaataatgcggtgaacataacagttggagccttggaagagagggtgatgctatctggaatgcatactgtggctgatatattttgctgctgttgtggacaaattgttggctggaaatacgaggctgcacatgagaagagtcaaaagtacaaagaaggaaagtttgttcttgagaggggaaggatcgtggatgaaattgacttctcgtcggaagtatacattgatacccgtcctagtatgagcgatggcgaagacgcgtaggatgtaaaccactgtttctgagctagatctagaaatataatatagtagcagcaggtgtaatgtatgtacatacatatatgcagggaaataatgtaagaaattggcgtggaagatttggtgtttgcaacttgatccatctgacaaagtacttgtatgttagttccatgatgtgtctggtacaaacattcttatgttctgttgggcatgcatataactcaagattcaggctttatcaaagttcctttttt

SEQ ID NO: 6519 - DNA, 643 bp, Tropaeolum majus
ttataaacaaaatgggaagaatatttgtggtggagctggagggaagatcttacagatgcaagttctgtagaacccacttagctctccctgatgatcttgtttctcgggcttttcattgtcgacgaggaaaagcataccttttcaataaagcggtgaacatcagtatgggtgttttggaggaaaggatgatgctttcaggaatgcacacggttgcagatatatattgttgctgttgtggacagattatcggctggaaatacgagtctgcccacgagaaaagccaaaagtacaaggaaggaaaatttgttctcgaaagaggaaggattgtcgacgaaatagacttctcaactgaagtttacatcgatacccatcttagtatgagcgatgctgatgctgatgccaatgacgcatagtacttactacctaagttttggttcagaaactaaaaaaggtgtgaatatttatgaacgtttgaaactacatgtgtgatttgtttttcgcaaaatcgccaaatttctggtttggtttatttggaggatcaagagagcttttttttgtttattgagctgtttgttttctttgtaattaaaatcgatgcatgttttcttgaaaaaaaaaaaagttatggtgagagtggaaagaa

SEQ ID NO: 6520 - DNA, 861 bp, Lupinus angustifolius
acattgtgtcattatatttaaaaataaattaaaaaataaatataggaacacttgttccttcaccatctctcaaatttgttcacttggaaattgttgtgtaccaccttggggtagtgaacggtgaagataatgggaagaattttcacggtagaattggaaggcaggtcttatggttgcaaattctgcaaaacccacctcgcccttgctgatgatctcatctctcgggcattttattgccagcggggaaaagcatatctcttcaacaatgttgtgaacttcacaatcggagaacttgaagaaagactgatgctttcggggttacatactgttgcggatattttttgctgttgctgtggtcaaataattggctggaaatatgagtttgcacatgagaagagccaaaaatataaagaagggaagtttgttcttgaaagaggaaggattgttgatggaattgatttctccgcagctgaattctttatcgagagccgtgccaacatgagtgatgctgaagatgcttagcatttaaaatgttatgcacttgttggatcagtgttgcttgaaagtagaaccttgaaggctcttcaatattagtatttgagtcatggctgcagtttaaggccacaagtaaacaactatctgcatgcgtttacattaaaaaattcacctcataaagttatccttaggcatgaacaattaagccgtagtaaaacagtgatttatcaatatatattatggaaacagggatacagtaagttaagaattgtgagtactgagtagcatccttttttattttagaaaaacaattaagcctttatttaaaatcaattttatacttataaacaataaagattaatttta

SEQ ID NO: 6521 - DNA, 671 bp, Prunus persica
gcactgtgtcaaattctcctctctctcattctcatatatctgactttggctttggcattttgcataggtgggttgtaaatctcagagatcatatatattggtagtgaatcttattactataaagaaagctgaggaaaagatgggaaggatatttgtggtagagctggagggaaggtgttacaaatgcaagttctgcaagacccatttggccctcgtctccgactgtgtctctcggtcttttcattgccgccggggaaaagcatacctcttcaataatgcggtgaataccactattggagcattagaggagaggttgatgctctcaggtctccatactgttgcggatatattttgctgctgttgtggacaaatcgttggctggaaatatgaatcggcacatgagaagagccagaaatacaaagaggggaagttcgtccttgagagagggaggatcgtcgatgaagtagatttttcgacagagttctttgttgattctcgtcctagcatgagtagtgatgctgatgatgtttaggatctgaatttcgttccctgagtagttcgtaccagacactaggcaaggcaatacatgcagaacagctgcactgtttttctgtacttgtaatagtattcgaataaatgacttaataaaaaggatatttgaatgactcaga

SEQ ID NO: 6522 - DNA, 842 bp, Phaseolus vulgaris
agaatccttcacaggtctctttctctctctgtcttcatagttcatacgaatcttcacttgtataattgtttttttttaccttggtaagcgaatgttgaaaaatagtgagtggtggtgacatcaaagggtgtctttcaaaaccgaagaaaatgggaagaatcttcacggtggagctggagggcaggtcctacggttgcaagtcctgcaaaacccacctagcccttgctgatgatctcatctctcgggcattttattgccagcggggaaaagcatatctcttcaataatgttgtgaacttcacgattggagtgctagaggaaaggatgatgctttctggacttcatactgtggcagatatcttttgttgttgctgtggtcaaatagttggctggaaatatgagtctgcacatgagagaagccaaaagtataaagaggggaagtttgttcttgaaagaggaaggattgttgatgaaattgatttctccgctgaattccatattgagagctgcgtcagcatgagtgatgctgaagatgcttaatcatattaaaatattcggcacttgtcagatcatgtgaagaagaatggacagtttttttatatatgaaaataatgtagaaccatgaaatgttcagaatcaaactttgtcatgctatttcttagtaatagttggtaaaaaagaagtacaattctcaatggtatttaatctgtgtagacagaaagagatgaatcaactgtttcagattttaccttcttttttgcaaagatcttcattataacctacctaaagtcagatatgagctccctttatattttcttcaatataaatagtcatattcaaatg

SEQ ID NO: 6523 - DNA, 1075 bp, Phaseolus vulgaris
gaaaagagaaaagaaaaaaatcttcgttgaatttttcatcctaccagtaactcagtaccacgtgaccgttttcctctctcttctgctagaatccttcacaggtctctttctctctctgtcttcatagttcatacgaatcttcacttgtataattgttttttttaccttggtaagcgaatgttgaaaaatagtgagtggtggtgacatcaaagggtgtctttcaaaaccgaagaaaatgggaagaatcttcacggtggagctggagggcaggtcctacggttgcaagtcctgcaaaacccacctagcccttgctgatgatctcatctctcgggcattttattgccagcggggaaaagcatatctcttcaataatgttgtgaacttcacgattggagtgctagaggaaaggatgatgctttctggacttcatactgtggcagatatcttttgttgttgctgtggtcaaatagttggctggaaatatgagtctgcacatgagagaagccaaaagtataaagaggggaagtttgttcttgaaagaggaaggattgttgatgaaattgatttctccgctgaattccatattgagagctgcgtcagcatgagtgatgctgaagatgcttaatcatattaaaatattcggcacttgtcagatcatgtgaagaagaatggacagtttttttatatatgaaaataatgtagaaccatgaaatgttcagaatcaaactttgtcatgctatttcttagtaatagttggtaaaaaagaagtacaattctcaatggtatttaatctgtgtagacagaaagagatgaatcaactgtttcagattttaccttcttttttgcaaagatcttcattataacctacctaaagtcagatatgagctccctttatattttcttcaatataaatagtcatattcaaatgtgatatgggggcaacagattcaagatccattgtaattatgccagactgttagatgtagtatattattattaggtacctatgaagcactgatgctactgggattttttttttccaaagtagtgtaattttattccaaattttcacaaa

SEQ ID NO: 6524 - DNA, 472 bp, Euphorbia peplus
gttgaggtgagatgggaagaatatttgcggtagagttagaaggaaggtcatacagatgcaagttttgctcaacccacttagcacttcctcttgatctcgtctccaggtcttttcattgtcgcaggggaaaggcttacctcttcaattccgtggtgaacattacagttggagcaatcgaggagagaatgatgctttccggattacatactgtcgctgatatcttttgttgctcttgcggacaaatcctaggctggaaatatgaggcagcacatgaaaaaggccaaaagtataaagaaggcaagtttgttcttgaaagagggaggattgttgatgagatggacttgtcaccgggaattttcattgacagccggacaggtatgagcgatggtgaagatgcctagcgtaggatacactattttcatattgtaaacgatacctgtgcaaaaataatgtactgtgtaaagtgtatatg

SEQ ID NO: 6525 - DNA, 645 bp, Heritiera littoralis
ctcctacaatccttatcagcaccaaccactgttatcatcaaatctactcctcatgtacctgcctgtgtcacccatttagaaagtgagattttgccatagcagagagaatgggaaggatttttgtggttgagcttgatggaaggtcttatagatgcaggttctgcaaaactcacttagctctccctgatgatcttgtttccaggtctttccattgtcgccgagggaaagcctacctcttcaataatgtggtgaacataacagttggagtcttggaagagaggctgatgctttctggaatgcatactgtggcagatatattttgctgctgttgcggacaaattgttggctggaaatacgaggcagcacatgagaagactcaaaagtacaaagaaggaaagtttgttctcgagagggggaggatcgtcgatgaaatcgacttctcatcggaagtatacatcgacacccgtcctagtatgagtgacggcgaagatgcttagaatattacatctgtctctgaagtagatctactaagagcaggtgtaatttttgttcatatctaataatgtaataattgccatggaagagtaggtattgtaacttgattcctttgacaaattcacatgtttgtctctatagctactctca

SEQ ID NO: 6526 - DNA, 653 bp, Quercus alba
gacacgcatgtggccactgcacagtcacactttgttcatcttactttcagatatctcttaaaaaaagctttgatttttgcaatttggtgaagtgggggtatccagtaaaagaaagcaagcagggaggtgatatagatgggaaggatatttgtggtggagcttgagggaaggtcatacagatgcaaattctgcaagacccacttggctcttgctgaagatcttgtctctcgagcttttcattgccgacggggaaaagcatacctcttcaataatgcggtgaacctcatagttggagcattagaggagaggctgatgctttctggtttgcatactgtggcagacatattttgttgctgttgtggacagattgtcggctggaaatatgaggctgcacatgagagaggtcagaagtataaggaagggaagtttgttcttgaaagagggaggatcgttgatgaagttgactttgctactgaattctatattgatacccgccctagcatgagtgacgctgaagatgcttaggatccaacttcatttctttaaatagttctactagacatttagactattcagaagagatttattgctcatgtatataactcaataaattttaactgtgattgttgctatccttttgggaattttctttt

SEQ ID NO: 6527 - DNA, 814 bp, Glycine max
aaaaccgatgaagaaataaaagaaaaaaaaaatctctgttgaacttttgatccgaccagtaactcagtaacacgtgaccgtttcctctctctcccttgctagaatccttcgtacccatctctgtctctctctctctctcttcgtagttcatagtaatctcttcatttgtataattggttttacctgggacagtgataatagtgagtggtggcatcaaaatcaaagggtgtctttcataaacgaagaaaatgggaagaatcttcacggtggagcttgagggtaggtcttacagttgcaagtcctgcaaaacccacctagcccttgcagatgatctcatctctcgttcattttattgccagcggggaaaagcatatctcttcaataatgttgtgaacttcacaattggagagctagaggaaaggttgatgctttcgggactgcatactgtggcagatattttttgttgttgctgtggtcaaatagttggctggaaatatgagtctgcacatgagagaaaccaaaagtataaagaggggaagtttgttcttgaaagagggaggattgttgatgaaatggatttctccactgaattccgtattgagagttgtgtcagcatgagtgatgctgaaaatgcttaaactttttaaaatcttctgtacttatcagatcaggtgaaagaatcgacttttttcctttttctttttatgtgaaaataaagtagaaccatgaaatgtttagaatctaaatttgttttactatttatttatagtaataacaggtaattaaaagaagaagaattctcaatggtgtttaa

SEQ ID NO: 6528 - DNA, 666 bp, Glycine max
gtaacacgtgaccgtttcctctctctcccttgctagaatccttctgataatagtgagtggtggcatcaaaatcaaagggtgtctttcataaacgaagaaaatgggaagaatcttcacggtggagcttgagggtaggtcttacagttgcaagtcctgcaaaacccacctagcccttgcagatgatctcatctctcgttcattttattgccagcggggaaaagcatatctcttcaataatgttgtgaacttcacaattggagagctagaggaaaggttgatgctttcgggactgcatactgtggcagatattttttgttgttgctgtggtcaaatagttggctggaaatatgagtctgcacatgagagaaaccaaaagtataaagaggggaagtttgttcttgaaagagggaggattgttgatgaaatggatttctccactgaattccgtattgagagttgtgtcagcatgagtgatgctgaaaatgcttaaactttttaaaatcttctgtacttatcagatcaggtgaaagaatcgacttttttcctttttctttttatgtgaaaataaagtagaaccatgaaatgtttagaatctaaatttgttttactatttatttatagtaataacaggtaattaaaagaagaagaattctcaatggtgtttaa

SEQ ID NO: 6529 - DNA, 614 bp, Carpinus betulus
aaaaaatttactggttttgcaatttgtagaggtgggtagatagtaaaaagaaagaaggaggaggaggagatgggaaggctatttgtggtggagttggaaggaaggtcatacagatgcaagttctgcaagacccacttggctctcgctgacgatcttgtctctcggggttttcattgccgccgaggaaaagcatacctcttcaataatgcggtgaacctcattgttggagcattagaggagaggatgatgctctctggattgcatacggtcgctgatattttttgttgctgctgtggacagatagttggctggaaatatgacgctgcacatgagaggagccagaagtataaagaagggaagtttgttcttgaaagagggaggattgttgatgaaattgacttttctaatgaattctatatcgatacccgccccagcgtgatgagtgatgctgaagacgtttaggatccaactttttctttaaagagatttagacagttgagaagagatttactgcttatgtgtatgattaaataatgtttaaattatgtaaattgttgcgatccttgggttatataatgtttgagttgcgtgggactgccacttgaaggaaaacc

SEQ ID NO: 6530 - DNA, 801 bp, Prunus mume
aaatcacaaaaaatgggatatatactatactatgatactgtatttgctaagtattttgggtgttgggagaactgccattctatactaggggaccgcacagcacggtggcactgtgtcaaattctcatctctctcattctcgtatatctgactttggctttggcattttgcataggtgggttgtaaatcttagagatcatatatattggtagtgaatcttattgctataaagaaaactgaggaaaagaagatgggaaggctatttgtggtagagctggagggaaggtgttacaaatgcaagttctgcaagacccatttggccctcgtctccgactgtgtctctcggggttttcattgccgccggggaaaagcatacctcttcaataatgcggtgaataccactattggagcattagaggagaggttgatgctctcaggtctccatactgttgctgatatattttgctgctgttgtggacaaatcgttggctggaaatatgaatctgcacatgagaagagccagaaatacaaagaggggaagttcgtccttgagagagggaggatcgtcgatgaagtagatttttcgacagagttctttgttgattctcgtcctagcatgagtagcgatgctgatgatgtttaggatctgaatttcgttccctgagtagtttgtaccagacactaggcaaggcaatacatgcagaacagctgcactgtttatatgtaaatgacttaataaaaaggatatttgaatgactcatgtgaagtgtttgaggtaaaagttatgccttttcagttttca

SEQ ID NO: 6531 - DNA, 1243 bp, Vigna unguiculata
ggagatggaggacgccgtggcagttattcctggattcatgtctcgtacgtgcgatcacgtcggcggttgtaccgctcccggctccagatcctccggcgagatctctcccgttcatttcttcggcgtttacgacggccatggtggctcacaggtggctaagttctgtgctaagcggatgcacgatgttatagcagaggagtggaaccgagaaatggcaggtggggctgagtggcagagaagatgggaaaccgtatttgctaacagttttgagaggactgacaatgaaatcctatcagacgcagttgcacctgaaatggttggatctactgcctctgtggtggttctatctggttgccaaattattgcatccaactgcggcgactcaagggtagttctttgccgcaggacacaaacaatccccttgtcagtggatcaaaagccggatagacaagatgaactcttgagaattgaaggagaaggaggaaaagtcataaactggaatggagctagggtgtttggtgtgcttgccatgtccagggccataggtgatcggtatttgagaccatggattattcctgtgcctgagataactttcacagctagaacagacgaggatgagtgcttaattttggcaagtgacggactctgggatgtaatgagtaatgaagaggttggagaagtggcacgccacattcttagaagacgccgcagatccttgtcagtggaggaaccgtctcctgcacaagttgttgccgacagcctgactgaaattgcatatggtagaaatagtaaagataacatttcgatcatagttgttgatctgaaatccaagagaaaacgtcagcaaaggcctcctttaatttcctaagaatctgtttctcttcaatcttgagaaggacaaagagacggtaatgaagttgtagagttgatctataaacaaacctctttctttttttttttttctatttttcatatgacccccttagtacttggtatcacttcaccttgtgtctttctcctaacctgctgtacagtacagagctgattgggaaaaaagaatctgcttcatgacgagtcacaactagctagggctggcttgttgtaacgaagtatatagatcactactatttttccttttccatttgctccttcctgaacggttatgtggataacagaatgaaatgccatcaattgtattgtttgaatttcttttagtgaaagaaatggaataaaatatggtgaa

SEQ ID NO: 6532 - DNA, 1361 bp, Cajanus cajan
ctccactcacaattcacaatagatgcgtgtgccatcaacaaaacttacattttcctcacacgtgtcgctgtctcgcctctcctttctgctccttttatcgcctcctcgcttctttttcttcccccctcttctctgtctgctctctcaaccacgacaccgtttgcgatggaggaggacgagcaactcgaacgattccactccgagttcgcctccaccagttccggctccgccatttcctccaccgacgatttccgcaacctcaccagctccggcgacatttcctccatcagcagcggctccggcgagattcctcccgtcgcggctctcgcgccgccgcccagggacaagtgcgtcggaaggactaacaagggagtgagttggggacacacttcggtgattgggaggcggaaggagatggaggacgccgtcgctgttattccgggattcatgtctcgcacctgttatcatgtcggcggttgtacggctcccggctccagatcctcctgtgagatcgctccacttcatttcttcggcgtttacgacggccacggtggctctcaggtggctaagttttgtgccaagcgaatgcacgatgttatagcagaggagtgggaccgagaaatggcaagtgcagctgaatggcagagaagatgggaaaccgtatttgctaacagttttgacaggactgacaatgaaatcctatctgacacagttgcaccagaaatggtaggatctactgcctctgtagtggttctatctggttgccaaattattacatccaactgcggcgactcaagggtagttctttgccgcaggacacaaacaatccccctaacagtggatcagaagccggatagacaagatgaactcttgagaattgaaggaggtggaggaaaagtcataaactggaatggagctagggtgtttggtgttcttgccatgtccagggccataggtgatcggtacttgagaccatggattattccagtgccagagataacttttacagccagaactgacgaggatgagtgcttaattttagcaagtgatggactttgggatgtaatgaccaatgaagaagttggggaagtggcacgccacattcttagaaggcgccgcagatctttgtcaatggaggaaaagtctcctgcacaagttgttgctgacagcctgactgaaattgcatatggtagaaatagtaaagataacatttcaatcatagttgttgatctgaaatcaaagagaaaacgtcagcaaaggccttctttaatttcctaagaatctgattctcttaaatttttttcaatcttgagaagggcaaagagacgataatcaagttgtagagttgatctacaaacaaa

SEQ ID NO: 6533 - DNA, 1865 bp, Glycine max
cccttctttccctactcacaaattcacaatagatgcgtgtgccatcaacaaaacttacattttcctcacacgtgtcgttttctcctctctccttttatcgtctcctctcctcgcttctttttcttcccccctcaactctcaactacgacaccagtaccgttgttgttgttgttgttcttgcgttatggacgaggacgagcaactcgaacgattcgactcggagttcgcgtccacgagttccatttcctccacgctcagcaccgacgatttccggaacctcaccagctccggtgacatttcctccatcagcagcggctccggcgagattcctcccgtctcggtcctcgcgccaccttttctccactgcgaggggtccaatgacggcgagacggcggcggcaagggagaagtgcgtgggaaggagtaacaagggagtgagctggggacacacttcggtgatagggagaaggaaagagatggaggacgccgtcgccgttattccgggattcatgtctcgcacgtgtgatcacatcggcggttgtacggctcccggttctagatcctccggtgagatcgctccggttcatttcttcggcgtttacgacggccacggtggctctcaggtggctaagttttgtgcgaagcggatgcacgatgttatagcagaggagtgggaccgagaaatggaaggtggcgctcgatggcacagaagatgggaaactgtatttgctaacagttttgagaggactgacaatgaaatcctatcagacgcagttgcgcctgaaatggtaggatctactgcctctgtggtgattctatctggttgccaaattattacatccaactgcggcgactcaagggtagttctttaccgcaggacacaaactatccccttgacagtggatcagaagccggatagacaagatgaacttttgagaattgaaggaggaggaggaagagtcataaactggaatggagctagggtgtttggtgttcttgccatgtccagggccataggtgatcggtacttgagaccctggattattccggtgccagagataactttcacagcaagaaccgatgaggatgagtgcttagttttggctagtgatggactctgggatgtaatgaccaatgaagaggttggagaagtagcacgccacattcttagaaggcgccgcagatcattgtcaatggaggaagcatctcctgcacaagttgttgccgacagcttgactgaaattgcattaggtagaaatagtaaagataacatttcaatcatagttgttgatctgaaatcaaagagaaaacgtcagcaaaggcctcctttaatttcctaagaaactgattctcgttaatccttttcaatcttgagaagggcaaagagacggtaatgaagctgtagagttgatctatgaagcaaacccccccctttctgatgaccccattggtacttggtatcacttcagcttgtgtttctcctaaccttctgtacagagttgtttggcaaaaagaatctgcttcatgatagggattgcatgttattaattgttataatgaagtttagatcagtactcttttttcccccatttggtcctgattcctgaacggttatgtgtggattaaaggaagagatggggaacagaatgaagtcctatcaattattattgtttgattttttttattgaaggaaatggaataaaacatgatgaactttattccatctcattgctttcaatactctcatttttcttctctttgatttgagggtatgggatgaaattactctaataagttataactcttattgttttgactagctttcaagcagtgaaatgaaaattttattattttattatataataa

SEQ ID NO: 6534 - DNA, 2416 bp, Glycine max
cgaaaatttcctcttaatttaattcacacgtcaaattttaccaaacgagtgggcccctaaagtaacagaacgtggcacctggcgtttctctaatgaaagccagagtaccgttgcttacgtacacaggttcctcacaggtcacacctgaagggcaagaatctagtgcaggcaaacccatagcggtaccgtgaggacggtccaatcacagggttgcgcgaagcagaggatgaaaaaggaggcgtgatgaatggaggggacaggtggagacgcagcataaggcagggtgagtaggagtacaatttacaaacagctcgtgtctctctctttttcccttctttccccactcacaaattcacaatagatgcgtgtgccatcaacaaaacttacattttcctcacacgtgtcgttttctcctctctccttttatcgtctcctctcctcgcttctttttcttcccccctcaactctcaactacgacaccagtaccgttgttgttgttgttgttcttgcgttatggacgaggacgagcaactcgaacgattcgactcggagttcgcgtccacgagttccatttcctccacgctcagcaccgacgatttccggaacctcaccagctccggtgacatttcctccatcagcagcggctccggcgagattcctcccgtctcggtcctcgcgccaccttttctccactgcgaggggtccaatgacggcgagacggcggcggcaagggagaagtgcgtgggaaggagtaacaagggagtgagctggggacacacttcggtgatagggagaaggaaagagatggaggacgccgtcgccgttattccgggattcatgtctcgcacgtgtgatcacatcggcggttgtacggctcccggttctagatcctccggtgagatcgctccggttcatttcttcggcgtttacgacggccacggtggctctcaggtggctaagttttgtgcgaagcggatgcacgatgttatagcagaggagtgggaccgagaaatggaaggtggcgctcgatggcacagaagatgggaaactgtatttgctaacagttttgagaggactgacaatgaaatcctatcagacgcagttgcgcctgaaatggtaggatctactgcctctgtggtgattctatctggttgccaaattattacatccaactgcggcgactcaagggtagttctttaccgcaggacacaaactatccccttgacagtggatcagaagccggatagacaagatgaacttttgagaattgaaggaggaggaggaagagtcataaactggaatggagctagggtgtttggtgttcttgccatgtccagggccataggtgatcggtacttgagaccctggattattccggtgccagagataactttcacagcaagaaccgatgaggatgagtgcttagttttggctagtgatggactctgggatgtaatgaccaatgaagaggttggagaagtagcacgccacattcttagaaggcgccgcagatcattgtcaatggaggaagcatctcctgcacaagttgttgccgacagcttgactgaaattgcattaggtagaaatagtaaagataacatttcaatcatagttgttgatctgaaatcaaagagaaaacgtcagcaaaggcctcctttaatttcctaagaaactgattctcgttaatccttttcaatcttgagaagggcaaagagacggtaatgaagctgtagagttgatctatgaagcaaacccccccctttctgatgaccccattggtacttggtatcacttcagcttgtgtttctcctaaccttctgtacagagttgtttggcaaaaagaatctgcttcatgatagggattgcatgttattaattgttataatgaagtttagatcagtactcttttttcccccatttggtcctgattcctgaacggttatgtgtggattaaaggaagagatggggaacagaatgaagtcctatcaattattattgtttgattttttttattgaaggaaatggaataaaacatgatgaactttattccatctcattgctttcaatactctcatttttcttctctttgatttgagggtatgggatgaaattactctaataagttataactcttattgttttgactagctttcaagcagtgaaatgaaaattttattattttattatataataatgtccaaatgatgatataatcatttattttattctatctttctactttttacttatcgttgaatattaaaatataggtgatgagttgcttagagtagggaacttttctttttatttgaccatatgttaactcgttggtaagtatattaatttgtgacaagtagtaaagtaaaatgaaagttcgagtgtcgaattcacatgaattttgtttgtatttgtatta

SEQ ID NO: 6535 - DNA, 2009 bp, Glycine max
tgaatatgaaaaaattggaaagaaaaataaaaataattaaaacgtgaaattttaccaaaggagaagtaggcccctaaagtaatagaaggtgccacctggcgttcctctaatgaaagacagagtaccgttgcttacgtacataggttcctcacacgtcagacactgaggggcaagaatcaggtgcaggcaaatccagtgtggtagtgtgaggagggtggaatcacaggtcataaaatgagcggaggggacaggtggagacgcagcataaggcagggtgagtaggagtacaatttacaaacttgcttttctttcttttcccactcccaattcacaatagatgcgtgtcccatcaacaaaacttacattttcctcacacgtgtcgctttctcctctctcctttctgctccttttatcgtctcctcgcttctttttctcccccctggcctccactctctaccctcaactacgaccacaccaccgttatggacgaggacgagcaactcgaacgattcgactcggagttcgcctccacgagttccatttcctccaccctcagcaccgacgatttccgcaacctcaccagctccggcgacatttcctccatcagcagcggctccggcgagattcctcccgtcgcggtcctcgcgcctccgtttctctaccgcgaggggtccaatgacgtcgagacggcgccggcgcccagggagaagtgcgtgggaaggagtaacaagggagtgagctgggggcacacttctgtgattgggagaaggaaagagatggaggacgccatcgccgttattccgggattcatgtctcgcacgtgcgatcgcgtcgggggttgtacggctcccggttctagatcctccggcgagatcgctccgcttcatttcttcggcgtttacgacggccacggtggctctcaggtggctaagttttgtgcgaagcggatgcacgatgttatagcagaggaatgggaccgagaaataggaggtgccgctgaatggcagagaagatgggaagctgtatttgctaacagttttgagaggactgataatgaaatcctctcagacgcagttgcaccagaaatggtaggatctactgcctctgtggtggttctatctggttgccaaattattacatccaactgcggcgactcaagggtagttctttgccgcaggacacaaactatccccttgacagtggatcagaagccggatagacaagatgaactcttgagaattgaaggaggaggaggaaaagtcataaactggaatggagctagggtatttggtgttcttgccatgtccagggccataggtgatcggtacttgagaccgtggattattccggtgccagagataactttcacagcaagaaccgatgaggatgagtgcttagttttggcaagtgatggactctgggatgtaatgaccaatgaagaggttggagaagtagcacgccgcattcttagaaggcgtcgcagatccttgtcaatggaggaaacatctcctgcacaagttgttgccgaaagcttgactgaaattgcatatggtcgaaatagtaaagataacatttcaatcatagttgttgatctgaaatcaaagagaaaacgtcagcaaaggcctcctttaatttcctaagaaactgattctcttcaatatttttcaatcttgagaagggcaaagagacggtaatgaaactgtagagtggatctataaagcaaaccctctttatttctttttttttttttttgatgacccattggtacttggtatcacttcagcttgtgtttctcctaaccttctgtacagagttgattggcaaaaagaatctgcttcatgacaagtgacaactggctagggcttgcatgttgttaattgttataatgatgtttagattattactctttttatttttcccatttggtcctgattccttaacgggttatgcaataaaactttatataaaatcaatttgttttagtttcatctatttaatgtttattaaga

SEQ ID NO: 6536 - DNA, 2300 bp, Glycine max
ttatgaaaccaattctttaattaagacttgatgagaaaatacactctttcatttaagctgaatatgaaaaaattggaaagaaaaataaaaataattaaaacgtgaaattttaccaaaggagaagtaggcccctaaagtaatagaaggtgccacctggcgttcctctaatgaaagacagagtaccgttgcttacgtacataggttcctcacacgtcagacactgaggggcaagaatcaggtgcaggcaaatccagtgtggtagtgtgaggagggtggaatcacaggtcataaaatgagcggaggggacaggtggagacgcagcataaggcagggtgagtaggagtacaatttacaaacttgcttttctttctttccccactcacaattcacaatagatgcgtgtcccatcaacaaaacttacattttcctcacacgtgtcgttttctcctctctcctttctgctccttttatcgtctcctcgcttctttttctcccccctggcctccactctctaccctcaactacgaccacaccaccgttatggacgaggacgagcaactcgaacgattcgactcggagttcgcctccacgagttccatttcctccaccctcagcaccgacgatttccgcaacctcaccagctccggcgacatttcctccatcagcagcggctccggcgagattcctcccgtcgcggtcctcgcgcctccgtttctctaccgcgaggggtccaatgacgtcgagacggcgccggcgcccagggagaagtgcgtgggaaggagtaacaagggagtgagctgggggcacacttctgtgattgggagaaggaaagagatggaggacgccatcgccgttattccgggattcatgtctcgcacgtgcgatcgcgtcgggggttgtacggctcccggttctagatcctccggcgagatcgctccgcttcatttcttcggcgtttacgacggccacggtggctctcaggtggctaagttttgtgcgaagcggatgcacgatgttatagcagaggaatgggaccgagaaataggaggtgccgctgaatggcagagaagatgggaagctgtatttgctaacagttttgagaggactgataatgaaatcctctcagacgcagttgcaccagaaatggtaggatctactgcctctgtggtggttctatctggttgccaaattattacatccaactgcggcgactcaagggtagttctttgccgcaggacacaaactatccccttgacagtggatcagaagccggatagacaagatgaactcttgagaattgaaggaggaggaggaaaagtcataaactggaatggagctagggtatttggtgttcttgccatgtccagggccataggtgatcggtacttgagaccgtggattattccggtgccagagataactttcacagcaagaaccgatgaggatgagtgcttagttttggcaagtgatggactctgggatgtaatgaccaatgaagaggttggagaagtagcacgccgcattcttagaaggcgtcgcagatccttgtcaatggaggaaacatctcctgcacaagttgttgccgaaagcttgactgaaattgcatatggtcgaaatagtaaagataacatttcaatcatagttgttgatctgaaatcaaagagaaaacgtcagcaaaggcctcctttaatttcctaagaaactgattctcttcaatatttttcaatcttgagaagggcaaagagacggtaatgaaactgtagagtggatctataaagcaaaccctctttatttctttttttttttttttgatgacccattggtacttggtatcacttcagcttgtgtttctcctaaccttctgtacagagttgattggcaaaaagaatctgcttcatgacaagtgacaactggctagggcttgcatgttgttaattgttataatgatgtttagattattactctttttatttttcccatttggtcctgattccttaacgggttatgcaataaaactttatataaaatcaatttgttttagtttcatctatttaatgtttattaagaaaaagagacacaactataatatgattttatcatatttaaatgttactaaagatttcttgatatgattttatggtttgtaataggattaaagaatgttttactttaattacataattattgtttaaaagttatgcgtggcacaaaagaaaatatcactctctacataataatgatttgatgccatctttattccgatcataagtaggtttctctttctgcaaatatatttcaaa

SEQ ID NO: 6537 - DNA, 1884 bp, Cicer arietinum
aggtggaacatggattatgtctataacagtgaatcacattgagcatttttacatattcaactctaaccaaaagccataagcaaaatatgtgttgaaggaagatccaaggggggatagttggaatcgcatcataacgcaggtgcgtatgaccatacacaattgtgtaccgtttctatttcgtactcaacttttacaaatcacaacggatgcgtgtgccataaaaaaaactgataacaattttcctcacacgtgtcactttcttaccagtcttttcttctccttttatctctctctctctctctctctcaatcaaccattgctgcgttatggaacctttggacgatgcggaatcgcaactcgaacgaatcgactctgagttaacgtctacaagctctggttccggcatttcctccgtattcagcgctgacgatttccgtaacttcaatagctccggcgacatttcctctatcagcagtggctccggggagattccgtctttcacggtgaaccgagtgattcttgcacctccgttgagtgctgcatccaatgaagcggacaacgaggccgctgtgccggcggtgagggagaagtgcgtgggaaggaataacaagggagtgagttggggacatacttcggtgattggaaggcggaaagagatggaggacgccgtcgccgttattccgggattcatgtctcgcacttgcgatcatgtcggaggttgtacggctccaggttcaagatcttccggagagatcggtcctgttcatttcttcggcgtttacgacggacacggtggctctgaggtggctaaattttgtgccaagcgaatgcatgatgttatagcagaggagtgggaccgagaaatagaaggcggtgctgaatggcagagaaggtgggaagcagtatttgctaatggttttgagaaaactgacaatgaaatcgaatcagacgcagttgcaccagagatggttggatctactgcttctgtggttgttctatctggttgccaaattattacatccaactgtggcgattcaagggttgttctttgccgcaggactcaaacactcccattgacagtggatcagaagcctgatagagaggatgaactcttgagaatcgaaggagaaggaggaaaggtcatacactggaatggagctagggtgtttggtgttcttgccatgtccagggccataggtgatcggtacttgagaccatggattatcccagtgccggagataacttttacagcaagaactgacgaagatgagtgtttaattttggcaagtgatggactttgggatgtaatgacaaatgaggaggtgggagacatagcgcgccacattctaagaaggcgccgcagatcattgtcgatggaggaaatatctccagcacaagttgttgctgatagcctcactgaaattgcatatagtagaaatagtaaagataacatttcaatcattgttgttgatctgaaatcaaagagaaaacgtttgcaaaggcctccttcaatttcctaaaaatacgattctctttgatagttttcaacaccttgagaaggtaatgaagttcctagagttgatctatatgagcagaacaactcctttgtcatgcatggtgattctctgttatcacttcaacttgtgtttctcctaacttgctagctgtacagagctgactggcaaaaaaaatctgattcatgacaagtaacaactagctaggacttgtttgttacaatgaagtattgatcaatactccattttatctgttccatccttgacaagggccaatagaatgaagttaccaattcatttgttgaattttttaaaactaatactaatcaatggaatgaaatataataaagtttatttcattccattgtat

SEQ ID NO: 6538 - DNA, 2008 bp, Lupinus angustifolius
aatcttattattagatgtctaattcattattaacaaattaagttacacagactcacgtaagtatttcctacgatttttctcccactgaagtcacaacataaaacagatgcgtgagccatcgacattacttacattttcctacacgtgtcacattcttatctgtcctttctttttctctttctctttctcttccttttattattatatatctcttccctctctctttctcactactattgcttcttcatggaaccctcacaggacgaccaacacgaacgagtcgactcagagtttacctcaacgagttccggttcaggcatttcctccatactcagcatcgacgacctccgcaacatgaccatcaccagcagcgaagtttcctccatcagcagcggtggctccggcgagattccgccgatgacgagggagaagtgtgtggggagaaagaacaagggagtgagctggggacagagttcagtgatcggaagaaggaaagagatggaagatgctgttgcggttattccaggattcatgtctcgtatgtgtgatcatgttggaggttgtacggctcctggttctagatcctccgatgagatctcaccggttcatttcttcggcgtttacgacggccacggtggatctcaggtggctaaattttgtgccaaacggatgcaccttgttatagcagaagagtgtgacaaagaaatggctggtggcactgaatggcagagaaggtgggaggctgtatttgccaaaggctttgagagaactgacactgaagtcctattagatgcagttgcaccagaaatggtaggatctactgcttctgtggtggttctatctggttgccaaattattacatctaattgtggtgactcaagggtagttctttgccgtaggacccaaacaatccccttgaccgtggatcagaagcctgatagacaagatgaactcctgagaattgaaggaacaggaggaaaagtgataaactggaatggagctagggtgtttggtgtccttgccatgtccagggccataggagacaggtacttgaggccatggattattccagtgcccgagataacttttacagcaagaactgaggaggatgaatgcttagttttggcaagtgatggactctgggatgtaatgaccaatgacgaggttggggaagttgcacgacatattctaaggcggcggcgcaggttgtccttatcaacagaagaaatatctccagcacaagttgttgcagatagcctgactgagattgcatatggtagaaatagtgaagataacatttcaatcatagttgttgatctgaaatcaaagagaagacgccagctaaggcctcctttagtttcctaagaatccaattcttttcaatatttttgaagcttgagaagggcaaagtgattgttactaagttgaagagctgatctatatacaaaaataccattttctacttatgaccccattggtaattgttatcatttcaacttgtgttctcctaacctgctgtacagagttaatagcaaaaattaagtcactggaattggtctagtggtgagggccttggatagttctcatcatgcaaaaagaatttgcttcatgacatttggtgacaactagcaagaggttgattgttataatgaagtacaaatagattctcattttaaaaaatgtaatgggaattgggatcaacaatttaatacataatgaaatgaaagtcttgttcaaattcttggttttgttctaaacctgggtgtaacctttgtcccaatggctgggttatggacttatggggatgtccctctgcccttaagatagtttgggacaagggattatgttgcatttggttggaaagtgactcttttggccactcgcctaatacttaatggctcctcacatccatgtagaaggatccttaagatgatcaatgatattcaaagatgggatagaactgtctgatctctcatggctattgagaatgcaaccaagtagctgattt

SEQ ID NO: 6539 - DNA, 1440 bp, Lotus japonicus
cttcattcctgttgcagttgcgttatggaatcggagtcggaggatggacaactcgaccgagtcgactccgagttgacttccaccacctccatttccaccatctcctccatactcacctccgacgactccttcaacttcaccagctccggcgacatttcctcttccagcagcggctccggcgagatcccaggcctgtccgttctcgcaccgctgcttccagcatcatctccgtcggaggatgcggcggtagtgagggagaagtgcgtgggaaggagcaacaagggagtaagctggggacatacttcagtgatcgggaggaggaaggagatggaggacgccgtcgccgtcgtgccgggattcatgtcctccacctgcaaccacatcggcggttgtacggcaccaggttccagatcttccggcgagatctctcccattcatttcttcggagtttacgatggccacggtggctctcaggtggctaaattttgtgccaagcggatgcatgatgttgtagcagaggagtggggcagagaaatggctgcagctggtggcgctgaatggcagagaaattgggaagctgtaattgctaatggctttgagagaactgacaacgaaatcaaatcagatgaagttgcaccggaaatggttggatccactgcctccgtggtggttctatctggttgccaaattatcacatccaactgcggtgactcaagggtggttctttgccgtaggactcaatcaatccccttgacagtggatcagaagcctgatagacaagatgaactcttgagaattgaaggagaaggaggaaaagttataaactggaatggagctagggtgtttggtgttcttgccatgtccagggccataggtgattggtacttgagaccatggattattccggtgccggagataacttttactgaaagaacggacgaggatgaatgcttagtgctggcaagtgatggactttgggatgtaatgacgaatgaagaggtcggggaagtagcgcgccacattctaagaaggcgtcggagatccttgtcaacaacggaggaaatatctcccgcacaagttgttgctgatagtctgactgaaattgcatgtggtagaaatagcaaagacaacatttctatcatagttgttgatctcaaatcaaagggaaaacgccagcaaaggcctccttaatgaagttctagagataatctaatacagacaaaccctttgatggttcctcattgctgcttggtatcacttcaacttgtgttccttctaacctgctgtacagaactgagctaactggcttaaaggttgaagcttcatgacaagtgacaactagctagggcttgtttgttgcaatgaagtatagatcaatattccatttttatccgtttggtcttgaattaaggcaaatagaatgaatctcagcagttcatt

SEQ ID NO: 6540 - DNA, 1463 bp, Arachis hypogaea
gccctctctcattgtcgttgcatcatggacgaggaagagcagctccagcgacacgactcagagttgtccaccatcagttccagctccggcatttcctcaatcctcagcttcgacgactttcgcggcagtaacaccagctccggcgacatttcctccatcagcagtggctccggggagattcctcccgccgacgccatactcttgcctcctctgcttaggcggactgtgtcgagtgacgtggaggttgtggtggcggcagcggtcagggataaatgcgtggggaggaagaacaagggagtgagttgggggcacacttcggtgattgggagaaggaaggagatggaggacgcggttgccgttattcctggattcatgtcccgcacgtgccaccacgtcggcggttgtacggcccctggctcccaatcctccggcgagatctctccccttcatttcttcggagtgtacgacggtcatggtggctctcaggtggctaaattttgtgcaaatcggatgcacgatgtgatagcagaggaatgggagcggcaaatagagagttatagtgaatggcaaagaaggtgggaggccgtattttctaacggttttgaaaggactgacaatgagatatcatcagatgaagttgcacctgaaatggtaggatctacagcctctgtggtggttctgtctggttgccaaatcattacatccaactgcggcgattcaagggtcgttctttgccgcagggctcaaacaatccccctcactgtcgatcagaagcctgatagacaagatgaactcttgagaattgaaggaggaggaggaaaagtcataaactggaatggagctagggtgtttggtgttcttgccatgtccagggctataggtgataggtacttgaggccatggatcattccagtgcctgagataacctttacagcaagaagtgaggaggatgagtgcttaatattggcaagtgatggactctgggatgtcatgacgaatgaagaggttggtgaagttgcgcggcatattctaagaaggcgacgaaggtccctgtctctggaggaaatatctcctgcacaagttgttgccaatagcctgactgagattgcttatgctagaaatagtaaggataacatttcaatcatagtagttgatctgaaatcgaagagaaaacgtcaaccaaggcctcctttagttgcccgagaagccaactacatataatctttttgaaccttgaagagggtctaagacatgaggatcatgaagttctttacatctaagaacaaaacaaatgatgacacccattggtacttattgctagttggtagcacttgagttttgtttctcctaaccaagcagcacagaattaactggcagaaagaatctgctttgtgacaggtgataactatctaaagcaagcttgttataaggaaaatatagatcgatactcagttttttttttc

SEQ ID NO: 6541 - DNA, 1998 bp, Fragaria vesca
cttcttctccctctctctcctcctccttcctattttatctcccattctctcgcctcctttctctcctcttcttctctctttttctctctctccttccgcatggacgaaccccaactcggccgggtcgactcactcgacctcgcctccaccagctcctccggcctctcctccatcctcacctccgacgactccagaagcaccaccagcagctccggcgagttctcgagaaccaccgccggaagctccggcgagattccggcgcttctggcggtgccggaggctaggccgaagtgcgtggggaggaacaataagggagtgacgtgggggtccactgcggtgattgggaggcggaaggagatggaggacgccgtggccgttattcccgggtttatggcttgcacgtgcgatcacgtggggggatgtaccgctcccggttcgagaacctcctccgagatctcccccgtccatttcttcggtgtctacgacggccacggcggcagtcaggtggctaaattttgtgctgagcgaatgcatgaagtcatagcacaagagtgggataaggagatggttgatggctgtgaatggcaaaggaggtgggagactactttcctagttgggttcgagagggctgatagtgaggtcctgacagaggcagatgcgcctgagatggttggatcaactgcagttgtagttgtcctatctggttgccagattatcacatccaactgtggtgactctagggcgattctttgccgagggacagaaacaatcccgttaactgttgatcagaagcccgacagagaagacgaactcattagaattgaaggagagggagggagagtcattaactggaatggggcaagggtgttcggagttcttgccatgtcaagagctataggtgatcggtatctaaggccttggataattccagttcctgagattacattcacagcgaggactgatgaggatgagtgtttgatcttggcaagtgatggactgtgggatgtaatgactaatgaagaggttggggaggtggctagacatattttaagaaggcggcgaaggtccatgtttacaaatactgaggaaatttctgcagcacaagctgttgctgatcatcttactgaaattgcatacggaagaaatagttccgacaacatctccatcatagttgttgatctcaaaatgaaaaggaaacgtcagccaaggcaatgaagggggagtggagtgatccatttctattctcacaccttcagaaactcagaggtgaggcaggaagatttactgccaaatgacttgatcagaatcattagcccgccttcagccttcagctacctttatctgacctgtacagactacagagctgactcgatcaatctcttccaactgtaacaactggaaaccagcttgttactttgaaacactagatcaatcctcatttttagttggcttggtcgagaaaagagtaacagatcacaaagtgaacattgaattatttgataatatttgcttcagtatgaagtaaagagaagaaagatgatggcaagagatatttactagttagctatctgcctctctttctttttctaacactatgatccaaaatgcgacatggaatgcatatatctggtggagtatttctgaagtcagtgctttcaaccgtggtagcttcagtagctgtgtgccttcctaaggtcagtcctacaatgaatttgtatcctagtaataatttgtttttcgagacatattacattgctttacatcaatattcaaagggctgaagggactaatggaattctatacgtgcttcaagttatactagtttcgtcgttcttatgtacatttctttctttacttcaaggcgcaaaactacatgtttagtgttctaagttcactcactgaccaagaacattgatattatttcttctgtacaagtgcctttgatgaatataggacaccaatgcaggcatatagctgtctgtttaccattattagcaa

SEQ ID NO: 6542 - DNA, 1767 bp, Citrus clementina
ctcgttgccacgcaatctacagcccgcaagttgacacttcaatccgcagattgcgggtgcattgcgcttcggaaacaccgcccaacagagaaactctcctccgttaattatgaaagtgtcactacatggaacccctttcagagcgagaagaagagcaactcgaacgattcgacttggtcgctgacacggacttggcatcggcgagttcaggcttgtcatttgtactaagcaccgacgattccaggagcacgactagctccggggacatctccgcaagctccggcgagattccagcgattcttgtcgaggaaacagtggttccgaggctggtggaccccattccttccatcggtgagttgacggtggcggtgacgccgacggcgaggctgatgtgtgtggggagggataataaaggagttacctggggtttaacatctgtgattggtagacgtagggagatggaggatgctgtcaccgtcatgcccggtttcatgtcttgcacttgcgatcacgtaggtggttgtacggctcctggttccaggtcctgcggcgagatctctcccatccatttctttggcgtctatgacggtcacggtggctcgcaggtggctaaattttgtgccgagcggatgcacgaagtgatagctgaagaatgggatcgagaaagggtttgtagtgattggcagaggagatgggaagttgcattttctagcggtttcgaaaggacagacaacgaggttctgacagaggcagcagctcctgaaatggttggatcaactgctgttgttgtggttctctctggttgccagattattacgtccaactgtggcgactcgagggctgtgctttgtcgcgggactgaaacaatcccattgactgttgatcagaagcctgatagacaggacgaactcgagagaatcgaaggagctggagggagagtcataaattggaatggtgctagggttttcggagttcttgccatgtccagagctataggggatcggtatctaaggccttgtataattccagtgcctgagattactttcacgacaaggaccgatgaggatgagtgtttgattttggcaagtgatggactttgggatgtcatgacgaatgaagaggttggtgaggtagctcgccgcttgctaagaaggcgacgcaggtccctgttggttgacgaggtttcgccagcacaagttgtggctgataatctcacagaaatagcatatggcagaaacagttctgataacatttcaatcattgttgtcgatttgaaagcaaaaaagaagcgccagcaaaggcagcagtgaaaagggagtgacgatgaaaccattttccccagaaatccaaatcactttcagccatttaattgaagtttagagatcaggctggcagcaggattgatgatctagtgatgttcaagaagttccgcgaatgagcaaatcccttattgatgatcactcaacaaggagactcgtttagctaccaatgttgacctcaacgtgtacagagctgaccggcaagtaactgttgcttgtaacaccaaaataggttttgttactgcaaagtactagatcaatcctcaatttttactggtttggtcaagaatttaaaaagaattaatgaaaacaaaagtgttctttaattgaagcatgaacacacaaggatgaaggaaaaggaaaagtttgggaagatcattcttttcctagcaagtatgaagggatttattgaattcatctttgaaagtaattaaggttattattcatt

SEQ ID NO: 6543 - DNA, 1767 bp, Citrus sinensis
ctcgttgccacgcaatctacagcccgcaagttgacacttcaatccgcagattgcgggtgcattgcgcttcggaaacaccgcccaacagagaaactctcctccgttaattatgaaagtgtcactacatggaacccctttcagagcgagaagaagagcaactcgaacgattcgacttggtcgctgacacggacttggcatcggcgagttcaggcttgtcatttgtactaagcaccgacgattccaggagcacgactagctccggggacatctccgcaagctccggcgagattccagcgattcttgtcgaggaaacagtggttccgaggctggtggaccccattccttccatcggtgagttgacggtggcggtgacgccgacggcgaggctgatgtgtgtggggagggataataaaggagttacctggggtttaacatctgtgattggtagacgtagggagatggaggatgctgtcaccgtcatgcccggtttcatgtctcgcacttgcgatcacgtaggtggttgtacggctcctggttccaggtcctgcggcgagatctctcccatccatttctttggcgtctatgacggtcacggtggctcgcaggtggctaaattttgtgccgagcggatgcacgaagtgatagctgaagaatgggatcgagaaagggtttgtagtgattggcagaggagatgggaagttgcattttctagcggtttcgaaaggacagacaacgaggttctgacagaggcagcagctcctgaaatggttggatcaactgctgttgttgtggttctctctggttgccagattattacgtccaactgtggcgactcgagggctgtgctttgtcgcgggactgaaacaatcccattgactgttgatcagaagcctgatagacaggacgaactcgagagaatcgaaggagctggagggagagtcataaattggaatggtgctagggttttcggagttcttgccatgtccagagctataggggatcggtatctaaggccttgtataattccagtgcctgagattactttcacgacaaggaccgatgaggatgagtgtttgattttggcaagtgatggactttgggatgtcatgacgaatgaagaggttggtgaggtagctcgccgcttgctaagaaggcgacgcaggtccctgttggttgacgaggtttcgccagcacaagttgtggctgataatctcacagaaatagcatatggcagaaacagttctgataacatttcaatcattgttgtcgatttgaaagcgaaaaagaagcgccagcaaaggcagcagtgaaaagggagtgacgatgaaaccattttccccagaaatccaaatcactttcagccatttaattgaagtttagagatcaggctggcagcaggattgatgatctagtgatgttcaagaagttccgcgaatgagcaaatcccttattgatgatcactcaacaaggagactcgtttagctaccaatgttgacctcaacgtgtacagagctgaccggcaagtaactgttgcttgtaacaccaaaataggttttgttactgcaaagtactagatcaatcctcaatttttactggtttggtcaagaatttaaaaagaattaatgaaaacaaaagtgttctttaattgaagcatgaacacacaaggatgaaggaaaaggaaaagtttgggaagatcattcttttcctagcaagtatgaagggatttattgaattcatctttgaaagtaattaaggtcattattcatt

SEQ ID NO: 6544 - DNA, 1680 bp, Eucalyptus grandis
ctccggtgaatgagagagaaccggcgcggagaggagagagagggattccgccgttcggattatatatcggagctaatggagcagcccgaagaggaggagcagctcgagagcttcgactcggagagctccggcgcgctgtcgatactgaccatcaccgaagatcccacgagcgccagcagctccggcgacctctgctcctccagcggccccgggagcagcggcgggagctccggcgagatccctgcgtgcgcggaggaggcggcggcggcggcaccgagcctgctagcggcggagccagctcggccgagggaggaggggctggcggggtcgacggaggcggacgccgcggcggcggcggccgggaagcggaagtgcgtggggaggagcaacaggggagtggcgtgggggtccacctcgatcatcgggcggcggaaggagatggaggacgccgtcgccgtggtgccggggttcatgtcccgcgcgtgcgaccacgtggggggctgcttggctcccggctcgaggatctccggcgagatctcgcccgtccacttcttcggcgtgtacgacggccacggcggcgctcaggtggccaatttctgtgctgcgcggatgcatgaagttatagccgaagaatggaacagggaagtaatggatgggttcgagtggcagagaaggtgggaagcagctttttctactggttttgagagggctgacagtgaagtcatgactgaagcggctgcacctgaaatggtaggatcaactgcggttgtggtgattctatccggctgtcagataatcgcttccaattgtggtgactcaagagcaattctttgccgtgggactcaaacaatccccttgactgttgatcaaaagccagatagacatgatgaactgatgcggattgaaggaatgggagggaaagtcataaactggaatggtgctagggtgtttggagtacttgctatgtccagagctataggtgaccggtatctgaggccgtggattattccagtgcctgaaatcacttttaccacaagagtggatgaggatgaatgtttgattttggcaagtgatgggctctgggacgtcatgactaatgatgaggttggagaggtggctcggcgcctactaaggagacgccgccgcctcatggtcgatgaaatctctccagcacaagccatagctaattatcttactgagacggcctatgggaggaacagttctgataacatatcaatcattgttgttgatttaaaagcgaagagaaagcgccagcaaaggccacaagagggttgaagatactatctttatccctattacttacatcccatttctttccagctctaatatctggagacaaggagaccaggaatgatctagtgatattttgcatttcacaatgactaaaggaacgaatttagcttggatagctatcatcccaacctgtacagagctgactggcgaaaatttatcgcttcctggaactggaatcggttgttgccatgtaatactaagtcaatcctcaattttagttggtttggtcaaaaggaaaaagatgacaaagcaagcattgttccataggaagcaaagcactgttctatgtaacttattcaacgattatcctgcaaatgaaagccaaattgttctttctttgcatatcttcatttgaattaccatcca

SEQ ID NO: 6545 - DNA, 552 bp, Vigna unguiculata
ggagaatcagtttaagtgagagagagaatggagggtgttgtgaagtttgcatgtgttgttgggtttgtggtgcttgtgagtattgcaaaggtggatagtgctggggaatgtgggaaatctactaccccagataatgaggctattaagcttattccatgtgcttcagcagcacaagatgagaatgctagtgtttctcagagttgctgtgcacaggtgaagaaaatagggcagaatcctagctgcctctgtgcagttctgctatcaaacacagctaaaatggctggagtcaaccctcagattgctatcaccatccccaagcgttgcaacctcgctaatcgccctgttggttacaagtgtggaccttacacactgccttaaaagagtgaagattgttacggaaatgaaagatacagtatatatgggtatcagctgctacaaactgtgactggactccatgtttgtcgtatttgtaacttccaagtgaataagacccagcagctcaatgcatgaataaaatatttactatgtgtttcgtcaaaaaaaaaaaaaaaa

SEQ ID NO: 6546 - DNA, 640 bp, Glycine max
aaggggttattgcattgtgaaattaatagagagacataaaaaataaacatatattgagaatggagggttgtgtgaagaagttgctatgccttgttgggtttgtggtgcttgtgagtactattggtggggtggagagtgctggtgaatgtgggaaatctacaacccctgataatgaggcttataagcttgcaccatgtgcctcagcagcacaagatgagaatgctagtgtttctcagagttgctgtgctcaggtgaagaaaattgggcagaaccctagttgcctctgtgcagttcttctctctaacacagccaaaatggctggcgtcaaccctcaagttgctgtcaccatccccaagcgttgtaacctggctaatcgccctgttggttacaagtgtggaccttacactctgccttgaaagagttaaggttgttgctgaaaacaaagatgacagggcgtaaatgcactatggatgttagctactacaaactgtgactacatgtttgttgtattgtcttgtaacttcctagtgaataagaactagcagctcactagtgtaccctataataaaacatgtactttcggtgttatatgtgcctactcaaacttttaactgttttaacattatattttaatcaccgt

SEQ ID NO: 6547 - DNA, 791 bp, Glycine max
aaggggttattgcattgtgaaattaatagagagacataaaaaataaacatatattgagaatggagggttgtgtgaagaagttgctatgccttgttgggtttgtggtgcttgtgagtactattggtggggtggagagtgctggtgaatgtgggaaatctacaaccccagataatgaggcttataagcttgcaccatgtgcctcagcagcacaagatgagaatgctagtgtttctcagagttgctgtgctcaggtgaagaaaattgggcagaaccctagttgcctctgtgcagttcttctctctaacacagccaaaatggctggcgtcaaccctcaagttgctgtcaccatccccaagcgttgtaacctggctaatcgccctgttggttacaagtgtggaccttacactctgccttgaaagagttaaggttgttgctgaaaacaaagatgacagggcgtaaatgcactatggatgttagctactacaaactgtgactacatgtttgttgtattgtcttgtaacttcctagtgaataagaactagcagctcactagtgtaccctataataaaacatgtactttcggtgttatatgtgcctactcaaacttttaactgttttaacattatattttaatcaccgtttccaaattaagttttctataatacttaatattatctagtaatgacttgttaattaatcaaaaagaaaaatctattgatgacttgactgagaagaatctaatactgagaaaaatcatttttaggtgatacactgaaaaagtttaatacttt

SEQ ID NO: 6548 - DNA, 757 bp, Glycine max
tataaaaccccatgagagccaaaggggttattgcattgtgaaatcaacagagaaacatttcactaatagagagacataagcataatattgagaaataatggagggttgtacttattgtgtgaagttgctatgccttgttgggtttgtggtgcttgtgagtactattgcaggggtggagagtgctggtgaatgtgggaaatctaccaccccagataatgaggcttataagcttgcaccatgtgcctcagcagcacaagatgagaatgctagtgtttctcagagttgctgtgctcaggtgaagaaaattgggcagaacccaagctgcctctgtgcagttctgctctccaacacagccaaaatggctggtgtcaaccctcaagttgctgtcaccatccccaagcgttgcaacctggctaatcgccctgttggttacaagtgtggaccttacactctgccttgaaagagttgaggttgttgctgaaaacaaagatgacagggcgtaagtgcactatggctgttggctactacaaactgtgactacatgtttgttgtatcgtcttgtaactttctagtgaataagagctagctgctcactagtgtaccctataataaaacatgtactttcggtgtttcatgtgcctactcaaacatttaactgttttaagttttaacaaaatcttttgatcatcgttacccaattaagtttgttataatatttaatattatctattaatgacttattaattctaaataaaca

SEQ ID NO: 6549 - DNA, 885 bp, Glycine max
gcaaaattgtgtttacacctgctttatgttcctaagtggtgcaataataaaactcaccctttgtcctagtgcaagctccattaatcagagggtgacaaggccaagcacttttttggagcatgttaggctataaaaccccatgagagccaaaggggttattgcattgtgaaatcaacagagaaacatttcactaatagagagacataagcataatattgagaaataatggagggttgtacttattgtgtgaagttgctatgccttgttgggtttgtggtgcttgtgagtactattgcaggggtggagagtgctggtgaatgtgggaaatctaccaccccagataatgaggcttataagcttgcaccatgtgcctcagcagcacaagatgagaatgctagtgtttctcagagttgctgtgctcaggtgaagaaaattgggcagaacccaagctgcctctgtgcagttctgctctccaacacagccaaaatggctggtgtcaaccctcaagttgctgtcaccatccccaagcgttgcaacctggctaatcgccctgttggttacaagtgtggaccttacactctgccttgaaagagttgaggttgttgctgaaaacaaagatgacagggcgtaagtgcactatggctgttggctactacaaactgtgactacatgtttgttgtatcgtcttgtaactttctagtgaataagagctagctgctcactagtgtaccctataataaaacatgtactttcggtgtttcatgtgcctactcaaacatttaactgttttaagttttaacaaaatcttttgatcatcgttacccaattaagtttgttataatatttaatattatctattaatgacttattaattctaaataaaca

SEQ ID NO: 6550 - DNA, 377 bp, Helianthus annuus
gaagttgctatgccttgttgggtttgtggtgcttgtgagtactattgcaggggtggagagtgctggtgaatgtgggaaatctaccaccccagataatgaggcttataagcttgcaccatgtgcctcagcagcacaagatgagaatgctagtgtttctcagagttgctgtgctcaggtgaagaaaattgggcagaacccaagctgcctctgtgcagttctgctctccaacacagccaaaatggctggtgtcaaccctcaagttgctgtcaccatccccaagcgttgcaacctggctaatcgccctgttggttacaagtgtggaccttacactcttccttaagatagtactgaggacaaggagggatttgggcgtgaga

SEQ ID NO: 6551 - DNA, 494 bp, Cicer arietinum
taatttcactaagagatataaacacacattaagaaaatggagactcttgttaagtttgtgtgccttattggttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctagaaaaacaagataaagtgggatatgctattgttgctgttagctactagtatggtgattatcacagtctttctttgagtttgtctttg

SEQ ID NO: 6552 - DNA, 589 bp, Cicer arietinum
tataatttcactaagagatataaacacacattaagaaaatggagactcttgttaagtttgtgtgccttattggttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctagaaaacaaagataaagtgggatatgcattgttgctgttagctactagtatggtgattatcacagtcttctttgagttgtcttgtaactttgttgttgtttatagtggataagaagagctagcagctcacttgtgtacaccctgaataaaacatgcactttcagttcagtgtttttttttt

SEQ ID NO: 6553 - DNA, 573 bp, Cicer arietinum
acacgtagtatattaatttcactaagagatataaacacacattaagaaaatggagactcttgttaagtttgtgtgccttattggttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcattgttgctgttagctactagtatggtgattatcacagcttctttgagttgtcttgtaactttgttgttgtttatagtggataagaagagctagcagctcacttgtgtacaccctgaataaaacatgca

SEQ ID NO: 6554 - DNA, 538 bp, Cicer arietinum
aagagatataaacacacattaagaaaatggagactcttgttaagtttgtgtgccttattgcttttgttgtacttgttagtgttgcaagtgtggaaagtgctggtgaatgtggaaaatccactacaccagataatgaagcttttaagctagctccttgtgcaagtgcagcacaagatgaaaaatgcaagtgtgtcacaaagttgttgtgctcaggttaagaaacttggtcagaatccaagttgtttatgtgctgttatgctatcaaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccct

SEQ ID NO: 6555 - DNA, 790 bp, Cicer arietinum
ataaacacacattaagaaaatggagactcttgttaagtttgtgtgccttattgcttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccctgaataaaacatgcactttcagttcagtgttttattttatgaatcttattaaactttatggttgatgcttttacattatatttcagtcattgttaccacttactaacactgaatataatttattgtaaaaaaaaaagcttagaaccatggtctgagttccaattaagaaaaaaaaaaaagaaaaaagaaaaaaaagaaaaaaaacgaaaaacgaacgtaggtaggaggacgaagacacacgaggagaggggggggggggggg

SEQ ID NO: 6556 - DNA, 1179 bp, Cicer arietinum
tttattgagaatgaggtggcagcattaaatagctcccttaatttacataatgcaagtaataactacatctagaaatatgaacatttaacaaaaaaatattgtcaccatccttgatattggacaagaaaattaacaaatttatgtcgacacaagctttttattgctaagtggtgcaataagatatactaagaaacacaccaattagtactagtgcaagctccattaatctaaggtggatgactagaccaagcacatttttttaacacttcatcatgctataaaatcccatcaaatgcatgacattgttacatagaagtaattaatttcactaagagatataaacacacattaagaaaatggagactcttgttaagtttgtgtgccttattgcttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccctgaataaaacatgcactttcagttcagtgttttattttatgaatcttattaaactttatggttgatgcttttacattatatttcagtcattgttaccacttactaacactgaatataatttattgtaaaaaaaaaaaagcttagaaccatggtctgagttccaattgaaagaggtgctcatatttaatatccacaatatttcaaataaaattatttttgatggaggaaacctataataataataataatatagtagttttactactgttttagccatgtattgcaaacatacattaatacattgtttggtgtga

SEQ ID NO: 6557 - DNA, 496 bp, Cicer arietinum
attaatttcactaagagatataaacacacattaagaaaatggagactcttgttaagtttgtgtgccttattgcttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagctttctttgagttgtcttgtaactt

SEQ ID NO: 6558 - DNA, 412 bp, Cicer arietinum
cctcccacgactaatttcactaagagatataaacacacattaagaaaatggagactcttgttaagtttgtgtgccttattgcttttgttgtacttgttagtgttgcaagtgtggaaagtgctggtgaatgtggaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgtaggtt

SEQ ID NO: 6559 - DNA, 604 bp, Glycyrrhiza uralensis
gacacataacacatacatattatcttcagaaaaattgaaattaatggaggctcctatgaagttgttgtgccttgttgggtttgtggtccttgttagtgttgctgcaggggtgaatagagtggagggtgctggtgaatgtggtaagtctaccaccccagataatgaggcctttaagcttgctccttgtgccagtgcagcacaagatgagaatgctagtgtctcccagagttgctgtgctcaggtcaagaagcttggtcagaacccaagctgcctctgtgcagttatgctctctaacactgccaaaatgtctggtgtcaaccctcaaatcgctgtaaccatccccaagcgttgcaacatcgctaatcgccccgtcggttacaagtgtggaccttacactcttccttaaaggagttaaggttgttgctggaagacaagaataactgggagtaaatgcactattgctgttagctactatgtactgtgaccacaactttgtgttgctgtattgtcctgtaactttattgtttatagtggataagagctagcagctcacttgtatccaccctgaataaaacatgcactttcagtgttttatgtgcctact

SEQ ID NO: 6560 - DNA, 656 bp, Medicago truncatula
gcatagaactaattaattatctaagatatatattaagaagaagaaaaaatggagggtcttatgaagatgctgtgccttgttggttttgtagtccttgttgcaggtattcatagtgttgaaagtgctggtgaatgtggaagaggtactacaccagatatggaagcatttaagctagctccttgtgcaagtgcagcacaagatgaaaatgctagtgtctcacaaacttgttgtgctcagactaagaaacttggtcagaatccaagttgtctttgtgctgttttgctctcaaacgttgctaaaatgtctggtgttaatcctcaaattgctgttactatccctaaacgctgcaactttgctaatcgccccgttggttataagtgcggaccttacactcttccttgaaagagttgaggttgttgatgaaagcaaacataaatgggatacgcattgttgctgttagctactattatggtcatcacaacttagttgtgttgtattgtaactttcttgtttgtttatagtgtggataagacctagcagctgacttgtgtacaccctcatgaataaaacatgttctttatcagtggtttattttatgtgcctactaaaactttttagtggatgctcttacatcatattttaattaccgttattac

SEQ ID NO: 6561 - DNA, 622 bp, Medicago truncatula
atagaactaattaattatctaagatatatattaagaagaagaaaaaatggagggtcttatgaagatgctgtgccttgttggttttgtagtccttgttgcaggtattcatagtgttgaaagtgctggtgaatgtggaagaggtactacaccagatatggaagcatttaagctagctccttgtgcaagtgcagcacaagatgaaaatgctagtgtctcacaaacttgttgtgctcagactaagaaacttggtcagaatccaagttgtctttgtgctgttttgctctcaaacgttgctaaaatgtctggtgttaatcctcaaattgctgttactatccctaaacgctgcaactttgctaatcgccccgttggttataagtgcggaccttacactcttccttgaaagagttgaggttgttgatgaaagcaaacataaatgggatacgcattgttgctgttagctactattatggtcatcacaacttagttgtgttgtattgtaactttcttgtttgtttatagtgtggataagacctagcagctgacttgtgtacaccctcatgaataaaacatgttctttatcagtggtttattttatgtgcctactaaaactttttagtggatg

SEQ ID NO: 6562 - DNA, 661 bp, Cajanus cajan
gcactgccaaatagagagagatataacataataataaagacataatattgagaatggagggttgtgtgaagttggtatgggttgtggggttagtggtgctactagtgagtgttgcaagggttgatagtgctggtgaatgtggcaagtctacaagcccagatgcagaagcaattaagcttgcaccttgtggttcagcagcacaagatgagagtgcaagtgtttctcaaagttgctgtgcccaggtgaagaaaatggggcagaatcctagctgcctctgtgcagttctgctctctaacactgccaaaatgtctggagtcgaccctaaaattgctatcaccattcccaagcgttgcaacctcgctaatcgccctgttggttacaagtgtggaccttacactctaccttgaaggagttaaagttgttgccggaaacgtaaatgcactatggctgttagctactacaaactgttgtgactacatgtttgttgtaactttttagtgaataagagctggaagctccctagtgtatgaataaaacatgttctttcggtgttttatgggcccactgatacttttttaatttttttttacattatccttcaatcactgttactaaagcttgctataatgaatcatagataaatataataacactaaccaac

SEQ ID NO: 6563 - DNA, 757 bp, Trigonella foenum-graecum
aattaacacatttgtgtctacacaagcttttatttgctaagtggtacaataagatatgctaagaaactcaccaatttgtactagtgcaagctccattaatctaaggtggatgactagaccaaccacatttttagtactataaagtcccatcaaatgcattgtatttttacatagaattaattaatttcactaagagatattagacatacattaagagaaaaaaatggagggtcttatgaagatgttgtgccttgttggttttgtagttcttgttgcagggattcatagagctgaaagtgctggtgaatgtggaagaggtactaccccagataatgaagcttttaagctagctccttgtgcaaatgcagcgcaagatgaaaatgctagtgtgtcacaaagttgttgtgctcaggttaaaaaacttggtcagaatccaagttgtctttgtgctgttatgctctcaaatgttgctaaaatgtctggtgctaaccctcaaattgctgttactatccctaaacgttgcaaccttgctaatcgccccgttggttacaagtgtggaccttacactcttccttgaaagagttgaggttgttgctaagaacaaagacaactgggatatgcattgttgctgttagctactagtatgatcaccacaacttagttgtgttgtattgtaactttgttgtttatagtgtgtcgataagacctagcagctcatttgtgtacacctgatgaataaaactgtttcactttcagt

SEQ ID NO: 6564 - DNA, 533 bp, Cicer arietinum
aagagatataacacacattaagaaaatggagactcttgttaagtttgtgtgccttatgtctttgttgtacttgttagtgttgcaagtgtggaaagtgctggtgaatgtaggaaaatccactacaccagataatgaagtctttaagctagctccttgtgcaagtgcagcacaagatagaaatgcaagtgtgtcacaaagttgttgtgctcaggttaagaaacttggtcagaatccaagttgttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccc

SEQ ID NO: 6565 - DNA, 576 bp, Cicer arietinum
agactcttgttaagtttgtgtgccttattgcttttgttgtacttgttagtgttgcaagtgtggaaagtgctggtgaatagtggaaaataccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccctgaataaaacatgcactttcagttcagtgtttttattttatgaatcttattaaactttatggttgatgc

SEQ ID NO: 6566 - DNA, 613 bp, Cicer arietinum
gtaagatataaacactaacattaagaaaatggagtactcttgttaagtttgttgtgccttattgctttgtttgtacttgttagtgttgcaagtgtggaaagtgctggtgaatagtggaaaaatccactacaccagataatgaagcttttaagctagctccttgtgcaagtgcagcacaagatgaaaatgcaagtgtgtcacaaagttgttgtgctcaggttaagaaacttggtcagaatccaagttgtttatgtgctgttatgctatcaaacactgccaaaatgtctggtgctgaccctcaaattgctgtgactatccctaaacgttgcaacattgctactcgccctgttggttacaagtgtggaccttacactctgccttgatagagttgaggttattgctgaaaacaaagataaatgggatatgcatcgttgctgttagctactagtatggtgattatcacagcttctttgagttgtcttgtaactttgttgttgtttatagtggataagaagagctagcagctcacttgtgtacaccctgaataaaacatgcactttcagttcagtgttttattttatgaatcttattaaactttatggtggatgctttt

SEQ ID NO: 6567 - DNA, 2279 bp, Glycine max
ataatattaaagccattgcaccatcttattaacaccacaaactccactaactgacaaaatgtggcgaaggagcttcagcagcagcaccgccgccaccaccgcgactctgaagggcaagaaatgggacgcgctgataatcggtggcggccacaacggcctgacggcggcggcatatctcgcccggggaggcctctcggtggcggtgcttgagcggcgccacgtgatcggcggcgccgccgtgacggaggagctggttccagggttcaagttttcgcggtgcagttaccttcagagcctgctgagaccgtccgttataaaggagctggagttggggaagcacggtttgaagcttctgaagcgcaatccgtcgtcgtttacgccctgcctcgacggacgctaccttctcttagggcccgacaaggacctcaaccactctgagatctccaaattctcactcgcagatgctcaggcttatccaagatatgagagtcagcttgagagcttctgtaagttcatggatctagtgctggattcgcccccacctgaatctgtgcaccataaatcgtctattaatgaaaaactgaagaataaaatacagaattcagtattttgggcaagttgtctgcggcaggtgtcttccttggggcaaaaggatatggtgaactttatggaccttctgttgtccccagcttctaaggttttgaacaactggtttgagacagatgttctgaaggcaacccttgcaactgatgctgtgataggcagtacagccagtgtccacaccccaggaagtggctatgtgctgctacatcatgtgatgggcgaaactgatggggaacgaggaatttggtcatatgttgaaggtggaatgggctcaatatccaaggctattggtaatgctgctattgaagctggagctcatgttgtaaccaacgctgaggtgtctcggttattgattgaaaacactagcactgtctgtggggtgactttggctgatggtactgaagtgcattcttcaattgttttgtctaatgcaactccatacaaaactttcatggaattagtgcccaacgatatcctccctgatgattttgttcgtgccattaagcactctgactacagttctgctactacaaaactaaatgtagcagttgataaattgcccgaatttcgctgttgcaagttagatcacccacatgctggcccacagcatgtcggcacaattcatataggttcagaaagcatggaggagattcactctgcatgtcaagatgcagtaaatggagtaccatcgagaagaccggttattgagatgacaattccctctgtactggacaaaactatttctccacctggtaagcatgtgatcaacctgtttgtgcagtatacaccctacaaaccattggatggtgattggcaagatcatgactacagagaatcgtttgcacaaaaatgcttcaagttgattgatgaatatgcccctggcttcagcacatcaatcattggttacgatatgctgactccaccggaccttgaaagggaaatcggtttgacaggagggaatatattccatggagctatggggttggattcccttttcctcatgcgacctgcaaagggatggtcaaactacaagactccgcttcgagggttatacttatgcggaagtggggcacatcctggtggtggtgttatgggagcacctgggcgtaatgctgctcgtttagttcttcaagaagttggagaaagaacttaaagtggtgatactgagttatgattctcacccaaatggttactgcctgcaaactggctcggaaagatggctatggctctttcattggaattatatgcagtaactattgcaaaatttgcaacgcgtcagatagaagaatcatcgtgacaatgatttatcaatttggatgagctgcataacaaagatgcagaaacctgtaatgtggatttccgaacactacaacttgtaatcctttttgataatttgactgctgttcaatgcattgattccagtaattactgtttgacacaggacatccatggttgatcatgaatatgaattataatgtgtaggaaagtatttatacgcggtcaacatttcaagtaaattgaatcaatagattaactgaaattgggatcagctaggaacaatgagtgctaagtaaaattgtacacaacattttttatttatcaacaagggtaagaatcgatcacaaatacaaactcaccattagatcaccagtagcaaccatggttaactcaaaact

SEQ ID NO: 6568 - DNA, 2125 bp, Glycine max
cttattaacaccacaaactccactaactgacaaaatgtggcgaaggagcttcagcagcagcaccgccgccaccaccgcgactctgaagggcaagaaatgggacgcgctgataatcggtggcggccacaacggcctgacggcggcggcatatctcgcccggggaggcctctcggtggcggtgcttgagcggcgccacgtgatcggcggcgccgccgtgacggaggagctggttccagggttcaagttttcgcggtgcagttaccttcagagcctgctgagaccgtccgttataaaggagctggagttggggaagcacggtttgaagcttctgaagcgcaatccgtcgtcgtttacgccctgcctcgacggacgctaccttctcttagggcccgacaaggacctcaaccactctgagatctccaaattctcactcgcagatgctcaggcttatccaagatatgagagtcagcttgagagcttctgtaagttcatggatctagtgctggattcgcccccacctgaatctgtgcaccataaatcgtctattaatgaaaaactgaagaataaaatacagaattcagtattttgggcaagttgtctgcggcaggtgtcttccttggggcaaaaggatatggtgaactttatggaccttctgttgtccccagcttctaaggttttgaacaactggtttgagacagatgttctgaaggcaacccttgcaactgatgctgtgataggcagtacagccagtgtccacaccccaggaagtggctatgtgctgctacatcatgtgatgggcgaaactgatggggaacgaggaatttggtcatatgttgaaggtggaatgggctcaatatccaaggctattggtaatgctgctattgaagctggagctcatgttgtaaccaacgctgaggtgtctcggttattgattgaaaacactagcactgtctgtggggtgactttggctgatggtactgaagtgcattcttcaattgttttgtctaatgcaactccatacaaaactttcatggaattagtgcccaacgatatcctccctgatgattttgttcgtgccattaagcactctgactacagttctgctactacaaaactaaatgtagcagttgataaattgcccgaatttcgctgttgcaagttagatcacccacatgctggcccacagcatgtcggcacaattcatataggttcagaaagcatggaggagattcactctgcatgtcaagatgcagtaaatggagtaccatcgagaagaccggttattgagatgacaattccctctgtactggacaaaactatttctccacctggtaagcatgtgatcaacctgtttgtgcagtatacaccctacaaaccattggatggtgattggcaagatcatgactacagagaatcgtttgcacaaaaatgcttcaagttgattgatgaatatgcccctggcttcagcacatcaatcattggttacgatatgctgactccaccggaccttgaaagggaaatcggtttgacaggagggaatatattccatggagctatggggttggattcccttttcctcatgcgacctgcaaagggatggtcaaactacaagactccgcttcgagggttatacttatgcggaagtggggcacatcctggtggtggtgttatgggagcacctgggcgtaatgctgctcgtttagttcttcaagaagttggagaaagaacttaaagtggtgatactgagttatgattctcacccaaatggttactgcctgcaaactggctcggaaagatggctatggctctttcattggaattatatgcagtaactattgcaaaatttgcaacgcgtcagatagaagaatcatcgtgacaatgatttatcaatttggatgagctgcataacaaagatgcagaaacctgtaatgtggatttccgaacactacaacttgtaatcctttttgataatttgactgctgttcaatgcattgattccagtaattactgtttgacacaggacatccatggttgatcatgaatatgaattataatgtgtaggaaagtatttatacgcggtcaacatttcaagtaaattgaatcaatagattaactgaaattggga

SEQ ID NO: 6569 - DNA, 2479 bp, Glycine max
aagcattgcaccatcattattaacaccaaagacaccacaaactccacaaattaacaaaatgtggcgaagaagcttcagtagcagcaccgccgctctgaagggcaagaaatgggacgcgctggtaatcggcggcggccacaacggcctgacggcggcggcatacctcgcgcgcggaggcctctcggtggcgatactggagcggcgccacgtgatcggcggcgccgccgtgacggaggagctggttccggggttcaagttttcgaggtgcagctacctccagagcctgctgagaccgtcggtcataaaggagctggagttggggaagcacggcttgaagcttctgaaaagcaatccgtcgtcgtttacgccctgcctcgacggacgctaccttctcttaggtcccgataaggatctcaatcactctgagatctccaaattctcactcaaagatgctcaggcttatccaagatatcagactcagcttgagagtttctgtaagttcatggatctagtgctggattcgccgccacctgaatctgtgcaccataaatcgtctattaatgaaaaattgaagaataaattacagaattctgtattttgggcaagttgtctgcgacaggtgtcttccttggggcaaaaggatatggtggactttatggaccttctgttgtccccagcttctaaggttttgaacaactggtttgaggcagatgttctgaaggcaacccttgcaactgatgctgtgataggcagtacagccagtgtccacaccccaggaagtggctatgtgctgctacatcatgtgatgggagaaactgacggggaacgtggaatttggtcatatgttgaaggtggaatgggctcaatatccaaggctattggtaatgctgctattgaagctggagcacatgttgtaaccaatgctgaggtgtctcggttgttgattgaaaactctagcactgtctgtggggtggctttggctgatggtactgaagtgcattcttcaattgttttgtctaatgcaactccatataaaactttcatggaattagtgtccaacgatgtccttcctgatgattttgttcgtgccattaagcacactgactacagttctgctactacaaaaataaatgtagcagttgataaattgcccgaatttcattgttgcaagttagaacaccctcatgctggcccacagcatgtcgccacaattcatataggttcagaaagcatggaggagattcactctgcatgtcaagatgcagtaaatggagtaccgtcgagaagaccggttattgagatgtcaattccctccatactggacaaaactatttctccacctggtaagcatgtgatcaacctgtttgtgcagtatacaccctacaaaccattggatggtgactggcaagatcatgactacagagaatcgtttgcacaaaaatgtttcacattgattgatgaatatgctcctggcttcagcacatcagtcattggttatgatatgctgactccaccagatcttgaaagggaaatcggtttgacgggagggaatatattccatggtgctatggggttggattcccttttcctcatgcgacctgcaaagggatggtcaaactacaagactccgcttaaagggttatacttatgcggaagtggggcacatcctggtggtggtgttatgggagcacctggacgtaatgctgctcgtttagttcttcaagaggttggagaaagaacttaagtggtgatatactgagttatgattctcgcccaaattattactgcttgcaaactggcttggaaagatggctctttcattggaattttatgcagtaactaatgtaaatttgcaatgcgtaagatagaagaatgaagaatcgtgacaatgattcatcaaattggatgagcttcataacaaagatacagaagctgtaatgtggatttcagaaaactagaacttgtaatccttttttataatttaacagctgttcaatgcattgattccagtacttactggtcgacacaggacatccacggttgatcatgaattataatgtgtagtgtaggaaagtatttatacgaggacaacatttcaagtaaattgaatcaaacagattaactgaaattgggatcagctgggaacaatgagtgctcagtaaagttgtacacaacattttttttatcaacaaggtagggaatcgatcacaaatacaaactcaccagtagaaaccatggtcaactcaaaactgtaattcagggtgtcaatcgttgtttcaattaggagcacttacactagggttttggacaaagacatcttatggacttccctgaatatagatagttcttcacctgtctgaaccctaggatgcgtagacgcagatccttccggaacttcaattgaaattatattactgcgacctccaaccagaaactgattttggaacaagattgattgctttggatgctgattcgagcc

SEQ ID NO: 6570 - DNA, 2451 bp, Glycine max
aagacaccacaaactccacaaattaacaaaatgtggcgaagaagcttcagtagcagcaccgccgctctgaagggcaagaaatgggacgcgctggtaatcggcggcggccacaacggcctgacggcggcggcatacctcgcgcgcggaggcctctcggtggcgatactggagcggcgccacgtgatcggcggcgccgccgtgacggaggagctggttccggggttcaagttttcgaggtgcagctacctccagagcctgctgagaccgtcggtcataaaggagctggagttggggaagcacggcttgaagcttctgaaaagcaatccgtcgtcgtttacgccctgcctcgacggacgctaccttctcttaggtcccgataaggatctcaatcactctgagatctccaaattctcactcaaagatgctcaggcttatccaagatatcagactcagcttgagagtttctgtaagttcatggatctagtgctggattcgccgccacctgaatctgtgcaccataaatcgtctattaatgaaaaattgaagaataaattacagaattctgtattttgggcaagttgtctgcgacaggtgtcttccttggggcaaaaggatatggtggactttatggaccttctgttgtccccagcttctaaggttttgaacaactggtttgaggcagatgttctgaaggcaacccttgcaactgatgctgtgataggcagtacagccagtgtccacaccccaggaagtggctatgtgctgctacatcatgtgatgggagaaactgacggggaacgtggaatttggtcatatgttgaaggtggaatgggctcaatatccaaggctattggtaatgctgctattgaagctggagcacatgttgtaaccaatgctgaggtgtctcggttgttgattgaaaactctagcactgtctgtggggtggctttggctgatggtactgaagtgcattcttcaattgttttgtctaatgcaactccatataaaactttcatggaattagtgtccaacgatgtccttcctgatgattttgttcgtgccattaagcacactgactacagttctgctactacaaaaataaatgtagcagttgataaattgcccgaatttcattgttgcaagttagaacaccctcatgctggcccacagcatgtcgccacaattcatataggttcagaaagcatggaggagattcactctgcatgtcaagatgcagtaaatggagtaccgtcgagaagaccggttattgagatgtcaattccctccatactggacaaaactatttctccacctggtaagcatgtgatcaacctgtttgtgcagtatacaccctacaaaccattggatggtgactggcaagatcatgactacagagaatcgtttgcacaaaaatgtttcacattgattgatgaatatgctcctggcttcagcacatcagtcattggttatgatatgctgactccaccagatcttgaaagggaaatcggtttgacgggagggaatatattccatggtgctatggggttggattcccttttcctcatgcgacctgcaaagggatggtcaaactacaagactccgcttaaagggttatacttatgcggaagtggggcacatcctggtggtggtgttatgggagcacctggacgtaatgctgctcgtttagttcttcaagaggttggagaaagaacttaagtggtgatatactgagttatgattctcgcccaaattattactgcttgcaaactggcttggaaagatggctctttcattggaattttatgcagtaactaatgtaaatttgcaatgcgtaagatagaagaatgaagaatcgtgacaatgattcatcaaattggatgagcttcataacaaagatacagaagctgtaatgtggatttcagaaaactagaacttgtaatccttttttataatttaacagctgttcaatgcattgattccagtacttactggtcgacacaggacatccacggttgatcatgaattataatgtgtagtgtaggaaagtatttatacgaggacaacatttcaagtaaattgaatcaaacagattaactgaaattgggatcagctgggaacaatgagtgctcagtaaagttgtacacaacattttttttatcaacaaggtagggaatcgatcacaaatacaaactcaccagtagaaaccatggtcaactcaaaactgtaattcagggtgtcaatcgttgtttcaattaggagcacttacactagggttttggacaaagacatcttatggacttccctgaatatagatagttcttcacctgtctgaaccctaggatgcgtagacgcagatccttccggaacttcaattgaaattatattactgcgacctccaaccagaaactgattttggaacaagattgattgctttggatgctgattcgagcc

SEQ ID NO: 6571 - DNA, 2266 bp, Cajanus cajan
aacgacaccacaaaattcacaaatttacgatatgtggcggaggagcttcagcagcagcagcggcagcaccgcattgaaggccaagaaatgggacgcgctgatcatcggcggcggccacaacggcctcacggcggccgcatacctcgcccgcggaggcctgtcggtggcggtcctggagcggcgccacgtcatcggcggcgccgccgtgacggaggagctggttcccgggttcaagttttcgcggtgcagttaccttcagagtctcctgagaccgtccgttatcaaggaactggagttggagaagcacggcttgaagcttctgaagcgcaatccgtcgtcgtttacgccctgtctcgacggacgctaccttctcatgggggccgacgaacatctcaaccactctgagatctccaaattctcgctgactgatgcagaggcttatccaagatatgcgagtcagcttgagaaattctgtaagttcatggatctagtgctggattcgcctccgcctgaatctgtgcagcacaaatcgtctattaatgaaaaattgaagaataaaatacagaattcagtattttgggcaaattgtctgcgccaggtgtcttccttggggcaaaaggatttggtggactttatggaccttctgttgtccccagcttctaaggttttgaataactggtttgaggcagatgttctgaaggcaacccttgcaactgatgctgtgataggcagtacagccagtgtccacaccccaggaagtggctatgttctgcttcatcatgtgatgggagaatctgatggggagcgtggagtttggtcatatgttgaaggtggaatggggtcaatatccaaggctattgggaatgctgctattagagctggagcacatattgtaaccaatgctgaggtggctgggctgttgattgaaaactctaggactgtctgtggggtgattttggccgatggtactgaagtgcattcttcaattgttctgtctaatgcgactccatataaaacttttatggaatttgtgcccaacaatgtcctccctgatgattttgttcgtgcaattaagcactctgactacagttctgctactacaaaaataaatgtagcagttgataaattgccccaatttccttgttgcaagttaaatcatcctcatgctggcccgcagcatgtcggcacaattcatataggttcagaaagcatggaggagattcactctgcgtgtcaagatgcagtaaatggaataccatccagaagaccagttattgagatgaccattccctccgcactggacaaaactatttctccacctggtaagcatgtgatcaacctgtttgtgcagtatacaccctacaaaccattggatggcgactggcaagatcatgactacagagaatcatttgcacaaaaatgcttcacgttgattgatgaatatgcgcctggcttcagtacatcaatcattggatatgacatgctgactccaccagatcttgaaagggaaatcggtttgacgggtgggaatatatttcatggtgctatggggttggattcccttttccttatgcgacctgcaaagggatggtcaaactataagactccgcttcaagggttatacttatgcggaagtggggcacatcctgggggcggagttatgggagcacctggacgtaatgctgcgcgtttagttcttcaagatgttggagaaagaacataagtggtgatacctaattatgactctcgctcaaattgtcagtgcctgtaaacaggctcggaggaattggtatttcattggaattatatgcagtaacttatgcaaaatttgcaacgcattagatagaagaataatgacaattatttatcaaattggatgagcagcataacaaatatgctataacttgtaatttctttaagataatttgccgcttgttcaatgcattgattccatttgttactgcttgacacgggaattctacgactacggttgatcattaattttaatgtgtattaaagtatttatacgaggtcaacatttcaagtcaattgaatcaaacagattaagtgaaattggaatcatctgggaacaattgagtggtcagtacagtacagtacacggtttctttgatcaataagggtagggaatcactaatgcaaactcaccaattgcctaaccaacccgttattatatcaggatgtcagtcatttcaaatgggagcactcacattagggttttggacgacaatacatcctacggactccc

SEQ ID NO: 6572 - DNA, 2026 bp, Medicago truncatula
ttaccacttatcagtcaacactctcgagagtgaaaccaaaaccttcttcaattccataaaaaacataccaaatgtggcgaaggaagttcaccaccaccatctccggcagcgccgccgcattgactgacaagaaatgggacgcactgatcatcggcggcggccacaacggcctaacagcagcagcatatctagcacgtggaggtctctcagttgccgtcctcgaacgccgccacataatcggcggagccgccgtaactgaggaacttattccaggtttcaagttttctcgctgcagttacctccaaagccttctccggccggcagttatcaatgaactggagttggcaaagcatggattgaagcttctgaagagaaatccgtcgtcgtttacgccgtgtcttgatggaagatatcttctcttaggacctgataaagatcttaatcactctcagatttctaaattctcaaaagctgatgcagatgcttatcccaaatatgagagtcagcttgagaccttctgtaaattcatggatctagtgctggattcatctccacctgaatctttgcaacataagtcatctcttaatgaacaactgaagaataaattacagaattcagtattttgggccagttgtttgcggcatgcagcctccatggggcaaaaggatatggtggactttatggaccttttgttgtctccagcttcgaaagtattgaataactggtttgaggcagatgttctgaaggcaacacttgcaacagatgctgtgataggatctacggccagtgtccacaccccaggaagtggttatgttctgctacatcatgtaatgggagaatctgatggagaacgtggaatttggtcatatgttgaaggtggaatgggctcaatatccaaggctattgctagtgctgctgtggcagctggagcacatgttgcaacgaatgctgaggtctctcagttgttgatcaaaaactctagcactgtcagtggggtgattcttgctgatggtactgaagtgcatgcttcagttgttctgtctaatgcaacaccttataaaactttcatggacttagtgcccaacaatgttctccctgatgatttttctcgggcaattaagcactctgactacagctctgctaccacaaaaataaatgtagcggttgataagttgccccaatttcagtgttgcaagtcaaatcattctcaagctggcccagagcatgttggcactattcatataggttcagagagcatggaggagattcattctgcatctcaagactcggtgaatggaataccatcaagaagaccggtcattgagatgacaattccttccgtattagacaaaactatatctccaccaggtatgcatgtgataaacctgtttgtgcagtatacaccctacaaaccatcggatggagactggcaagatcatgagtacagagaatcatttgcacaaaaatgcttcacattgattgatgaatatgcacctggtttcagcacatcagtcgtcggttatgacatgctgactccaccagaccttgaaagggaaatcggtttgacaggagggaatatattccacggtgctatgggtttggattctcttttcctcatgcgacctgtaaaaggatggtcaaactataagactccacttaaaggtttatacttatgcggaagtggagcacatcctggtggtggagttatgggagcacctggacgcaatgctgcccatctagttcttcaggatatcagaaaaacatgagtgatgataattgcagcttaagcccaagttgttgatgcctgcaaatagggttggaaagatatttctttcagtggtaccagcggtatttatatgctcgagctttttatgtgatgtattggttagaaggatcacaaaattgatctaccgaattatattaacaattgcacaagtttgcagatgttgtaacatgtattttattttagagaacttaaacctgtaatccttcaagacaagctggcaattttgctatgcattgattc

SEQ ID NO: 6573 - DNA, 2025 bp, Medicago truncatula
cacttaccacttatcagtcaacactctcgagagtgaaaccaaaaccttcttcaattccataaaaaacataccaaatgtggcgaaggaagttcaccaccaccatctccggcagcgccgccgcattgactgacaagaaatgggacgcactgatcatcggcggcggccacaacggcctaacagcagcagcatatctagcacgtggaggtctctcagttgccgtcctcgaacgccgccacataatcggcggagccgccgtaactgaggaacttattccaggtttcaagttttctcgctgcagttacctccaaagccttctccggccggcagttatcaatgaactggagttggcaaagcatggattgaagcttctgaagagaaatccgtcgtcgtttacgccgtgtcttgatggaagatatcttctcttaggacctgataaagatcttaatcactctcagatttctaaattctcaaaagctgatgcagatgcttatcccaaatatgagagtcagcttgagaccttctgtaaattcatggatctagtgctggattcatctccacctgaatctttgcaacataagtcatctcttaatgaacaactgaagaataaattacagaattcagtattttgggccagttgtttgcggcatgcagcctccatggggcaaaaggatatggtggactttatggaccttttgttgtctccagcttcgaaagtattgaataactggtttgaggcagatgttctgaaggcaacacttgcaacagatgctgtgataggatctacggccagtgtccacaccccaggaagtggttatgttctgctacatcatgtaatgggagaatctgatggagaacgtggaatttggtcatatgttgaaggtggaatgggctcaatatccaaggctattgctagtgctgctgtggcagctggagcacatgttgcaacgaatgctgaggtctctcagttgttgatcaaaaactctagcactgtcagtggggtgattcttgctgatggtactgaagtgcatgcttcagttgttctgtctaatgcaacaccttataaaactttcatggacttagtgcccaacaatgttctccctgatgatttttctcgggcaattaagcactctgactacagctctgctaccacaaaaataaatgtagcggttgataagttgccccaatttcagtgttgcaagtcaaatcattctcaagctggcccagagcatgttggcactattcatataggttcagagagcatggaggagattcattctgcatctcaagactcggtgaatggaataccatcaagaagaccggtcattgagatgacaattccttccgtattagacaaaactatatctccaccaggtatgcatgtgataaacctgtttgtgcagtatacaccctacaaaccatcggatggagactggcaagatcatgagtacagagaatcatttgcacaaaaatgcttcacattgattgatgaatatgcacctggtttcagcacatcagtcgtcggttatgacatgctgactccaccagaccttgaaagggaaatcggtttgacaggagggaatatattccacggtgctatgggtttggattctcttttcctcatgcgacctgtaaaaggatggtcaaactataagactccacttaaaggtttatacttatgcggaagtggagcacatcctggtggtggagttatgggagcacctggacgcaatgctgcccatctagttcttcaggatatcagaaaaacatgagtgatgataattgcagcttaagcccaagttgttgatgcctgcaaatagggttggaaagatatttctttcagtggtaccagcggtatttatatgctcgagctttttatgtgatgtattggttagaaggatcacaaaattgatctaccgaattatattaacaattgcacaagtttgcagatgttgtaacatgtattttattttagagaacttaaacctgtaatccttcaagacaagctggcaattttgctatgcattg

SEQ ID NO: 6574 - DNA, 2094 bp, Trigonella foenum-graecum
aaacataaacataagaagacacttcacagttcacactcttcagagtcgaaccaaatgtggcgtaggaggtttagcaccaccgtttccggcagcgccgcctcattgacggacaagaaatgggacgcactgatcatcggcggcggccacaacggcctaacagcagcagcatacctcgcccgtggaggcctctcagtagccgtcctcgaacgccgccacataatcggcggcgcagccgttactgaggagctaattccaggtttcaagttttctcgttgcagttacctccaaagccttctccggccggcagttatcaacgaactggagttggcgaagcatggattgaagcttctgaagagaaatccgtcgtcgtttacgccgtgtcttgatggacgctaccttctcttagggcctgataaggatcttaatcactctcagatttccaaattctcaaaaaatgatgcagaagcttatcctaaatacgaaagtcagcttgagaacttctgtaaatttatggatctagtgctggattcgtctccacctgaagctttgcaacataaatcatctcttaatgaacagctgaagaataaattacagaattcagtattttgggccagttgtttgcggcacgcagcctccatggggcaaaaggatatggtggactttatggaccttttgttgtccccagcttctaaagttctgaataactggtttgaggcagatgttttgaaggcaacacttgcaacagatgctgtgataggatctacagccagtgtccacaccccaggaagtggttatgttctgctacatcatgtaatgggagaatctgatggagaacgtggaatttggtcatatgttgaaggtggaatgggctcaatatccaaggctattgctagtgctgctgtggcagctggagcacatgttgcaacaaatgctgaggtgtctcaattgttgattaaaaactctagcactgtcagtggggtgattcttgctgatggtactgaagtgcatgcttcagttgttctgtctaatgcaacaccttataaaactttcatggatttagtgcccaacaatgttctccctgatgatttttctcgggcaattaagcactctgactacagctctgccaccacaaaaataaatgtagcggttgataagttgccccaatttcagtgtatcaagtcagatcattctcatgctggcccagagcatgttggcactattcatataggctcagagagcatggaggagattcacgctgcatctgaagatgccgtgaatggaataccatcaagaagaccggtcattgagatgacaattccttccgtattggacaaaactatttccccgccgggtatgcatgtgataaacctgtttgtgcagtatacaccctacaaaccattggatggggactggcaagatcgtgagtacagagaatcatttgcacaaaagtgcttcacattgattgatgaatatgcacctggtttcagcacatcagtcgtcggttatgacatgctgactccaccagatcttgaaagggaaatcggtttgacaggagggaatatatttcatggtgctatgggtttggattcacttttcctcatgcgacctgtaaaaggatggtcaaactataagactccacttaaaggcttatacttgtgtggaagtggagcacatcctggcggtggagttatgggagcgcctggacgcaatgctgcccatgtagttcttcaggatgtcaggaaaacatgagcgattatgattctagctcacacccaagttgttaatgcctgcaaataggcttggaaaggatatgtctttcagtggtaccagtgctgtttatatgcaggagctttttgtgatgtattggttagaagaggatcacaaaattgatctaccaaattatattaacaatttcacaagtttgcagatgttgtaacgtgtattttagaaaacttgaacctgtaatccttcaagacaagctggcaattgtgctatgcattgattccagtaaatgttataatacaggaaatccaatattcttcatgaattgcaatatgtaggaatatagtgtcaacatttcaaggcaaggcagcc

SEQ ID NO: 6575 - DNA, 2009 bp, Cicer arietinum
gagagagacagttagttcagaaatcgaacagtattgagagtcaaactaaaagctaacaatacaaatgtggcgaaggaagtttaccaccaccgtctctggcagcgcctcttcacttaaagacaagaaatgggacgcactcattatcggaggcggccataacggtctcacagccgcagcatacctcgctcgtggaggcctttcagttgctgtactcgaacgccgctacataatcggcggcgccgccgtaacagaggagcttattcccggttttaagttttcgcgatgtagttacctccagagccttctccgaccggcggtgatcaatgaactggagttggcgaagcacggattgaagcttctgaagagaaatccggcgtcgtttactccttgtcttgatggacgctaccttatcttgggacctgataaggatgtcaatcattctcagatttcgaaattctcacaagctgatgcagatgcttatccaatatatgagagtaagcttgagaacttctgtaagttcatggatcttgtgctggattcggctccacctgaatctttgcaacataaatcatctcttaacgaacaattgaagagtaaattacagaattcagtattttgggccagttgtttgcagcaggcagcctgcatggggcaaaaggatatggtggactttatggaccttttgttgtccccagcttctaaagctttgaataactggtttgagacagatgttctgaaggcaacacttgcaacagatgctgtgataggatctacggccagtgtccacaccccaggaagtggttatgttctgctacatcatgtaatgggagaaactgatggagatcgtggaatttggtcatatgttgaaggtggaatgggctcaatatccaaggctattgctagtgctgctaccacagctggagcacatatcgtaacgaatgctgaggtgtctcaattgttgattaaaaactctagcactgtctgtggggtgattctggccgatggtactgaagtgcatgcttctgttgttctgtctaatgcaacaccttataaaactttcatggaattagtgcccaacaatgtcctccctgatgattattttggggcaattaagcactctgactacagttctgccaccacaaaaataaatgtagcagtcgataaattgccccagtttcagtgttgcaagtcaaatcattctcatgctggcccagagcatgttggcactattcatataggttcagagagcatggaggagattcactctgcatctcaagacgcggtgaatggaataccatcaagaagacctatcattgagatgacaattccttccgtattggacaaaactatatctccgccaggtaagcatgtgataaacctgtttgtgcagtacacaccctacaaaccattggatggggactggcaagatcatgactacagagaatcatttgcacgaagatgcttcacattgattgatgaatatgcacctggtttcagcacatcagtcattggttatgacatgctgactccaccagatcttgaaagggaaatcggtttgacaggagggaatatatttcatggtgctatgggtttggattctcttttcctcatgcgacctgtaaaaggatggtcaaactataagactccacttaaaggtttatacttatgcggaagtggggcacatcccgggggtggagttatgggagcacccggacgcaatgccgcccatttagttcttcgggatatcagaaaaacatgagtgatgataatatgataattgtatttgtagctctcaccaagttgttgatgcctgcaaataggcttggaaagatatgtcttcctgtgaaatttatatgcaggagatatctttttgtgatgtattggatagaaggatcgcaaaaattgatctaccatataattttattatttaacaacttttagaataattatatttttagttatcttgttttcattgattcatgaaattatttctctattttaaaaatctg

SEQ ID NO: 6576 - DNA, 1893 bp, Populus trichocarpa
cagaaacaagccaaacagaaactttttttattttaagaaaaaaaacaccgtaatgtggagacggagctttagcacggcaaccaatgcctcgaccgcactgaaggagaagaaatgggacgcgctggtgatcggcgccggccacaacggcctaacagctgccgcttatttagctggctccggcctatccgtcgccgttcttgaacgccgccacgtcatcggcggagctgccgtaacggaagaactgattccaggcttcaagttctctcgctgtagttatctccaaagtctcctccgtccttcactcatcaaagagttggagttagggaggcatggattgaagttgttgaagaggagtccgtcgtcttttacgccgtgtttagatggaagctaccttttattagggcctgatagagagcttaatcattcagagatctctaagttctctgttaatgacgccaatgcatatcacagatatgagaagcagctagagagtttctgtaagttgatggatcctttgttggactcgccaccaccagaaactgcgcaaaatggagcgtcttttaatgatcgattgaaggacaaattgagaaaatcggctttttgggcaagttttatgcggcaagcgctctcattagggcaaaaagatttggtggattttatggaccttttgttgtctccagcttcgaaggttttgaataaatggtttgagacagatgttcttaaggcaactcttgcaacagatgctgtgataggttctacggcaagtgtccatacaccagggagtggatatgttttgctacatcacgtgatgggagaaactgatggggaacgtggaatttggtcgtatgttgaaggtgggatgggttcagtatcctctgctatcgcaaatgctgctagggaatctggggctcatattgtgacaagtgcagaggtttcacaattgatgatcaaggattctggcactgtgaatggggtattactggctgatggtacagaagttctctctccaattgttctgtcaaatgccactccttataagactttcttggaattagtccctaataatacccttcctgatgattttacccgtgccctgaagtactctgactatagctctgcaactacaaagattaatctagctgttgataaactcccccaatttcaatgctgcaagttgaatcatcctgatgctggtcctcagcacgtgggcactattcatattggttcagagagtatggaggagattgatttggcttgtcaagatgctgtcaatggggtaccatcaagaaggccagttatcgaaatgacaattccttctgtattggacaaaactatttctcctcctggtaagcatgtgatcaacttgtttgtccaatacacaccctataagccatcagatggaagctggggagattctgcttatagagaatcatttgcacaaaaatgttttagcttgattgaggaatatgcccctgggttcagctcatcaatcattggctatgacatgttgactccaccagatcttgaaagggaaattggtcttacaggagggaatatattccacggtgctatgggattggattcccttttcctcatgcgaccagtgaaaggatggtcgagctataggactcctctccaagggctgtatttgtgtggaagcggaacccatccagggggtggtgtgatgggcgcacctggacgcaatgctgcacatgtcgttcttcaagatgttgaaaaaccttgaaccgattctcttgtagtgtgtttgggattttcaaaaattttgatttttttttatttaaaatatttttttatatattttcagataattttgatatgtagatattaaaaataatttaaaaaaattttaaaaaaattattttaatatatttt

SEQ ID NO: 6577 - DNA, 2020 bp, Theobroma cacao
aaccaaacgagcatttgctccactatcgtttttcattacaaaatttcagactctctctcttatttattttctgccaatcaataagctgaaagcaagctcacccagagcaatgtggcgaaggagcttcagcaccggcagtcacgtgagctccatgcacatgctgaaggagaaaaaatgggacgcgctcgtaatcggaggtggccacaacggcttgactgcggcggcttacttagctcggagtggactctccgtggccgtgctcgagcgacgccacatcatcggtggagcggcagttaccgaagaactgatccctggcttcaagttctctcgatgcagttacctccagagcctcctccgcccctccatcatcagagaactagagttagcgagacatggattgaagttgttgaaaaggaatccatcgtcgtttactccttgtttggatggaagatatcttttgttagggcctgataaagagcttaatcattctgagatctccaagttctccaaacgagatgccgatgcttatccaagatatgagagtcagttagagaggttctgtaaactcatggatccacttttggattcaccacctcctgaaactttgcaaggtatctcatctctccaagatcgattcaaaaataaagtacacaactcagcctattggactcgattgctgtgccaggctgcatccttggggcagaaagatatggtggattttatggatcttttattgtccccggcttcaaaggttttgaataactggtttgagacagatgttctgaaggcaacccttgcaacagatgctgtgatagggagtacggctagtgtctgcacaccagggagtggatatgttctgctacatcatgtaatgggagaaacagatggtgatcgtggaatttggtcatacgttgaaggtggaatggggtcagtctctatggctattggcaatgctgccaaagaagctggggctcatattgtcacaagtgcggaggtttcacagctgatagttgaggactcaggcaaagtgaatggggtgctgctggctgatggtacactggtgcattcttcaagcgttttatcaaatgcaaccccttataaaactttcatggaattggtgcctgataatgttcttcctgatgatttcagttatgccattaagtattctgattacagctctggaactacaaaaataaacctagctgttgataaattgcctgagtttcactgttgcaagtcaatttatcctggttcaggtcctcagcacactggtaccattcatattggttctgagagcatggaggagattaattcagcctctcaagatgccgtcaatggattaccatcaagaaggccagtcattgaaatgacaattccatccgtactggacaagacaatttctccacctggtaagcatgtcattaacttgttcatccaatacacaccttataaaccattggatggcggctgggatgatcctgcttatagggaatcatttgcacaaagatgtttcaccttgattgatgaatatgctccggagttcagctcatctatcattggctatgacatgctaactcctcctgaccttgaaagggaaataggcttgacaggaggaaatatctttcatggtgcaatgggattagattctctttttctcatgcgacctgttaaaggatggtcaaattataggaccccgttgccaggcctttacttgtgtggtagtggtgctcatcctgggggaggtgtgatgggtgcgccgggccgcaatgcagcacagctagttcttcaagatttcaagaaaaaatccaagtgatgctcggaaaaccaagctccgctttttcattagtctctggcaaatatatcctttggtcgaaattcagagcggcttctttatccgaatcatgatgttgaattaaatatacgtcctgcatgtcatttttattattattatgcttttatataaaattattaaaatagagtatttaacaatacaaaacatagatataactagatgttgaaa

SEQ ID NO: 6578 - DNA, 1852 bp, Prunus persica
aaatgtggcgaaggagctttagcagcagcagcagcgcgggcgctacaagttcgttgaaggacaagaaatgggacgctctggtcattggtggtggccacaacggcctcacggctgccgcgtacctcgcacgtggcggcctatccgtcgccgtccttgaacggcgtcacgtgatcggcggcgctgccgtgaccgaagaactcgttcccggcttcaaattctctcggtgtagctacctccaaagcctcctccgcccctccatcatcaaagaactagagctggcgcggcatggaatgaagttgctgaagaggagcccctcgtcgttcacgccttgtttggatggaaaatatcttcttttggggccaaacaaggacttaaaccactctgagatttccaagttctccaaacaagacgccgatgcttatccaagatatgagaatcagctgcagaagttttgtgaatttatggaccccttgttggattcggctcctcctgaatctttgcaatgtgaatcatcttgtagtgttggtgaccgcatcaagaataagatgcacaattcaatgttttggactcggtgtctgagacaggctgccaccttaggccaaaaagatatggtggattttatggaccttttactatctccggcttcaaaggttttgaacaactggtttgagtcagatgttctgaaggcaacccttgcaacagatgctgtaataggaaccacgagaagtgtccatacaccagggagtggatatgtcctgctacatcatgtgatgggagaaactgatggtgagcgtggaatttggtcgtatgttgaaggtgggatgggttcagtatccttggctatcggtaatgccgctaaggaagctggagctcatattgtaacatgtgcagaggtgcaacaattgttgattaatgactctggcacggtcaacggggttttgctggctgatggttcacaagtgcacacttcaatggttttatcaaatgcaaccccttataaaacattcaaggagttggtgccggataatgttcttcctgatgatttcattaatgcaattaagtactctgattacagctctggaacgacaaaaataaatttggcagttgataaattgcctcagttcaaatgttgcaagttaagtcatcctgatgcaagtcctcagcatgtggggaccattcatattggttctgagagtatggaggagattcactctgcctgtcaagatgctgtcaatggattaccgtcgcaaagaccagttattgagatgacaataccttctgtactggacaatactatatctccacctggtaagcatgtgatcaacttgtttattcagtacacaccatatagtccgtcagatggtcactggggagatcctgtttacagagaatcattcgcacaaaaatgttttaccctgattgatgagtatgccccggggttcagttcatcaatcattggttacgacatgttgactccaccagaccttgagagggaaattggtttaacaggagggaatatcttccatggtgctatgggattggattcgctctttctcatgcgacccgttaaaggatggtcaaattacagaacaccattgcatgggctgtatttgtgtggcagcggtacccacccgggaggtggtgtgatgggtgcacccgggcgtaatgctgcgcgtgtggctcttgaagatgttaacaagcccttgaaatgattttcagaatggtaccaacttaccatcgatgttaatctgacggttctactttcatttgcagttgggtgtgggctgaaatttacgggcacacaaccacttttttccttatcttgtatcttgtgttatcttttttgggtttt

SEQ ID NO: 6579 - DNA, 2265 bp, Theobroma cacao
tacgtatcagaacaagataagcaaaactgaatgcgcttacgacaaacattctttcagggttcagacgtttaattgcctttcttttatgctttttattttttcaaaaaattagaaaatatgacgtggtggtgatgatgaggtgtcgagcaagctaagattaagaaataagttttcaaatcacaatgtttggtcaaaaactccaaccaaacgagcatttgctccactatcgtttttcattacaaaatttcagactctctctcttatttattttctgccaatcaataagctgaaagcaagctcacccagagcaatgtggcgaaggagcttcagcaccggcagtcacgtgagctccatgcacatgctgaaggagaaaaaatgggacgcgctcgtaatcggaggtggccacaacggcttgactgcggcggcttacttagctcggagtggactctccgtggccgtgctcgagcgacgccacgtcatcggtggagcggcagttaccgaagaactgatccctggcttcaagttctctcgatgcagttacctccagagcctcctccgcccctccatcatcagagaactagagttagcgagacatggattgaagttgttgaaaaggaatccatcgtcgtttactccttgtttggatggaagatatcttttgttagggcctgataaagagcttaatcattctgagatctccaagttctccagacgagatgccgatgcttatccaagatatgcgagtcagttagagaggttctgtaaactcatggatccacttttggattcaccacctcctgaaactttgcaaggtatctcatctctccaagatcgattcaaaaataaagtacacaactcagcctattggactcgattgctgtgccaggctgcatccttggggcagaaagatatggtggattttatggatcttttattgtccccggcttcaaaggttttgaataactggtttgagacagatgttctgaaggcaacccttgcaacagatgctgtgatagggagtacggctagtgtctgcacaccagggagtggatatgttctgctacatcatgtaatgggagaaacagatggtgatcgtggaatttggtcatacgttgaaggtggaatggggtcagtctctatggctattggcaatgctgccaaagaagctggggctcatattgtcacaagtgcggaggtttcacagctgatagttgaggactcaggcaaagtgaatggggtgctgctggctgatggtacactggtgcgttcttcaagcgttttatcaaatgcaaccccttataaaactttcatggaattggtgcctgataatgttcttcctgatgatttcagttatgccattaagtattctgattacagctctggtactacaaaaataaacctagctgttgataaattgcctgagtttcactgttgcaagtcaatttatcctggttcaggtcctcagcacactggtaccattcatattggttctgagagcatggaggagattaattcagcctctcaagatgccgtcaatggattaccatcaagaaggccagtcattgaaatgacaattccatccgtactggacaagacaatttctccacctggtaagcatgtcattaacttgttcatccaatacacaccttataaaccattggatggcagctgggatgatcctgcttatagggaatcatttgcacaaagatgtttcaccttgattgatgaatatgctccggagtttagctcatctatcattggctatgacatgctaactcctcctgaccttgaaagggaaataggcttgacaggaggaaatatctttcatggtgcaatgggattagattctctttttctcatgcgacctgttaaaggatggtcaaattataggaccccgttgccaggcctttacttgtgtggtagtggtgctcatcctgggggaggtgtgatgggtgcgccgggccgcaatgcagcacagctagttcttcaagatttcaagaaaaaatccaagtgatgctcggaaaaccaagctccgctttttcattagtctctggcaaatatatcctttggtcgaaattcagagcggcttctttatccgaatcatgatgttgaattaaatatacgtcctgcatgtcatttttattattattatgcttttatataaaattattaaaatagagtatttaacaatacaaaacatagatataactagatgttgaaataatatatttaatattattataaaaaatcgatatattttactgt

SEQ ID NO: 6580 - DNA, 1967 bp, Prunus mume
ctaactggtaagcagcaaaaaccagcagagaagaaatgtggcgaaggagcttcagcagcggcagcagcgtaggcgctacaagcgcgttgaaggacaagaaatgggacgctctggtcattggtggtggccacaacggcctcgcggcggccgcgtacctcgcacgtggcggcctatccgtcgctgtccttgaacggcgtcacgtgatcggcggcgccgccgtaaccgaagaactcgttcccggcttcaagttctctcggtgtagctacctccaaagcctcctccgcccctccatcatcaaagaactagagctggcgcggcatggaatgaagttgctgaagaggagcccttcgtcgttcacgccttgtttggatggaaaatatcttcttttggggccaaacaaggacttaaaccactctgagatttccaagttctccaaacaagacgccgatgcttatccaagatatgagaatcagctggagaagttttgtgaatttatggaccccttgttggattcggctcctcctgaatctttgcaatgtgagtcatcttgtagtgttggtgaccgcatcaagaataagatgcacaattcaatgttttgggctcggtgtctgagacaggctgccaccttaggccaaaaagatatggtggattttatggaccttttattatctccggcttcaaaggttttgaacaactggtttgagtcagatgttctgaaggcaacccttgcaacagatgctgtaataggaaccacgggaagtgtccatacaccagggagtggatatgtcctgctacatcatgtgatgggagaaactgatggtgagcatggaatttggtcgtatgttgaaggtgggatgggttcagtatccttggctatcagtaatgctgctaaggaagctggagctcatattgtaacatgtgcagaggtgcaacaattgttgattaatgactctggcacggtcaacggggttttgctggctgatggttcacaagtgcacacttcaatggttttatcaaatgcaaccccttataaaacattcaaggagttggtgccggataatgttcttcctgatgatttcattaatgcaattaagtactctgattacagctctggaacgacaaaaataaatttagcagttgatagattgcctcagttcaaatgttgcaaattaagtcatcctgatgcaggtcctcagcatgtggggaccattcatattggttctgagagtatggaggagattcactctgcctgtcaagatgctgtcaatggattaccgtctcaaagaccagttattgagatgacaataccttctgtactggacaatactatatctccacctggtaagcacgtgatcaacttgtttattcagtacacaccatatagtccatcagatggtcactggggagatcctgtttacagagaatcattcgcacaaaaatgttttaacttgattgatgagtatgccccggggttcagttcatcaatcattggttatgacatgttgactccaccagaccttgagagggaaattggtttaacaggagggaatatcttccatggtgctatgggattggattcgctcttcctcatgcgacccgttaaaggatggtcaaattacagaacaccattgcacgggctgtatttgtgtggcagtggtacccacccgggaggtggtgtgatgggtgcacccgggcgtaatgctgcgcgtgtggctcttgaagatgttaacaagcctttgaaatgattttcggaatgttacctacttacaatcgatgttaatctgacggttcaactttcatttgccgttggatgtgggctgaaatttacgggcacacaaccacttttttacttgtatcttgtatcttctgtttttatttggggttttttttcctttcattcagaatacaaaagtgaataaaataaaataaaataaaataaaataataatcatggttatttaccaattt

SEQ ID NO: 6581 - DNA, 1783 bp, Manihot esculenta
aaatgtggcgaaggaatttcaccacagcaaccgctactcgcgcactcaaggagaagaaatgggacgcgcttgttatcggcgccggccataatggcttgacggccgccgcctaccttgctaaagctggactctctgttgctgtgctcgagcgccgtcatgtcatcggtggcgcagccgtaacggaggagcttattccaggcttcaagttctctcgctgtagctacctccaaagtctcctccgcccctcagtaatcaaagagttggagttgaagagacatggacttaagttgttgaagagaaatccgtcctcatttacaccctgtttagacggacgctaccttctattaggacctgataagaaccttaatcattctgagatttccaagttctccattcgagatgctgatgcttatcccaggtatgaaaatcaacttgagaacttttcgaaatttatggatccacttttggattcacctcctccagaatctttgcaaggtgtctcatctcttaaggatcggttcaaggacaatatacagaaatcagcattttgggcacgttgcttgcggcgggctctttccattggtcagacagatatggtggacttcatgaaccttttattatctccagcttcaaaggttttgaataactggtttgagacagacgttctgaaggcaacccttgcaacagatgctgtaataggcaccacgggtagtgtccacacaccagggagtggatatgttctgttacatcatgtcatgggagaaactgatggggatcgtggaatttggtcgtatgttgaaggtgggatgggctcagtatcttgtgccattggtaatgctgctagggaagctggggctcatattataacaagtgccgaggtttcagaagtgataattaatggttctggggaagtgaacggggtattactggctgatgatacagaggtgctttcttcagtggtgctgtcaaatgccactccttacagaactttcatggaattagtgcccaacaatgttcttcctgaagattttattcgtgctgtgaaatactctgactatagctctgctactacaaagataaacatagctgttgataagctgcctcaatttcagtgttgcaagatgagtcacccagatgcaggccctcagcatatgggcaccattcatattggttcagagaatatggaggagattcacttggcctgtgaagatgccatcaatgggttaccatcaagacgacctgttatcgaaatgacaattccttctgtattggacaagactatttctccacctggtaagcatgtgataaatctgtttgttcagtacacaccctacagtccgtcagatggaagctggggagatccttcctatagagaatcgttttcaaaaagatgttttaatttgatcgaggaatatgcccctggcttcagctcatcaatcattggttacgacatgttgaccccaccagaccttgaaagggaaattggtctgacaggtggtaacatatttcacggtgccatgggattggattccctcttccttatgcgacctgttaaaggatggtcaaactatagaacaccccttcgaggactgtacctgtgcggaagtggaagccatccgggtggcggtgtgatgggtgcgcctggacgtaatgctgcacatgtagttctccaggatgttaaaacccaataaattcaactgcacaatcttacaggtctgaatttatttgtacttgctgcatcaacattttatttgtcagattaagagaagaattcttcctagtc

SEQ ID NO: 6582 - DNA, 3565 bp, Ricinus communis
aaggctcacgatggagttcaagcgtacaagcttttccttctggaagtaagaagtctcgagtcttctcctctgcaacaacagaagagttttcgtctttataaaaatgttagggaatgaatacataatttgggttgttggccacaattgacagagacacccataaacaatctgatgtggagtccactgatatgattctctgtccgtgatatttataagacgcccctggctccattatataacaatcacaatgcacagaaacacccataaacaatctgcccacttgattctgttttcggactgactgatttaaaacttacctaataactaaatttaaccttccatccaatactactatctctcccactagacatgtggtggcggagcttcaccacctcaacagccagccgcgatctccttggtaaaaaatgggacgcccttattatcggtgccggccacaatggcttgacagccgctgcctatcttgctcgtggtggactctccgtggccgtccttgagcgccgtcacgtcatcggcggtgcagccgtcaccgaagaacttattccaggctttaaattctctcgctgcagttaccttcagagtctcctccgtcccactgtgattaaagagttagagttggggagacatggattaaagttgctgaagagaaatccgtcgtcgtttacgccttgcttagatggacgctatcttttattaggacctaataaagagcttaatcattctgagatatctaagttctctattcgagatgccaatgcttatcccagatatgagaatcagctcgagaagttttgtgagttcatggatccatttctagattcaccacctccggaatctttgcaaagggtttcatcttttaacgttaggttcaaggacaagatgtataaatcagctttttgggctcgtcttttgcgtggcgctttctccttgggtcagaatgagatggtggacttcatggaccttttattgtccccagcttcaaaagttttgaataaatggtttgagacagatgttctgaaggcaactcttgggacagatgctgtaattggctctacaggcagcatccatacaccaggaagtggatatgttctgttacatcatgtcatgggagaaactgatggggatcgtggaatctggtcgtatgttgaaggtgggatgggcttagtatccttggctattagtaatgctgctagggaagctggggctcacattgtgacaaatgccgaggtttcagaaatgatgattaatgattctggcgcagtgaatggggtactactggctgatggtaggcaggtgctttcttcagttgtcctgtcaaatgcgacaccatataaaactttcatggaattagtgcccaataatgttcttcctgaagattttgtccgcgccttgaagtactctgattatagttctgctactacaaagataaacatagctgttgataaactgccccaatttcgatgttgcaagctaaatcatccagatgcaggtccccagcacatgggcaccattcatattggttcagagagtatggaggagattgacttggcctgtcaagatgctgttaatgggttaccatcaaagagacctgttattgaaatgacaataccttctgcattggataagattatttctccacctggtaagcatgtgataaacttgtttattcagtacacaccctacagcccctcagatggaagctggagagatcctgcttatagagaatcatttgcgcaaagatgctttaacatgatcgatgagtatgcccctggcttcaactcatcaatcattggttatgacatgttgacaccacctgaccttgaaagggagattggtctaacagggggtaatatatttcatggtgctatgggattggattccctcttcctcatgcgaccagttaaaggatggtcaaactataggactcctctacaagggctttacctgtgtggaagtggaagccatccgggtggtggtgttatgggtgcgcctggccgtaatgctgcacatgtagttcttcaggatgttaaaaaccattaaactgatggatggcacaaatttgcaaatctgttgcctaaagtgtctcaaatcttctgttgtcatcctggagtgaagtgttatgtcgttagttaatggttatatcttatctttgtatgactggtacatgagaccccatttcaattagagaattattctgatcaattccccagtttcttgttgtatttctaaaattgctgcaacacaagcagtctgggccagacttatacgggttagtgactaaggcatacagatttacagttgttagcttctttgaatatgcattagcaaccaacttatggtttatacttccccctccaattgtgacagattttaaatcatttttcggattcagtcattaacaatatacttttcttatggtatactttcttatgatatacgtgtgactaatttaagacggctaaacgcatatttgtacatctagattttcaatttttgatctaatttaatacttttttgtaatatttaacactttgatatgcagcttcgatcaatatgctcacgtgtaatttgtaaatgtattaggcgttctgatattatcatttaatagagttcaggtgcctgttaaaataaaaattaaaaatatttaagaattttacagatactctgtttttgcatgttgaatatagatagttcattagcagtacgtcagtcccataagaatatttgaaaggaaaaacctcggctatcacaagcattgaaatcataaaacatgactagcgaatttcaaaaagttgacaaaattttctagcaagagaaattcacagctgttcattaagaaaagccttcaatatcaaaactctatgcatttcaaagtgcagaattcatttgatacagaaacagagaactcatctgcaattgaatattcctcgtctcagttgtgaattaatttcagtgctcttatatccttgtactaaagaagggtggttgcgactgtaaattgtagcatgaaggccaaaaactgcataaattgaagtggataaaagggttgagaagtaaaaggattacagttttatctatgaactgcaaaactattttgcagtggatacaaaatatcaaccaaatcaattggaataaatcgtattagtggcaaaagaattgcttaacaaatgcttcttaagcgacttattaagcaacgttcagaattagcacagcacatgaaaatgatttccaatcttggggtacaatttctcaaggtgatatgtgatagagcattactcaccatttatatcacttctgatgtagctgcctgaagtatttatcaaggttcttcccaatacaatgctttgaaatatttatcaaggcagggaactaatactatagcaacctgcttaatacagaaatgtcggacttgtaagaagcttcaggtctgagagacatagccttctgtggccattttaacatctctttttaaggcaatcctaccggttccgccaactggcaacagttttgggaactaatgtcatagaatacgaggatgcttcaagcc

SEQ ID NO: 6583 - DNA, 2410 bp, Vitis vinifera
cgttttacttctgggtggtgtttctgagaaaacatattggaacaaggacatgaagatcatggtaccaggagtgttcaattgcctcatcgactaatttatttatatgccctctccataacaccgggtgaagctccctcccggcactacggcggtgagatctcccagctcaatgggtgcttggattggggggtccaaccttcgtcacggagtttcatgctgatcatcagtgtgcagagtggcatccgccaatgttacacagctcccaccgaatttgcctgttcttgcgtgtaaagcacaaccccaatccatgatgctgctcttttgtcatattggatgaaattaaattaaatactcatcgaatgtatttcacccttctttttatggtaaacaaatgaaattggacaagggacactggtcacgatacttcacgctctcaactgaaacccaaaaaggaataatagaataaactattattgccactgcagtccacaactcaaggcactgaaaacagtggtgaccggagactgagaaagggagaaaaatgtggcgaaggggttttagcagcagcgccggctgcagtaacgcattgaaggagaagaaatgggacgcgctggtaatcggtgccggccacaacggcctaaccgccggcgcatacctggctcgcgctggtctctctgttgctgttctcgaacgtcgccacatcataggcggcgcggccgtcacagaagaaattatccctggctttaagttctcccgatgcagctacctccagagcctcctccgcccctccgtcatcaaggaattagagttagcaagacatggattaaagttgttgaagaggaatccttcatccttcacgccttgtgttgatgggcggtatcttctcttaggccctgataaggaccttaattattctgagatttcaaagttctccaaacgagatgctgatgcctatttaagatatgagaatcagctagagaacttctgtaaactcatggatccgcttttggattcacctcctcctgaaaccatgcaagggctttcatcatttaatgaccgcatcaagaataatgtacgcaaatcagttttttgggctcattgtctgcgttcggcactctcattgggacaaaaagatttggtggacttcatggaccttttattggcccctgcatcaaaagttttgaataactggtttgagactgatgtcctgaaggcaacacttgcaacagatgctgtgattggaagtacaggaagtgtccacacacctgggagtggatatgttctgctacatcatgtgatgggagaaaccgatggtgatcgtggtatttggtcgtatgttgaaggtggtatgggctcagtatccttggctattagcaaggctgctaaggaagctggggctcatgttgtaacaagtgcagaggtttcacagttgatgattgaggactcgggcagagtaaatggggtattgctggctgatgggacacgggtgcattcttcagttgttttgtcaaatgcaaccccttataagactttcatggaatttgtacctgaaaatgtccttcctgatgattttctccgtgctattaagtactctgactacagctctggaactaccaaaatgaacttagctgttgatacattgcctcaatttcagtgttgcaaattgagccaccctgatgcaggtcctcaacatgtgggtaccattcacattggttctgagagtatggaggagattgactcagctagtcaagatgctacaaatggcataccatcacagagaccaattatcgagatgacaattccttctgtattggacaagactatttctccacctggtcagcatgtgatcaacttatttattcaatacacaccctataaacctttggatggcagctgggaagatcctgcatatagagaattatttgcacaaagatgtttcaacttgattgatgaatatgcccctggtttcagctcaacaatacttggctatgacatgctgactccaccagaccttgaaagggaaattggtctcacaggagggaatatctttcatggtgccatggggttggattctctcttcctcatgcgacctgtaaaaggatggtcaaactacaggactccactgcaggggctttatttgtgcgggagtggggctcatcctgggggtggtgtgatgggtgcccctggtcgtaatgccgcgtctgtggtacttgaagatgttaagaaatcattcaactgataatgctcattacctaaagatatcattgatataataaaattgggatcaccttctcaggcccccctgtatctctagttatttttcttttatacgtgggttgtatgattatggacgtaaaatgggctcacatggggctgggcccactattacaatctctctttttctcagcaa

SEQ ID NO: 6584 - DNA, 4340 bp, Vitis vinifera
atgtggcgaaggtatttcagtagcaacatcaactccacgcgcacattgaaggagaagaaatgggacgctctggtgatcggcgccggccacaacggcctcacagccgctgcttacttggctcgctctggcctctccgtcgccgttctcgagcgtcgccacatcatcggcggtgctgccatcactgaagaactcgttcctggctttaagttctcccgctgcagctacgtccagagcctcctccgcccctccatcatcaaggacttggagttggcaaaacatgggttgaagttgttgaagatgaaagcggctacgttcacaccctgtgttgatggtcgctatcttcttttgacttataatcagaagcaaaattacaaggagatttccaggttctcaaaacgagatgcagatgcttttccaagatatgaaagtcaactaattaaattctgtgaagtcatggattttcttttggattcacttactcccgaaacattaaatcatgattcatcttttaccgatcggctgagagacaagttgaacaagtcagttttttggggtcgttttctgcatcgggttctctcactggggcagaaagatttggtggactttgtggaccttctgttgtccccaacttcaaaggttttgaactactggtttgagacagatgtgctgaaggcaacacttgcaggggatgctatcattgggagtatggcaagcatccatgcacctggaagtggatatgttctgctgcatcatgtaatgggcaatactgatggtgaacgtaatgtttggtcgcatgttgaaggtggcatgggttcagtatcatcagctataagtaaggctgctagggaggttggggcacatattgtgacaaatgcagaggtttcacagttgatgattgaagactctggtgttgtaaatggggtactactggaggatgggacacaggtgtattcttctgttgttttgtcaaatgcaaccccttataagactttcatggaattagtgcctcaaaatgttcttccagatgattttttccatgctattaagaacattgactacaaatctggaaccacaaaaattaatgtagctgttgataaattgcctgagttccagtgttacaagttcaaccatccagaagcaggtcctcaccatacagctaccattcacattggtactgacagtatggaggagattggcttagcttgtcaagatgcttggaatggcctatcatcacggaggcctgttattgagatgacaattccttcttcattggacaagactatttctcctcctggtaagcatgtggtcagtctatttacacaatatacaccctataatctcaccgatggtagctgggaagatcctgcatacagagaatcatatgcaaaaaggtgtttcaacttgattgatgaatatgcccctggctttagctcatctgtcattggttatgacatgctggcaccaccggatcttgagagggtgattggtctgacaggggggaatatttttcatggtgctatgagtttggattctcttttcctgatgcgccctgtcaaaggatggtcaggttataggactccagtgagagggctgtatttgtgcggcagtggaacacatcctggtggtggtgtgatgggggcgcctggtcgtaactctgcgcaagtcgtcattcaagatcttaaaaaatattacgtatgagagttggatttaatggatgttattctccacaatattttccttattagtttccttaagtggttgatttttgaaattaatttaggaagatagccctttttttttgtttttttggggtttgtgttctttctttccgggttgaaggagaaatatacaagaaccaataaaaagttcaatgtgagagaacaccgttttacttctgggtggtgtttctgagaaaacatattggaacaaggacatgaagatcatggtaccaggagtgttcaattgcctcatcgactaatttatttatatgccctctccataacaccgggtgaagctccctcccggcactacggcggtgagatctcccagctcaatgggtgcttggattggggggtccaaccttcgtcacggagtttcatgctgatcatcagtgtgcagagtggcatccgccagtgttacacagctcccaccgaatttgcctgttcttgcgtgtaaagcacaaccccaatccatgatgctgctcttttgtcatattggatgaaattaaattaaatactcatcgaatgtatttcacccttctttttatggtaaacaaatgaaattggacaagggacactggtcacgatacttcacgctctcaactgaaacccaaaaaggaataatagaataaactattattgccactgcagtccacaactcaaggcactgaaaacagtggtgaccggagactgagaaagggagaaaaatgtggcgaaggggttttagcagcagcgccggctgcagtaacgcattgaaggagaagaaatgggacgcgctggtaatcggtgccggccacaacggcctaaccgccggcgcatacctggctcgcgctggtctctctgttgctgttctcgaacgtcgccacatcataggcggcgcggccgtcacagaagaaattatccctggctttaagttctcccgatgcagctacctccagagcctcctccgcccctccgtcatcaaggaattagagttagcaagacatggattaaagttgttgaagaggaatccttcatccttcacgccttgtgttgatgggcggtatcttctcttaggccctgataaggaccttaattattctgagatttcaaagttctccaaacgagatgctgatgcctatttaagatatgagaatcagctagagaacttctgtaaactcatggatccgcttttggattcacctcctcctgaaaccatgcaagggctttcatcatttaatgaccgcatcaagaataatgtacgcaaatcagttttttgggctcattgtctgcgttcggcactctcattgggacaaaaagatttggtggacttcatggaccttttattggcccctgcatcaaaagttttgaataactggtttgagactgatgtcctgaaggcaacacttgcaacagatgctgtgattggaagtacaggaagtgtccacacacctgggagtggatatgttctgctacatcatgtgatgggagaaaccgatggtgatcgtggtatttggtcgtatgttgaaggtggtatgggctcagtatccttggctattagcaaggctgctaaggaagctggggctcatgttgtaacaagtgcagaggtttcacagttgatgattgaggactcgggcagagtaaatggggtattgctggctgatgggacacgggtgcattcttcagttgttttgtcaaatgcaaccccttataagactttcatggaatttgtacctgaaaatgtccttcctgatgattttctccgtgctattaagtactctgactacagctctggaactaccaaaatgaacttagctgttgatacattgcctcaatttcagtgttgcaaattgagccaccctgatgcaggtcctcaacatgtgggtaccattcacattggttctgagagtatggaggagattgactcagctagtcaagatgctacgaatggcataccatcacagagaccaattatcgagatgacaattccttctgtattggacaagactatttctccacctggtcagcatgtgatcaacttatttattcaatacacaccctataaacctttggatggcagctgggaagatcctgcatatagagaattatttgcacaaagatgtttcaacttgatcgatgaatatgcccctggtttcagctcaacaatacttggctatgacatgctgactccaccagaccttgaaagggaaattggtctcacaggagggaatatctttcatggtgccatggggttggattctctcttcctcatgcgacctgtaaaaggatggtcaaactacagaactccactgcaggggctttatttgtgcgggagtggggctcatcctgggggtggtgtgatgggtgcccctggtcgtaatgccgcgtctgtggtacttgaagatgttaagaaatcattcaactgataatgctcattacctaaagatatcattgatataataaaattgggatcaccttctcaggcccccctgtatctctagttatttttcttttatacgtgggttgtatgattatggacgtaaaatgggctcacatggggctgggcccactattctaatctctctttttctcagcaagatcaatgcccgatgctaacgagggcacaaggcccgaagcccaggg

SEQ ID NO: 6585 - DNA, 829 bp, Vigna unguiculata
atcttcattcttcttcgcttccaaattggcatggcttccacagtgttcacatatccttctcttcaccttcacatccactcacaaaaaccatcaaatccatcacacttttccattcacagccaacccagaaaccacttttccatcagatgcacatctccagaatccactcctctcgaggacaattttctaaccccagacccttccttcagcacagtgaacagcgaagaatcttttcccattgagaagagaagaaggtcagagatagtgagagaaagaaggggaaagaagcttgtgcagcctgagcctccaaactttgaaattggatggaagaggacaaaagagataaagcaagaggtgccagtagggtatgtgatagctgacttcttggagaagctagagaccctcatggggaagcagtttggatcaacagaactgttggcaaaggtgggagaaattgtggctgagagggcaagagaagaggctgagattctcatggatgaagggaaagtggaggagagaatggtcactgaacttttcagagtgttgaagttgatggagatggatttggctatggtgaaggcttctgtcaaggaggagactttgggagagaggcttgagcaggccaaggcaaggtgcaggcaagccattcttgttgcttattccttttgaactctctttcatggggattctgtgtcacagtagagatacacagtgttacagtggtgaacaacttgaagcaactgatatataagtgtgtttggattactaaattgatttttgtctaaaagtggattaacagtaaaagtataaaattttaattctgtgtaag

SEQ ID NO: 6586 - DNA, 1310 bp, Glycine max
atttaactgtattattatctgaaaactgatagctatgtatgcatatatacacaccaaaccaaccatagtccaaaaaaatacaacacccttatcttcactcattctttcattcacttcacttccaaattgtcatggcttccacagtgttctcatatccttctcctcttcatcttaaaacctatccacacaaaacatcatcaaacccttcagagttttccattcacatccaacccaaaaagcacttttccattagatgcacatctttggactccattcctgaggctgagtttccaactccagatccttcctcaagcacagtgaacagtgcagagtcctttcccattgagaagagaaggaggtcagagatagtgagagagagaagaggagaaaaactagtgcagccagagccaccaaactttgaaataggttggaagaggaccaaagagatcaacctagagaggccaatagggcatgtcatagctgatttcttggagaagctggagaccctcatggagaaggagtttggatcaacagaacttctggctaaggttggggagattgtggccgagagggcaagagaggaggctgagattctcatggatgaagggaaagtggaagagagaatggtgactgaattgtttagagtgttgaagttgatggagatggacttggcaatggttaaggctgctgtgaaggaggagactttgggtgagaggcttgagctggccaaggcaaggtgcaggcaagccatacttgttgcttattccttttgagaactttcatgggagatacaatgtagggtgtatttggatacacgttgaaatcagttaaacggaaaaatcacattttccaaagcaaaaatgtcaaagaaatgttgtagttttcatctaaatgttagttggtgttggattcaactgcttcccaaatacacacatagtagttgtaaagaacttgaaagtactgataaattttgctgaattgtgcacccattgacctttttttaatcgtcatattcttttacctaagacatgacatcagattctgatttaaagaaaaactaaaatgtgtacacataagtggttaaatggtgtgtgttgaacacttttgagttttgagaagcctaagattcatgttcttagcttaaactatgaacttatgcataagataagcaagatttcatccctttcctcacacttgaacataagatagcttaaactatctgatagtgattttatttatgttaagccttttctttagtatcttatgttatgaggttcttgcctcctatgttgactctaatgacctaaagg

SEQ ID NO: 6587 - DNA, 1214 bp, Glycine max
atagtccaaaaaaatacaacacccttatcttcactcattctttcattcacttcacttccaaattgtcatggcttccacagtgttctcatatccttctcctcttcatcttaaaacctatccacacaaaacatcatcaaacccttcagagttttccattcacatccaacccaaaaagcacttttccattagatgcacatctttggactccattcctgaggctgagtttccaactccagatccttcctcaagcacagtgaacagtgcagagtcctttcccattgagaagagaaggaggtcagagatagtgagagagagaagaggagaaaaactagtgcagccagagccaccaaactttgaaataggttggaagaggaccaaagagatcaacctagagaggccaatagggcatgtcatagctgatttcttggagaagctggagaccctcatggagaaggagtttggatcaacagaacttctggctaaggttggggagattgtggccgagagggcaagagaggaggctgagattctcatggatgaagggaaagtggaagagagaatggtgactgaattgtttagagtgttgaagttgatggagatggacttggcaatggttaaggctgctgtgaaggaggagactttgggtgagaggcttgagctggccaaggcaaggtgcaggcaagccatacttgttgcttattccttttgagaactttcatgggagatacaatgtagggtgtatttggatacacgttgaaatcagttaaacggaaaaatcacattttccaaagcaaaaatgtcaaagaaatgttgtagttttcatctaaatgttagttggtgttggattcaactgcttcccaaatacacacatagtagttgtaaagaacttgaaagtactgataaattttgctgaattgtgcacccattgacctttttttaatcgtcatattcttttacctaagacatgacatcagattctgatttaaagaaaaactaaaatgtgtacacataagtggttaaatggtgtgtgttgaacacttttgagttttgagaagcctaagattcatgttcttagcttaaactatgaacttatgcataagataagcaagatttcatccctttcctcacacttgaacataagatagcttaaactatctgatagtgattttatttatgttaagccttttctttagtatcttatgttatgaggttct

SEQ ID NO: 6588 - DNA, 969 bp, Glycine max
tatctgaaaactgatagctatgtatgcatatatacacaccaaaccaaccatagtccaaaaaaatacaacacccttatcttcagtcattctttcattcactttacttccaaattggaatggcttccactgtgttctcatatccttctcttcaccttaacatctatccacagaaaacatcatcaaatcgatcagagttttccattcacatccaacccaaaaagcacttttccattagatgcacatctttggactcaactcctgaggctgactttccaactccagacccttcctcaagcacagtgaacagtgcagagtcctttcccattgagaagagaaggaggtcagagatagtgaggaagagaaggggagagaaacttgtgcagccagagccaccaaactttgaaataggttggaagaggaccaaggagattaacctagagaggccaatagggcatgtcatagctgattttttggagaagttggagaccctcatggggaaggagtttggatccacagaactgctggctaaggttggggagattgtggctgagagggcaagagaggaggctgagattctcatggatgaaggaaaagttgaagagagaatggtaactgagctctttagagtgttgaagctgatggagatggatttggctatggttaaggctgctgtgaaggaggagactttgggtgagaggcttgagctggccaaggcaaggtgcaggcaagccatacttgttgcttattccttttgagaactctttcatgggaatgaatgtgacatcggatatacaatgtagggtgtgtttggatacgcattggaaccacgttaaatggaaaaatcacacttttcaaaaagcaaaaatgtcaaagtaactatgttgtagctttcatatgaaagttcattagcgttggattcaactgttttctaaacacacacgtaatagtggtaaagaatttgatggtact

SEQ ID NO: 6589 - DNA, 919 bp, Glycine max
aaaatacaacacccttatcttcagtcattctttcattcactttacttccaaattggaatggcttccactgtgttctcatatccttctcttcaccttaacatctatccacagaaaacatcatcaaatcgatcagagttttccattcacatccaacccaaaaagcacttttccattagatgcacatctttggactcaactcctgaggctgactttccaactccagacccttcctcaagcacagtgaacagtgcagagtcctttcccattgagaagagaaggaggtcagagatagtgaggaagagaaggggagagaaacttgtgcagccagagccaccaaactttgaaataggttggaagaggaccaaggagattaacctagagaggccaatagggcatgtcatagctgattttttggagaagttggagaccctcatggggaaggagtttggatccacagaactgctggctaaggttggggagattgtggctgagagggcaagagaggaggctgagattctcatggatgaaggaaaagttgaagagagaatggtaactgagctctttagagtgttgaagctgatggagatggatttggctatggttaaggctgctgtgaaggaggagactttgggtgagaggcttgagctggccaaggcaaggtgcaggcaagccatacttgttgcttattccttttgagaactctttcatgggaatgaatgtgacatcggatatacaatgtagggtgtgtttggatacgcattggaaccacgttaaatggaaaaatcacacttttcaaaaagcaaaaatgtcaaagtaactatgttgtagctttcatatgaaagttcattagcgttggattcaactgtttcctaaacacacacataatagtggtaaagaatttgatggtactaataaattt

SEQ ID NO: 6590 - DNA, 1330 bp, Medicago truncatula
gagagggtgaagatatataataatcagttccaaggaaaatttcagttccaaaaacagttcctgtttccatggcacctgtacctatttctagcatcaatgtaggacacattgatgatgtacaagaattaagaagaactaagccaaagacagttcctcaaagatttgtaagagacatgacagaaagaccaacacttctttccccacaaaacagtgacatgcctgtcattgatttctctaagtttagtaaagggaacaaagaggaagttttcaatgaactttctaagctttcaactgcttgtgaggagtggggattttttcaggtgattaatcatgagattgaccttaatctgatggagaacatagaggatatgagtagggagtttttcatgctacctttggatgagaaacagaagtaccctatggctccaggaacagtccaaggttatggacaagcttttgttttctcagaggaccaaaaacttgattggtgcaacatgtttgccttaggaattgaacctcactatattaggaactcaaatctttggccaaagaagccagcaagactcagtgaaacaattgaattgtactcaagaaaaatcaggaaactctgccagaatttgctgaaatacatagcattaggcctgagtttagaagaagatgtttttgagaagatgtttggtgaagcagtacaagccataaggatgaattactatccaacatgttcaagacctgaccttgttttgggtttgagtcctcattcagatggcagtgcccttactgtgttgcagcaagctaagggaagcccagtgggtcttcaaatacttaaagacaacacatgggtccctgttgaaccaatttcaaatgctcttgttatcaacattggagacacaatagaagttcttacaaatggaaaatacaagagtgtggagcatagagctgtggctcatgaggaaaaagacagactctcaattgtgacattttatgctcctagctatgatctagagctaggaccaatgcttgaacttgtggatgaaaaccacccatgcaagtataaaagatacaatcatggagagtatagtaaacactatgtaacaaataagttacaaggaaagaggaccctggactttgccaagatggaaattatgaataatacaaactaggaagacttagttctccaactagctaggagcactgtgaatctatgattagacaattaagtatatataaaaattagtcacatagaagtatcaatgtcaagcttcttaatatcttttattgaaaaataggtagaagaattagtgactcttgtgattaatctttacaagaaaat

SEQ ID NO: 6591 - DNA, 2661 bp, Glycine max
ttggggtgaaggagtaaaagaaaagcgaaaagggttttgcgttgaagagaagtagggtttaggtaataggtgaaacggtgggagagaagcagcctcaacctgaatctaaggtactgcaatctcttatggtttctattggttcaaaaacattggtgtcaagaagctcaatgggcgagcacgactatgaacccctcaaacaaggcaaaactaagaggaggaagcataagaaaggaggatccactcatgcattcgattccaactccttcacttctccgcctcaactatcccgtgttaggaaacagcttgaccctgaaacaacccaatacttctctgaaatttctaatctttttgaaagtgacggggttgaattggaggatcgatcacttatatgtgctaatgctctcgaagaaaccaaggggaaagaattcgaaattgcaactgattatattcttagccacactctcgagaccattctccagggctgtgatgtacaccatctttgtgatttccttcacacttctgctaaccacttcccctatattgcaatggatagatctggttctcatgtcgctgagacctccatcaagtctttagctgttcatctccaggacgacgatgacgtcgttcgccctctcgttgaggaggcgttaaccatgatatgcaaggtgattgcagcaaattctgttgatgtcatgtgcaactgctatggttctcacgtgcttcggactcttctttgcctttgtagaggagtaccattagataagtccggatactatttatcaaaatcaactacagtattagcagaccggttgaattcgaaggagttttcttcaaaaaaatatgatgcaacaaattttcagcctggatttccaaatttactgaaatcacttgtgtcagatatgttaaagcatgctaagaaatgtatcaagatactacaagttgaccaattcagcagtttggttttccagacagtgctgagggtcttggcaggcgatgatgaagagttgttacatgtgattcctatccttcttggctgcaaggataagaataatgcagaggacaattttataggcactagagtagtagcggagctcaagaatttgttaaaagaatctaaatttagccatctaatggaggttgttttggaagtatctcctgaggccttattcaatgaattattcactaaagtattcaggaattccttgtttgagttatcatctcatcaacatggaaactttgttgttcaagcattaatttcttatgcaagcaatcaagatctgatggagttgatttgggaagaacttgggccaaatttggagggtcttttcaaaatgggaaggtcaggagttgttgcttcacttgttgctgccagtgaaaggcttcatattaatgaacacaagtgctgtcaagtccttgctgaagcagtgtgtccagtggatgagtctccaaaatggattgttccaagactattgtttcttgatagctgtttcacaagtgaagataagtccaattggagctggcaaagtggttctaaaatgcatgtcatgggttctctgatcctacagacagtattccgttttagaagtgaatgtatacaaccttatatcatcagtataacttccatggaagcgactcatgtgcttgaagcagtggtagatgcaagagggtcacatgttattgaggcttttctatgttcgggagcttctgggaaacagaagcgcagattggttacaaaactacaagggcattttggagaggttgctctcacctcatctggtgcttttaccattgaaaagtgcttcactgccagtaatctgtcactaagagaggctatagtgtctgagatgttggctgtgcgaagtgatctttccaaggcaaagcagggctcttacctattgaggaaactagatattgacggatatgctgcgaatcctgatcattggaggtcaaaacaagcatccaaagaatctacttataaagatttttataccatgtttggttccagtgatacaaagttgacggaaaatgatgcctttcttgctgacacttcgaataataaatcaaataaaaaaactgtaaaggaaatgaggaaagaaattgaccaatccctaggttctggtgcaccatttctgagcacccaaaacttcaagaaaaacccaaaaaaagaaaagcacaaaagtaagaaaaatgctcaggttagtggagatgatgttaactctaataggaagaagaaaagatctaacaaggaaaaggttgaaagtgggtttgatattgctgctaagaagacattgaagaaacgacgaagagatgatgacctttctgaggcttctctgaagaaagtgaaggcaccaaatgcagagtgaaagacaagttttttccttaaagagaaggatggcgttaagcatgtcagcagggtccccaagatttaatgcatgaaggcttgaatgatttcctctttgctagtaattttgtatcattttaccatgtcgcatagactatgtaactggaaaattgcattaagaaaggtagttactctaaagattttttttcctctaacgaatttccttagcacctcctcccccctcacccctatatactgtgatgtgcataattattatatataacttcaatacgaacgtagagatcgttccccgtttttag

SEQ ID NO: 6592 - DNA, 2695 bp, Glycine max
ttggggtgaaggagtaaaagaaaagcgaaaagggttttgcgttgaagagaagtagggtttaggtaataggtgaaacggtgggagagaagcagcctcaacctgaatctaaggtactgcaatctcttatggtttctattggttcaaaaacattggtgtcaagaagctcaatgggcgagcacgactatgaacccctcaaacaaggcaaaactaagaggaggaagcataagaaaggaggatccactcatgcattcgattccaactccttcacttctccgcctcaactatcccgtgttaggaaacagcttgaccctgaaacaacccaatacttctctgaaatttctaatctttttgaaagtgacggggttgaattggaggatcgatcacttatatgtgctaatgctctcgaagaaaccaaggggaaagaattcgaaattgcaactgattatattcttagccacactctcgagaccattctccagggctgtgatgtacaccatctttgtgatttccttcacacttctgctaaccacttcccctatattgcaatggatagatctggttctcatgtcgctgagacctccatcaagtctttagctgttcatctccaggacgacgatgacgtcgttcgccctctcgttgaggaggcgttaaccatgatatgcaaggtgattgcagcaaattctgttgatgtcatgtgcaactgctatggttctcacgtgcttcggactcttctttgcctttgtagaggagtaccattagataagtccggatactatttatcaaaatcaactacagtattagcagaccggttgaattcgaaggagttttcttcaaaaaaatatgatgcaacaaattttcagcctggatttccaaatttactgaaatcacttgtgtcagatatgttaaagcatgctaagaaatgtatcaagatactacaagttgaccaattcagcagtttggttttccagacagtgctgagggtcttggcaggcgatgatgaagagttgttacatgtgattcctatccttcttggctgcaaggataagaataatgcagaggacaattttataggcactagagtagtagcggagctcaagaatttgttaaaagaatctaaatttagccatctaatggaggttgttttggaagtatctcctgaggccttattcaatgaattattcactaaagtattcaggaattccttgtttgagttatcatctcatcaacatggaaactttgttgttcaagcattaatttcttatgcaagcaatcaagatctgatggagttgatttgggaagaacttgggccaaatttggagggtcttttcaaaatgggaaggtcaggagttgttgcttcacttgttgctgccagtgaaaggcttcatattaatgaacacaagtgctgtcaagtccttgctgaagcagtgtgtccagtggatgagtctccaaaatggattgttccaagactattgtttcttgatagctgtttcacaagtgaagataagtccaattggagctggcaaagtggttctaaaatgcatgtcatgggttctctgatcctacagacagtattccgttttagaagtgaatgtatacaaccttatatcatcagtataacttccatggaagcgactcatgtgcttgaagcagtggtagatgcaagagggtcacatgttattgaggcttttctatgttcgggagcttctgggaaacagaagcgcagattggttacaaaactacaagggcattttggagaggttgctctcacctcatctggtgcttttaccattgaaaagtgcttcactgccagtaatctgtcactaagagaggctatagtgtctgagatgttggctgtgcgaagtgatctttccaaggcaaagcagggctcttacctattgaggaaactagatattgacggatatgctgcgaatcctgatcattggaggtcaaaacaagcatccaaagaatctacttataaagatttttataccatgtttggttccagtgatacaaagttgacggaaaatgatgcctttcttgctgacacttcgaataataaatcaaataaaaaaactgtaaaggaaatgaggaaagaaattgaccaatccctaggttctggtgcaccatttctgagcacccaaaacttcaagaaaaacccaaaaaaagaaaagcacaaaagtaagaaaaatgctcaggttagtggagatgatgttaactctaataggaagaagaaaagatctaacaaggaaaaggttgaaagtgggtttgatattgctgctaagaagacattgaagaaacgacgaagagatgatgacctttctgaggcttctctgaagaaagtgaaggcaccaaatgcagagtgaaagacaagttttttccttaaagagaaggatggcgttaagcatgtcagcagggtccccaagatttaatgcatgaaggcttgaatgatttcctctttgctagtaattttgtatcattttaccatgtcgcatagactatgtaactggaaaattgcattaagaaaggtagttactctaaagattttttttcctctaacgaatttccttagcacctcctcccccctcacccctatatactgtgatgtgcataattattatatataacttcaatacgaacgtagagatcgttccccgtttttagaatacaaatattttaaattttaggtatataagag

SEQ ID NO: 6593 - DNA, 2957 bp, Glycine max
agatttctcacaaaaataaaataaaataaataaaaaaatctcattcccgcaagcgcggttatcctcaactcactcttccaaccacgctcactcccgcgtcctcttcgatggccagcaccgcaaatcactgtctccaactcgccggcgccaccgagtcaactcgtcgctggagaatctccatttcgtgcaagaagaagtcggacaagttagcattcaaggaaacgaaggaaggcttcgtggactacgacagaggccagcacgaggtctccacgaaaatatccggcctccgcaaggacgacatcgccgcccgatatcgcctccgcgtcgccggaaaccgcttccagatggactggacggtgtcggaggtcgccgaccttgtcctctccctcaacctctccgacgacgacgacgtcgacggcctgctcaaccgctgggttggccgcttcgcgcgcaagaatttccccttccttatcaaggagttgacgcagcgagggtccattgaacactgtaaccgcgtgttccggtggttgaagaaccagaagaactaccgtgcgcgcaatgatatatacaatatgatgattaggttgcacgccaggcacaatcgaacggaccaggcgcgtggattgttttttgagatgcaggaatggaggtgtaaacctgatgtcgagacttacaatgctattattaatgcgcatggtcgggctggacagtggcgttgggctatgaatatcatggatgacatgctgcgtgcagctattccaccaagtcggtcaacttataacaacttaataaacgcttgtggatctagtgggaattggaaagaagcacttaatgtttgcaagaaaatgacagagaatggtgttgggcctgatcttgttactcacaatattattctatctgcatttaaaagtggggctcagtattcaaaagctttgtcttattttgaactaatgaagggaactcatattcgtcctgacacaactacacttaatattgttatccattgtctagtaaaacttaggcaatatgacaaagctattgaaatttttaattccatgagggagaagaagtcggaatgtacccctgatgttgttacattcactagtatcattcacctgtattctgtgtgtgggcaagttgaaaattgtgaggctgcatttaatatgatgcttgcagaagggctgaaacctaatatagtctcatataatgcactcataggtgcatatgctgctcgtggtatggacaatgaggcgcatttgtttttcaatgagataaaacaaaatggcttccgccctgatattgtatcgtatacatctctccttaatgcttatggaaggtcacaaaagccccataaagctagacaaatatttgataggatgaagagaaacaagttgaagccaaatcttgtcagttacaatgcgctgattgatgcctatggatctaatggtttgctggcagatgcaattaaaatcttgcgagaaatggaacaagaaggaattcagccaaatgttgtctcaatatgcacactcttggctgcctgtggacgatgcagtcgaaaggtgaagattgacacagtgctaacagcagctgagatgcgaggaattaaattaaacacagttgcatataatgcagctataggaagctgtatgaatgtaggggaatatgacaaagctataggcttgtataaatctatgaggaagaaaaaaattaaaactgattctgttacttacactgtgttgataagtggttgttgtaagatgtcaaaatacggcgaagccctatcttttatggaagaaattatgcatctaaaacttcctttgtccaaagaggtctactcatccgccatatgcgcctatagcaaacagggccaaattgtagaggcagagtctacattcaacttgatgaaatcatctggttgctaccctgatgtggttacatacaccgccatgcttgatgcgtacaatgcagctgagaattgggagaaagcttatgcactctttgaagaaatggaagcaagcagcatcaagctagatactattgcctgtgcagctctaatgagatcttttaataaaggtggccaaccaggaagggttcttagtcttgcagaaagtatgagagaaaaagaaattcctttcagtgataccatattttttgaaatggtatctgcctgtagcatattacaagattggaggacagctgttgatatgatcaagtacatagagccctcacttcctgtaatttcatccggatgtttgaatcagttcctgcattctttaggaaaaagtggaaagattgaaactatgttgaagttattcttcaaaatgttggcatcaggtgccgatgttaacttaaacacttactctatattattgaagaaccttttatcatctggaaattggaggaagtatttagaggtattgcaatggatggaggatgccggaattcatccatcaaaagaaatgtaccatgatatatcctccttttcacaaaaatgctgtggcaatgaaaatgctgctgtcataagagaaagacttgaatccttgaaaagagaattcggggatcaaatttctacaagccagccctgtgaatctcttgtcatggaatcacattcttttgcttagctgtgacacgttgttccaactgctgtgggagttctgcctgtgagatttttttaaagattgaagttgaaactcaacttaatttattggatcatacgctactcctgtatatagattatttttcatattatgcccgcaatttgtaaatcatctcatctttccttcctgtgtatatactagtacgttcggactgtactgtaaaatgtaaagtccaagtggggttacactaaagaatgtgtataaaccttatcagttcatgctatcaatatagttgctgttgatggctcgctcgcactttaaactttacaatgcattttaacgaaaactactgtatatttc

SEQ ID NO: 6594 - DNA, 3020 bp, Cicer arietinum
attacatcgcggttattatcttcaacgaaactccattgtccactcttgtctgagtggtcttgatggccagcacagtatcaaactgcatccaactcggcggcggcgccgagtcaactcgcccgccaaaatccacactaacacgcaagaagaaaaccaacgagttagcattcaaggagacgaaggacggcttcgttgactacgacagaggtcagcacgaagtatccacgagaatcaccggcctccgcaaggatgacatccccgcccactaccgcctccgagtcgccggcaaccgctttcaaaaggactggacagtgtcggaggtcaccgactcgattctctccctcaccctccgtgatgacgtcgaaggtctactcaaccgctggataggccgcttcgcacgcaagaatttccctttcctcattagggagttgacacagagaggttcaattgaacactgtaacttagttttcagctggatgaagaaccagaagaattattgtgctagaacagatatatacaacatgatgattaggttgcaggctaggcataatagaacggaccaggcacgtgggttgtttttcgagatgcaaaaatggaggtgcaagcctgatgctgagacttacagtgctcttattaatgcacatggtcgagctggacaatggcgttgggctatgaatatcatggaagacatgttgcgtgcagctattccaccaagtcggtcaacctacaacaacttgattaatgcctgtggatctagtggaaattggaaagaagcacttaatgtttgcaagaaaatgactgacaatggagttggacctgatcttgtcactcacaatattatgttatctgcatttaaaagtggacatcagtattcaaaagctttgtcgtattttgaattaatgaagggaactcacattcgccccgacgcaaccacactcaatattattattcattgtctagtgaagcttcgacagtatgacaaagccattgatatttttaattccatgagggaaaagaagtcggaatgtcatcctgatgttgtaacattcactagtatcattcatttgtattctgtgtctgggcaaattgaaaattgtgaggctgcattcagtatgatgcttgcagaagggctgaaaccaaatatagtatcatacaatgcattactaggtgcatatgctgctcgtgggatggaaaatgaggcactacaagtttttaataagataaagcaaaatggtctccgcccagatattgtatcttatacatctctgcttaatgcatatggaagatcacgaaagccccaaaaagcaagggaaatattcataatgatgaagagaaacaacttgaagccaaacattgtcagttacaatgcactgattgatgcctatggatccaatggtttgcttgaagatgcaattgaaatcttgcgggaaatggaacaggataggattcatccgaatgttgtctcaatatgtacgctcttggctgcctgtgggcggtgctatcagaaggtgaagatcgatactgtgttatcagcagctgagatgcgaggcattaagttgaacacagttgcatataattcagctataggaagctatattaatgtgggggaatatgacaaagccatagatttgtataactctatgaggaagaaaaatataaaatctgattctgttacttacactgtcttgataagtggttgttgtaagatgtccaaatatggggaagccctatcttttatggaagaaatgatgcatctaaaactttctatgtccaaagaggtctactcatctgtcatatgtgcctatagcaaacagggtcaaatcacagaagcagagtctacattcaatttgatgaaatcatgtggttgcaatccagatgttgttacatatactgcaatgcttgatgcctacaatgcagctgagaagtgggagaaagcatatgctctctttgaagaaatggaagcaaatgaggtcaagctagataccatcgcatgtgcagctgtaatgagagcttttaacaaaggtggccaaccaggaatggtccttagtcttgcacaaagtatgagagaaaaagagattcctttaagtgataccatattttttgaaatggtatctgcatgtagcttattacatgattggaagacagctgttgatgtgatcaagtacatggagccttcacttcctgtaatttcatctggatgtttgaatctgttcctgcattcattaggaaaaagtggaaagattgaaacaatgttgaagctattcttcaaaatgctggcatcaggtgctgatgttaacttcaatacttattctattttattgaaaaaccttttatcatctggaaattggaggaagtatttagaggtactacagtggatgaaggatgcaggaattaatccctcgaatgaaatgtaccgtgatatatcctccttttcacaaaaatgctgtggggctgaaaatgctgctgtcataaaagaaaggcttgaatccttgaagagaaaagctggggatgaaatttctgcaagccaatcttgcgaatctcacgttcttagttgaccgtcgtatggaatatcttctttttatttgctttgaaacgctgttccaaactgctgggcacttatgtgtctgagtttgtgaagattgaagttggatccaagtaaatttatttgatcatcctctattccgtgtaagattatttttcctgttacaattgcagttctgtaaatgaaatttatgtttttccatcctgtgtagatatttgtaaattgttccataggaccttttttaactattaaccaatgaaaatatagcatatggattttagttaatttattttaaaagttaacaccgttgcagctcctctgtttcacacggtttaagtgaaaatcaagaataaaatacaaaatactgtccaaaaatcaacatcaaggaaggcaaaagaaaagatgagataaaagatttactcaaaaaaaattaaaatcacatattaagtacaatatcaaggatttaaaatgtaacttt

SEQ ID NO: 6595 - DNA, 3032 bp, Medicago truncatula
taaagaaggaagtgtgaatagtaaatctctcagataagatatatatccgatttttaaaagcacagtttatctgcatccttgaaatgctccggaatttcaatggccaccaccacatcaccttactgcatccaactcagcggcgttaccgagtcaactcgtcctccaaaatccacaaccacacgcaagaaaagctccaacgaagttgcattcaaggagaagaaggatggtttcgtcgactacgacagaggacaccaccaagtctccaccaaaatatccggcctccgtaaagaagatatccccgctcactaccgcctccgtgttgccggtaaccgcttccaaaaggattggaccgtgtcggaggtcgtcgactccgtcctctccctcactctccgtgacgacattgaaggcctgctcaatcgttggattggtcgattcgctcgcaagaatttccctttcctcatcagagagttgacacaacgaggttcaattgaacactgtaacttagttttcagctggatgaagaatcagaaaaattattgtgccagaacagatatatacaacatgatgattaggttgcatgctaggcataatagaacggatcaggcacgtggtttgttttttgagatgcaaaaatgcaggtgtaaacctgatgctgagacatacaatgctcttattaatgcgcatggtcgagccggacaatggcgttgggctatgaatattatggatgacatgctgcgtgcagctatcccaccaagtcggtcaacttacaacaacttgattaatgcttgtggatctagtggaaattggaaagaagcacttaatgtttgcaagaaaatgactgacaatggagttggacctgatcttgtcactcacaatattatgttaactgcatttaaaagtggcactcagtattcaaaagctttgtcgtactttgaacttatcaagggaactcacattcgcccggacacaactacacacaatatcattatccattgtctagtgaagcttaaacaatatgacaaagccgttgatatttttaattccatgaaggaaaagaagtcggaatgtcaccctgacgttgtaacattcaccagtatgattcatttgtattctgtgtgtggacacattgaaaattgtgaggctgcattcaatatgatgcttgcagaagggctgaaaccaaatatagtctcatacaatgcactactaggtgcatatgctgctcgtgggatggaaaatgaggcacttcaggtttttaatgagataaaacaaaatggtttccgtccagatgttgtatcttatacatctctacttaatgcttatggaagatcacgaaagccccaaaaagcaagggaaatattcaaaatgataaagagaaacaacttgaagccaaacattgtcagttacaatgcactgattgatgcctatgggtctaatggtttgcttgaagatgcaattgaaatcttgcgagaaatggaacaagataagattcatccgaatgttgtctcaatatgcacactcttggctgcctgtggacggtgtggtcaaaaggtgaaaattgatactgtgctgtcagcggctgagatgcgaggcattaaattgaacacagttgcatataattcagctataggaagctatattaatgtgggggaatatgacaaggctatagacttgtataactctatgaggaagaaaaaaataaaatctgattccgttacttacactgtcttgataagtggttgttgtaagatgtcaaaatttggggaagccctgtcttttatggaagaaatgatgcatctaaaacttcctatgtccaaagaggtctactcatctatcatatgtgcctatagcaaacagggtcaaatcatagaagcagagtctacattcaacttgatgaaatcattgggttgcagtccagatgtggttacatatactgcaatgcttgatgcctacaatgcagccgagaagtgggagaaattatatgcactatttgaagaaatggaagaaaatgacgtcaagctagataccatcgcatgtgcagctctaatgagagcttttaacaaaggtggccaaccaggaagggtccttagtcttgcacaaagtatgagagaaaaagacattcctttaagtgataccatattttttgaaatggtatctgcctgtggcttattacatgattggaagacagctgttgatatgatcaagtacatggagccctcacttcctgtaatttcatctgggtgtttaaatctgttccttaattctttaggaaaaagtggaaaaattgagattatgttgaagctattcttcaaaatgttggcatctggtgctgaagttaacttcaatacttattctattttattgaaaaaccttttatcatctggaaattggaggaagtatttagaggtactacaatggatggaggatgcaggaattcatccctcaaatgaaatgtaccgtgatatatctttttcacaaaaaaactgtggggttgaaaatgctgctgtcataaaagaaagacttgaatctttgaaaagaaatgccggggatcaaagttctgcaagccaaccttgtgaatctcatgtatgttcttagctgaccgttgtcgtggaattcgaataactttgacacactgtttgaaactgctgggagagtcgtgcatctgagtttgtgaagattgaagttggatctcaagtaaattgatttgaccatcctctattccttgtaagattatttttcttgttacaaatgcaattctgtaaatcaaattatgttatccttcctgtgtagattgttccacagatcctttattaaccattaaataaccaaatgaaaatataacatgtggatttagtttatttattttaaaaagttaacacactcttctgtttcacaatccctttccactttctctcccttcttttttttcagaaccgtttccatctagccatggctttttggtttcttttcaacaaaagttaagtttctccagctgtttataaaggtgtagtatgagaaatgtataatctgatttc

SEQ ID NO: 6596 - DNA, 3087 bp, Cajanus cajan
cacgttccatccccgatggccagcaccgcaactcagtatctccaaatcgccggcgccggcgccgcttcgaatcaccggagaacctccatttcgtgcacgaagaaatcgaatccttcggcattcaaggaaacgaagcaaggcttcgtggactacgaccgaggtcagcacgaggtcgccaccaaaatcaccggcatccgcaaggacgacatcgccgcccgctaccgcctccgcgtcgccggaaaccgcttccagaaggactggacggtgtccgaggtcgtcgacttggtcctatcgctcgacatctccgacgacgtcgacggtctactcaaccgctggataggccgcttcgcacgcaagaatttccccttcctcatcaaggagttgacgcagcgagggtccgttgaacactgtaacctcgtgttccggtggatgaagaaccagcgaaattactgtgcgcgcacggatatatacaacatgatgattaggttgcacgctcggcacaatcgaacggaccaggcgcgtggattgtttttcgagatgcaagagtggaggtgtaaacctgatgttgagacttacaatgctcttatcaatgcgcatggtagagctggacaatggcgttgggccatgaatatcatggatgacatgctgcgtgcagctgtgtgtactttgtatttttcttccctactcatattttattccgccaagtcggtcaacttataacaacttgataaatgcttgtggatctagtgggaattggaaagaagcactcaatgtttgcaagaaaatgacagacaatggtgttgggcctgatcttgttactcacaatattatactatctgcatttaaaagtggggctcagtattcaaaagctctgtcttattttgaactaatgaagggaactcatatccgtcctgacacaactacacttaatattgttattcattgtctagtaaagcttcgacaatatgacaaagctattgatatttttaattccatgagggagaagaagtcagaatgcacccctgatgtcgttacattcactagtatcattcacttgtattctgtgtgtggacaagttgaaagctgtgaggctgcattcaatatgattcttggagaagggctgaaaccaaatatagtctcctataatgcactaataggtgcatatgctgctcatgggatggacaatgaagcacttttggttttcaatgaaataaagcaaaatggtatccgccctgatattgtgtcttatacttctctccttaatgcttatggaagatcacaaaagccccagaaggcaaggaaaatatttgatatgataaagaaaaacaagttgaagccaaacattgtcagttacaatgcactgattgatgcttatggatctaatggtttgctggcagatgcaattgaaatcttgcgagaaatggaacaagatggaattcagccaaatgttgtctcaatatgcaccctcttggctgcctgtggacgatgcagtcggaaggtgaagattgacacagtgctaacagcagctgagatgcggggaattaaattgaacacagttgcatataattcagctataggaagctgtatgaatgtaggggaatatgacaaagctataagcttgtataaatctatgaggaagaaaaaagttaaaactgattctgttacttacactgtgttgataagtggttgttgtaagatgtcaaaatatggtgaagccctatcttttatggaagaaatgatgcatctaaaacttcctttgtccaaagaggtctactcatctgtcatatgtgcctatagcaaactgggccaaattgtagaagcagagtctacattcaacctgatgaaatcatctggttgctaccctgatgtggttacatacactgccatgcttgatgcttacaatacagctgagaattgggagaaagcttatgcactctttgaagaaatggaagcaagtggcatcaagctagatactgttgcttgtgcagctctaatgagatcttttaatagaggtggccaaccaagaagggttcttggtcttgctgagagtatgaaagaaaaagaaattcctttcagtgataccatattttttgaaatggtatctgcctgtagcatattacaagattggaggacagctgttgatatgatcaattacatagagccctcacttcctgtaatatcatccggatgtttgaatcagttcctgcattctttaggaagaagtggaaagattgaaactatgttgaagttattcttcaaaatgttggcatcaggtgctgatgttaacttaagcacttactctattttattgaagaatcttttatcatccggaaattggaggaaatatttagaggtattacaatggatggaggatgcaggaattcatccatcaactgaaatgtaccatgatatatcctccttttcgcaaaaatgctgtggggatgaaaatgctgctgtcataaaagaaagacttggtatgaattttcatgttgtattgaggattgcgtttcctaatgttgatatgcacatgctttcattcttttaatgcaccctgctatttgaagaggtttaatttatttaatcaacctgtgtgattttgcttaggtatagaccaggtattttatttgtgtatgtgtcattttgcttagttcatcattcttctttcatctatgcgctcctgctttattcaaattgtcatgatatatagtaactcagaccttgcatttatcttggtcataaacttgtgcagaatccttgaaaagaaaattcggggatcaaatttctacaggccaaccttgtgaatctcctgttcttagttgaccattgtgacggaatcattttttttctttcacttagccgtaacacactgatcagactgctatgggagttctgcctgtgagattttgtgaagattgaaggtagaactcaatttattgaatcatacgttactactgtacaaatattaattttcatgttacgcctgcaatttctaaataatctcgtgtttggcgcttttcctttgggaattgatttttgcacactcctgtctgatcttctttctcatttatttattttcattttatttta

SEQ ID NO: 6597 - DNA, 1066 bp, Brassica rapa
gcaaacctcagtacaccctccgcagtttttttgtctacagaggaaacctaagttgcaaccatgggtatttctcgtgactccatccacaagaggcgtgccactggaggcaagcagaagcaatggaggaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaatcatgtgcagaggaagattgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaagattcagaagaagaagggcaagggtgccgcttaaaactcgttgtctgcttgaaagctttatgttttttttcatgaaacatgtttgagttttcagtttagtgtctgagagcctatgttttggatttagcttttgcgatatggtatttcataaactcctgtcgttacaatgttatttgtctcgtaatttttgtttaatttaaaagcgtctttgatgaatttgatcgttgtggcataaaatcggtttcaccatggaggattgttaaccatgaagttaaatgcaaatgtatacgaaatgtaaacatcagcttactaattttagtggtcaagatcaagttaaggaaaacaataagttgttt

SEQ ID NO: 6598 - DNA, 851 bp, Brassica oleracea
gtgctccgcagttttttttgtctacagagaaaacctaagttgcaaccatgggtatttctcgtgactccatccacaagaggcgtgccactggaggcaagcagaagcaatggaggaagaagcgaaagtacgagatgggaagacagccagctaacaccaagctgtccagcaacaagacggtcagaagaatccgtgtccgtggaggcaacgtcaagtggcgtgcattgagactcgataccggtaactactcgtggggaagtgaagctgttacccgcaagaccagagtccttgacgtggtctacaatgcctccaacaacgagcttgtccgtaccaagacacttgttaagagcgccattgttcaggtcgacgctgctcctttcaagcagtggtacttgcagcactacggtgttgaggttggtcgcaagaagaagaatgctgctgcttctgccgccaagaaggaaggagaggatggcgaagatgctgctccagctgctgctgcacctgaggaggtgaagaagagcaaccatgtgcagaggaagattgagagccgtcaagaaggtcgcactcttgattcccacattgaggaccagtttgcaagtggacggttgttggcctgcatctcctcaaggcccggccaatgtggtcgtgctgatggatacattcttgaaggcaaagagcttgagttctaccagaagaaaattcagaagaagaagggcaagggtgccgcttaaagctcgttgtctgcttgaaagctttatgtttttttcatgaaacatgtttgagttttcagtttagtgtctgagaagcctatgttttggatttagctttgctatatggtatttcataaactcccg

SEQ ID NO: 6599 - DNA, 981 bp, Brassica napus
gcatgccaacttcattagtaccagccatatttctctcttagattttttttgtctacagagaaaacctaagttgcaaccatgggtatttctcgtgactccatccacaagaggcgtgccactggaggcaagcagaagcaatggaggaagaagcgaaagtacgagatgggaagacagccagctaacaccaagctgtccagcaacaagacggtcagaagaatccgtgtccgtggaggcaacgtcaagtggcgtgcattgagactcgataccggtaactactcgtggggaagtgaagctgttacccgcaagaccagagtccttgacgtggtctacaatgcctccaacaacgagcttgtccgtaccaagacacttgttaagagcgccattgttcaggtcgacgctgctcctttcaagcagtggtacttgcagcactacggtgttgaggttggtcgcaagaagaagaatgctgctgcttctgccgccaagaaggaaggagaggatggcgaagatgctgctccagctgctgctgcacctgaggaggtgaagaagagcaaccatgtgcagaggaagattgagagccgtcaagaaggtcgcactcttgattcccacattgaggaccagtttgcaagtggacggttgttggcctgcatctcctcaaggcccggccaatgtggtcgtgctgatggatacattcttgaaggcaaagagcttgagttctaccagaagaaaattcagaagaagaagggcaagggtgccgcttaaagctcgttgtctgcttgaaagctttatgttttttcatgaaacatgtttgagttttcagtttagtgtctgagaagcctatgttttggatttagctttgctatatggtatttcataaactcccgtcgttacaatgtgatttgtctcgtaatttttgtttaatttaaaaacgtctttgatgaaaatttgatcactgtggcataaaatcggttttgtttgtgtatc

SEQ ID NO: 6600 - DNA, 904 bp, Brassica napus
caaccatgggtatttctcgtgactccatccacaagaggcgtgccactggaggcaagcagaagcaatggaggaagaagcgaaagtacgagatggggaggcagccagctaacaccaagctgtccagcaacaagacggtcagaagaatccgtgtccgtggaggcaacgtcaagtggcgtgcgttgaggctcgatactggtaactactcgtggggaagtgaagctgttacccgcaagaccagagtcctcgacgtggtctacaatgcctccaacaacgagcttgtccgtacaaagacgcttgttaagagtgcaattgttcaggttgatgccgctcctttcaagcagtggtacttgcagcactatggtgttgaggttggtcgcaagaagaagaataatgctgctgcttctgccgccaagaaggaaggagaggatggtgaggatgctgcaccagctgctgctgctgcacctgaggaggtgaagaagagcaaccatgtgcagaggaagattgagagccgtcaagaagggcgcactcttgattcccacattgaggaccagtttgcaagtggacggttgttggcatgcatctcctcaaggcccggccaatgtggacgtgctgatggatacattcttgaaggtaaagagcttgaattctaccagaagaagattcagaagaagaagggcaagggtgccgcttaaaactcgttgtctgcttgaaagcttatgtttttttcatgaaacatgtttgagttttcagtttagtgtgtctgagaacctatgttttggatttagctttgctataatggtatttcgtaaactcccgtcgttacaatctgattgtctcgtaattttgttaatttaaaacgtctttgatgaatttgatcattgtggcataaaatcgggtttagttt

SEQ ID NO: 6601 - DNA, 837 bp, Brassica napus
gcgcatttttaacagagaaaggcaaccatgggtatatctcgtgactcaatccacaagaggcgtgccactggaggcaagcagaagggatggaggaagaagcgaaagtatgagatgggaaggcagccagccaacactaagttgtccagcaacaagacggtcagaagaatccgtgtccgtggaggtaacgtcaagtggcgtgcgttgaggctcgacactggtaactactcttggggaagtgaagctgttactcgcaagaccagagttcttgatgtggtctacaatgcctccaacaacgagttggtccgtaccaagacactagtgaagagcgccattgttcaggtggatgctgctcctttcaagcagtggtacctccagcactatggtgttgaggttggtcgcaagaagaagactgctccttctgctgccaagaaggaaggagaggatggtgaagaggctgctccagctgctgctgctgctcctgaggaggtgaagaagagcaaccacgtccagagaaagattgagagccgtcaagaaggtcgtagccttgattcccacatcgaggaccagtttgcaagtggtcgtttgctggcatgcatctcatcaaggcctggccagtgcggaagagctgatggatacattcttgaaggcaaagagttggaattctaccagaagaagatccagaagaagaagggaaagggtgctgcttagaaagcttcttgttctttgcctgaaatcttttgttttcttcagacatgttttgagttttcagtttgtaatactgtctgagaagtgagaacctatgtttttggattagcttgacatcatttatcttaatac

SEQ ID NO: 6602 - DNA, 697 bp, Brassica napus
ttttgtctacagaggaaacctaagttgcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtcctcgacgtggtctacaatgcctccaacaacgagcttgtccgtaccaagacgcttgttaagagcgccattgtccaggtcgacgctgctcctttcaagcagtggtacttgcagcactacggtgttgaggttggtcgcaagaagaagaatgctgctgcttctgccgccaagaaggaaggagaggatggtgaggatgctgctccagctgctgctgcacctgaggaggtgaagaagagcaaccatgtgcagaggaagattgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaagattcagaagaagaaggg

SEQ ID NO: 6603 - DNA, 918 bp, Brassica oleracea
  misc_feature (648)..(648): n is a, c, g, or t
  misc_feature (785)..(785): n is a, c, g, or t
  misc_feature (792)..(792): n is a, c, g, or t
  misc_feature (825)..(825): n is a, c, g, or t
gatctccggcgcaatttttaacagagaaaggcaaccatgggtatatctcgtgactcaatccacaagaggcgtgccactggaggcaagcagaagggatggaggaagaagcgaaagtacgagatgggaaggcagccagcaaacaccaagttgtccagcaacaagacggtcagaagaatccgtgttcgtggaggtaacgtcaagtggcgtgcgttgaggctcgatactggtaactactcctggggaagtgaagctgttactcgcaagaccagagtccttgatgtggtctacaatgcttccaacaacgagttggttcgtaccaagactcttgtgaagagtgccattgttcaggttgatgccgctcctttcaagcagtggtatctccagcactatggtgttgaggttggtcgcaagaagaagactgttccttccgctgccaagaaagaaggagaggatggtgaggatgctgctccagctgccgctgcacctgaggaggtgaagaagagcaaccacgtccagagaaagattgagagccgtcaagaaggtcgtagccttgattcccacattgaggaccagtttgcaagtgggcgtctgttggcttgcatctcatcaaggcctggccagtgtggaagagctgatggatacattctngagggtaaagaattagaattctaccagaagaaaatccagaagaagaagggaaagggtgctgcttaaagcttgttctttgcctgaaaccttttgttttcttcaaacatgttttgagttttcagtttgtaatactgtcngagaacntatgtttttggattagcttgacatcatttatcntaatactcccatcctttattgtggtgcaatattttgtgatttatttctcttgatatttaggtttagaaaagttaattctggacacggttacat

SEQ ID NO: 6604 - DNA, 953 bp, Brassica rapa
gtgtccaaaaatctcacatctccggcgcaattttaacagagaaaggcaaccatgggtatatctcgtgactcaatccacaagaggcgtgccactggaggcaagcagaagggatggaggaagaagcgaaagtatgagatgggaaggcagccagccaacactaagttgtccagcaacaagacggtcagaagaatccgtgttcgtggaggtaacgtcaagtggcgtgcgttgaggctcgacactggtaactactcctggggaagtgaggctgttacccgcaagaccagagttcttgatgtcgtctacaatgcctccaacaacgagttggtccgtaccaagacactagtgaagagcgccattgttcaggtggatgctgctcctttcaagcagtggtatctccagcactatggtgttgaggttggtcgcaagaagaagactgttccttctgctgccaagaaggaaggagaggatggtgaagaggctgctccagctgctgctgctgctcctgaggaggtgaagaagagcaaccacgtccagagaaagattgagagccgtcaagaaggtcgtagccttgattcccacatcgaggaccagtttgcaagtggtcgtttgctggcatgcatctcatcaaggcctggccagtgcggaagagctgatggatacattcttgaaggcaaagagttggaattctaccagaagaagatccagaagaagaagggaaagggtgctgcttagaaagcttcttgttctttgcctgaaatcttttgttttcttcagacatgttttgagttttcagtttgtaatactgtctgagaagtgagaacctatgtttttggattagcttgacatcatttatcttaatactccccatcatttattgtggtgcaatattttgtgatttatttctcttgatatatatttaggtttagaaaagttaattctggatacgattagat

SEQ ID NO: 6605 - DNA, 924 bp, Raphanus sativus
tttttttgtctacagagaaaacctaagttgcaaccatgggtatttctcgtgactcaatccacaagaggcgtgccactggaggcaagcagaagggatggaggaagaagcgaaagtatgagatgggaaggcagccagccaacaccaagctctccagcaacaagacggtcagaagaatccgtgtccgtggaggtaacgtcaagtggcgtgcgttgaggctcgataccggtaactactcctggggaagcgaagctgtcacccgcaagaccagagtccttgacgttgtctacaacgcctccaacaacgagcttgtccgtaccaagacacttgttaagagcgccattgttcaggttgatgccgctcctttcaagcagtggtacttgcagcactatggtgttgaggttggtcgcaagaagaagagtgctcctgctgccgccaagaaggaaggcgaggatggtgaggatgctgcaccagctgctgctgctcctgaggaggtgaagaagagcaaccacgtgctgaggaagattgagagccgtcaagaaggtcgcagtcttgattcccacattgaggaccagtttgcaagcggaaggttgttggcctgcatctcctcaaggcccggccaatgtggacgtgctgatggatacattcttgaaggcaaggagctagaattctaccagaagaaaatccaaaagaagaagggcaagggtgccgcttaaagcttgttgctggcttgaaagctttatgtttacatgggacatgttttgagttttcagtttctagtgtctctgagatcgtatgtgttggattagctttttgctatatgctatttcgtaaactctgttctttacccatgtttctcgtctcgtattttttgtttaatttaaaacgtctttgatgattatgatattctcaagttgcgttcttgcc

SEQ ID NO: 6606 - DNA, 935 bp, Raphanus sativus
ggaccctccgcatttattttgtctaacagagaaaacctaagttgcaaccatgggtatttctcgtgactcaatccacaagaggcgtgccactggaggcaagcagaagggatggaggaagaagcgaaagtatgagatgggaaggcagccagccaacaccaagctctccagcaacaagacggtcagaagaatccgtgttcgtggaggcaacgtcaagtggcgtgcgttgagactcgataccggtaactactcctggggaagtgaagctgtcacccgcaagaccagagtctttgacgttgtctacaacgcctccaacaacgagcttgtccgtaccaagacactcgttaagagcgccattgttcaggttgatgccgctcctttcaagcagtggtacttgcagcactatggtgttgaggttggtcgcaagaagaagagtgctcctgctgccgctaagaaggaaggcgaggatggtgaggatgctgctccagctgctgctgctgcacctgaggaggtgaagaagagcaaccatgtgctgaggaagattgagagccgccaagaaggtcgcagccttgattcccacattgaggaccagtttgcaagcggacggttgttggcctgcatctcctcaaggcccggccaatgtggacgtgctgatggatacattcttgaaggcaaggagctagaattctaccagaagaaaatccaaaagaagaagggcaagggtgccgcttaaagcttgttgttggcttgaaagctttatgtgttacatgggacatgttttgagttttcagtttctagtgtctctgagatcctatgtgttggattagctttttgctatatgctatttcgtaaactctgttcgttacccatgtttctcgtctctcgtattttttgtttaatttaaaacgtctttgatgattatgatagtctcaagttgc

SEQ ID NO: 6607 - DNA, 920 bp, Brassica napus
ggcgcagctgaaaacttcatctcgcggaagaggcaaccatgggtatctctcgtgactccatccacaagagacgtgccactggaggcaagcagaagcaatggaggaagaagcgaaagtacgagatgggaaggcagccagccaacaccaagttgtccagcaacaagacggtgagaagaatcagagtccgtggaggtaacgtcaagtggcgcgcgttgaggctcgacactggtaactactcgtggggaagtgaagctgttacccgcaagaccagggttcttgatgtcgtctacaacgcttccaacaacgagcttgtccgaaccaagactcttgtcaagagtgctattgttcaggttgatgctgctcctttcaagcagtggtacttgcagcattatggagttgaggttggtcgcaagaagaagaatgcttctgctgctgctgccgccaagaaggacggagaggaaggtgaagaagctgctccagctgctgccgctcctgaggagaccaagaagagtaaccatgtcttgaggaagatcgagagccgtcaggagggacgcagccttgattcccacatcgaggaccagtttgccagcggacgtttgttggcttgcatctcatcgaggcctggccagtgtggtcgtgccgatggatacatccttgaaggcaaagagctagagttctaccaaaagaagattcagaagaagaagggaaagggtgctgcttaagagcttcacttctttacttcgaaacttttttttgtattatcttcaaacaatgttttgagtttcagtttctactactgtctgagaacttatgtttttggattagctttcaatgatatttcataaactcccccatcagttaattttagcttactatctttgtttcggatttttttgtttagttttgaaatctttcatatg

SEQ ID NO: 6608 - DNA, 843 bp, Brassica napus
aaacttcatctcgcggaagaggcaaccatgggtatctctcgtgactctatccacaagaggcgtgccactggaggcaagcagaagcaatggaggaagaagcgaaagtacgagatgggaaggcagccagccaacacgaagttgtccagcaacaagacggtgagaagaatcagagtccgtggaggtaacgtcaagtggcgtgcgttgaggctcgacaccggtaactactcctggggaagtgaagcagttacccgcaagaccagggttcttgatgttgtctacaacgcttccaacaacgagctcgtcaggaccaagactcttgtcaagagtgctattgttcaggtcgatgctgctcctttcaagcagtggtacttgcagcattatggagtcgaggttggtcgcaagaagaagaatgcttctgctgctgctgccgccaagaaggacggagaggaaggtgaagaagctgctccagctgctgccgctcctgaggagaccaagaagagtaaccatgtcttgaggaagatcgagagccgtcaagagggacgcagccttgattcccacatcgaggaccagtttgccagcggacgtttgttggcttgcatctcatcgaggcctggccagtgtggtcgtgccgatggatacatccttgaaggcaaagagctagagttctaccaaaagaagattcagaagaagaagggaaagggtgctgcttaagagcttcacttctttacttcgaaactttttttgtattatcttcaaacaatgttttgagtttcagtttctactactgtctgagaacttatgtttttggattagctttcaatgatatttcataaactccccatc

SEQ ID NO: 6609 - DNA, 914 bp, Raphanus sativus
ggtccggcgcaattttaacagagaaactctaattaagaggcaaccatgggtatatctcgtgactcaatccacaagaggcgtgccactggaggcaagcagaagggatggaggaagaagcgaaagtacgagatgggaaggcagccagccaacaccaagctgtcaagcaacaagactgttagaagaatccgtgttcgtggaggcaacgtcaagtggcgtgcgttgaggctcgacactggtaactactcttggggaagtgaggcagttacccgcaagaccagagtccttgatgttgtttacaacgcctccaacaacgagcttgtccgtacaaagacgctagtcaagagcgccattgttcaggtggatgccgcgccattcaagcagtggtatctccagcactatggtgtcgaggttggtcgcaagaagaagaatgctgcttccgctgccaagaaggaaactgaggatggtgaagaagcagctccagctgctgctgctgctgctgctcctgaggaggtgaagaagagcaaccacgtgctgagaaagattgagagccgtcaagagggacgaagtcttgattcccacattgaggagcagtttgcgagcggtcgtttgttggcttgcatctcatcaaggcccggccagtgcggacgtgctgatggatacattctggaaggtaaagagctggaattctaccagaagaagatccagaagaagaagggaaagggtgctgcttaaaagcttgttctttgcctgaaacctttttgttttctttatacatgctgttttgaggtttcagtttgtaatactgtgtgagaacttatgtttttggattagcttaattcgtatttcttagtacttccatcagttattattgtacaatggtttgagatatctattttcatggtttccctttatta

SEQ ID NO: 6610 - DNA, 866 bp, Raphanus sativus
aggatctccggcgcaattttaacagagaaactctcattaagaagcaaccatgggtatatctcgtgactcaatccacaagaggcgtgccactggaggcaagcagaagggatggaggaagaagcgaaagtacgagatgggaaggcagccagccaacaccaagttgtccagcaacaagacggtcagaagaatccgtgttcgtggaggcaacgtcaagtggcgtgcgttgaggctcgatactggtaactactcttggggaagtgaggcagttacccgcaagaccagagttcttgatgttgtctacaacgcctccaacaacgagcttgtccgtacaaagacgctagtcaagagtgctattgttcaggtggatgccgctcccttcaagcagtggtatctccagcactatggtgtcgaggttggtcgcaagaagaagaatgctgcttccgctgccaagaaggaagcagaggatggtgaagaagcagctccagctgctgctgctgctgctgctgctcctgaggaggtgaagaagagcaaccacgtgctgagaaagattgagagccgtcaagagggacgaagtcttgattcccacattgaggaccagtttgcgagcggtcgtttgttggcttgcatctcatcaaggcccggccagtgcggacgtgctgatggatacattctggaaggtaaagagctggaattctaccagaagaagatccagaagaagaagggaaagggtgctgcttaaaagcttgttctttgcctgaaacctttttgttttctttatacatgctgttttgaggtttcggtttgtaatactgtgtgagaacttgtgtttttggattaagcttgatatcgtatttcttagtacttcc

SEQ ID NO: 6611 - DNA, 892 bp, Brassica oleracea
gccctaccggcgcagctgaaaacttcatctcgcggaagaggcaatcatgggtatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggcaacgtcaagtggcgtgcgttgaggctcgacactggtaactactcgtggggaagtgaagcagtgacccgcaagaccagggttcttgatgttgtctacaacgcttccaacaacgagctcgtcaggaccaagacgcttgtcaagagtgctattgttcaggtcgatgctgctcctttcaagcagtggtacttgcagcattatggagttgaggttggtcgcaagaagaagaatgcttctgctgctgccgccaagaaagacggagaggaaggtgaagaagctgctccagctgctgccgctcctgaggagaccaagaagagtaaccacgtcttgaggaagatcgagagccgtcaagagggacgcagccttgattcccacatcgaggaccagtttgccagcggacgtctcttggcgtgcatctcatcaaggcctggccagtgtggacgtgctgatggatacattcttgaaggcaaagagctagagttctaccaaaagaagatccagaagaagaagggaaagggtgctgcttaagagcttcactactttacttcgaaacttttttttgtattatcttcaaacaatgttttgagtttcagtttctactactgtctgagaacttatgtttttggattagctttcaatgatatttcataaactcccccatcagttaattttagcttactatctttgtttcag

SEQ ID NO: 6612 - DNA, 748 bp, Brassica napus
gcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaaccatgtgcagaggaagatcgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaagatcagaagaagaagggcaagggtgccgacttaaactacgttgtctgctttaaagtcttatggttttttttctatgaaacatgtttgagttt

SEQ ID NO: 6613 - DNA, 834 bp, Brassica napus
ctaccggcgcagctgaaaacttcatctcgcggaagaggcaatcatgggtatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggcaacgtcaagtggcgtgcgttgaggctcgacaccggtaactactcgtggggaagtgaagcagtgacccgcaagaccagggttcttgatgttgtctacaacgcttccaacaacgagctcgtcaggaccaagacgcttgtcaagagtgctattgttcaggtcgatgctgctcctttcaagcagtggtacttgcagcattatggagttgaggttggtcgcaagaagaagaatgcttctgctgctgccgccaagaaagacggagaggaaggtgaagaagctgctccagctgctgccgctcctgaggagaccaagaagagtaaccacgtcttgaggaagatcgagagccgtcaagagggacgcagccttgattcccacatcgaggaccagtttgccagcggacgtctcttggcgtgcatctcatcaaggcctggccagtgtggacgtgctgatggatacattcttgaaggcaaagagctagagttctaccaaaagaagatccagaagaagaagggaaagggtgctgcttaagagcttcactactttacttcgaaacttttttttgtattatcttcaaacaatgttttgagtttcagtttctactactgtctgagaacttatgtttttggattagctttcaa

SEQ ID NO: 6614 - DNA, 934 bp, Brassica juncea
gtacttttaaaagctctctctcttcgttcttccaactcctaccggcgcagctgagaagtttatctcgcggaagaggcaaccatgggtatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggtaacgtcaagtggcgtgcgttgaggctcgacaccggtaactactcgtggggaagtgaagcagttacccgcaagaccagggttcttgatgttgtctacaacgcttccaacaacgagctcgtcaggaccaagacgcttgtcaagagtgctattgttcaggtcgatgctgctcctttcaagcagtggtacttgcagcattatggagtcgaggttggtcgcaagaagaagaatgcttctgctgttgctgccaagaaggatggagaggaaggtgaagaagttgctccagctgctgccgctcctgaggagaccaagaagagtaaccacgtcttgaggaagatcgagagccgtcaagagggacgcagccttgattcccacatcgaggaccagtttgctagcggaaggttgttggcttgcatctcatcaaggcctggccagtgtggacgtgccgatggatacattcttgaaggcaaagagctagagttctaccaaaagaagattcagaagaagaagggaaagggtgctgcttaagagcttcacttctttacttcgaaacttttttttgtattatcttcaaacaatgttttgagtttcagtttctactactgtctgagaacttatgtttttggattagctttcaatgatatttcataaacttccccatcagttaattattctacaatgtttttgtctctatatttaa

SEQ ID NO: 6615 - DNA, 1000 bp, Brassica rapa
aaacactccttgtccccttttaatagctctctctctcttcgtttctccaactcctaccggcgcagctgaaaacttcatctcgcggaagaggcaaccatgggtatctctcgtgactccatccacaagagacgtgccactggaggcaagcagaagcaatggaggaagaagcgaaagtacgagatgggaaggcagccagccaacaccaagttgtccagcaacaagacggtgagaagaatcagagtccgtggaggtaacgtcaagtggcgtgcgttgaggctcgacaccggtaactactcatggggaagtgaagcagttacccgcaagaccagggttcttgatgttgtctacaacgcttccaacaacgagctcgtcaggaccaagacgcttgtcaagagtgctattgttcaggtcgatgctgctcctttcaagcagtggtacttgcagcattatggagtcgaggttggtcgcaagaagaagaatgcttctgctgttgctgccaagaaggatggagaggaaggtgaagaagttgctccagctgctgccgctcctgaggagaccaagaagagtaaccacgtcttgaggaagatcgagagccgtcaagagggacgcagccttgattcccacatcgaggaccagtttgctagcggaaggttgttggcttgcatctcatcaaggcctggccagtgtggacgtgccgatggatacattcttgaaggcaaagagctagagttctaccaaaagaagattcagaagaagaagggaaagggtgctgcttaagagcttcacttctttacttcgaaacttttttttgtattatcttcaaacaatgttttgagtttcagtttctactactgtctgagaacttatgtttttggattagctttcaatgatatttcataaacttccccatcagttaattattctacaatgtttttgtctctatatttaaacttttgaactactaccacatttcatctttttggatagtgcttaaaaccag

SEQ ID NO: 6616 - DNA, 691 bp, Brassica napus
ggcagtttttttgtctacagaggaaacctaagttgcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaaccatgtgcagaggaagatcgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaag

SEQ ID NO: 6617 - DNA, 854 bp, Brassica napus
ccaactcctaccggcgcagctgaaaacttcatctcgcggaagaggcaaccatgggtatctctcgtgactccatccacaagagacgtgccactggaggcaagcagaagcaatggaggaagaagcgaaagtacgagatgggaaggcagccagccaacaccaagttgtccagcaacaagacggtgagaagaatcagagtccgtggaggtaacgtcaagtggcgtgcgttgaggctcgacaccggtaactactcatggggaagtgaagcagttacccgcaagaccagggttcttgatgttgtctacaacgcttccaacaacgagctcgtcaggaccaagacgcttgtcaagagtgctattgttcaggtcgatgctgctcctttcaagcagtggtacttgcagcattatggagtcgaggttggtcgcaagaagaagaatgcttctgctgttgctgccaagaaggatggagaggaaggtgaagaagttgctccagctgctgccgctcctgaggagaccaagaagagtaaccacgtcttgaggaagatcgagagccgtcaagagggacgcagccttgattcccacatcgaggaccagtttgctagcggaaggttgttggcttgcatctcatcaaggcctggccagtgtggacgtgccgatggatacattcttgaaggcaaagagctagagttctaccaaaagaagattcagaagaagaagggaaagggtgctgcttaagagcttcacttctttacttcgaaactttttttgtattatcttcaaacaatgttttgagtttcagtttctactactgtctgagaacttatgtttttggattagctttcaatgatatttcataaa

SEQ ID NO: 6618 - DNA, 901 bp, Eutrema halophilum
gtcatcaattctcaagtcggcgctgtcatacttttttctctcggagaaaccctaaagaggcaaccatgggtatttctcgtgactccatccacaagaggcgtgccactggaggcaagcagaagcaatggaggaagaagcgaaagtatgagatgggaaggcaacctgccaacaccaagttgtctagcaacaagacggtcagaagaatcagggttcgtggaggtaatgtcaagtggcgtgcgttgaggcttgatactggtaactactcatggggaagtgaagcagtaactcgtaagaccagagtccttgatgtggtctacaatgcatccaacaacgagttggtccgtacaaagacacttgtcaagagtgctattgtacaggttgatgctgctcccttcaagcagtggtatctccagcactatggtgttgaagttggtcgcaagaagaagaatgctagttctgctaccaagaaggaaggagaggacggtgaagatgcttcagccccagctgctgcacctgaggagaccaagaagagcaaccatgtcttgagaaagattgagcagcgtcaagagggtcgtagtcttgattcccacattgaggaccaatttgcaagtggtcgtttgttggcttgtatctcttcaaggccaggccagtgtgggcgtgctgatggatacattctggaaggtaaagagttagagttctaccagaaaaagatccagaagaagaagggaaagggtgctgcttagaatttgttcttctttgcttgaagccttttgatttcttcaaacatgttttgagtatttatgagaaccgatgtttttggattagcgtactaatggtgtttcataaactctcgtcagttattatggtacaatggttttgagttatctattttcatggtaaa

SEQ ID NO: 6619 - DNA, 924 bp, Brassica napus
gaaaacttcatctcgcggaagaggcaaccatgggcatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggcaacgtcaagtggcgtgcgttgaggctcgacaccggtaactactcgtggggaagtgaagctgttacccgcaagaccagggttcttgatgttgtctacaacgcttccaacaacgagctcgtcaggaccaagactcttgtcaagagtgctattgttcaggttgatgctgctcctttcaagcagtggtacttgcagcattatggagttgaggttggtcgcaagaagaagaatgcttctgctgctgccgccaagaaagacggagaggaaggtgaagaagctgctccagctgctaccgctcctgaggagaccaagaagagtaaccacgtcttgaggaagatcgagagccgtcaagagggacgcagccttgattcccacatcgaggaccagtttgccagcggacgtctcttggcgtgcatctcatcaaggcctggccagtgtggacgttctgatggatacattcttgaaggcaaagagctagagttctaccaaaagaagatccagaagaagaagggaaagggtgctgcttaagagcttcactcctttacttcgaaactttttttgtattatcttcaaacaatgttttgagtttcagtttctactactgtctgagaacttatgtttttggattagctttcaatgatatttcataaactcccccatcagttaattttagcttactatctttgtttcggatttttttgtttagttttgagatctttcatatgaattttgttacatagtt

SEQ ID NO: 6620 - DNA, 1007 bp, Brassica napus
gactccttgtcctcttttaatagctctctctctcttcgtttctccaactcctaccggcgcagctgaaaacttcatctcgcggaagaggcaaccatgggtatctctcgtgactccatccacaagaggcgtgccactggaggcaagcagaagcaatggaggaagaagcgaaagtacgagatgggaaggcagccagccaacaccaagttgtccagcaacaagacggtgagaagaatcagagtccgtggaggtaacgtcaagtggcgtgcgttgaggctcgacaccggtaactactcgtggggaagtgaagctgttacccgcaagaccagggttcttgatgttgtctacaacgcttccaacaacgagctcgtcaggaccaagactcttgtcaagagtgctattgttcaggttgatgctgctcctttcaagcagtggtacttgcagcattatggagttgaggttggtcgcaagaagaagaatgcttctgctgctgccgtcaagaaggacggagaggaaggtggagaagctgctccagctgctgccgctcctgaggagaccaagaagagtaaccacgtcttgaggaagatcgagagccgtcaagagggacgcagccttgattcccacatcgaggaccagtttgccagcggacgtctcttggcgtgcatctcatcaaggcctggccagtgtggacgtgctgatggatacattcttgaaggcaaagagctagagttctaccaaaagaagatccagaagaagaagggaaagggtgctgcttaagagcttcacttcgaaacttcgaaactttttttgtattatcttcaaacaatgttttgagtttcagtttctactactgtctgagaacttatgtttttggattagctttcaatgatatttcataaactcccccatcagttaattttagcttactatctttgtttcggatttttttgtttagttttgaaatctttcatatgaattttgttacatagttttgaactttaccaaatcgc

SEQ ID NO: 6621 - DNA, 820 bp, Brassica napus
catctcgcggaagaggcaaccatgggcatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggcaacgtcaagtggcgtgcgttgaggctcgacaccggtaactactcgtggggaagtgaagctgttacccgcaagaccagggttcttgatgttgtctacaacgcttccaacaacgagctcgtcaggaccaagactcttgtcaagagtgctattgttcaggttgatgctgctcctttcaagcagtggtacttgcagcattatggagttgaggttggtcgcaagaagaagaatgcttctgctgctgccgtcaagaaggacggagaggaaggtggagaagctgctccagctgctgccgctcctgaggagaccaagaagagtaaccacgtcttgaggaagatcgagagccgtcaagagggacgcagccttgattcccacatcgaggaccagtttgccagcggacgtctcttggcgtgcatctcatcaaggcctggccagtgtggacgtgctgatggatacattcttgaaggcaaagagctagagttctaccaaaagaagatccagaagaagaagggaaagggtgctgcttaagagcttcacttcgaaacttcgaaacttttttttgtattatcttcaaacaatgttttgagtttcagtttctactactgtctgagaacttatgtttttggattagctttcaatgatattt

SEQ ID NO: 6622 - DNA, 933 bp, Raphanus sativus
gggactccttgtccccatataatagctctctctctctctcttcgttcttccaactcctaccggcgcagctgagaagtttatctcgcggaagaggcaaccatgggtatctctcgtgactccatccacaagaggcgtgccactggaggcaagcagaagggatggaggaagaagcgaaagtacgagatgggaaggcagccagccaacaccaagttgtcaagcaacaagacggtgagaagaatccgagtccgtggaggtaacgtcaagtggcgcgcgttgaggctcgacaccggtaactactcgtggggaagtgaagctgttacccgcaagaccagggttcttgatgtcgtctacaacgcttccaacaatgagctcgtcaggaccaagactcttgttaagagtgctattgttcaggtcgatgccgctcctttcaagcagtggtacttgcagcattacggagttgaggttggtcgcaagaagaagagtgctgcttctgtcgccgccaagaaggacggagaggaaggtgaagaagctgctccagctgctgccgctcctgaggagaccaagaagagtaaccacgtcttgaggaagatcgagagccgtcaagagggacgcagccttgattcccacatcgaggatcaattcgctagcggacgtctgttggcttgcatctcatctaggccaggccagtgtggacgtgccgatggatacattctggaaggcaaagagctagagttctaccagaagaagatccagaagaagaagggaaagggtgccgcttaaaagctacacttctttactttcaaactttttttttgtcttatcatcaaacatgttttgagtttcattttcagtttctactattgtctgagaacccgagatgcttttggattagcttgcaatgatatttcataaactaccccatcagttaattat

SEQ ID NO: 6623 - DNA, 888 bp, Eutrema halophilum
ctcggcgcttaatcactcggagaaaccctaagaggctaccatgggtatttctcgtgactccatccacaagaggcgtgctacgggaggcaagcagaagcaatggaggaagaagcgaaagtatgaaatgggaaggcagcctgccaacaccaagttatcgagcaacaaaacggtcagaagaatcagggttcgtggaggtaatgtgaagtggcgtgccttgagacttgataccggtaactactcctggggaagtgaagccgttacccgcaagaccagagtccttgatgtggtctacaatgcatccaacaacgagttggtccgtacaaaaactcttgtcaagagtgctattgtacaggtggatgctgctcccttcaagcagtggtatctccagcactatggtgttgaggttggtcgcaagaagaagaatgctggtgcctccaccaagaaggaaggagaggatactgaagatgctccagccgcagctgctgctacacctgaggagaccaaaaagagcaaccatgtcctgagaaagattgagcaacgtcaagagggtcgcagtcttgattcccatattgaggaccagtttgcaagcggtcgtttgttggcttgtatctcgtcaaggcctggtcaatgcgggcgtgctgatggatacattctggaaggtaaagagctagagttctaccagaagaagatccagaagaagaagggaaagggtgctgcttagacgtcgatcttcttttcttgaacttcaaacatgttttgaattttcagtttcatttgtatgagaacctatgtttttggattagcttgctatggaatttcataaactcctatcagtattacgctgccatggttttgtctcggattttttttaatattgaaattataatc

SEQ ID NO: 6624 - DNA, 896 bp, Eutrema halophilum
ctcggcgcttaatcactcggagaaaccctaagaggctaccatgggtatttctcgtgactccatccacaagaggcgtgctacgggaggcaagcagaagcaatggaggaagaagcgaaagtatgaaatgggaaggcagcctgccaacaccaagttatcgagcaacaaaacggtcagaagaatcagggttcgtggaggtaatgtgaagtggcgtgccttgagacttgataccggtaactactcctggggaagtgaagccgttacccgcaagaccagagtccttgatgtggtctacaatgcatccaacaacgagttggtccgtacaaaaactcttgtcaagagtgctattgtacaggtggatgctgctcccttcaagcagtggtatctccagcactatggtgttgaggttggtcgcaagaagaagaatgctggtgcctccaccaagaaggaaggagaggatactgaagatgctccagccgcagctgctgctacacctgaggagaccaaaaagagcaaccatgtcctgagaaagattgagcaacgtcaagagggtcgcagtcttgattcccatattgaggaccagtttgcaagcggtcgtttgttggcttgtatctcgtcaaggcctggtcaatgcgggcgtgctgatggatacattctggaaggtaaagagctagagttctaccagaagaagatccagaagaagaagggaaagggtgctgcttagacgtcgatcttcttttcttgaacttcaaacatgttttgaattttcagtttcatttgtatgagaacctatgtttttggattagcttgctatggaatttcataaactcctatcagtattacgctgccatggttttgtctcggattttttttaatattgaaattataatcacctatcg

SEQ ID NO: 6625 - DNA, 728 bp, Brassica napus
attttaacagagaaaggcaaccatgggtatatctcgtgactcaatccacaagaggcgtgccactggaggcaagcagaagggatggaggaagaagcgaaagtatgagatgggaaggcagccagccaacactaagttgtccagcaacaagacggtcagaagaatccgtgtccgtggaggtaacgtcaagtggcgtgcgttgaggctcgacactggtaactactcttggggaatgaagctgttactcgcaagaccagagttcttgatgtggtctacaatgcctccaacaacgagttggtccgtaccaagacactagtgaagagcgccattgtcaggtggatgctgctcctttcaagcagtggtacctccagcactatggtgttgaggttggtcgcaagaagaagactgctccttctgctgccaagaaggaaggagaggatggtgaagaggctgctccagctgctgctgctgctcctgaggaggtgaagaagagcaaccacgtccagagaaagattgagagccgtcaagaaggtcgtagccttgattcccacatcgaggaccagtttgcaagtggtcgtttgctggcatgcatctcatcaaggcctggccagtgcggaagagctgatggatacattcttgaaggcaaagagttggaattctaccagaagaagatccagaagaagagggaaggtgctgcttagaaagcttcttgttctttgcctgaaatcttt

SEQ ID NO: 6626 - DNA, 742 bp, Brassica napus
aacttcatctcgcggaagaggcaaccatgggcatctctcgtgactccatccacaagaggcgtgccactggaggcaagcagaagcaatggaggaagaagcgaaagtacgagatgggaaggcagccagccaacaccaagttgtccagcaacaagacggtgagaagaatccgagtccgtggaggcaacgtcaagtggcgtgcgttgaggctcgacaccggtaactactcgtggggaatgaagctgttacccgcaagaccagggttcttgatgttgtctacaacgcttccaacacgagctcgtcaggaccaagactcttgtcaagagtgctattgttcaggttgatgctgctcctttcaagcagtggtacttgcagcattatggagttgaggttggtcgcaagaagaagaatgcttctgctgctgccgccaagaaagacggagaggaaggtgaagaagctgctccagctgctaccgctcctgaggagaccaagaagagtaaccacgtcttgaggaagatcgagagccgtcaagagggacgcagccttgattcccacatcgaggaccagtttgccagcggacgtttgttggcttgcatctcatcgaggcctggccagtgtggtcgtgccgatggatacatccttgaaggcaaagagctagagttctaccaaaagaagattcagaagaagaagggaaagggtgctgcttaagagcttcacttctttacttcgaaactttttttgttat

SEQ ID NO: 6627 - DNA, 765 bp, Raphanus sativus
cttccaactcctaccggcgcagctgagaagtttatctcgcggaagaggcaaccatgggtatctctcgtgactccatccacaagaggcgtgccactggaggcaagcagaagggatggaggaagaagcgaaagtacgagatgggaaggcagccagccaacaccaagttgtcaagcaacaagacggtgaggagaatccgagtccgtggaggtaacgtcaagtggcgtgcgttgaggctcgacaccggtaactactcgtggggaagtgaagcggtgacacgcaagaccagggttctcgatgtcgtctacaacgcttccaacaacgagctcgtcaggaccaagactcttgtgaagagtgctattgttcaggtcgatgccgctcctttcaagcagtggtacttgcagcattacggagttgaggttggtcgcaagaagaagagtgctgttgctgctgcgtccaagaaggacggagaggacggtgaggaagctgctccagctgctgctgctcctgaggagaccaagaagagtaaccacgtcttgaggaagatcgagagccgtcaagagggtcgcagccttgattcccacatcgaggatcaattcgctagcggacgtctgttggcttgcatctcatctaggccaggccagtgtggacgtgccgatggatacattctggaaagcaaagagctagagttctaccagaagaagatccagaagaagaagggaaagggtgccgcttaaaagcttcacttttttactttcaaactttttt

SEQ ID NO: 6628 - DNA, 840 bp, Raphanus sativus
aagaggcaaccatgggtatctctcgtgactccatccacaagaggcgtgccactggaggcaagcagaagggatggaggaagaagcgaaagtacgagatgggaaggcagccagctaacaccaagttgtcaagcaacaagacggtgaggagaatccgagtccgtggaggtaacgtcaagtggcgtgcgttgaggctcgacaccggtaactactcgtggggaagtgaagcggtgacacgcaagaccagggttctcgatgtcgtctacaacgcttccaacaatgagctcgtcaggaccaagactcttgttaagagtgctattgttcaggtcgatgccgctcctttcaagcagtggtacttgcagcattacggagttgaggttggtcgcaagaagaagagtgctgcttctgtcgccgccaagaaggacggagaggaaggtgaagaagctgctccagctgctgccgctcctgaggagaccaagaagagtaaccacgtcttgaggaagatcgagagccgtcaagagggacgcagccttgattcccacatcgaggatcaattcgctagcggacgtctgttggcttgcatctcatttaggccaggccagtgtggacgtgccgatggatacattctggaaggcaaagagctagagttctaccagaagaagatccagaagaagaagggaaagggtgccgcttaaaagcttcacttttttactttcaaacttttttttttgtcttatcatcaaacatgttttgagtttcagtttctactattgtctgagaacccgagatgcttttggattagcttgcaatgatatttcataaactaccccatcagttaattat

SEQ ID NO: 6629 - DNA, 871 bp, Raphanus sativus
caactcctaccggcgcagctgacaagtttatctcgcggaagaggcaaccatgggtatctctcgtgactccatccacaagaggcgtgccactggaggcaagcagaagggatggaggaagaagcgaaagtacgagatgggaaggcagccagccaacaccaagctgtcaagcaacaagacggtgaggagaatcagagtccgtggaggtaacgtcaagtggcgcgcgttgaggctcgacaccggtaactactcgtggggaagtgaagcagtgacacgcaagaccagggttcttgatgttgtctacaacgcccccaacaacgagcttgcgcgtacaaagacccttgtgaagagtgctattgttcaggtggatgctgctcctttcaagcagtggtacttgcagcattacggagttgaggttggtcgcaagaagaagagtgctgttgctgccgccaagaaggacggagaggaaggtgatgaagctgctccagctgctgctgctgctcctgaggagaccaagaagagtaaccacgtcttgaggaagatcgagagccgtcaagagggacgcagccttgattgccacatcgaggatcaattcgctagcggacgtctgttggcttgcatctcatttaggccaggccagtgtggacgtgccgatggatacattctggaaggcaaagagctagagttctaccagaagaagatccagaagaagaagggaaagggtgccgcttaaaagcctcacttttttactttcaaacttttttttgtcttatcatcaaacatgttttgagtttcagtttctactattgtctgagaacccgtgatgcttttggattagcttgcaatgatatttcataaactaccccatcagtta

SEQ ID NO: 6630 - DNA, 848 bp, Eutrema halophilum
aacattatacttttgttaggtatttctcgtgactccatccacaagaggcgtgccactggaggcaagcagaagcaatggaggaagaagcgaaagtatgagatgggaaggcaacctgccaacaccaagttgtctagcaacaagacggtcagaagaatcagggttcgtggaggtaatgtcaagtggcgtgcgttgaggcttgatactggtaactactcatggggaagtgaagcagtaactcgtaagaccagagtccttgatgtggtctacaatgcatccaacaacgagttggtccgtacaaagacacttgtcaagagtgctattgtacaggttgatgctgctcccttcaagcagtggtatctccagcactatggtgttgaagttggtcgcaagaagaagaatgctagttctgctaccaagaaggaaggagaggacggtgaagatgcttcagccccagctgctgcacctgaggagaccaagaagagcaaccatgtcttgagaaagattgagcagcgtcaagagggtcgtagtcttgattcccacattgaggaccaatttgcaagtggtcgtttgttggcttgtatctcttcaaggccaggccagtgtgggcgtgctgatggatacattctggaaggtaaagagttagagttctaccagaaaaagatccagaagaagaagggaaagggtgctgcttagaatttgttcttctttgcttgaagccttttgatttcttcaaacatgttttgagtatttatgagaaccgatgtttttggattagcgtactaatggtgtttcataaactctcgtcagttattatggtacaatggttttgagttatctattttcatggt

SEQ ID NO: 6631 - DNA, 966 bp, Arabidopsis thaliana
ctcctctcaactccgcgcagctaaactttattggagaaaccctaatcggcgacaatgggtatttctcgtgactctatccacaagaggcgtgccactggaggcaagcagaagcaatggaggaagaagcgaaagtatgagatgggaaggcagccagccaacaccaagctctcaagcaacaagacggtcagaagaataagagttcgtggtggaaatgttaagtggcgtgcgttgaggctcgatactggtaactactcgtggggaagtgaagcaactacccgcaagaccagagtccttgatgtggtctacaatgcctccaacaatgagcttgtacgtactaagacacttgtcaagagtgctattgttcaggttgatgctgctccgttcaagcagtggtacctctcgcactatggtgttgagcttgggcgcaagaagaagagtgcttcttccaccaagaaggacggagaggaaggtgaagaggcagctgttgcagctcctgaggaggtcaagaagagcaaccacctcctgagaaagattgcaagccgtcaagagggtcgcagtcttgattcacacattgaggaccaatttgcaagtggacgtttgttggcttgtatctcttcaaggcctggccagtgcgggcgtgctgatggatacatcttggaaggtaaagagttggagttctacatgaagaagatccagaagaagaagggcaagggtgctgcttagagtctcttcttatctgccttgagcttttgtcttacaacatgttttgagttttcagtttcaattgtctgagaaactatgtttttggattagcttgtggtatttctttgaaactcccattatggtacaatgtttttgtcttggattttctttataattttaatcgataatttcactcaagttttatgcagtcaatattaagattgttctgttggtgaatttgaaatttctttgtctgtttgtttc

SEQ ID NO: 6632 - DNA, 894 bp, Arabidopsis thaliana
tctcaactccgcgcagctaaactttattggagaaaccctaatcggcgacaatgggtatttctcgtgactctatccacaagaggcgtgccactggaggcaagcagaagcaatggaggaagaagcgaaagtatgagatgggaaggcagccagccaacaccaagctctcaagcaacaagacggtcagaagaataagagttcgtggtggaaatgttaagtggcgtgcgttgaggctcgatactggtaactactcgtggggaagtgaagcaactacccgcaagaccagagtccttgatgtggtctacaatgcctccaacaatgagcttgtacgtactaagacacttgtcaagagtgctattgttcaggttgatgctgctccgttcaagcagtggtacctctcgcactatggtgttgagcttgggcgcaagaagaagagtgcttcttccaccaagaaggacggagaggaaggtgaagaggcagctgttgcagctcctgaggaggtcaagaagagcaaccacctcctgagaaagattgcaagccgtcaagagggtcgcagtcttgattcacacattgaggaccaatttgcaagtggacgtttgttggcttgtatctcttcaaggcctggccagtgcgggcgtgctgatggatacatcttggaaggtaaagagttggagttctacatgaagaagatccagaagaagaagggcaagggtgctgcttagagtctcttcttatctgccttgagcttttgtcttacaacatgttttgagttttcagtttcaattgtctgagaaactatgtttttggattagcttgtggtatttctttgaaactcccattatggtacaatgtttttgtcttggattttctttataattttaatcgataatttcactc

SEQ ID NO: 6633 - DNA, 777 bp, Arabidopsis lyrata
agctaaactttgttggagaaaccctaatcggcgacaatgggtatttctcgtgactccatccacaagaggcgtgccactggaggcaagcagaagcaatggaggaagaagcgaaagtatgagatgggaaggcagccagccaacaccaagctctcaagcaacaagacggtcagaagaatcagagttcgtggtggaaatgttaagtggcgtgcgttgaggctagatactggtaactactcctggggaagtgaagctgttacccgcaagaccagagtccttgatgtcgtctacaatgcctccaacaatgagcttgtccgtactaagacacttgtcaagagtgctattgttcaggttgatgctgctcctttcaagcagtggtacctctcgcactatggtgttgaagttggccgcaagaagaagaatgctgcttccaccaagaaggacgcagaggaaggtgaagaggtagccgctgttgaggagaccaagaagagcaaccacctctcgagaaagattgagagccgtcaagagggtcgcagtcttgattcacacattgaggaccaattcgcaagtggacgtttgttggcttgtatctcttcaaggcctggccagtgcggacgtgctgatggatacatcttggaaggtaaagagttggagttctacatgaagaaaatccagaagaagaagggcaagggtgccgcttagattctcttcttgtcttgcaacatgttttgagttttcagtttcaattgtctgagaaactatgtttttggattagcttgt

SEQ ID NO: 6634 - DNA, 880 bp, Arabidopsis lyrata
ctctctacaccgcgcagctaaactttgttggagaaaccctaatcggcgacaatgggtatttctcgtgactccatccacaagaggcgtgccactggaggcaagcagaagcaatggaggaagaagcgaaagtatgagatgggaaggcagccagccaacaccaagctctcaagcaacaagacggtcagaagaatcagagttcgtggtggaaatgttaagtggcgtgcgttgaggctagatactggtaactactcctggggaagtgaagctgttacccgcaagaccagagtccttgatgtcgtctacaatgcctccaacaatgagcttgtccgtactaagacacttgtcaagagtgctattgttcaggttgatgctgctcctttcaagcagtggtacctctcgcactatggtgttgaagttggccgcaagaagaagaatgctgcttccaccaagaaggacgcagaggaaggtgaagaggtagccgctgttgaggagaccaagaagagcaaccacctctcgagaaagattgagagccgtcaagagggtcgcagtcttgattcacacattgaggaccaattcgcaagtggacgtttgttggcttgtatctcttcaaggcctggccagtgcggacgtgctgatggatacatcttggaaggtaaagagttggagttctacatgaagaaaatccagaagaagaagggcaagggtgccgcttagattctcttcttgtcttgcaacatgttttgagttttcagtttcaattgtctgagaaactatgtttttggattagcttgtggtatttccttaaactcccagcagttattatggaacaatgtttttgtctcggatctttgttttaattttaatcgataatatcactgaa

SEQ ID NO: 6635 - DNA, 855 bp, Cleome gynandra
ctcatctgcagtctcgaaactcttctagcaggaaaaacctcggcgtctgaagggagaagaaaccaaagaattcttccgtcgccgcgatgggtatttctcgtgattcgatccacaagaggcgtgcaactggtggcaagcagaagcaatggaaggaaaagcgaaagtacgagatgggaagagttgccgcaaacactaagctgtcgagcaacaagactgtcaggagggttagggttcgtggaggaaatgtcaagtggcgtgcactgagacttgatactggaaattactcttggggaagcgaagccgttacccgcaagacaaggatccttgatgtggtgtacaatgcgtcaaacaatgagcttgttcgtaccaagactcttgtcaagagtgctatagtgcaggttgatgctgcacccttcaagcaatggtatcttcagcattatggtgttgaggttggccgcaagaaaaagtctgctgctacttctgccaagaaagaaggagaagaaggtgaagactcaactgctgctcctgaggagacaaagaagagcaaccacgttctcaggaagttagagaagcgtcaacaagaccggactcttgaccaacacattgaggaccagttcgccagcggtcgtttacttgcttgtatctcatcaaggcctggccaatgtggacgtgctgatggatacattttggagggtaaagagctggagttctacatgaagaagatccaaaagaagaagggcaagggtaccgcttaagatccttggattctttttttcttttggcgtcacaacattgtcttgttagtatgtgatgagagagatttcatattgggttatttttggttagcctttggtg

SEQ ID NO: 6636 - DNA, 902 bp, Cleome spinosa
ggctggtgtaaaactcggcgactgcagggagggagaagaaaccctagaaatctcctgttgcggcgatgggtatctctcgtgattcgatccacaagaggcgtgcgactggtgggaagcagaagcaatggaggaaaaagcgaaagtatgagctcggaagagttgcagcaaacaccaagctttccagtaacaagactgtaaggagggttagggttcgtggagggaacgtcaagtggcgtgcgctgaggcttgacactgggaattactcttggggaagcgaggccgtcacccgcaagaccaggatcctcgatgttgtgtacaatgcatcgaacaacgagcttgttcgtaccaagacactagtcaagagtgccatagttcaggttgatgctgcgcccttcaagcaatggtatctccaacattacggtgttgagattggccgcaagaaaaagactccagctacttctggcaagaaagaaggagaggaaggtgaagatggtgctgctgctcctgaggagacaaagaagagcaaccacgtgctgaggaagctagagaagcgccaaaagaaccgtgctcttgactcacacattgaggaccaattcgcgagcggtcggttgctcgcatgtatctcatcaaggcctgggcaatgcggtcgggctgatggatacattttggagggcaaagagctggagttctacatgaagaagatccagaagaagaagggcaagggtgctgcttagaatcgttggcttcttcggttgttatgatatcctcaagttttgttggtgtcacaatacttgtgtctggttagtatgtggtgttgagattggcatactccccctttggatgtgatgacaatttttcttgaacttgagcaatgttcttgcctgagtttttaataaaaaaaa

SEQ ID NO: 6637 - DNA, 840 bp, Cleome spinosa
cctcgaaacatcggcgtctcagcgtagaagaaatcctagcacatctccgttgccgcgatgggtatttctcgtgattcgatccacaagaggcgtgcaactggtgggaagcagaagcaatggaggaagaagcgaaagtatgagttgggtagagttgctgcaaacactaagctatccagcaacaagactgttaggagggttagggttcgtggaggtaatgttaagtggcgtgctttgaggcttgacactgggaattactcttggggaagcgaggccgttacccgcaagaccaggatccttgatgtcgtgtacaatgcttcgaacaatgagcttgtccgtaccaagacccttgtcaagagcgctatagtgcaggtcgatgttgcgcctttcaagcaatggtatcttcagcattacggtgtggaggtcggtcgcaagaagaaaactgctgctgcttctggcaagaaagaaggagaggaaggtgaagatgctgctcctgaggagacaaagaagagcaaccatgttctgagaaagctggagaagcgtcaacagaaccggtctcttgactcacacatcgaggaccagtttgctagcggtcgattgctcgcttgcatctcatcacggcccggccaatgtggtcgtgctgatggctacattctggagggtaaagagctggaattctacatgaagaagatccagaagaagaagggcaagggtaccgcttagtatccttggattctttcttccgttgccatatctttagtttttgttttcgtctcaacactttttttgtctggttagtatgtgatgacagatttcatctgtctttttttttattttggactt

SEQ ID NO: 6638 - DNA, 898 bp, Cleome spinosa
ggcaggggaaactcggcgtctcaagggagagagaaaccctagaactcttccgacgccgcgatgggtatctcgcgtgattcgattcacaagaggcgtgcaactggtgggaagcagaagcaatggaggaagaagcgaaagtatgagttgggaagagttgccgcaaacaccaagctgtcgagcaacaagactgtgaggagggttagggttcgtggagggaatgtcaagtggcgtgctttgaggcttgacaccgggaattactcttggggaagtgaggctgttacccgcaagaccaggatcctcgatgtcgtctacaactcatcgaacaacgagcttgtccgtaccaagactcttgtaaagagtgctatcgttcaagtcgatgctgcacccttcaagcagtggtatctccagcactacggtgttgaggttggccgcaagaagaagaccgcagctactgccggcaagaaagaaggagaggaaggtgaagacactgctgctctcgaggagacaaagaaaagcaaccatgtacttagaaagctggagaaacgacaacagaaccgcaatcttgacccgcatattgaggaccaattcgcaagtggtcgtctactggcttgtatctcttcaaggcctggccagtgcggtcgggcagatggatacattttggagggtaaagagctggagttctacatgaagaagatccagaagaagaaggggaagggtaccgcttaggatcttttttgattcattggtttgctatttccttggttttggtggtctctcaatggtttgtctgattattacgtgacgaaaggtttcatatgccttttgggattaacctgtgatgccgtttccataaactcggtcagcgctcttgcctgagatttctccgttaaaaaaaaaa

SEQ ID NO: 6639 - DNA, 980 bp, Raphanus sativus
ttttaacagagaaactctaaagagacaaccatgggtatatctcgtgactcaatccacaagaggcgtgccactggaggcaagcagaagggatggaggaagaagcgaaagtacgagatgggaaggcagccagccaacaccaagttgtcaagcaacaagactgttagaagaatccgtgtccgtggaggcaacgtcaagtggcgtgcgttgaggctcgatactggtaactactcttggggaagtgaggctgttacccgcaagaccagagtccttgatgttgtctacaatgcttccaacaacgagcttgtacgtacaaagactctagtcaagagtgccattgttcaggtggatgctgctcctttcaagcagtggtatctccagcactatggtgtcgaggttggtcgcaagaagaagaatgctgcttccgctgccaagaaggaagctgaggatggtgaagaagcagctccagctgctgctgctgctgctgctcctgaggaggtgaagaagagcaaccacgtgctgagaaagattgagagccgtcaagagggacgaagtcttgattcccacattgaggaccagtttgcgagcggtcgtttgttggcttgcatctcatcaaggcccggccagtgcggacgtgctgatggatacatttctggaaggtaaagagctggaattctaccagaagaagatccagaagaagaagggaaagggtgctgcttaaaagcttgttcttttgcctgaaacctttttgttttctttatacatgctgttttgaggtttcagtttgtaatactgtgtgagaacttatgtttttggattagcttgatatcgtatttcttagtacttccatcagttattattgtacaatgctttgagattactattttcatggtttccctttattattaggttaattctggattggatgtataacaatataaatgacagagtacttaagaatgaagcatagtatttggagccca

SEQ ID NO: 6640 - DNA, 1053 bp, Gossypium hirsutum
agtgtataactgatcttctaatctcagcgtatcacttcctttcaaaccctagcttccttcttctttgagattttgcttcagcactctaaggccccttacaagccaaaatgggtatttctcgtgattccatgcacaagaggcgtgccactggtggcaaaaagaaggcttggaggaagaagagaaagtatgagcttggaaggcaacctgcaaacacaaagctatcaagcaacaagacagtcaggaggattagggtccgaggtggaaatgtgaagtggcgtgccttgaggcttgacacaggaaactactcctggggaagtgaggctgtgactcgtaagaccagaattttggatgtggtgtacaatgcgtctaacaatgagttggttcgtacacaaactctggtgaagagtgctattgttcaagtcgatgctgctccattcaagcaatggtatctccagcactatggtgttgacattggccgcaagaagaaagcagcagcagcagccaagaaagaaggagaggaaggtgaaactgctactgaggaagtgaagaagagcaaccatgtcttgaggaagctggagaaacggcagcagagtcgcacacttgactcccatattgaggagcaatttggtagtggtcgtttactggcttgcatctcttcacggcctggtcaatgtggccgtgctgatggatatatcttggagggcaaagagctggagttttacatgaagaagatacagagaaagaaggggaagggagctgcctaaaattttgttgcttttaagtatttcattattgagatcaaaatgtccttttttttttttgccttactttcaccatttgagaacatttgaaattgtgttagttttgagtttttttttgtttgaatgttaattagtgtgtaccatttaacagtacttttatatacttgcatgttgtagtttgaaggtagtatcttgaactttatagatggagccaattttggttgggatgtggctctctacttaaatttttaaaggtgtcaaaaataggcccaatcttgaaattttgacttga

SEQ ID NO: 6641 - DNA, 1186 bp, Glycine max
agcccaatgggttcttaaccctgtcccttctctttgatcagtaaccctaccctttcttctttttcttcttcttctcattagccagagctcgcagcaccaccaccagcaccaccaccagcaccgttctattcttcttccacaatgggtatctctcgtgattccatgcacaagaggcgcgccaccggcggcaagaagaagtcttggaggaagaagagaaagtatgagcttgggaggcagccagcaaacacaaagctatcaagcaacaagacggtgaggaggattagggttcgcggtggaaacgtgaagtggcgtgctttgaggcttgataccgggaactactcttgggggagtgaggctgtgacccgcaagacaaggattcttgatgttgtgtacaatgcatccaacaatgagcttgttcggactcagacgctggtcaagagtgccattgttcaggtcgatgcagcgcccttcaagcagtggtatctgcagcattatggcgttgaggttggccgcaagaagaagagtgcagcagcttctgtcaagaaggaaggggaggatggtgaagctgcaactgaggaggtgaagaagagtaaccatgttgtgagaaaattggaaaagcgaaagcagaaccgggtgcttgatcctcacattgaagaacaatttggaggtggtcgccttttggcttgtatctcatctcgacctggccaatgtggccgtgctgatggatatatattagagggcaaagagctggaattttacatgaagaagcttcagaagaagaagggcaagggtgctgcttaagatattgtctctcttcctactcgttgtatcagaatttcatgaagctcttaactatccaccaacagattatcagttttgctaggaactctattttctttgggagggaagggtttatgggtgtaaacatgaccgagaacttttatttgtttacttatagtgagtcctgtttaaattgattatttccaccattacaattttctagtgcattgactttctttccttacatttctttagagcagacagagtacttggaattatttacatttgccctttataagttcttaaaatgagtagttcttttgatttctgaacttcctcttcatggattttgattctcatgttgagtaaaataacaaactcatatggtatttatgagattttttta

SEQ ID NO: 6642 - DNA, 1112 bp, Glycine max
tctcattagccagagctcgcagcaccaccaccagcaccaccaccagcaccgttctattcttcttccacaatgggtatctctcgtgattccatgcacaagaggcgcgccaccggcggcaagaagaagtcttggaggaagaagagaaagtatgagcttgggaggcagccagcaaacacaaagctatcaagcaacaagacggtgaggaggattagggttcgcggtggaaacgtgaagtggcgtgctttgaggcttgataccgggaactactcttgggggagtgaggctgtgacccgcaagacaaggattcttgatgttgtgtacaatgcatccaacaatgagcttgttcggactcagacgctggtcaagagtgccattgttcaggtcgatgcagcgcccttcaagcagtggtatctgcagcattatggcgttgaggttggccgcaagaagaagagtgcagcagcttctgtcaagaaggaaggggaggatggtgaagctgcaactgaggaggtgaagaagagtaaccatgttgtgagaaaattggaaaagcgaaagcagaaccgggtgcttgatcctcacattgaagaacaatttggaggtggtcgccttttggcttgtatctcatctcgacctggccaatgtggccgtgctgatggatatatattagagggcaaagagctggaattttacatgaagaagcttcagaagaagaagggcaagggtgctgcttaagatattgtctctcttcctactcgttgtatcagaatttcatgaagctcttaactatccaccaacagattatcagttttgctaggaactctattttctttgggagggaagggtttatgggtgtaaacatgaccgagaacttttatttgtttacttatagtgagtcctgtttaaattgattatttccaccattacaattttctagtgcattgactttctttccttacatttctttagagcagacagagtacttggaattatttacatttgccctttataagttcttaaaatgagtagttcttttgatttctgaacttcctcttcatggattttgattctcatgttgagtaaaataacaaactcatatggtatttatgagatttttt

SEQ ID NO: 6643 - DNA, 1168 bp, Glycine max
gcccattacattttatcagtaaccctatcctttcttcttcttctcattagcacgagctcgcaataccagcaccgttctattcttcttccaaaatgggtatctctcgtgattccatgcacaagaggcgcgccaccggcggcaagaagaaagcttggaggaagaagagaaagtatgagcttgggaggcagccagcaaacacaaagctatcaagcaacaagacggttaggaggattagggttcgcggtgggaacgtgaagtggcgcgctttgaggcttgatactgggaactactcttgggggagtgaggctgcaacccgcaagacaaggattcttgatgtggtgtacaatgcatccaacaatgagcttgttaggactcagacattggtcaagagtgccattgttcaggtcgatgcagcacccttcaagcagtggtatctgcagcattatggcgttgaggttggccgcaagaagaagagtgcagcagcttctgccaagaaggaaggggaggatggtgaagctgcaactgaggaggtgaaaaagagtaaccatgttttgagaaaattagaaaagcgaaagcagaaccgagttcttgatcctcacattgaagaacaattcggaggtggtcgccttttggcttgtatctcatctcgacctggccaatgtggtcgtgctgatggatatatattagagggaaaagagctggaattttacatgaagaagcttcagaagaagaagggcaagggtgctgcttaagatattgtctatcttcctactcgttgtatcagaatttcttgaagctcttaactatccaccaacagattatcagttttgctacgaactctattttctttgggaggggtttatgggtgtaaacatggccaagaacttttatttgtttacttatagtgagtcctgtttaaattgattatttctaccattacaattttctagtgcatttactttctttccttgattttctttagagcagacagagtccttggaattattttcgtttgctgtttataagtttaattatgtgagttggtcttaaaatgagtagttcttttgatttctgaccttcctcttcatggactatgttatgaatctcatgatgagtaaaataacaaactcgacatttaagtggatgagattttttaaaattttattca

SEQ ID NO: 6644 - DNA, 1072 bp, Prunus mume
gacttcgtttgtactaaagacctagctcggctgcctcacttgtctcaaaccctagccgcgttgccgcaactccaggagcagagacacccttgaactctcctcctcccaagatgggtatttcccgagattccatgcacaagagacgtgccactggaggcaagaagaaggcatggaggaagaagagaaagtatgagcttggaaggcaacctgcaaacacaaagttgtcaagcaacaagacagtgaggagaatcagagttcgaggtgggaatgtgaagtggcgtgctctgaggcttgacacaggaaatttctcatggggtagtgaggctgtgacccgcaaaacccgtcttcttgatgtcgtgtacaatgcatctaacaatgagctggtccgtactcaaactttggtgaagggtgccattgttcaggttgatgcagcaccattcaagcagtggtatctccagcactacggagttgaaattggccgcaagaagaaaactgcagctgctgccaagaaagaaggagaggaaggtgatgctgctgctgctcctgctgccgttgctgaggaggtgaagaagagcaaccatgtagtaagaaagttggagaagcgtcaacagagtcgcacccttgaccagcatattgaagagcaatttggtggtggtcgtctattggcttgtatctcatcacgacctggacagtgtggccgtgctgatggatatatattggagggcaaagagctggaattttacatgaagaagctccagaggaagaaggggaagggtgccgctgcttagaattttgttaccagaactttagtcctttagactcagaatatgttatttccttcatcctttcctactttttgaggggttgcactttatttcggtttgatgttgaactggtaaacactgtttctatggtgggatgtttaatcagcaattatatttcattttggatctttctctttcatttcgtaagcgtcaacacttggttggatgctgcagtttcaaacgttggtttattttcttactcaattctcaacaaacaaggcttgctggaactttgaaatcatttggga

SEQ ID NO: 6645 - DNA, 1029 bp, Glycine max
ctcattagcacgagctcgcaataccagcaccgttctattcttcttccaaaatgggtatctctcgtgattccatgcactataggcgcgccaccggcggcaagaagaaagcttggaggaagaagagaaagtatgagcttgggaggcagccagcaaacacaaagctatcaagcaacaagacggttaggaggattagggttcgcggtgggaacgtgaagtggcgcgctttgaggcttgatactgggaactactcttgggggagtgaggctgcaacccgcaagacaaggattcttgatgtggtgtacaatgcatccaacaatgagcttgttcggactcagacattggtcaagagtgccattgttcaggtcgatgcagcacccttcaagcagtggtatctgcagcattatggcgttgaggttggccgcaagaagaagagtgcagcagcttctgccaagaaggaaggggaggatggtgaagctgcaactgaggaggtgaaaaagagtaaccatgttttgagaaaattagaaaagcgaaagcagaaccgagttcttgatcctcacattgaagagcaattcggaggtggtcgccttttggcttgtatctcatctcgacctggccaatgtggtcgtgctgatggatatatattagagggaaaagagctggaattttacatgaagaagcttcagaagaagaagggcaagggtgctgcttaagatattgtctatcttcctactcgttgtatcagaatttcttgaagctcttaactatccaccaacagattatcagttttgctacgaactctattttctttgggaggggtttatgggtgtaaacatggccaagaacttttatttgtttacttatagtgagtcctgtttaaattgattatttctaccattacaattttctagtgcatttactttctttccttgattttctttagagcagacagagtccttggaattattttcgtttgccgtttataagtttaattatgtgagttggtcttaaaatgagtagttcttttgattt

SEQ ID NO: 6646 - DNA, 933 bp, Glycine max
gagggcgaggaagccacatagagacacaatacagagtgagttgttgctccttcgccacaactctctgccaacatgggtatctccagagattctatgcacaagaggcgtgccactggtggcaagaagaaggcctggaggaaaaagagaaagtatgagcttggtcgccagcctgctaacactaagctgtcaagcaacaagacagtcaggaggatccgtgttagaggtggaaatgtgaaatggagggcattgagattggatactggaaattactcctggggaagtgaagctgtaactcgcaagactcgtgtactagatgtggtttacaatgcctcaaacaatgagcttgtgcgtactcagactcttgtcaaaagtgctatcgttcaggttgatgctgctccattcaaacagtggtatcttcagcactatggtgttgagattggtaggaaaaagaagacagctgccaagaaggaaactgcagaggagggtggtgatgctgctgcagctgcagaagaagccaaaaagagtaaccatgtgcagagaaaattggagaagcgccagaaagatcgaaagcttgatgctcacattgaggagcagtttggtggtgggcgtttgcttgcttgcatttcctctagacctggtcaatgtggcagagctgatggctacattctggaaggtaaggagttggagttttacatgaaaaaactccagaagaagaagggaaagggtgctgcttgattttagtgttttccaaatttttatatggctttagttgcttttatgtgttgctggtaccatttaaggtgatgttttgagccacaggacatcgattagtgcaaattatcttgttagtccttcgcaaattggcatcgtaattttgttttgaactgtttttgctactgatgagttataatttttattaattaatgtcttgct

SEQ ID NO: 6647 - DNA, 1096 bp, Quercus alba
gttaaacctagctcgcctctctttacatttctctttctttctcacaccctatctttctcggcagagatattgtgacttctaggacagagaaaccctagaatccccactcggccaaaatgggtatctctcgtgattccatgcacaagagacgtgccactggaggaaagaagaaggcttggaggaagaagcgaaagtacgagcttggaaggcaacctgcaaacacaaagctgtcaagcaacaagacagttagaagaattagggttcgaggaggaaacgtgaagtggcgtgctctgagacttgatactggcaacttctcgtgggggagtgaggccgtgacccggaagacacgtcttcttgatgtggtctacaatgcatccaacaatgagttggttcgtactcagactttggtgaagagtgctatagttcaggttgatgctgcaccattcaagcagtggtatctccagcactatggagttgaaattggtcgcaagaagaaaactacagcttccaccaagaaagaaggagaggagggtgaagctgctgctgccaccgccaccactgaggaggtgaagaagagcaaccatgtccagagaaagctagagaagcgccaacagaatcgcaagcttgactcacatattgaagagcaatttggtggtggacgtttgttagcttgtatctcatcacgacctggtcagtgtggccgtgctgatggatatatcctggaaggcaaagagcttgagttctacatgaagaagatccagaggaagaagggcaaggctggtgcagcctaaattttgttacttgaactacatccttcatagctgaatgtcttttttgttcactttattttatttctcccctagacattgaacttaagttgatatgctccattttgccagaaagccttttgcttgtgttaagtttgacttaattgggatattattagttttccttctgtgataagaacgtgttataactattactgttgtgatcaatacttcaaccacctttaaatggatgtcccagattgtgttttctgggagcttttcatctgaagttggattggaatgggcagaagatggatgttattttgtga

SEQ ID NO: 6648 - DNA, 919 bp, Prunus persica
tcaaaccctagccgcgttgccgcaactccaggagcagagaaaccctagaactctccttctcccaagatgggtatttcccgagattccatgcacaagagacgtgccactggaggcaagaagaaggcatggaggaagaagagaaagtatgagcttggaaggcaacctgcaaacacaaagttgtcaagcaacaagacagtgaggagaatcagagtacgaggtgggaatgtgaagtggcgtgctctgaggctcgacacaggaaatttctcatggggtagtgaggctgtgacccgcaaaacccgtcttcttgatgtcgtgtacaatgcatctaacaatgagctggtccgtactcaaactttggtgaagggtgccattgttcaggttgatgctgcaccattcaagcagtggtatctccagcactacggagttgaaattggccgcaagaagaaaactgcagctgctgccaagaaagaaggagaggaaggtgatgctgctgctgctcctgctgccgtcgctgaggaggtgaagaagagcaaccatgtagtaagaaagttggagaagcgtcaacagagtcgcacccttgaccagcatattgaagagcaatttggtggtggtcgtctattggcttgtatctcatcacgacctggacagtgtggccgttctgatggatatatattggagggcaaagagctggaattttacatgaagaagctccagaggaagaaggggaagggtgctgctgcttagaattttgttaccagaactttagtcatttagactcagaatatgttatttccttcatcctttcctaccttttgaggggttgcattttatttcggtttgatgttgaactggtaaacactgtttcaatggttgaatgtttaatcagcaattatatttcattttggatctttccctttca

SEQ ID NO: 6649 - DNA, 1110 bp, Glycine max
ggccgggtaagcgaagccggatcagtaagtagggtttcgtctgttgaaatatataatccgtaatattagggttttaagagagggcgaggaagccacatagagacacaatacagagtgagttgttgctccttcgccacaactctctgccaacatgggtatctccagagattctatgcacaagaggcgtgccactggtggcaagaagaaggcctggaggaaaaagagaaagtatgagcttggtcgccagcctgctaacactaagctgtcaagcaacaagacagtcaggaggatccgtgttagaggtggaaatgtgaaatggagggcattgagattggatactggaaattactcctggggaagtgaagctgtaactcgcaagactcgtgtactagatgtggtttacaatgcctcaaacaatgagcttgtgcgtactcagactcttgtcaaaagtgctatcgttcaggttgatgctgctccattcaaacagtggtatcttcagcactatggtgttgagattggtaggaaaaagaagacagctgccaagaaggaaactgcagaggagggtggtgatgctgctgcagctgcagaagaagccaaaaagagtaaccatgtgcagagaaaattggagaagcgccagaaagatcgaaagcttgatgctcacattgaggagcagtttggtggtgggcgtttgcttgcttgcatttcctctagacctggtcaatgtggcagagctgatggctacattctggaaggtaaggagttggagttttacatgaaaaaactccagaagaagaagggaaagggtgctgcttgattttagtgttttccaaatttttatatggctttagttgcttttatgtgttgctggtaccatttaaggtgatgttttgagccacaggacatcgattagtgcaaattatcttgttagtccttcgcaaattggcatcgtaattttgttttgaactgtttttgctactgatgagttataatttttattaattaatgtcttgctattcttattgttgggtactgggggatggggttttcaatagcagataaatgtgtaagagctagtattcattcaattattaaaatcttaattttaaaaat

SEQ ID NO: 6650 - DNA, 960 bp, Juglans hindsii x Juglans regia
  misc_feature (567)..(567): n is a, c, g, or t
  misc_feature (570)..(570): n is a, c, g, or t
  misc_feature (657)..(657): n is a, c, g, or t
  misc_feature (933)..(933): n is a, c, g, or t
ctctgcagagatttgtggacttgtggcagacagacaccgtagaacagccactcggccaaaatgggtatttctcgtgattccatgcacaagagacgtgccactggaggcaagaagaaggcttggaggaagaagcgcaagtatgagctcggaaggcaacctgcaaacacaaagctttcaagcaacaagacagttaggaggattagagttcgaggtgggaatgtgaagtggcgtgctctgaggcttgacactggaaactactcatgggggagtgaggctgtgacccggaaaacccgtcttcttgatgtggtctacaatgcatccaacaatgagctggttcgtactcagactctggtaaaaagtgctatcgttcaggttgatgcagcgccattcaagcagtggtatcttcagcattatggagttgacattggtcgcaagaagaaaactttggcttccaccaagaaagaaagcgaggagggtgatgctcctgctgctgctgctgctcctgctactgaggaggcgaagaaaagcaaccatgtccagagaaagctggagaagcggcagcagaancgnaagcttgatgcacacattgaagagcaatttggtagtggtcgtttgttggcttgtatctcatcaagacctggtcagtgtggccgtgcngatggatacatcttggaaggtaaagagcttgagttctacatgaagaagatccagagaaagaagggcaagggagctgcctaaagttttgttacctgaacgtcatcctttatatcagaatctgttttgttcatgatgtttcctctcacataggcattgaacttaagcttagacgaaacattttgggagaagctatttcttgtgttacatttgacttcctaattggaatattatgggtgtcttctattgtcattgatgaactgaatatcattgttagcnttgagtttgttatttactaccaacagc

SEQ ID NO: 6651 - DNA, 822 bp, Cleome spinosa
gacgtctggaggagaaagaggccataggattttccgtcgccgcgatgggtatttctcgtgattccatccacaagaggcgtgcaactggtggcaagcagaagcaatggaggaagaagcgaaagtacgagttgggaagagttgccgcaaacactaagctttcaagcaacaaaacagtcaggaggcttagggttagaggaggaaacattaaatggcgagctttgagactcgacacgggaaatttctcgtggggtagtgaggctgccacccgcaagagtagaatcctcgatgtggtgtataatgcatcaaataacgagcttgtccgcaccaaaacattggttaagagtgctatagttcaaatcgatgccgcacccttcaagcaatggtacctctcccactatggtgttgaggttggccgcaagaagaaggcatcagcttcttcaggcaagaaagaagaggaaggtgaagatggtgccgagaaagctgcagcccccgaggagacaaagaagagcaaccatgtcctgaggaagctcgagaaacgtcaacagaaccgagctctcgactcccacatcgatgaccagttctcaactggtcgtttgctggcttgtatctcatcaaggccgggccagtgtggtcgtgctgatggatatattttggagggtaaagagttggagttttacatgaagaagattcagaagaagaagggcaagggtgctgcctagggtttttgtttctttgtctgaaccattagttgctgagaaatgttgcattttcaggttcctctaaccatattgctgtagtagcatggttatgagatttcataga

SEQ ID NO: 6652 - DNA, 1011 bp, Cajanus cajan
taagagggtttagtcgccggccagagctcgcagcagcaggagcaccaccgttcacttcttccaaaatgggtatctctcgtgattccatgcacaagaggcgcgccactggtggcaagaagaaagcttggagaaagaagagaaagtacgagcttgggaggcagccagcgaacacaaagctatcgagcaacaagacggttaggaggattagggttcgtggtgggaatgtgaagtggcgtgctttgaggcttgacactggtaactactcttgggggagtgaggctgtgacccgtaagacaaggatccttgatgtggtgtataatgcatccaacaatgagctggttcggactcagacattggtcaagagtgctatcgttcaggttgatgctgcgcccttcaagcagtggtatctgcagcattatggtgttgatattgggcgcaagaagaagagtgctgctgcttctgccaagaaagaaggagaggatggcgaagctgcaactgaggaggtgaagaagagtaaccatgttttaagaaagttggaaaagcgtaaacagaaccgggtgcttgatcctcacattgaagaacaatttggaggtggtcgccttttggcctgtatctcatcccgacctggccaatgtggccgtgctgatggatatatattagagggtaaagagctagaattttacatgaagaagcttcagaggaagaagggaaagggtgctgcttaagatattctctcttcgaactcgaacaatcagatgatcagttttgccagtagctctactttcttgggcgggagggttgtatgggttggtttaattatagccaaagtaacttttaattgtttacttcatagtgagttctgttcaagttgattattaaactagcaactgtccttggaattattttcatttgtagtttaatttggaaacttaattatgtgaattcttaaaatgagtgtttctttttgatttgtgatcttagcttcccgacgaattgaatcgtacattgaga

SEQ ID NO: 6653 - DNA, 928 bp, Brachypodium distachyon
agcaaccggcggcgcagccacaaagcagggacaggagaggagggaaccctaagccgccgccaccatgggtatctcgcgtgactcgatgcacaagcgccgcgccactggcggcaagcagaaggcctggaggaagaagcgaaagtatgagctcggtcgccagcctgctaacaccaagctgtcaagcaacaagacagtgaggagggtgcgtgtccgtggaggcaatgtcaagtggagggctctccgtttggatactggcaactactcctggggaagtgaggctgtgacccgcaagactcgtctcctcgatgtggtttacaactcttccaacaatgagcttgtcaggacccagacacttgtgaaaaatgccattgtgcaagttgatgctgcccccttcaagcagtggtacctcactcactatggagtggatattggtaggaagaagaagactcctgctgctaccaagaaggatgctactgaggatggtgatgctgctgctcctgctgctgcggctgcagaggaagccaagaaaagcaacaatgtccagaggaagctggagaaacgccaacagggtcgcacactagacccccacattgaagaacaatttagcagcggaaggttgttggcttgcatttcgtcccgccctgggcagtgtggacgggctgacggctacatccttgagggtaaggagctggagttttacatgaagaagcttcagaagaagaagggcaagggtgccgctgcttagagcaaatctaccttaagaactttttttgttctcttgatactgttagctgtttggagtttatatcttatgcttgcggacaaaatggctgtttgtttcccccctcgaaatggtcctgtctagcatgaagagctgagaattgtttatgtactctcgtatcattagtttcaatgtgtactcttttgc

SEQ ID NO: 6654 - DNA, 894 bp, Brachypodium distachyon
tcaaccggcggcgcagccacagagggaacccgaagccgccgccatgggtatctcgcgtgactccatgcacaagcgccgcgccactggcggcaagcagaaggcctggaggaagaagcgaaagtatgagctcggtcgtcagcctgctaacaccaagctgtctagcaacaagacagtgaggagggtccgtgtccgtggaggcaatgtcaagtggagggccctacgtttggatactggcaactactcctggggaagtgaggctgtgacccgcaagacccgtctccttgatgtggtttacaactcctccaacaatgagcttgtcaggacccagacccttgtgaaaaatgccattgtgcaagttgatgctgcccccttcaagcagtggtacctcactcactatggagtggatattggtaggaagaagaagacccctgctgctaccaagaaggatgctactgaggatggtgatgctgctgcacctgctgctgcggccgcagaggaaaccaagaaaagcaacaatgtccagaggaagctggagaaacgccaacagggtcgcaccctagacccccacatcgaagaacaatttagcagtggaaggttgttggcatgcatttcttcccgccctgggcagtgtggacgagctgatggctacatccttgagggtaaggagcttgagttctacatgaagaagctccaaaagaagaagggcaagggtgccgctgcttagagcaaatcctaagaactctttttgttcccttgatactgttagctgtttggagtctgtcttatgcttgcggacaaatggctggttgtttcccccctcaaaattgatcttgtctagcatgaagagctgagaattgtttatgtactctcgtattattagtttctatgtgtact

SEQ ID NO: 6655 - DNA, 1198 bp, Brachypodium distachyon
ataaaatcacaaccgcttagcgaggcagcaccttttgcgaggcagagcaaccggcggcgcagccacaaagcagggacaggagaggagggaaccctaagccgccgccaccatgggtatctcgcgtgactcgatgcacaagcgccgcgccactggcggcaagcagaaggcctggaggaagaagcgaaagtatgagctcggtcgccagcctgctaacaccaagctgtcaagcaacaagacagtgaggagggtgcgtgtccgtggaggcaatgtcaagtggagggctctccgtttggatactggcaactactcctggggaagtgaggctgtgacccgcaagactcgtctcctcgatgtggtttacaactcttccaacaatgagcttgtcaggacccagacacttgtgaaaaatgccattgtgcaagttgatgctgcccccttcaagcagtggtacctcactcactatggagtggatattggtaggaagaagaagactcctgctgctaccaagaaggatgctactgaggatggtgatgctgctgctcctgctgctgcggctgcagaggaagccaagaaaagcaacaatgtccagaggaagctggagaaacgccaacagggtcgcacactagacccccacattgaagaacaatttagcagcggaaggttgttggcttgcatttcgtcccgccctgggcagtgtggacgggctgacggctacatccttgagggtaaggagctggagttttacatgaagaagcttcagaagaagaagggcaagggtgccgctgcttagagcaaatctaccttaagaactttttttgttctcttgatactgttagctgtttggagtttatatcttatgcttgcggacaaaatggatggttgtttcccccctcgaaatggtcctgtctagcatgaagagctgagaattgtttatgtactctcgtttcattagtttcaatgtgtactcttttgctcgtcgtttataattttgagcttagctgttttgcatgactgattttctttacaccgcagcttaagtgtttgtacacccaaaaaagcaagtgtttgcaaacagtgtcttgacttagtcagatcaggcaatcgagtaagagttgatctttctacaacgtcgtaattaatgctgataaatcatgtagagttagtttatagatgacacctgttatatgtctacgacccg

SEQ ID NO: 6656 - DNA, 841 bp, Fagopyrum esculentum
ccctctgctgcctgaacgcaagagcaaccatgggtatttctcgtgattctatgcacaagaggcgtgccactggaggcaagaagaagtcatggaggaagaagcgaaagtatgagctcggaagacagccagctaacaccaagctgtcaagcaacaagacggttagaagggttagggttagaggtggtaatgtgaagtggcgtgctttgaggttggatactggaaattactcatggggtagtgaggctgtgaccaggaaaactcgtgtcttggatgtggtgtacaatgcatccaacaatgagttggttaggacacagactttggtgaagagtgccattgttcaagttgatgctgcaccattcaagcaatggtatctccaacattatggagttgacattgggcgcaagaagaagactgctgcttctgctaagaaggaaggagaggaaggtgaagccactgaagaaggaaagaagagcaaccatgtccagaggaagttggagaagcgccaagaaggccgcaccctagatgcacacattgaagagcaatttagcagtggacgtttgttggctgctatttcatcacgtcccggccaatgcggtcgtgctgatggatacatcttggagggcaaagagttggaattctacatgaagaagttacagaagaagaagggcaagtctgctggtgctgcttagccttatttagtcaagaatcaaacatttttagttttaactttcttttgagcttgttgtcttctttagcatggatcttggatctgcttttttgttttggtcaaactttgtagttcaaaagactttctcaagtttgcaatatgaatcgtaatcaa

SEQ ID NO: 6657 - DNA, 955 bp, Gossypium raimondii
ctgcctctcaaaccctagcttcagtctcttctgggatttgcttcaacagacccccccccccaaaaaaaaaacccttgaactttttccgcagtcaaaatgggtatctctcgtgattcgatgcacaagaggcgtgccactggaggtaaaaagaaggcttggaggaagaagagaaagtatgagcttggaaggcaaccagcaaacacaaagctttcaagcaacaagacagttaggaggattagggttcgtggtggaaatgtcaagtggcgtgctctgaggctcgacactggaaactactcgtggggaagtgaggccgtgactcgtaagaccagaattttggatgtggtgtacaatgcatccaacaatgagttggttcgtactcaaactctggttaagagtgctattgttcaagttgatgctgcaccattcaagcagtggtatctccagcactatggtgtcgacattggtcgcaagaaaaaaacagcagccaagaaagaaggagaggaaggtgaaactggcactgaggaggtgaagaagagcaaccatgtcttgaggaagctggagaaacgtcaacagaatcgcaagctagatccacatatcgaggatcaattcgcaagtggtcgtttgttggcttgtatctcttcaaggcctggtcagtgtggccgtgctgatgggtatatcttggaaggcaaagagctggaattctacatgaagaagatccagagaaagaaggggaagggagctgcctaaaaattttgttatgtgagcttttatatatcatgtcagaatctcctctctgctactttttatctttttacaggacattcaagattgtattagtttttgaactttttagtttgaatgtcaactagtgggttgttgtgtaatgttgaacaatataatatttgtgtttgaattttgatattcttgaactttataaatgcaggccttcctcttt

SEQ ID NO: 6658 - DNA, 945 bp, Malus domestica
gcccgccttcactcactcgtctcaaaccctagccgcgttgccgcagactctccaggagcagcagagccctagaacgccaaaatgggtatttctcgtgattccatgcacaagagacgtgccactggaggcaagaagaaggcttggaggaagaagcgaaagtacgagctcggaaggcaacctgctaacaccaagttgtcaagcaacaagacagtgaggaggatcagggttcgaggtgggaatgtcaagtggcgtgctctgaggctcgacactggaaacttctcctggggtagtgagaccgtgactcgcaaaacccgtcttcttgatgttgtgtacaatgcatctaacaatgagttggtccgtactcaaactttggtgaagagtgccattgttcaggttgatgctgcaccattcaagcagtggtatctccagcactatggagttgaaattggccgcaagaagaaaactgcggcagctgccaagaaagaagcagaggatggtgaagcacctgctgctgctcccgaggaggcaaagaagagcaaccatgtagccagaaagctggagaagcgtcaacagactcgcaccttggaccagcatattgaggaacaatttggcggtggtcgtctgttggcttgtatttcatcacgacctggtcagtgtggccgttgtgatggatatatcttggagggcagagagctggagttttacatgaagaagctccagaggaagaaggggaagggagctgctgcttaaatttttgttaccggaacttagccatcgtagactcagaatatgtcatctctattctcttttcctactttctaaagtatttcactttatttgagtttgaagttggaacttgctttactccaaacaatgtttttatggttgaattaatcagtaatcctattttggcaatcgtaaacgcaactatttggatgcctcgag

SEQ ID NO: 6659 - DNA, 1010 bp, Gossypium hirsutum
aaaataaaattcccattaaggcttgaactgttcttcagccaaaatgggtatttctcgtgattcaatgcacaagaggcgtgccactggtggcaaaaagaaggcttggaggaagaagagaaagtatgagcttggaaggcaacctgctaacacaaagctgtcaagcaacaagacagtcaggaggattagggttcgtggtgggaatgtgaagtggcgtgctctgaggctcgacaccggaaactactcatggggaagtgaggctgtgactcgtaagaccaggattttggatgtggtgtacaatgcatccaacaatgagctggttcgcactcaaactctggtgaagagtgctattgttcaagttgatgctgctccattcaagcagtggtatctccagcactatggcattgacattggtcgcaagaagaaatcagctgcagccaagaaagaaggagaggaaggtgaaactgctacagaggaggtgaagaaaagcaaccatgtattgaggaagctggagaagcgtcaacaaaatcgcacgcttgacccacatattgaggaacaatttggcagtggtcgactgttggcttgtatctcttcacggcctggtcaatgtggccgtgcagatggatacatcttggagggcaaagagctggagttctacatgaagaagatccagagaaagaaggggaagggagctgcttaaaaatttattgcatgagttttcagctttcatatcagaatgccgccctgagtttttgcctttcacatttccagaacatttaaaattgtgttagcattgaacttttaatctggatccctgagagttattatttttgtattggaatttagattatctttgaactttataaatgcaagcttattttggttggtaaagatgcagatcttctgcttttattttccagattatgattgttccaatgcgcagagtttagtgtgcatgttcaaatgttttcttttaagtgtttgtgaaaggtcagggtcatattttgttatct

SEQ ID NO: 6660 - DNA, 1120 bp, Gossypium raimondii
ttcataaaactagggttttctggtgtgtatatcccttccctgcttcaagtctccgcccgtcattcctgagcttccttcttgttgcttcacttttttttttttaaaataaaaataaaaaccccattaaggcttgaactcttcttcagccaaaatgggtatttctcgtgattcaatgcacaagaggcgtgccactggtggcaaaaagaaggcttggaggaagaagagaaagtatgagcttggaaggcaacctgctaacacaaagctgtcaagcaacaagacagtcaggaggattagggttcgtggtgggaatgtgaagtggcgtgctctgaggctcgacaccggaaactactcatggggaagtgaggctgtgactcgtaagaccaggattttggatgtggtgtacaatgcatccaacaatgagctggttcgcactcaaactctggtgaagagtgctattgttcaagttgatgctgctccattcaagcagtggtatctccagcactatggcattgacattggtcgcaagaagaaatcagctgcagccaagaaagaaggagaggaaggtgaaactgctactgaggaggtgaagaaaagcaaccatgtattgaggaagctggagaagcgtcaacaaaatcgcacgcttgacccacatattgaggaacaatttggcagtggtcgactgttggcttgtatctcttcacggcctggtcaatgtggccgtgcagatggatacatcttggagggcaaagagctggagttctacatgaagaagatccagagaaagaaggggaagggagctgcttaaaaaattattgcatgagttttcagctttcatatcagaatgccgccctgagtttttgcctttcacatttccagaacatttaaaattgtgttagcattgaacttttaatctggatccctgagagttattatttttgtattggaatttagattatctttgaactttataaatgcagcttattttggttggtaaagatgcagatcttctgcttttatttttccagattatgattgttccaatgcgcagagtttagtgtgcatgttcaaatgttttcttttaagtgtttgtgaaaggtcagggtcatattttgttatctaa

SEQ ID NO: 6661 - DNA, 1400 bp, Gossypium raimondii
caaaaactagggtttttgtgtattgcaaagcttcaaatctccgcctatggctgtactgcctctcaaaccctagcttcagtctcttctgggatttgcttcaacagaccccccccccaaaaaaaaacccttgaactttttccgcagtcaaaatgggtatctctcgtgattcgatgcacaagaggcgtgccactggaggtaaaaagaaggcttggaggaagaagagaaagtatgagcttggaaggcaaccagcaaacacaaagctttcaagcaacaagacagttaggaggattagggttcgtggtggaaatgtcaagtggcgtgctctgaggctcgacactggaaactactcgtggggaagtgaggccgtgactcgtaagaccagaattttggatgtggtgtacaatgcatccaacaatgagttggttcgtactcaaactctggttaagagtgctattgttcaagttgatgctgcaccattcaagcagtggtatctccagcactatggtgtcgacattggtcgcaagaaaaaaacagcagccaagaaagaaggagaggaaggtgaaactggcactgaggaggtgaagaagagcaaccatgtcttgaggaagctggagaaacgacaacagaatcgcaagctcgatccacatatcgaggatcaatttgcaagtggtcgtttgttggcttgtatctcttcaaggcctggtcagtgtggccgcgctgatgggtatatcttggaaggcaaagagctggaattctacatgaagaagatccagagaaagaaggggaagggagctgcctaaaaattttgttatgtgagcttttatatatcatgtcagaatctcctctctgctacttttatctttttacaggacattcaagattgtattagtttttgaactttttagtttgaatgtcaactagtgggttgttgtgtaatgttgaacaatataatatttgtgtttgaattttgatattcttgaactttataaatgcaggccttcatcttttctgattctttttttggggggtgggggttgtaatgaccaaagttggtagactttatgaggtagggagggactaggattactctgcctgcaactgaagctaaattttaaaatgatggctactattgatttgtaggctagtctttaatggcaacaatgcacatcaatattgtaagaagttcatgttggcttgtgagattgaaatgtgagaattgtttgctagaattgttcggcattgtactcacatctaattctcagaagaaagaatccgcaatgcacagcatgtgtccaagcaaacacaattatacttgaacactacaaaatcattcaattactaataaatactgtgtggggggtgtccattgttttgggccacaattaaaattttatgcctgt

SEQ ID NO: 6662 - DNA, 1071 bp, Cajanus cajan
aaccctaagagggtgaagccaccagccagagctcgcagcaagttctcttcttccaaaatgggtatctctcgtgattccatgcacaagaggcgcgccactggtggcaagaagaaagcttggagaaagaagagaaagtacgagcttgggaggcagccagcgaacacaaagctgtcaagcaacaagacggttaggaggattagggttcgtggtgggaatgtgaagtggcgtgctttgaggcttgacactggtaactactcttgggggagtgaggctgtgactcgcaagactaggatccttgatgtggtgtataatgcatccaacaatgagctggttcggactcaaactttggtcaagagtgctattgttcaggttgatgctgctcccttcaagcagtggtatctgcagcattatggtgttgatattggtcgcaagaagaagagtgctgctgcttctgccaagaaagaaggagaggatgctgaagctgcaactgaggaggtgaagaagagtaaccatgttttgagaaagttggaaaagcgtaaacagaaccgggtgcttgatcctcacattgaagaacaatttggaggtggtcgccttttggcttgtatctcatcccgacctggccaatgtggccgtgctgatggatatatattagagggcaaagagctagaattttacatgaagaagcttcagaggaagaagggcaagggtgctgcataagatattctctgtttgtactcgcacaatcagatgatcagttttgccaggagctctactttcttgggtagggagggttttatggttttagggttgtgtgggtttaaaaatagccaagaacttttaattgtttacttaatagtgagttctgtttaaattgattattaaactagcaactgcccttggaattattttcatttgtggttaaatttgtaaacttaattatgtgtccggcgagtttaaaatgagtttttcttttgatattctatcttcatctgcttgacgaattgaattttaaattgagacaaaatctctttatgtgctctaatgacaacagattggaaggtgttttgtaaa

SEQ ID NO: 6663 - DNA, 1081 bp, Populus trichocarpa
caatgatctagggttttatactataaatttaggcgcaaagcatcaatcccctcccagttgtctcaaaccctagcagctctcagcagagaaaccttagcatcttgcctctgcaaaaatggggatttctcgtgattctatgcacaagaggagggccaccggaggcaagaagaaagcttggagaaagaagagaaagtatgagctcggaaggcaacctgcaagcactaagctgtctagcaacaagacagtgaggaggattagggttcgaggaggaaatgtgaagtggcgtgctttaagacttgatactggaaactactcatggggtagtgaggctgtgacccgaaagaccaggattcttgatgtggtgtacaatgcatccaacaatgagttggttcgtactcagactttggtgaagagtgccatcgttcaggttgatgctgcacctttcaagcagtggtatctccagcactatggtgtggacattggtcgcaagaagaaaaccacagcagctgccaagaaggaaggagaggaaggtgaagctgctgctactgaggaggtgaagcagagcaatcatgtccagaggaagctggagaagagacaacagattcgcaagcttgaccctcatattgaagagcaatttggcagtggtcgtttgctagcttctatttcatcacgtcctggtcagtgtgggcgagctgatggatatatcttggagggcaaagaactggagttttacatgaagaaaatacaaaggaagaagggcaagggagctgcctagagttttgttatttgaattttcttttcagatcaggcgtctattttcaccttattttgcttgaagttggacgtgtaacttttgatgagataagaaatttaacttgaaggtagacctgtcatttgaattttgagtagaatattcaggtggttctggtttaatttggcgtttttcacctcgcattaaagataaatctcttgtttttgtgttgagttggatgatgaaggtttcttagccgaatcctatttctgacctggtgactagtcgttatgagcttgcatgagattgatcggtatgataagaatgcat

SEQ ID NO: 6664 - DNA, 1023 bp, Silene vulgaris
ttgcaattgcagcataataatcatactgtaaccctaatttctcctccatcatcccaaaatgggtatttctcgtgattctatgcacaagaggcgtgaaactggtggaaagaagaaggcatggagaaagaagcgaaagtatgagttgggaaggcagcctgccaacacaaagctgtcaagcaacaaaactgttcgtagagttagggttcgtggtggtaatgtgaaatggcgtgcattgaggttggatactggtaactactcatggggtagtgaggctgtcacccgcaaaacccgtattttagatgtggtgtacaatgcatcaaacaatgagcttgtcaggacacagacccttgtgaagagtgccatcgttcaggttgatgccgcaccattcaaacagtggtatctacaacactatggtgttgaagttgggcgtaagaagaaatctgctgctgctcctaagaaggaaggcgaggatggtgagactgccgaagagaccaagaaaagcaaccatgtgactaggaagttggagaagcgtcaagagggtcgtgaattggatgctcacattgaagaacaatttggtggtggtcgtttgttggcatgcatttcctctcgtcccggtcaatgtggccgctgtgatggatacattttggagggcaaagagctggaattctacatgaagaagatccagaagaagaagggcaaatcagcagcttaagcagcgatgactgtagaatcataaacactcaggtgttttatttggttttctacctacaattactcttttaattttgttcggacctcttttttagtttgagatgtgtcatcttagtcaaaacattttgtaagctgtgagttggtacttggtatttcttatatttttgtcccaagggttaccgtttcaccagaagtttttgcatggtctcgagtgtttctgttttcctacatctacctttttttttccctaccttagtacacctcggattttaaaacatcagagattcagaggtacccttttccctaacttta

SEQ ID NO: 6665 - DNA, 876 bp, Ambrosia trifida
ttaggaggagcggcgcgtaactaacatccatctgcaaccatgggtattagtcgtgacagtatgcataagaggcgagccactggtggcaagaagaaggcctggagaaagaagcgaaagtatgagcttggaaggcagccagccaacaccaagatctccagcaacaagactgttaggagggttagggttcgtggtggtaatgtcaagtggcgtgccttgaggttggataccggtaactactcatggggaagtgaggctgtcacgcgtaagacccgtatattggatgtggtctacaatgcatcgaacaatgagttggtcagaactcagacgcttgtgaagagcgcaatcgttcaggtggacgctgcacccttcaagcaatggtatcttcaacactacggtgtcgaaattggccgcaagaagaaagcagctgcttccgcagccaaaaagagggagaggaaggagaaggtgcaaccgaagaggccaaaaagagtaatcatgttgtgaggaaacttgaaaagcgtcaagaggaccgcaaactggattctcatgttgaagaacaattttccagtggtcgtcttctagctgccatctcatcgcgccctggccagtgtggtcgtgctgacggatacatattggaaggaaaagagcttgaattctacatgaaaaagcttcagaagaagaaagggaagggtgctgcagcttaaaacagtctttctttataatagatttgtattttttttttccatttatatttgaggaatgacatgactcaggagttttgttgacttttgttagataggtttgactttttgatatgttgactttataatggtttcttattgtgctgtgttattgtgttgtttgttagataaaaaaaga

SEQ ID NO: 6666 - DNA, 986 bp, Fagus grandifolia
tttcgcagccctctctttctctgcagagattttgtgacttctgggacagagaatcctagaacccccagtcagacaaaatgggtatttctcgtgattccatgcacaagagacgtgccactggaggaaagaagaaggcttggaggaagaagcgcaagtatgagctcggaaggcaacctgcaaacacaaagctgtcaagcaacaagacagttaggagagttagggttcgaggtggaaacgtgaagtggcgtgcactgaggctcgacactggaaactactcatgggggagtgaggctgtgacccggaagacacgtattcttgatgtggtctacaatgcatccaacaatgagctggttcgtacccagacattggtgaagagtgctattgttcaggttgatgctgcaccattcaagcagtgtatctccagcactatggagttgatattggtcgcaagaagaagacttcagctgccaccaagaaagaaggggaggaaggtgatgctgctgctcctgctgctgctgctgccactgaggacgtgaagaagagcaaccatgtccagagaaagctggagaagcgtcaacagaatcgccagcttgatgcacatattgaagagcaatttagtggtggtcgtttgttagcttgtatctcatcacgacctggccagtgtggccgtgctgatggatatatcctggaaggcaaagagcttgagttctacatgaagaagctccagaggaagaagggcaagggagccacagcctaaaattttgttccctgaacttcatcattcacatcagaattcttttttgtttcactttatttcttctcccttagacattgaacttaagctgagatgcaccgttttaccagaagctttttcttgtgttaagtttgacttcttaattggaatttttttagttttcctttcgtgatatgaatgtattgttattattactgttctgattaatacttagtactcctactattacctt

SEQ ID NO: 6667 - DNA, 1029 bp, Castanea mollissima
ccatctttctcggcagagagattgtgacttctaggacagagaaaccctagaatccccactcagcaaaaatgggtatctctcgtgattccatgcacaagaggcgtgccactggaggaaagaagaaggcttggaggaagaagcgaaagtacgagcttggaaggcaacctgcaaacacaaagctgtcaagcaacaagacagttagaagaattagggttcgaggaggaaacgtgaagtggcgtgctctgagacttgatactggtaacttctcagtgggggagtgaggctgtgacccggaagacacgtcttcttgatgtggtctacaatgcatcaaacaatgagttggttcgtactcagactttggtgaagagtgccattgttcaggttgatgctgcaccattcaagcagtggtatctccagcactatggagttgaaattggtcgcaagaagaaaactacagcttccaccaagaaagaaggggaggagggtgaagctgctgctgccactgccaccacagaggaggtgaagaagagcaaccatgtgcagagaaagctggagaagcgtcagcagaatcgcaagcttgactcacatattgaagagcaatttggtggtggacgtttgttagcttgtatctcatcacgacctggtcagtgtggccgtgctgatggatatattctagaaggcaaagagcttgagttctacatgaagaagatccagaggaagaagggcaaggctggtgcagcttaaattttgttacttgaactacatccttcatagcagaatgtcttttttgtttactttattttatttctcccctagacattgaacttaagttgagatgctctattttgccagaaagccttttgcttgtgttaagtttgacttaattgggatattattagttttccttctgtgatatgaacgtgttaaaaacttaaaactattactgttgtgattaatacttcaaccacctttaaatggatgtcccagattgtgttttctgggagcttttcatctgaagttggattggaa

SEQ ID NO: 6668 - DNA, 939 bp, Gossypium hirsutum
gcctctcaaaccctagcttcagtctcttctggattgctcaacagaccccccaaaaaaaccttgaacttttccgcagtcaaaatgggtatctctcgtgattcgatgcacaagaggcgtgccactggaggtaaaaagaaggcttggaggaagaagagaaagtatgagcttggaaggcaaccagcaaacacaaagctatcaagcaacaagacagttaggaggattagggttcgtggtggaaatgtcaagtggcgtgctctgaggctcgacactggaaactactcgtggggaagtgaggccgtgactcgtaagaccagaattttggatgtggtgtacaatgcatccaacaatgagttggttcgtactcaaactctggttaagagtgctattgttcaagttgatgctgcaccattcaagcagtgggtatctccagcactatggtgtcgacattggtcgcaagaagaaaacagcagccaagaaagaaggagaggaaggtgaaactggcactgaggaggtgaagaagagcaaccatgtcttgaggaagctggagaaacgacaacagaatcgcaagctcgatccacatatcgaggatcaatttgcaagtggtcgtttgttggcttgtatctcttcaaggcctggtcagtgtggccgcgctgatgggtatatcttggaaggcaaagagctggaattctacatgaagaagatccagagaaagaaggggaagggagctgcctaaaaattttgttatgtgagcttttaacatatcatgtcagaatctcctctctgctacttttatctttttacaggacattcaagattgtattagtttttgaactttttagtttgaatgtcaactagtgggttgttgtgtaatgttgaacaatataatatttgtgtttgaattttgatattcttgaactttataaatgcaggccttcatct

SEQ ID NO: 6669 - DNA, 696 bp, Valeriana officinalis
ccatgggtatttctcgtgattctatgcacaagaggagagccactggtggcaagaagaaggcatggaggaagaagcgaaagtatgagctcggacgtcagccagcaaacacgaagctgagcagcaacaagacagtgaggagagttagagtgaggggaggaaacgtgaaatggagagcactccgattagatactggaaatttctcatggggaagtgaggctgttactcgcaagacgcgtcttcttgatgtcgtctacaatgcgtccaacaatgagcttgttcgtactcaaaccctagtcaagagcgccattgttcaagttgatgctgcacccttcaaacagtggtatcttacccactacggtgttgaaattggaaggaagaaaaaatctgccgctcctgccaagaaagaaaccgccgaggagggagaagctgctgctgctgctgctgcagaggaagctaagaagagtaaccatgtagccaggaaaatcgagaagcgtcaggctgaacgtaaacttgattctcacatcgaagaacagtttggcggtggtagacttttggcttgtatctcttctcgacccggtcaatgcggtcgtgctgatggatacattcttgaggggaaagagctcgagttttacatgaagaaactccaaaagaagaagggcaagggtgctgctgcttaagttcttcatctttatttat

SEQ ID NO: 6670 - DNA, 794 bp, Ambrosia trifida
gcgtaactaagatccatctgcaaccatgggtattagtcgtgacagtatgcataagaggcgtgccactggtggtaagaagaaggcctggagaaagaagcgaaagtatgagcttggaaggcagccagccaacaccaagatctccagcaacaagactgttaggagggttagggttcgtggtggtaacgtcaagtggcgtgctttgaggttggataccggtaactactcatggggaagtgaggctgtcacgcgtaagacccgtatattggatgtggtctacaatgcatcgaacaatgagttggtcagaactcagacacttgtgaagagcgcaatcgttcaggtggacgctgcacccttcaagcaatggtatcttcaacactacggtgttgatattggccgcaagaagaaagcagctgcttccgcggccaaaaaagagggagaggaaggagaaggtgcaaccgaagaggccaaaaagagtaatcatgttgtgaggaaacttgaaaagcgtcaagaggaccgcaaactggattctcatgttgaagaacaattttccagtggtcgtcttctagctgccatctcatcgcgccctggccagtgtggtcgcgctgacggatacatattggaagggaaagagcttgaattctacatgaaaaagctccagaagaagaaagggaagggtgctgcagcttaaaacagtctttctttataatagatttgtatttttttctatttatatttgatgaatgacatgactcaggagttttgttgacttttgttagataggtttgacttttgtt

SEQ ID NO: 6671 - DNA, 947 bp, Amsonia hubrichtii
gagaccgccgtctcgtctactgcagccgtagcagcagcaccgccaccaccgttgcaaccatgggtatttctcgagattccatgcacaagagacgtgccactggtggcaagaagaaggcctggaggaagaagagaaagtatgagcttggccgtcagcctgctaataccaaactctctagcaacaagactgtaaggagaatccgtgttagaggaggcaatgttaagtggagggctcttcgattggatactggaaattactcttggggaagtgaagctgttacccgcaaaactcgtattcttgatgtggtctacaatgcctcaaacaatgagcttgtgagaactcaaacactggtgaagagtgccatagttcaggtggatgctgccccattcaagcaatggtaccttcagcactatggtgttgatattgggaggaagaagaaagcagcagctgctgctaagaaggaaggagaggaggatgaaggtgctgcagctgcagaggacaccaagaagagcaatcatgttcaaaggaagcttgagaaacgccaaaaagaccgtaagcttgacccacacattgaggagcagtttggctctggtaggttgatggcttgcatttcatctcgaccaggtcaatgtggcagggctgatggatatatcttggaaggaaaggaacttgaattttatatgaagaagatacaaaggaagaagggcaagagtggtgctgcctagacaccaatggacttgagctctcacctgagtcagatgcattagttcatatgtttcttgctttatgttctagtatcaatccatcgtcatgtaacaaatacaaaacttgaaaattttgctttctgttctagaagttagactatttcagcggcctttatgtttgatcttagttttgcttgaaatatgatatattttgtttcacatctaatctcataaacaatgttt

SEQ ID NO: 6672 - DNA, 932 bp, Cynodon dactylon
accgaagcagcggcggcgcaggcggaccaggaggaggcggagcagcagcgcagccgagccaccgccgccaccatgggtatctcgcgtgactcgatgcacaagcgccgggccaccggtggcaagcagaaggcgtggaggaagaagcgaaagtatgagcttggtccccagcctgctaacaccaaactgtcaagcaacaagacagtcaggagggtccgagtccgtggaggtaatgtgaagtggagggctctccgtttggatactggtaactactcatggggaagtgaggctgttacccgcaagacccgtatcctcgatgtggtctacaatgcatcaaacaatgagcttgtcaggactcagacccttgtgaagagtgccattgtgcaagttgatgctgccccattcaaacagtggtacctcactcactatggtgtggaaatcggtaggaagaagaaggcccctgctgccaagaaggatgtggcagagggacaagaggctgaggctgctgctgaggaaacaaagaagagcaaccatgtccagaggaaacttgagaagcgtcaggagggacgcacacttgacccacacattgaggagcaatttggcagtggaaggctgttggcgtgcatttcttctcgccctggacagtgtggcagagctgatgggtacatcctcgagggtaaagagcttgagttctacatgaagaagctccagaagaagaagggcaagggtgctgcagcttagagcattcttgtgggtgttctacagttaaagggtggcctcacctatttatcttctactgggtttttgttagtcgtctcaagtgcatctgtcatattttcagacctacagaacaccactttctaaaaatggattagcctggaagaactgagaattttcacctgtattgtcgtgatatgtaggttacatgtttactt

SEQ ID NO: 6673 - DNA, 902 bp, Cynodon dactylon
caccaccacaccgcagtaccaggagaggtagggagccgccgccgccgccgccgccaccatgggtatctcacgtgactcgatgcacaagcgccgcgccaccggtggcaagcagaaggcgtggaggaagaagcgaaagtatgagcttggccgtcagccagccaataccaagctctccagcaacaagacggtgaggagggtgcgtgtccgtggtggtaatgtgaagtggagggctctccgcttggatactggaaactactcatggggaagtgaggccgtgacccgcaagacccgtatcctcgatgtggtctacaatgcatccaacaatgagcttgtgaggactcagacccttgtcaagagcgccattgtgcaagttgatgctgcccccttcaagcagtggtacctcacccactacggcgtcgacatcggtaggaagaagaaaacccctgctgccaagaaggagggtgctgagggacaggagggtgaagctgctgctgaggaaactaagaaaagcaaccatgtccagaggaagcttgagaagcgccaggagggacgcacacttgacccccatattgaagagcaatttggcagtggaaggctgttggcttgcatttcttctcgccctgggcagtgtggacgtgctgatggctatatcctcgagggtaaagagctggagttctacatgaaaaagctccagaagaagaagggcaagggtgctgccgcttaaacgcatgtaatctgctggttgagccaggacaactgcccttgtgttacctgggtactgttagtttttgtcgaggaattttatgttatgtattgcagacatggttttttggtcctggaaaagaacttgagggtgtttcagtgccctggatcgtagattaatatatgtacttctgccgact

SEQ ID NO: 6674 - DNA, 1017 bp, Fragaria vesca
ccctcgaacaaaccctagccgctttgccgcagcagagaaacctctccttctgccaaaatgggtatctctcgagattctatgcacaagagacgtgccactggaggcaagaagaaggcctggaggaagaagcgaaagtacgagctcggaaggcagccagccaacacaaaactgtccagcaacaagacagtgaggaggatcagggttcgaggtggaaatgtgaagtggcgtgctttgaggcttgacacaggaaatttctcttggggtagtgaggctgtgaccaggaagacccgtcttcttgatgttgtttacaatgcatctaacaatgagcttgtgcgtactcaaaccttggtgaagagtgccattgttcaggttgatgcagcacctttcaagcagtggtattccacccactatggtgttgaaattggccgcaagaagaaaaccgctgctgctatcaagaaagaagcagaggatggtgaggctgctacggctgctgctgcagctgctgaggaggttaagaagagcaagcatgtagaaaggaagttggagaagcgccagcagactcgcgtgcttgaccaccacattgaggaacaatttggtggcggtcgtctattggcttgcatctcttcacgacctggtcaatgcggccgtgcagatggatacatcttggagggcaaagagctagagttttacatgaagaagctccagaggaagaagggaaagggagcaactgcctagaattttgctatttgaacttggtcattttagactcagaatatgacgtttccttcctcctttcttactttctaatggattgcacttatttcagttgaagttaaaaacgatccgtctatggttgaatgtttaatgaggagttatattcatacgtttgtttttggccgatctcttttgagtatgaaaacttgggacgttttgttgaactgtgtttttctttgaaaattacctcggcgaggtggaacaggaagtaattcctacatttgataagaaaagaacatgtat

SEQ ID NO: 6675 - DNA, 1041 bp, Fragaria vesca
gcgtcgaacagaaaccctagccgcgttgccgcagcagagaaacctttggaaactctccctctgccaaaatgggtatctctcgagattccatgcacaagagacgtgccactggaggcaagaagaaggcctggaggaagaagagaaagtacgagctcggaaggcagccagccaacactaaactgtccagcaacaagacagtgaggaggattagggttcgaggtggaaatgtgaagtggcgtgctttgaggcttgacacaggaaatttctcttggggtagtgaggctgtgaccaggaagacccgtcttcttgatgttgtttacaatgcatctaacaatgagcttgtgcgtactcaaaccttggtgaagagtgccattgttcaggttgatgcagcacctttcaagcagtggtattccacccactatggtgttgaaattggccgcaagaagaaaaccgctgctgctatcaagaaagaagctgaggatggtgaggccgctaccgctgctgctgcagctgctgaggaggttaagaagagcaagcatgtagaaaggaagttggagaagcgccagcagactcgcgtgcttgaccaccacattgaggaacaatttggtggcggtcgtctattggcttgcatctcttcacgacctggtcaatgcggccgtgcagatggatacatcttggagggcaaagagctagagttttacatgaagaagctccagaggaagaagggaaagggagcaactgcctagaattttgctatttgaacttggtcattttagactcagaatatgacgtttccttcctccttactttctaatggattgcacttatttcagttgaagttaaaaacgatccgtctatggttgaatgtttaatgagttatattcatatgtttgtttttggccgatctcttttgagtatgaaaacttgggaagttttgttgaactgtgtttttctttgaaaattacctcggcgaggtggaacaggaagtaattccgacatttgataagaaaagaacttgtatggttaaaatttggatagaaa

SEQ ID NO: 6676 - DNA, 958 bp, Gossypium raimondii
gtcattcctgagcttccttcttgttgcttcactttttctttttttttaaataaaaataaaaaccccattaaggcttgaactcttcttcagccaaaatgggtatttctcgtgattcaatgcacaagaggcgtgccactggtggcaaaaagaaggcttggaggaagaagagaaagtatgagcttggaaggcaacctgctaacacaaagctgtcaagcaacaagacagtcaggaggattagggttcgtggtgggaatgtgaagtggcgtgctttgaggctcgacaccggaaactactcatggggaagtgaggctgtgactcgtaagaccaggattttggatgtggtgtacaatgcatccaacaatgagctggttcgcactcaaactctggtgaagagtgctattgttcaagttgatgctgctccattcaagcagtggtatctccagcactatggcattgacattggtcgcaagaagaaatcagctgcagccaagaaagaaggagaggaaggtgaaactgctactgaggaggtgaagaaaagcaaccatgtattgaggaagctggagaagcgtcaacaaaatcgcgcgcttgacccacatattgaggaacaatttggcagtggtcgtctgttggcttgtatctcttcacggcctggtcaatgtggccgtgcagatggttacatcttggagggcaaagagctggagttctacatgaagaagatccagagaaagaaggggaagggagctgcttaaaaaattattgcatgagttttcagcattcatatcagaatgccgcccttaggttttgcctttcacatttccagaacatttaaagttgtgttagcattgaacttttaatctggatccctgagagttattatttttgtattggaatttagattatctttgaactttataaatgcagcttattttggttggtaaagatgcagatcttctgcttt

SEQ ID NO: 6677 - DNA, 890 bp, Antirrhinum majus
gagcggcacgattcggcacgagagcatccgctaaccgcaatcatgggtatctcacgagattcgatgcacaagaggcgtgccactggaggcaagaagaaggcttggaggaagaagcgaaagtacgagctcggaagacagcctgctaacaccaagttgtcaagcaacaagaccgtgcgaagggtgagagttcgtggaggtaatgtgaagtggcgtgctttgaggttggatacaggaaattactcatggggaagtgaagctgtgacccgaaagacccgcattcttgatgttgtttacaatgcatcaaacaacgagttggttaggacccagactttggtgaagggtgctattgttcaagttgatgctgcacctttcaagcagtggtattctcagcattatggagttgaaattggtcgcaagaagaagactgctgccaagaaggaaggagaggaagctgaagctgctccagctgaggaggtgaagaagagcaaccacgttcaaagaaaaattgaaaagcgccaagagggccgcaagattgatgcacatatcgaggagcaatttggtggtggccgtttgttagcttctatctcctcccgccctggccagtgtggtcgtgctgatgggtatattctggagggtaaggagttggagttctacatgaagaagcttcagaggaagaaaggaaagggcgcggcttaattttgtatcaggctcatcaaaattttccaaacttgaactatcttatttttctttgttgttccgttcgaggaatgtcctagacatattttggttcagtattttgtcataatattaatctgtaaggagaattttgaatagttttggatgattgctgtgctgtggtcttagaatgctaaatttgctacagttactac

SEQ ID NO: 6678 - DNA, 1069 bp, Theobroma cacao
aatttaccctaacataaacccgcccaattggacataaaagtaatttcacaaactagggtttttgggtgtataaccaagcttcaaatctccgcctatcacttcctctcaaaccctagcttccttctgctctgagatttgcttcaacccaaaagccccgaaaaggcttaagctttttccctcagccaaaatgggtatttctcgtgattcaatgcacaagaggcgtgccaccggtggcaagaagaaagcatggaggaagaagagaaagtatgagcttggaaggcaacctgcaagcacaaagttgtcaagcaacaagacagtcaggaggattagggttcgtggtggaaatgtgaagtggcgtgctctgaggctcgacactggaaactactcatgggggagtgaggctgtgacccgtaagaccagaattttggatgtggtgtacaatgcatccaacaatgagctggtccgtactcaaactttggtgaagagtgctattgttcaagttgatgctgctccattcaagcagtggtatctccagcactatggtgttgacattggtcgcaagaagaaaacagcagcggcagcagccaagaaagaaggaggagaggatggtgaaattgctactgaggaggtgaagaagagtggccatgtcttgaggaagctggaaaagcgtcagctgaatcgcaagcttgactcacatattgaggagcaatttggtagtggtcgtttgttggcttgtatctcttcacggcctggtcagtgtggacgtgctgatgggtatatcttggaaggcaaagagctggagttctacatgaagaagatccagagaaagaaggggaagggagctgcctaaaaattttgttactcgagatttcatctttcagatcagaatttccttttttgcctttctttcaccttttcagttgtttgacatttaagattgtgttagtattgaacatttagtttgaatgtcgactagtcggttgtgccctattcaacagtattattatataacttcggttgcatgttatttttgtacttgaagtttataaatgcagcttattttgattga

SEQ ID NO: 6679 - DNA, 964 bp, Theobroma cacao
ctctcaaaccctagcttccttctgctctgagatttgcttcaacccaaaagccccgaaaaggcttaagctttttccctcagccaaaatgggtatttctcgtgattcaatgcacaagaggcgtgccaccggtggcaagaagaaagcatggaggaagaagagaaagtatgagcttggaaggcaacctgcaagcacaaagttgtcaagcaacaagacagtcaggaggattagggttcgtggtggaaatgtgaagtggcgtgctctgaggctcgacactggaaactactcatgggggagtgaggctgtgacccgtaagaccagaattttggatgtggtgtacaatgcatccaacaatgagctggtccgtactcaaactttggtgaagagtgctattgttcaagttgatgctgctccattcaagcagtggtatctccagcactatggtgttgacattggtcgcaagaagaaaacagcagcggcagcagccaagaaagaaggaggagaggatggtgaaattgctactgaggaggtgaagaagagtggccatgtcttgaggaagctggaaaagcgtcagctgaatcgcaagcttgactcacatattgaggagcaatttggtagtggtcgtttgttggcttgtatctcttcacggcctggtcagtgtggacgtgctgatgggtatatcttggaaggcaaagagctggagttctacatgaagaagatccagagaaagaaggggaagggagctgcctaaaaattttgttactcgagatttcatctttcagatcagaatttccttttttgcctttctttcaccttttcagttgtttgacatttaagattgtgttagtattgaacatttagtttgaatgtcgactagtcggttgtgccctattcaacagtattattatataacttcggttgcatgttatttttgtacttgaagtttataaatgcagcttattttgat

SEQ ID NO: 6680 - DNA, 957 bp, Gossypium hirsutum
tcgttacaagtatatatttcttttcatttggtagttgttataataaaaataaaaaccccattaaggcttgaactcttcttcagccaaaatgggtatttctcgtgattcaatgcacaagaggcgtgccactggtggcaaaaagaaggcttggaggaagaagagaaagtatgagcttggaaggcaacctgctaacacaaagctgtcaagcaacaagacagtcaggaggattagggttcgtggtgggaatgtgaagtggcgtgctttgaggctcgacaccggaaactactcatggggaagtgaggctgtgactcgtaagaccaggattttggatgtggtgtacaatgcatccaacaatgagctggttcgcactcaaactctggtgaagagtgctattgttcaagttgatgctgctccattcaagcagtggtatctccagcactatggcattgacattggtcgcaagaagaaatcagctgcagccaagaaagaaggagaggaaggtgaaactgctactgaggaggtgaagaaaagcaaccatgtattgaggaagctggagaagcgtcaacaaaatcgcgctcttgacccacatattgaggaacaatttggcagtggtcgtctgttggcttgtatctcttcacggcctggtcaatgtggccgtgcagatggttacatcttggagggcaaagagctggagttctacatgaagaagatccagagaaagaaggggaagggagctgcttaaaaaattattgcatagttttcagcattcatatcagaatgccgcccttagggtttgcctttcacatttccagaacatttaaagttgtgttagcattgaacttttaatctggatccctgagagttattatttttgtattggaatttagattatctttgaactttataaatgcagcttattttggttggtaaagatgcagatcttctgcttttattttc

SEQ ID NO: 6681 - DNA, 860 bp, Gossypium hirsutum
cagtcaaaatgggtatttctcgtgattcgatgcacaagaggcgtgccactggaggtaaaaagaaggcttggaggaagaagagaaagtatgagcttggaaggcaaccagcaaacacaaagctttcaagcaacaagacagttagaaggattagggttcgtggtggaaatgtcaagtggcgtgctctcaggctcgacactggaaactactcgtggggaagtgaggctatgactcgtaagacccgaattttggatgtggtgtacaatgcatccaacaatgagttggttcgtactcaaactctggttaagagtgctattgttcaagttgatgctgcaccattcaagcaatggtatctccagcactatggtgtcgacattggtcgcaagaaaaaaacagcagccaagaaagaaggagaggaaggtgaaactggcactgaggaggtgaagaagagcaaccatgtcttgaggaagatggagaaacgtcaacagaatcgcaagctagatccacatatcgaggatcaattcgcaagtggtcgtttgttggcttgtatctcttcaaggcctggtcagtgtggccgtgctgatgggtatatcttggaaggcaaagagctggaattctacatgaagaagatccagagaaagaaggggaagggagctgcctaaaaattttgttatgtgagcttttatatatcatgatagaatctcctctttgctactttttatctttttacaggacattcaagattgtattagtttttgaactttttagtttgaatgtcaactagtgggttgttgtgtaatgttgaacaatataatatttgtgtttgaattttgatattcttgaactttataaatgcaggcctt

SEQ ID NO: 6682 - DNA, 906 bp, Silene vulgaris
gagtgagtgagagagagggaggaatcttctctgcaatttgcgaaaatgggtatttctcgtgattccatgcacaagaggcgtgccactggtggcaagaagaaggcttggaggaagaagagaaagtacgagttaggaaggcagcctgctaacacaaagttgtcaagcaacaagactgttagaagagtccgagttcgtggtggtaatgtgaagtggcgtgcgttgaggttggataccggtaactactcatggggtagcgaggccgtgacccgcaagacccgtatcttggatgtggtctacaatgcatcaaacaatgagttggtgaggacacagactttggtgaagagtgccattgttcaggttgatgctgcaccgtttaagcagtggtatctacaacactacggagttgaaattggccgcaagaagaaggctgccgctgctgctgccaagaaggaaggagaggatggtgaggctactgaggagactaagaaaagcaaccatgtaactagaaagctcgagaaacgccagcaggatcgtgaacttgacgctcacattgaagaacaatttggtggaggtcgtttgttggcttgcatttcttcacgacctggtcaatgtggccgttgtgatggatacattctggagggcaaggagctcgaattctacatgaagaagatccagaggaagaagggcaaatcagctgcttaaaattacctctgtagcattatagtcaccctgatgtttttttatctttggtttttgatcaacaaatggctctttattagcatatcgttggacctgtttttagttggactcgaaaccattttgtaatctgtcagtcaagtttaaatatttttgatctcatgaggttgaactgaagttctctactgattgttttttatatgggttact

SEQ ID NO: 6683 - DNA, 1062 bp, Citrus clementina
ctcagcgtctctcagccactctctctttctctgcctcaaacgctgaatcacctatcaatcgcccagacagagaaaccctaagaatttctctctgcgaaaatgggtatttcccgtgattccatgcacaagaggcgtgctactgggggcaagaagaaggcttggaggaagaagagaaagtatgagcttggaaggcaacctgcaaatactaagctatcaagcaacaagacagtgaggaggattagggttcgtggaggtaatgtgaaatggcgtgctttgaggcttgacacaggaaactactcctggggaagtgaagcagtgactcgtaagaccagaattctggatgtggtatacaatgcctccaataatgagctggtccgtactcaaactttggtgaagagtgccattgttcaggttgatgcagcaccattcaagcagtggtatctccagcattatggtgttgacattggtcgcaagaagaaggctgcagctgctgccacaaccaagaaagaaggagaggaaggagaggctcccgccactgaggaggcaaagaagagcaaccatgtctcaagaaagcttgagaagcgtcaaaaagatcgcacacttgacccacatattgaggagcagtttggtagtggtcgtttgttagcttgtatcgcatcacggcctggccagtgtggacgtgctgatggatacatcttggagggtaaagaactggaattctacatgaagaagttacagaggaagaagggcaagagtgctggtgctgcttaaatttttgtttattgaaactccgtactggaatttctagttttgtcttgtgttcttgtttttagtcttaagttaaaacttcgagagtcgagatgatatcagcagtcgaacttgtatttctcacttgtgttattgttatattttgtttttgaatattaccagtgcctgtgttagaatttcttccgctctacatttttcttgattctgtctgcgccatcagcgaattggtagttaatgccttcgtggttattgttgctcaaggttgatgtattaattccataccgaacatgaacc

SEQ ID NO: 6684 - DNA, 833 bp, Fagopyrum esculentum
agcaaccatgggtatttctcgtgattctatgcacaagaggcgtgccactggaggcaagaagaagtcatggaggaagaagcgaaagtatgagctcggaagacagccagctaacaccaagctgtctagcaacaagacggttagaagggttagggttagaggtggtaatgtgaagtggcgtgctttgagattggatactggaaactactcatggggtagtgaggctgtgaccaggaaaactcgtgtcttggatgtggtgtacaatgcatccaacaatgagttggttaggacacagactttggtgaagagcgccattgttcaagttgatgctgcgccattcaagcaatggtatctccaacattatggagttgacattgggcgcaagaagaagactgccacttctgccaagaaggaaggagaggaaggtgaagccaccgaagaagcaaagaagagcaaacatgtccagaggaagttggagaagcgccaagaaggccgtaccctagatgcacacattgaagagcaatttagcagtggacgattgttggctgctatttcatcacgtcccggccagtgcggtcgtgctgatggatacatcttggagggcaaagagttggaattctacatgaagaagttgcagaagaagaagggcaagtctgctggtgccgcttaaaacccttatttactcaagatccaaagatttttagttttgactttcttttgagcttgttgtcttatttagccatggatcttggatttgcttttttgtgttggtcagttcaaaagaatttgtcaagtttgcaagatagtcgtaatcaacccaagttttgttgaactct

SEQ ID NO: 6685 - DNA, 689 bp, Fagopyrum esculentum
gaacacaagcgcaagagcaaccatgggtatttctcgtgattctatgcacaagaggcgtgccactggaggcaagaagaaggcatggaggaagaagcgaaagtatgagctcggaagacagccagccaacaccaagctgtcaagcaacaagacggttagaagggttagggttagaggtggtaatgtgaagtggcgtgctttgagattggatactggaaactactcatggggtagtgaggctgtgaccaggaaaactcgtatcttggatgtggtgtacaatgcatccaacaatgagttggttaggactcagactttggtgaagagcgccattgttcaagttgatgctgcaccattcaagcaatggtatctccaacattacggagttgacattgggcgcaagaagaagactgccacttctgctaagaaggaaggagaggacggtgaagccaccgaagaagcaaagaagagcaaccatgtccagaggaagttggagaagcgccaagaaggccgctccctagatgcacacattgaagagcagtttagcagtggacgtttgttggctgctatttcatcacgtcccggccagtgtggtcgcgctgatggatacattttggagggcaaagagttggaattctacatgaagaagttgcagaagaagaagggcaagtctgctggtgctgcttaaaagcctt

SEQ ID NO: 6686 - DNA, 1039 bp, Eragrostis curvula
gggaaaggggcggcgccgcgcagccacccacagccgcagcaggaggggaggaggtcgccaccatgggtatctcacgtgattcgatgcacaagcggcgcgccaccggtggcaagcagaaggcgtggaggaagaagcgaaagtatgagcttggccgtcagcctgctaacaccaagctctccagcaacaagacagtaaggagggtgcgtgttcgcggaggcaatgtgaagtggagggccctccgtttggatactggcaactactcatggggtagtgaggcggtgacccgcaagacgcgtctccttgatgtggtgtacaatgcgtccaacaatgagcttgtgaggactcagacccttgtgaagagtgtcatcgtgcaagttgatgctgcccccttcaagcagtggtacctcacccactacggtgtggatatcggcaggaagaagaaggcccctgctgccaagaaggagggtgctgaggagggtgaagctgccgccgaggaaacaaagaaaagcaaccatgtccagaggaagcttgagaagcgccaacagggtcgcacacttgacccccatattgaagaacaatttggcagtggaaggctcttggcctgcatttcatctcgccctgggcagtgtggccgtgctgatggctatatcctcgagggtaaagagctggagttctacatgaagaagctccagaggaagaagggcaagggtgctgcggcttagagtgcatgtaaacctgcagttggttctgagccaggattaccctatgtttacctgaagtactgttagtttttgtcgagggattctatgtcatgtttggagacattttttttttctttttggtcccagtaatgaattctagcaaaaggacttgggaatgtttcagtgtcatggacacctttttcctcgaaaaaaaaaaaaaaaaaaaaaaaaaaagataccgggttaaaacccggggtaacaaattcccggggccgccgggggccggggaaaagggaggcggggccaattcccctaaaggaggccaaataatttcgcgg

SEQ ID NO: 6687 - DNA, 720 bp, Panax ginseng
atccccatctcttttataagctgctgtcatttgggttgtaggaggagaatccaccgtctgcaaacatgggtatttctcgggattcgatgcacaaaaggcgtgcaactggaggcaagaagaaggcttggaggaagaagcgaaagtatgaactcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgtggtgtataatgcatcaaataatgaattggttaggacacagacattggtgaagagtgccattgttcaggttgatgcagcaccatttaagcaatggtatcttcagcattatggtgttgacattggtcgaaagaagaaatcctctgctgctgccaagaaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtcaatgcggtcgtgctgatggatacattttggagggtaaggagttggagttctacatgaagaaactccagaggaagaaaggaaagggcgcagcag

SEQ ID NO: 6688 - DNA, 938 bp, Gossypium raimondii
ttcctttcaaaccctagcttccttcttctttgagattttgcttcagcactctaaagccccttccaagccaaaatgggtatttctcgtgattccatgcacaagaggcgtgccactggtggcaaaaagaaggcttggaggaagaagagaaagtatgagcttggaaggcaacctgcaaacacaaagctatccagcaacaagacggtcaggaggattagggtccgaggtggcaatgtgaagtggcgtgccttgaggcttgacacaggaaactactcctggggaagtgaggctgtgactcgtaagaccagaattttggatgtggtgtacaatgcgtctaacaatgagttggttcgtacacaaactctggtgaagagtgctattgttcaagtcgatgctgctccattcaagcaatggtatctccagcactatggtgttgacattggtcgcaagaagaaagcagcagcaggagccaagaaagaaggagaggaaggtgaaactgctactgaggaagtgaagaagagcagccatgtcttgaggaagctggagaaacgtcagcagagtcgcacacttgacccccatatcgaggagcaatttggtagtggtcgtttactggcttgcatctcttcacggcctggtcaatgcggccgtgctgatggatatatcttggagggcaaagagctggagttttacatgaagaagatgcagagaaagagggggaagggagctgcctaaaattttgttgcttttgagtatttcatcattaagatcaaaatgtccttttttttttttgccttactttcaccatttgagaacatttgaaattgtgttagttttgagcttttttttttttagtttgaatattaattattgtgtacttttatatacttgcatgttattttttgtactttgaaggtagtatcttgaactttatagatggagcc

SEQ ID NO: 6689 - DNA, 964 bp, Gossypium raimondii
atttgcttcaaccccctcccgctcttccccctgctaaaaggcttgagctttcagccaaaatgggtatttctcgtgattcgatgcacaagaggcgtgccactggtggcaaaaagaaggcttggaggaagaagagaaagtatgagcttggaaggcaaccagcaaacacaaagttgtcaagcaacaagacagtcaggaggattagggttcgtggtggaaatgtgaagtggcgcgctctgaggctcgacactggaaactactcatggggaagtgaggctgtgactcgtaaaaccagaatattggatgtggtctacaatgcatctaacaatgagcttgttcgtactcaaactttggtgaagagtgctattgttcaagttgatgctgctccattcaagcaatggtatctccagcactatggtgtcgaccttggtcgcaagaagaaaacacttgcagcagctaccaagaaagatggagaggaaggtgaaactgttgctgaggaggcgaagaagagcaaccatgtcttaaggaagttggaaaagcgtcagcagaaccgcaagctcgacccacatattgaggatcaattcagtagtggtcgtttactggcttgtatctcttcacggcctggtcagtgcggccgtgctgacgggtatatcttggaaggcaaagaactggagttctacatgaagaagatccagagaaggaagggaaagggagctgcctaaagttttgttacttgagatttcatatttcagatcaaatgtcccttttcttaacctttctttcaccattttcaggagattttgagattgtgatagtggttacacttttagtatgaattttcaagtagtgaagttgtgtcttaattcaacagtattatcatataccttgagctgcatgtttttttgtacttggaatttagttgatatttaacttaatataaatggcaacctgttttgggattttgtat

SEQ ID NO: 6690 - DNA, 924 bp, Arachis hypogaea
agggagaggccgacttgtgtgtttttggttcagccaagatgggtatttccagggattctatgcacaagaggcgcgccactggtggcaagaagaaggtttggaggaagaagaggaagtatgagcttggacgccagccagccaacactaagttatcgagcaataagacggtcaggaggattcgtgttagaggtggcaatgtgaagtggagggcattgaggttggataccggaaactattcatggggaagtgaagctgtgactcgcaagactcgtattcttgatgttgtttacaatgcctcaaacaatgagctcgtgagaactcagactcttgtcaagagtgccattgttcaggttgatgctgccccattcaagcagtggtaccttcagcattatggtgttgatattggcaggaagaagaaaacagctgctgccaagaaggatgctgaggaaggtgagacccctacggaggaagccaagaaaagcaaccatgtgcagagaaaaatcgagaaacgtcagaaagatcgtaagcttgatccccatattgaagagcagtttggtggtgggagattgctggcttgcattgcttctcgacctggtcaatgtggcagggctgacggctatattttggaaggtaaggagcttgaattttacatgaagaaaatccagaagaaaaagggaaagggtgctgcctaattgttctgttctcatacttgtattctggatttattcgtttttgttggggattggttccattcttggtgatttttcaccgtcatcaccttctgaatgaagccataacacgttagtgtgacttaacgcgtattgttatcttagttttgttttttatgttccttttgtttttgttttttttcttcttaaattatgagtactagtaattttcatcaaaatgttttgaattgataga

SEQ ID NO: 6691 - DNA, 915 bp, Arachis hypogaea
gcagtggtatcaacgcagagtggccattacggccgggggtagtagggagaggcagtctctgtgcttttgaatcagccaagatgggtatttccagggattctatgcacaagaggcgcgccactggtggcaagaagaaggtttggaggaagaagagaaagtatgagcttggacgccaaccagccaacactaagctatcgagcaataagacggtcaggcggattcgcgttagaggtggcaatgtgaagtggagggcattgaggttggatacaggaaactattcgtggggaagtgaagctgtgacgcgcaagactcgtattcttgatgttgtttacaatgcctccaacaacgagctcgtgagaactcagacccttgtcaagagtgccattgttcaggttgatgctgctccattcaagcagtggtaccttcagcattatggtgttgatattggcaggaagaagaaaacagcagctgccaagaaggatgctgccgaggaaggtgagacccctgcagaggaagccaagaaaagcaaccatgtgcaaagaaaaatcgagaaacgccagaaagatcgcaaacttgatccccatattgaagagcagtttggtggtgggagattgctggcttgcattgcttctcgacctggtcaatgtggcagggctgacggctacattttggaaggtaaggagcttgaattttacatgaagaaaatccagaaaaagaagggaaagggtgctgcttagttgtacttttctcatacttgtattttggaatttgttgtctctgttggagattggttccattcttggtgatgtttcaccgtcattaccttctgaatagagccatagcacatgctagtgtgacttaatgcgttatcatagttttgttttaaatgtgttttttcatttcttttcttttttt

SEQ ID NO: 6692 - DNA, 862 bp, Arachis hypogaea
gctggtgatagttgtgggaggcgactcggtgcttttggttcaaccaagatgggtatttccagggattctatgcacaagaggcgcgccactggtggcaagaagaaggtttggaggaagaagagaaagtatgagcttggacgccagccagccaacactaagttatcgagcaacaagacggtcaggaggattcgtgtaagaggtggcaatgtgaagtggagggcattgaggttggatacaggaaactattcgtggggtagtgaagctgtgactcgcaagactcgtattcttgatgttgtttacaatgcctcaaacaatgagctcgtgagaactcagacccttgtcaagagtgccattgttcaggtggatgctgctccgttcaagcagtggtaccttcagcattatggtgttgatattggcaggaagaagaaaacagcagctgccaagaaggatgctgccgaggaaggtgagacccccgcagaggaagccaagaaaagcaaccacgttcagagaaaaatcgagaaacgccagaaagatcgtaagcttgatccccatattgaagagcagtttggtggtgggagattgctggcttgcattgcttctcgacctgggcaatgtggcagggctgatggctatattttggaaggtaaggagcttgagttttacatgaagaaaatccagaagaagaagggaaagggtgctgcctaattattctattctcacacttgtattttggatttggtcgtctctgttggagattggttacattcttggtgatttttcaccgtcatcaccttctgaatgaagccattacttgttagtgtgacctaatgcgaattgttatcttagttttgttttaattttg

SEQ ID NO: 6693 - DNA, 944 bp, Arachis hypogaea
ggtgcttttggttcaaccaagatgggtatttccagggattctatgcacaagaggcgcgccactggtggcaagaagaaagtttggaggaagaagagaaagtatgagcttggacgccagccagccaacactaagttatcgagcaacaagacggtcaggaggattcgtgtaagaggtggcaatgtgaagtggagggcattgaggttggatacaggaaactattcgtggggtagtgaagctgtgactcgcaagactcgtattcttgatgttgtttacaatgcctcaaacaatgagctcgtgagaactcagacccttgtcaagagtgccattgttcaggtggatgctgctccgttcaagcagtggtaccttcagcattatggtgttgatattggcaggaagaagaaaacagcagctgccaagaaggatgctgccgaggaaggtgagacccccgcagaggaagccaagaaaagcaaccacgttcagagaaaaatcgagaaacgccagaaagatcgtaagcttgatccccatattgaagagcagtttggtggtgggagattgctggcttgcattgcttctcgacctgggcaatgtggcagggctgatggctatattttggaaggtaaggagcttgagttttacatgaagaaaatccagaagaagaagggaaagggtgctgcctaattattctattctcacacttgtattttggatttggtcgtctctgttggagattggttacattcttggtgatttttcaccgtcatcaccttctgaatgaagccattacttgttagtgtgacctaatgcgaattgttatcttagttttgttttaattttgttcttttttggaagattactagtaattttcagtaaaaagttttgaaattgatattgatggatggataacctcgcttaattatgttgtcaaatcaagataataatgtgcg

SEQ ID NO: 6694 - DNA, 894 bp, Arachis hypogaea
ggtgcttttggttcagccaagatgggtatttccagggattctatgcacaagaggcgcgccactggtggcaagaagaaggtttggaggaagaagagaaagtatgagcttggacgccagccagccaacaccaagttatcgagcaataagacggtcaggaggattcgtgttagaggtggcaatgtgaagtggagggcattgaggttggatacaggaaactattcgtggggtagtgaagctgtgactcgcaagactcgtattcttgatgttgtttataatgcctcaaacaatgagctcgtgagaactcagacccttgtcaagagtgccattgttcaagttgatgctgctccattcaagcagtggtaccttcagcattatggtgttgatattggtaggaagaagaaaacagcagctgccaagaaggatgctgccgaggaaggtgagaccccggccgaggaagccaagaaaagcaaccatgtgcagagaaaaatcgagaaacgccagaaagatcgtaagcttgatccccatattgaagaacagtttggtggtgggagattgctggcctgcattgcttctcgacctggtcaatgtggcagggctgacggctatattttggaaggtaaggagcttgaattttatatgaagaaaatccagaagaagaagggaaagggtgctgcttaattgttctattctcatacttgtattttggatttggtcgtttctgttggagaatggctccattcttggtgatttttcaccgtcatcaccttctgaatgaagccatagcacatgttagtgtgacctaatgcgtattgatatattagttttgttttaattttatttattttggaagagtactagtaattttcattaaaaatgttttgaaattgatattga

SEQ ID NO: 6695 - DNA, 934 bp, Glycine max
gggtgggcgaggtagccagagagtgatacaatacagagtgcgttgttgctccttcgccacaactccctgccaacatgggtatctccagagattctatgcacaagaggcgtgccactggtggcaagaagaaggcatggaggaagaagagaaagtatgagcttggtcgccagcctgctaacactaagctgtcaagcaacaagacagtcaggaggatccgggttagaggtggaaatgtgaagtggagggcactgagattggatactggaaattactcctggggaagtgaagctgtaactcgcaagactcgtatactagatgtggtttacaatgcctcaaacaacgagcttgtgcgtactcagactcttgtaaaaagtgctattgttcaggttgatgctgctccattcaaacagtggtaccttcagcactatggtgttgagattggtaggaagaagaagacagctgccaagaaggaaactgcagaggagggtgctgctgctgttgctgtggaagaagccaaaaagagtaatcatctgcagagaaaattggagaagcgccagaaagatcgtaagcttgatgctcacattgaggagcagtttggtggtgggcgtttgcttgcttgcatttcctctcggcctggtcaatgtggcagagctgacggctacattttggaaggtaaggagttggagttttacatgaaaaaactccagaaaaagaagggaaagggtgctgcttgattttagtgtttcccagatttttatatggctttagttgcttttatatgttgttggtacaatttaaggtgatgttttgtgccacatgacatcttttagtgcaaactatcttgttagtcctttgcaaattgacatcttaattttgttttgaactgtttttttgccaccgacgagttacaatttttattaattgaatgtcttgc

SEQ ID NO: 6696 - DNA, 1047 bp, Phaseolus vulgaris
tcgctgaacgggcgaagttactagccagagctcgcagcagtaccaccgttctactctgccaaaatgggtatctctcgtgattccatgcacaagaggcgcgctactggtggcaagaagaaagcttggaggaagaagagaaagtatgagcttgggaggcagccagcaaacacaaagctgtcaagcaacaagacaattaggaggattagggttcgtggtgggaatgtaaagtggcgtgctttgaggcttgatactgggaactattcttgggggagtgaggctgtgactcgcaaaacaaggattcttgatgtggtgtacaatgcatccaacaatgagcttgttcggactcagacattggtcaagagcgccattgttcaagtcgacgctgcgcccttcaagcagtggtatcttcagcattatggcgttgacattggtcgcaagaagaagattgtagcttctgccaagaaggaaggagaggatggtgaagctgcaaccgaggaggtgaagaagagtaaccatgtcctaagaaaattggaaaagcgaaaacagagccgggtgcttgattctcacattgaagaacaatttggaggtggtcgccttttggcttgtatctcatcccgacctggccaatgtggccgttctgatggatatatattagagggcaaagagctggaattttacatgaagaagcttcagaagaagaagggcaagggtgctgcttaagatattgtctatcttcctaactctttttatcagattttcttgatggtcttaactatccagtcaaattatacgttctgctaggaagtcgactttcttgaggagggaacggtttatggtgtaaacatggccaataacttctatttctttatttagagtgagtttaaatcgattatctccaccgttacagatttatagtacatgactctctcaccttgtattttcctgaacatgatgtgctggtttttcaaatagtgtggtataagcaaatccgttaccaattagtagtattttttaaacaatttggaaacccagttatgttcttgttca

SEQ ID NO: 6697 - DNA, 1020 bp, Phaseolus vulgaris
gctgaacgggcgaagttactagccagagctcgcaacagtaccaccgttctactctgccaaaatgggtatctctcgtgattccatgcacaagaggcgcgctactggtggcaagaagaaagcttggaggaagaagagaaagtatgagcttgggaggcagccagcaaacacaaagctgtcaagcaacaagacaattaggaggattagggttcgtggtgggaatgtaaagtggcgtgctttgaggcttgatactgggaactattcttgggggagtgaggctgtgactcgcaaaacaaggattcttgatgtggtgtacaatgcatccaacaatgagcttgttcggactcagacattggtcaagagcgccattgttcaagtcgacgctgcgcccttcaagcagtggtatcttcagcattatggcgttgacattggtcgcaagaagaagattgtagcttctgccaagaaggaaggagaggatggtgaagctgcaaccgaggaggtgaagaagagtaaccatgtcctaagaaaattggaaaagcgaaaacagagccgggtgcttgattctcacattgaagaacaatttggaggtggtcgccttttggcttgtatctcatcccgacctggccaatgtggccgttctgatggatatatattagagggcaaagagctggaattttacatgaagaagcttcagaagaagaagggcaagggtgctgcttaagatattgtctatcttcctaactctttttatcagattttcttgatggtcttaactatccagtcaaattatacgttctgctaggaagtcgactttcttgaggagggaacggtttatggtgtaaacatggccaataacttctatttctttatttagagtgagtttaaatcgattatctccaccgttacagatttatagtacatgactctctcaccttgtattttcctgaacatgatgtgctggtttttcaaatagtgtggtataagcaaatccgttaccaattagtagtattttttaaacaattt

SEQ ID NO: 6698 - DNA, 983 bp, Gossypium hirsutum
ttttttcttcacagatttgcttcaaccccctcccgctcttccccctgctaaaaggcttgagctttcagccaaaatgggtatttctcgtgattcgatgcacaagaggcgtgccacaggtggcaaaaagaaggcttggaggaagaagagaaagtatgagcttggaaggcaaccagcaaacacaaagttgtcaagcaacaagacagtcaggaggattagggttcgtggtggaaatgtgaagtggcgcgctctgaggctcgacactggaaactactcatggggaagtgaagctgtgactcgtaaaaccagaatattggatgtggtctacaatgcatctaacaatgagcttgttcgtactcaaactttggtgaagagtgctattgttcaagttgatgctgctccattcaagcaatggtatctccagcactatggtgtcgaccttggtcgcaagaagaaaacacttgcagcagctaccaagaaagatggagaggaaggtgaaactgttgctgaggaggcgaagaagagcaaccatgtcttaaggaagttggaaaagcgtcagcagaaccgcaagcttgacccacatattgaggatcaattcagtagtggtcgtttactggcttgtatctcttcacggcctggtcagtgcggccgtgctgacgggtatatcttggaaggcaaagaactagagttctacatgaagaagatccagagaaggaagggaaagggagctgcctaaagttttgttacttgagatatcatatttcagaccaaatgtcccttttttaacctttctttcatcattttcagtagattttgagattgtgatagtggttacacatttagtatgaattttcaagtagtgaagttgtgtcttaattcaacagtattatcatataccttgagctgcatgttttttttgtacttggaatttagttgatatttaacttaatataaatggcagcctgttttgggattttgtattatca

SEQ ID NO: 6699 - DNA, 899 bp, Cyamopsis tetragonoloba
cacgaggaccgttctctgcttcgtcgaaaatgggtatctctcgcgattccatgcacaagaggcgtgccactggtggcaagaagaaggcttggaggaagaagagaaagtatgagcttgggaggcagccagcaaacaccaagctatcaagcaacaagacagttaggaggattagggttcgaggtggaaatgtgaagtggcgtgctttgaggcttgatactgggaattactcttgggggagtgaagctgtgactcgcaagactagaattcttgatgtggtttataatgcatccaacaacgagctggttcgtactcagacattggtcaagagtgccattgttcaggttgatgcagcacctttcaagcagtggtatctccagcattatgatgtcgatgttggtcgcaagaagaagagtgcaacttctgccaagaaggaaggagaggatgctgaagctgcaactgaagaggtgaagaagagtaaccatgtcttgagaaaattggaaaagcgtaaacagaaccgtgtgcttgatcctcatattgaagaacaattcggaggtggtcgccttttggcttgtatctcatcccgacctggtcaatgtggccgtgctgatggatacatattagagggcaaagagctggagttctacatgaagaagcttcagaagaagaagggcaagggtgctgcttaagataattaactctctttctactctatcagaaagaacccctttatatctttagacatagtcagataccagttttgccagtactttcatggggagggtgggagtatcggtgtcaccgtgattcgtgaattaaaccctggaattcttgtttgtttactttttatgagtcatgtttaaattgatacctcttctgttataaatttatagtgcattgac

SEQ ID NO: 6700 - DNA, 1033 bp, Eucalyptus grandis
aagctagtggtatcaacgcagagtgcccctcagccgactggtctttctcttccagcccctgctcgcagaaaccctagcttctccgcaggcgttcgggactgtgcaaggacagaggcctagggcttgcgacctgcaatcatgggtatctctcgtgattcgatgcacaagaggcgcgccaccggtggcaagaagaaggcgtggaggaagaagagaaagtatgagcttggaaggcaacctgccaacactaagctgtcgagcaacaagactgtgaggaggattagagttaggggtggcaatgtgaagtggcgtgctctgaggctcgacaccggaaattactcatggggaagtgaggcagtgaccaggaagactaggattcttgatgtggtgtacaacgcatccaacaacgagctggtccgtacccagactctggtgaagagtgcaatagtccaggttgatgcagcaccattcaagcagtggtatctccagcactatggtgttgatattggccgcaagaagaaaaatcaagcttctgccaagaaagaaggagaggaggctgaagctcctgctgaggaggtgaagaagagcagccacgtattgagaaagcttgagaaacgccaaaccgaacgcaagcttgatcaacatattgaggagcaattcagcagtggccgtttgttagcgtccatctcatcccgaccgggtcagtgcggccgtgctgatggatatatcttggagggtaaggagctggaattctacatgaagaagattcagaggaagaagggcaagggagctgccgcataaatttttgtttctgcaatacagaggacctaaatcttccatgtctttttattcccctgaacattagttttagtttatattttaagtgtttgcatcaaattgaggttgtcatctttttattcccttgacatgaaacagttattagtgtatttgtcttgatcaagtcatctttcttttctaatcagtggtggtttggatcttatgcatctaaattatgactatggtcaactctttcacg

SEQ ID NO: 6701 - DNA, 922 bp, Euphorbia peplus
tccatacagtgcaaacatgggtatttctcgtgattcgctgcataagcgacgcgccactggtggcaagaagaaggtctggaggaagaagcgaaagtatgagctcggaaggcagcctgccaataccaaactgtctagcaacaagactgtgagaagaatcagggtacgaggtggaaatgttaagtggcgtgctttgaggctcgatactggaaatttctcgtgggggagtgaagctgttaccaggaagaccagacttcttgatgtggtctacaatgcatcaaacaatgagcttgttcgtactcaaactttggtcaagagtgctattgttcaggttgatgcagcacctttcaaacaatggtatcttcagcactatggagtcgacattggtcgcaagaagaaaaccactcttgctaagaaggacggagaggaaggtgaagctgctgctgcagctgctactgaagaagtgaagaagagtaaccatgtcacaagaaagcttgaaaccagacaacagactcgcaagcttgattcccatattgaggaacaatttagtggtggtcgccttttagcttgcatatcttcacggcctggccaatgtggtcgttgtgatgggtacatcttggaggggaaagagctagaattctacatgaagaagctccagaagaagaaaggcaagggagctgctgcttaaatttttgttacctgacttcatatttcagatcaagtttagccctccacaacttattttgttttctttcagacttgatttttgtcttgatgaaatgagtgattacagtatcacaattcagacaattaaatccttaattagaattgtcatttcaaggtgttaatggtgctggtctgttgagaatgtttcaagagctagaaacaaatagatatcgccttaatatataaatgagtactgtta

SEQ ID NO: 6702 - DNA, 856 bp, Fagopyrum esculentum
ctcgatagtgtaaagaaaaccctagctttgcttcgccacttcccctgtgacggaaccaagcaaccatgggtatttctcgggattctttgcacaagaggcgtgccactggaggcaagaagaaggtttggaggaagaagcgaaagtatgagctcggaagacagccagctaacactaagctgtcgagcaacaagacagttaggagggttcgagtcagaggtggcaatgtgaaatggcgtgctttgaggttggacactggaaactattcttggggtagtgaggctgtcaccaggaaaacccgtgtgttggatgtggtctacaatgcatccaacaatgagttggttaggactcagacactggtgaagagtgccattgttcaggttgatgctgcaccattcaagcaatggtacctacagcattacggagttgaaattggtcgcaagaagaagtctgctgcttctactaagaaggaaggagatgaagctgaagctactgaagaggaaaagaagagcaaccatgtcaagaggaaattggagaagcgccaggaaggccgaactcttgatgctcacatcgaagaacaatttagcagcggacgtctgttggctgccatctcatcacgcccgggccagtgtggtcgtgctgatggatacatcttggagggcaaagaattagaattttacatgaagaagcttcaaaagaagaagggcaaggctgctgcttaattctgttatcctatatgttttaccattcagtacaagagcttagtttgatgttctttttaaaagttgcaaattttggcttgcccttgatcatggaccagggttttcctttttgacagtttgaatctttaatcgacgag

SEQ ID NO: 6703 - DNA, 1261 bp, Gossypium raimondii
aaacaaaaactagggtttttgtgtatatgcgggctctaacttccgcctgtcactgcttctgaatcctagcttcttttttcttcacagatttgcttcaaccccctcccgctcttccccctgctaaaaggcttgagctttcagccaaaatgggtatttctcgtgattcgatgcacaagaggcgtgccactggtggcaaaaagaaggcttggaggaagaagagaaagtatgagcttggaaggcaaccagcaaacacaaagttgtcaagcaacaagacagtcaggaggattagggttcgtggtggaaatgtgaagtggcgcgctctgaggctcgacactggaaactactcatggggaagtgaggctgtgactcgtaaaaccagaatattggatgtggtctacaatgcatctaacaatgagcttgttcgtactcaaactttggtgaagagtgctattgttcaagttgatgctgctccattcaagcaatggtatctccagcactatggtgtcgaccttggtcgcaagaagaaaacacttgcagcagctaccaagaaagatggagaggaaggtgaaactgttgctgaggaggcgaagaagagcaaccatgtcttaaggaagttggaaaagcgtcagcagaaccgcaagctcgacccacatattgaggatcaattcagtagtggtcgtttactggcttgtatctcttcacggcctggtcagtgcggccgtgctgacgggtatatcttggaaggcaaagaactggagttctacatgaagaagatccagagaaggaagggaaagggagctgcctaaagttttgttacttgagatttcatatttcagatcaaatgtcccttttcttaacctttctttcaccattttcaggagattttgagattgtgatagtggttacacttttagtatgaattttcaagtagtgaagttgtgtcttaattcaacagtattatcatataccttgagctgcatgtttttttgtacttggaatttagttgatatttaacttaatataaatggcagcctgttttgggattttgtattatcatataggatgattttagttgatggttaaagcttgattagctcttaactcgacataattcaaacaaggaacacaaaagttgcagacatggagtggataaatatttacatataatcatgatgaagaaatggataagctgcgtttcggcaaaagtacctaaatcgctttattataccttgctttgcatttggatgttagatgagggagc

SEQ ID NO: 6704 - DNA, 915 bp, Mesembryanthemum crystallinum
  misc_feature (734)..(734): n is a, c, g, or t
  misc_feature (739)..(739): n is a, c, g, or t
atttagcacgagcagactctgaaaaccctaaatttcacaaaatgggtatttcccgtgattctatgcacaagaggcgtgccactggaggcaagaagaaggcttggaggaagaagcgaaagtatgaactcggaaggcagcctgctatgacaaagttgtcaagcaacaagacagtgaggagagtcagggttcgcggtggaaatgttaagtggagagcattgaggttggataccggtaacttctcatggggtagtgaggctgtgacccgcaagacccgtcttctggatgtggtttacaatgcatccaacaatgagttggtgaggacacagactttggtgaagagtgccattgtccaggttgatgctgcaccattcaagcagtggtatctccagcactatggagttgaagttggacgaaagaagaagggtgctgctgcagcagccaagaaagagggcgaggaggagaccaccgaggaggccaagaagagcaaccatgttgcaaggaaaatcgagaagcgtcaacagggtcgcacattagacccgcatattgaagaacaattcggcggtggtcgtttgttggcttgcatttcatcccgtcctggacaatgtggccgtgctgatggatatatcttggaaggcaaagagcttgaattctacatgaagaagctccagaggaagaagggcaaatcagctgcttgataaacttttgctctgaaagcatcaggatcagagtttaantttgntttctttaatcgattacaccttagtatggatcagaccttgtcttattgagcttgaattatggcctacttagcataatctttttgtaatcttggatttgatactttcaagtgttggcttttagggttgaactcatttttctggctttgtttgcattgggggcattgggctttacgct

SEQ ID NO: 6705 - DNA, 1105 bp, Glycine max
aaaaaatcttagttttttgttttgaaaagaggtgaaattgggcctgattctgggccgggtaagtgaagcaggatcagaaaataggatttcgtgtgttgaaatataaaacgcggaatattagggttttaagggtgggcgaggtagccagagagtgatacaatacagagtgcgttgttgctccttcgccacaactccctgccaacatgggtatctccagagattctatgcacaagaggcgtgccactggtggcaagaagaaggcatggaggaagaagagaaagtatgagcttggtcgccagcctgctaacactaagctgtcaagcaacaagacagtcaggaggatccgggttagaggtggaaatgtgaagtggagggcactgagattggatactggaaattactcctggggaagtgaagctgtaactcgcaagactcgtatactagatgtggtttacaatgcctcaaacaacgagcttgtgcgtactcagactcttgtaaaaagtgctattgttcaggttgatgctgctccattcaaacagtggtaccttcagcactatggtgttgagattggtaggaagaagaagacagctgccaagaaggaaactgcagaggagggtgctgctgctgttgctgtggaagaagccaaaaagagtaatcatctgcagagaaaattggagaagcgccagaaagatcgtaagcttgatgctcacattgaggagcagtttggtggtgggcgtttgcttgcttgcatttcctctcggcctggtcaatgtggcagagctgacggctacattttggaaggtaaggagttggagttttacatgaaaaaactccagaaaaagaagggaaagggtgctgcttgattttagtgtttcccagatttttatatggctttagttgcttttatatgttgttggtacaatttaaggtgatgttttgtgccacatgacatcttttagtgcaaactatcttgttagtcctttgcaaattgacatcttaattttgttttgaactgtttttttgccaccgacgagttacaatttttattaattgaatgtcttgcaatcctcttattgttgggtactaggggagggggtgttcaatg

SEQ ID NO: 6706 - DNA, 963 bp, Trigonella foenum-graecum
agagagaagtcggtggcggtgtaggtttggtagagagagagagagagagagagagagaggaagctgaagctgcgccaagatgggtatttctagggattctatgcacaagagacgtgccactggtggcaagcagaagacctggagaaagaagcgaaagtacgagcttggtcgccagccagcaaacactaagttgtcaagcaacaagacagtcaggaggatccgtgttagaggtggcaatgtgaaatggagagctcttagattagacactggtaatttctcatggggtagtgaggcagttactcgcaagactcgtcttctggatgtggtttacaatgcctcaaacaatgagcttgttcgaactcagactttggttaagagtgctattgtccaagttgatgctgccccattcaagcagtggtaccttcagcactatggtgttgaagttggtagaaaaaagaaaacagcagcaaagaaggattctgcagaggaggctgaagttgttgctgaagaagttaagaaaagtaaccacgtgcagagaaaacttgagcagcgtcagaaagataggcaacttgattcccatattgaagagcagttcggtggtggtcgtttgcttgcctgcatttcatctcgccctggtcaatgtggcagagctgatgggtacattcttgaaggtaaggagctggagttttacatgaagaaattacagaaaaagaagggaaagactgctgcttaattgaagtgttttccaacttatatatgacttcgttagtgtttctattttggtatttggtaccattcaagtttatgttttctttggttgagtgttaattggacacctgtactagttttatgcaaatttcatccaaattttgctctttaatttctggagtttaatttaatgttttgcaactgatagttggacaccttcactagttatatgcaaattttgctcttaagttaatc

SEQ ID NO: 6707 - DNA, 593 bp, Triticum aestivum
gggtatatctcgtgactcaatccacaagaggcgtgccactggaggcaagcagaagggatggaggaagaagcgaaagtatgagatgggaaggcagccagccaacactaagttgtccagcaacaagacggtcagaagaatccgtgtccgtggaggtaacgtcaagtggcgtgcgttgaggctcgacactggtaactactcttggggaagtgaagctgttactcgcaagaccagagttcttgatgtggtctacaatgcctccaacaacgagttggtccgtaccaagacactagtgaagagcgccattgttcaggtggatgctgctcctttcaagcagtggtacctccagcactatggtgttgaggttggtcgcaagaagaagactgctccttctgctgccaagaaggaaggagaggatggtgaagaggctgctccagctgctgctgctgctcctgaggaggtgaagaagagcaaccacgtccagagaaagattgagagccgtcaagaaggtcgtagccttgattcccacatcgaggaccagtttgcaagtggtcgtttgctggcatgcatctcatcaaggcctggccagtgcggaa

SEQ ID NO: 6708 - DNA, 1000 bp, Arachis hypogaea
agggagaggcagtctctgtgcttttgaatcagccaagatgggtatttccagggattctatgcacaagaggcgcgccactggtggcaagaagaaggtttggaggaagaagagaaagtatgagcttggacgccaaccagccaacactaagctatcgagcaataagacggtcaggcggattcgtgttagaggtggcaatgtgaagtggagggcattgaggttggatacaggaaactattcgtggggaagtgaagctgtgactcgcaagactcgtattcttgatgttgtttacaatgcctcaaacaatgagctcgtgagaactcagacccttgtcaagagtgccattgttcaggttgatgctgctccattcaagcagtggtaccttcagcattacggtgttgatattggcaggaagaagaaaacagcagctgccaagaaggatgctgctgaggaaggtgagacccctgcagaggaagccaagaaaagcaaccatgtgcaaagaaaaatcgagaaacgccagaaagatcgcaaacttgatccccatattgaagagcagtttggtggtgggagattgctggcttgcattgcttctcgacctggtcaatgtggcagggctgacggctacattttggaaggtaaggagcttgaattttacatgaagaaaatccagaaaaagaagggaaagggtgctgcttagttgtacttttctcgtacttgtattttggaattagttgtctctgttggagattggttccattctgggtgatgtttcaccgtcatcaccttctgagtgaagccatggcactttagtgtgacttaatgcgatatcatagttttgttttaaatgtgttttttcatttcttttctttttttggttattgatgagaactagtagtttcctcaaatgttttgaaattgatattcatgataactaacaacctctctaaattatattggttgattaggttagagagatacataaggaattaaggataagagtaaa

SEQ ID NO: 6709 - DNA, 3152 bp, Ambrosia trifida
tacccaacagcagctctagggttttagaccttattctcatttgttctaccgttatcttaatctttcacctgtatctgcattttggcataatttgcagtcatggtgcagtataattttaagaaaattactaaagtacctacgggtaaagattttgttgatatagtactcagtcgaacacagcggcaaacgcctactgtcgttcacaagggctatgcgattaatcgtattcgccagttttacatgcgaaaagtgaaattcacacaaacgaattttcacgaaaagctctctacgattatcgaagagtttccgaggcttgatgatatacatcctttttatggtgatcttctccatgttctttacaataaagatcattataaacttgcccttggtcagatcaatactgctagaaatcttattagtaaaattgcgaaagattatgtgaagttgttgaaatatggcgattcgctatatcggtgtaaggctttaaaggttgctgctcttggtcgaatgtgtacggttacaaaaagaattggtcctagtttggcgtaccttgatcaaattaggcaacacatggcgaggctgccgtctattgaccctaacactaggacgattttgatctgtgggtatccgaatgttgggaaaagttcgtttattaacaaaattactagagcagatgttgatgtccagccatatgcttttactacaaagtctttgtttgttggtcatactgattataaatacttgcggtatcaagttatagataccccggggattttggatagaccgtttgaagatcgtaatattattgaaatgtgtagtataacagcgttagcacatctacgagctgcagtcttgttctttcttgatatctctggttcttgtgggtacacaatcgctcaacaggcggcgcttttcacagtataaagtctttgtttatgaacaaacctttgattatcgtctgcaacaagactgatttgcagtcgctggaaggaatatctgaggatgacaagaagttggttgaggagatgaagtcagaagcaatgaaaactctaattggccaaggcggtgagcctagagaaggtgctgaagtgcttttaacaatgagcactttgactgaacagggtgtgattgctgttaaaaacgctgcttgtgaacggttattagatcaaagagttgaagttaaaatgaagtctaaaaagataaatgattgtttaaatcgttttcatgttgctgttccgaaaccacgtgaccaaaaagagagaccaccttgcataccacaagctgttcttgaagcgaaagctaaagaagctgagaaagaaaagagaaagcttgaaagggatattgaagaagaaaatggtggtgcaggttgtttattctgctagcttaaagaaacattatcttcttgcaaatgatgaatggaaggaagataacatgcccgaaattcttgatggacacaatgtgtatgattttgtggaccctgatattttacaaaggctcgaggagttggagaaagaagaaggtcttctgcaggagcaggaagacgatgaggtggacatggacgtagaggatttgaccccgcaacagcaaaaggaactagctgaaatcaggagaaagaaaagcatactcatcagagagcatagaatcaaaaagagcacagcagaaagccgacctattgtgccaagaaagtttgataaagacaaaaagttcacttccgagagaatgggtcgacagctgtcatctttgggacttgacccgtctaaagcaatggaacgggttcgaagcaagtctaggggacgtaagagggagaggtcaactgatcatggtggtgatgacatgaatgtggatgatgacggttcaaataagaagatgaagttgaggtcattgtccaggtcgaggtcaaggtcaagaccgccaacagatgtggtagttcctggtgagggatataaagattctgctcaaaagattcaggcgtttaaaatgggtaaaaaagctgtttacaagaggaacaaagatgctcgaaagggtgagggtgatagagtcattcctaatctaaaaccaaagcatttgtattctggcaagcggtccaatggcaaaaccactagacgttgatgatgatgtcaaaactttatgttttatggagaggctgaccagcaaaaagagcgacgatttgaggcctggatgaatgccgccatcatctggtaacatctagggaatggcagcctataattttgcaagtctttcgctttggattttcttcttttctagtgtctgattataaaattttgaacttctggtatttttggtgatacggctcgcaacttgaattattatacactaaatgtttttctttttgaatcggtagtgctagtattgtaataaaagatgataaagcttacaacgacctgaaacattcataaagtcggcatttaacaaacaaacacgtcaaaatttcagttccatgccttgcagagtaaaaaagaaaaaggaaataaaacttaagcagcaccctttcctttcttcttctggagtttcttcatgtagaactcaagctccttaccctccaagatatatccgtcagcacggccacattggccagggcgtgatgaaatagcagccaaaagacgtccacttgaaaactgctcttctacatgagcgtcaagtttgcgctcctcttgacgtttctccaacttcctcacaacatgattactcttctttgcctcctcagtggcagcctcggcttcctctccctctttcttagcagcaacagccgctttcttcttgcgaccgatttcgacaccatagtgttgtagataccattgtttaaaaggcgcagcatcaacttgaacaatagcacttttcaccagagtttgagttctgaccaactcattgttggatgcattgtaaaccacatccaagatacgggtctttcgggttacagcctcacttccccaagagtagttacctgtatctaacctcaacgcacgccacttgacattaccacctcgaaccctaacccttctaacagtcttgttgctggatatttttgtgtttgcaggctgtcttccgagctcatactttcgcttctttctccaggccttcttcttgccaccagtggcccgtctcttgtgcatcgaatctcttgatatccccat

SEQ ID NO: 6710 - DNA, 794 bp, Panax ginseng
caaacatgggtatttctcgggattcgatgcacaaaaggcgtgcaactggaggcaagaagaaggcttggaggaagaagcgaaagtatgaactcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgtggtgtataatgcatcaaataatgaattggttaggacacagacattggtgaagagtgccattgttcaggttgatgcagcaccatttaagcaatggtatcttcagcattatggtgttgacattggtcgaaagaagaaatcctctgctgctgccaagaaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtccaatgcggtcgtgctgatggatacattttggagggtaagggagttggagttctacatgaagaaactccagaggaagaaaggaaagggtgcagcagcttaaaatcgtgacttgaatggagtttgaattctgaatttttttctctatattactttttttacttcttcaggcatgaaactaaggaactattaagctctcatagttagcttcattttcttggctgtctgag

SEQ ID NO: 6711 - DNA, 1366 bp, Brachypodium distachyon
ccttgagcgaggaagatcaaccggcggcgcagccacagagggaacccgaagccgccgccatgggtatttcgcgtgactccatgcacaagcgccgcgccactggcggcaagcagaaggcctggaggaagaagcgaaagtatgagctcggtcgtcagcctgctaacaccaagctgtctagcaacaagacagtgaggagagtccgtgtccgtggaggcaatgtcaagtggagggccctacgtttggatactggcaactactcctggggaagtgaggctgtgacccgcaagacccgtctcctcgatgtggtttacaactcctccaacaatgagcttgtcaggacccagacccttgtgaaaaatgccattgtgcaagttgatgctgcccccttcaagcagtggtacctcactcactatggagtggatattggtaggaagaagaagacccctgctgctaccaagaaggatgctactgagacattgcaggatggtgatgctgctgcacctgctgctgcggctgcagaggaaaccaagaaaagcaacaatgtccagaggaagctggagaaacgccaacagggtcgcaccctagacccccacatcgaagaacaatttagcagtggaaggttgttggcatgcatttcttcccgccctgggcagtgtggacgagctgatggctacatccttgagggtaaggagcttgagttctacatgaagaagctccaaaagaagaagggcaagggtgccgctgcttagagcaaatcctaagaactctttttgttcccttgatactgttagctgtttggagtctgtcttatgcttgcggacaaatggctggttgtttcccccctcaaaattgatcttgtctagcatgaagagctgagaattgtttatgtactctcgtattattagtttctatgtgtactcttttggatcgtcgtttataattttgaacttagctgttttgcctgactggttttctttacaccgcagccgtgtttgtacgtctaaaaacaaaagaagtgtttgcagacagtttccctcgctttaggtcatctgcaaaggctgattttttatcaacttttaattggaatttactaatgtggaggaaaaaaagagtagaaatgactctttggtgcgtcaggcaatagactaaagtacggagtgcaatcttctaccactgtacaacaacccgtcatactagtacgtctttcactataaatgatgtaatatttcaaaaatatggctgtcgttgtttcctaaaccttttgtggaacagtaagaataactaatgctagcagatcatgtagagttggtttaaagacagaagctgtcatacgtctcactctaaatgatgtggagagtcagggtat

SEQ ID NO: 6712 - DNA, 883 bp, Panax ginseng
tcaacgcagagtacatggggagaatccaccgtctgcaaacatgggtatttctcgggattcgatgcacaaaaggcgtgccactggaggcaagaagaaggcttggaggaagaagcgaaagtatgaactcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgttgtgtataatgcatcaaataatgaattggttaggacacagacattggtgaagagtgccattgttcaggttgatgcagcaccatttaagcaatggtatcttcagcattatggtgttgacattggtcgcaagaagaaatcctctgctgctgccaagaaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtcaatgcggtcgtgctgatggatacattttggagggtaaggagttggagttctacatgaagaaactccagaggaagaaaggaaagggtgcagcagcttaaaatcgtgacttgaatggagtttgaattctgaatttttttctctatattactttttttacttcttcaggcatgaaactaaggaactattaagctctcatagttagtttcatttcttgttgtctgagtgttgaagaagaatatttgaattttctttaatttttaatagtggtagtgttattggct

SEQ ID NO: 6713 - DNA, 903 bp, Panax ginseng
ctgtcatttgggttgtaggaggagaatccaccgtctgcaaacatgggtatttctcgggattcgatgcacaaaaggcgtgcaactggaggcaagaagaaggcttggaggaagaagcgaaagtatgaactcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgtggtgtataatgcatcaaataatgaattggttaggacacagacattggtgaagagtgccattgttcaggttgatgcagcaccatttaagcaatggtatcttcagcattatggtgttgacattggtcgaaagaagaaatcctctgctgctgccaagaaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtcaatgcggtcgtgctgatggatacattttggagggtaaggagttggagttctacatgaagaaactccagaggaagaaaggaaagggtgcagcagcttaaaatcgtgacttgaatggagtttgaattctgaatttttttctctatattactttttttacttcttcaggcatgaaactaaggaactattaagctctcatagttagtttcatttcttgttgtctgagtgttgaagaagaatatttgaattttctttaatttttaatagtggtagtgttgttggcttaattacagcgcttttat

SEQ ID NO: 6714 - DNA, 1064 bp, Cajanus cajan
tacagctgaagttggcctgatcatgggccgtgacgggccgggtaagtggagggagatcaacaagttagggttttaacgaaagcgagggacgagagacagagtgcattgttgcttcttggtttcaactctctgccaacatgggtatttccagggattctatgcacaagaggcgtgccactggtggcaagaagaaggcctggaggaagaagaggaagtatgagcttggtcgtcagcctgctaacactaagctatcaagcaacaagacagtcaggaggatccgtgttagaggtggcaatgtgaaatggagggcactgagattggatactggaaattactcctggggaagtgaagctgtaactcgcaagactcgtatacttgatgtggtttacaatgcctcaaacaatgagcttgtgcgaactcagacacttgtcaaaagtgctattgttcaggttgatgctgctccatttaaacagtggtaccttcagcactatggtgttgagattggtaggaaaaagaagacagctgccaagaaggattttgctgaggagggtgatgctactgctgttgctgctgcagaagaatccaaaaagagtaatcatgtgcagagaaaattggagaagcgccagaaggatcgaaagcttgatccccacattgaggagcagtttggtggtggtcgtttgcttgcttgcatttcatctcgacccggtcaatgtggccgatccgatggctacattctggaaggtaaggagttggaattttacatgaagaaactccaaagaaagaagggaaagggcgctgcttgattttagtgttcccaaatttttgtatggctttagttgtttttatttgtcgccggttccatttaaggcgatgttttgtaccgcgtgacatcgtttagtgcggactattttgttagtcctttgcagattgacaattttgtttatccctctttcaatgaagagttttatccctctttctcatttatccattgatattcaatctgtgttcttttttcacaattttcattgatattgtttgttcgggaaaaatgaatattgttgata

SEQ ID NO: 6715 - DNA, 1103 bp, Triticum aestivum
gcgagaccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttactcgttggattttcttagatgttgcgtccatgtcatgtttgcagacatactgaacaccattttctgtaaacggttcgagtcctaggttgaactgagaatgttttgcctgttttggttgtgatctaaagctatccagattctattatgtgttctaccttgcagtattttcatctgttcagtgaagttttgatcttgagtctccatgttgatttgctgccagctttgcctttcaggcatgttagatttgtatggttcctgcagttgcaaaggacccatccagtgtgaaaacccgatcatgtatgcaaagcaattttgatcatggaatct

SEQ ID NO: 6716 - DNA, 1078 bp, Triticum aestivum
gctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttactcgttggattttcttagatgttgcgtccatgtcatgtttgcagacatactgaacaccattttctgtaaacggttcgagtcctaggttgaactgagaatgttttgcctgttttggttgtgatctaaagctatccagattctattatgtgttctaccttgcagtattttcatctgttcagtgaagttttgatcttgagtctccatgttgatttgctgccagctttgcctttcaggcatgttagatttgtatggttcctgcagttgcaaaggacccatccagtgtgaaaacccgatcatgtatgcaaagcaattttgacc

SEQ ID NO: 6717 - DNA, 1076 bp, Panax ginseng
gctgtcatttgggttgtaggaggagaatccaccgtctgcaaacatgggtatttctcgggattcgatgcacaaaaggcgtgccactggaggcaagaagaaggcttggaggaagaagcgaaagtatgaactcggaagacaacctgcaaacacaaagttgtctagcaacaagacagttacgtagggtaagggttcgaggtgggaacgtgaagtggcgtgccttgaaggttggacacagggaactactcttgggggtagtgaggctgtgacacgaaagaactagaattctggatgtggtgtataatgcatcaaataatgaattggttaggacacagacattggtgaagagtgccattgttcaggttgatgctgcaccatttaagcaatggtatcttcagcactatggtgttgacattggtcgcaagaagaaatcctctgctgctgccaagaaagaaggagaggagggtgaagctgctactgaggaagcgaagaagagcaaccatgtacaaagaaaaattgagaagcgtcaagaggatcgtaagattgatgcccatattgaagaacaatttggaggtggtcgtcttttagctgcaatttcctcacgacctggtcaatgcggtcgttctgatggatacattttggagggtaaggagttggagttctacatgaagaaactccagaggaagaaaggaaagggcgcagcagcttaaaatttcgtgacttgaatgtagtttgaattctgaattttttctctatattactttttttacttcttcaggcatgaaactgaagaactattaagctcatagttagtttcatttcttgttgtctcgagtgttgaagaagaatatttgaattttctttattttttaacagtggtagtgttattggcttaatttagcgcttttattattgtagtcttctcaatttcagactaaaaaaaaaaaacaaaaaaaaaaacaaaaaaaaaacaaaaaaaaacaaaaaaaaaaacaaaaaaaacaaaaaaacaaaaacaaacaagagagagagacacagagagacacacaccacccccacaccccccccccccccccccc

SEQ ID NO: 6718 - DNA, 887 bp, Panax ginseng
gtatccccttctcttttataagctgctgtcatttgggttgtaggaggagaatccaccgtctgcaaacatgggtatttctcgggattcgatgcacaaaaggcgtgccactggaggcaagaagaaggcttggaggaagaagcgaaagtatgagctcggaagacaacctgcaaacacaaagttgtctagcaacaagacagttcgtagggtaagggttcgaggtgggaacgtgaagtggcgtgccttgaggttggacacaggggaactactcttggggtagtgaggctgtgacacgaaagactagaattctggatgtggtgtataatgcatcaaataatgaattggttaggacacagacattggtgaagagtgccattgttcaggttgatgcagcaccatttaagcaatggtatcttcagcattatggtgttgacattggtcgaaagaagaaatcctctgctgctgccaagaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtcaatgcggtcgtgctgatggatacattttggagggtaaggagttggagttctacatgaagaaactccagaggaagaaaggaaagggtgcagcagcttaaaatcgtgacttgaatggagtttgaattctgaatttttttctctatattacttttttacttcttcaggcatgaaactaaggaactattaagctctcatagttagtttcatttcttgttgtctgagtgttgaagaagaatatttgaattttctttaattttt

SEQ ID NO: 6719 - DNA, 784 bp, Gossypium raimondii
cctttcaaaccctagcttccttcttctttgagattttgcttcagcactctaaagccccttccaagccaaaatgggtatttctcgtgattccatgcacaagaggcgtgccactggtggcaaaaagaaggcttggaggaagaagagaaagtatgagcttggaaggcaacctgcaaacacaaagctatccagcaacaagacggtcaggaggattagggtccgaggtggcaatgtgaacgtggcgtgccttgaggcttgacacaggaaactactcctggggaagtgaggctgtgactcgtaagaccagaattttggatgtggtgtacaatgcgtctaacaatgagttggttcgtacacaaactctggtgaagagtgctattgttcaagtcgatgctgctccattcaagcaatggtatctccagcactatggtgttgacattggtcgcaagaagaaagcagcagcaggagccaagaaagaaggagaggaaggtgaaactgctactgaggaagtgaagaagagcagccatgtcttgaggaagctggagaaacgtcagcagagtcgcacacttgacccccatatcgaggagcaatttggtagtggtcgtttactggcgtgcatctcttcacggcctggtcaatgcggccgtgctgatggatatatcttggagggcaaagagctggagttttacatgaagaagatgcagagaaagagggggaagggagctgcctaaaattttgttgcttttgagtatttcatcattaagatcaaaatgttcctttttttttt

SEQ ID NO: 6720 - DNA, 894 bp, Arachis hypogaea
gcggcaccttcgacttccaaaatgggtatctctcgtgattctatgcacaagaggcgcgccactggtggcaagaagaaggtttggaggaagaagagaaagtatgagcttggaaggcaaccagcaaacacaaagctctccagcaacaaaactgttaggaggatcagggttcgaggtgggaatgtaaaatggcgtgctttgaggcttgacactgggaactactcttggggtagtgaagctgtgactcgcaaaacgaggattctcgatgtggtgtataatgcctccaacaatgaacttgttcgaactcagactttggtcaagagtgccatcgttcaggttgatgctgcacctttcaaacagtggtatctccagcattatggtgtcgacattggtcgcaagaagaagggtgcaacttctggcaagaaagaaggggaggatgctgaaactgcaaccgaagaagtgaagaagagtaaccatgtcttgagaaagttggagaagcgtaaacaaacccgggtgcttgattcccacattgaagaacaatttggaagtggtcgcctcttggctagtatctcatcccgccccggtcaatgtggtcgtgctgatggatatatattggagggcaaagagcttgagttctacatgaagaagcttcagaaaaagaagggcaagggtgctgcttaagatgttgtatttcctccattttagttttctttgaattatcttgttgaaactattacatcttagacaatcaaggtgatcattttgctagaatgtctactttctatgggttgttttggtagtgatgttgggttgtaaacaaaacccggaactttgaactgtttaatgatattgatagtgagtcctatttaaattaaattagcactgccattataattt

SEQ ID NO: 6721 - DNA, 849 bp, Ambrosia trifida
tagctagggttttgaatacatccatcttattattaaagcatttacataaaccaaaccctacccttctcttctcttctctttgtcgaagtaggcggagctaccctgtggatttgcaatcatggggatatcaagagattcgatgcacaagagacgggccactggtggcaagaagaaggcctggagaaagaagcgaaagtatgagctcggaagacagcctgctaacacaaaaatttccagcaacaagacggttagaagagtcagggttcgaggtggtaatgttaagtggcgtgcattgaggttagatacaggtaactactcttggggaagtgaggctgtaacccgaaagacccgtatcttggatgtggtttacaatgcatccaacaatgagttggtcagaactcaaactctggtgaaaagtgctattgttcaagttgatgctgcgccttttaaacaatggtatctacaacactatggtgtcgaaatcggtcgcaagaagaaagtggctgctgctgctaagaaagagggagaggaagccgaggctgccactgaggaggcaaagaagagtaatcatgttgtgaggaagttggagaaacgtcaagaggagcgcaaacttgacgctcatgtagaagagcagttttcaagtggacgtcttttggctgctatttcatcacgccctggccaatgtggccgtgctgacggatatatcttggagggtaaggagcttgagttctacatgaagaaactccagaagaagaaaggaaagggtgctgcctaagttttatttcctttttcttttttactcttgcaaggcatgaaactgaaattttgatgtgtttgtttgttaaaatg

SEQ ID NO: 6722 - DNA, 1270 bp, Cannabis sativa
aagagtgtgaggagtggctttaaggttttagccgaagcggagcagaagaagaagaagaagaagctcaacaggaacaagctccgtctgcagccatgggtatttctcgtgattctatgcacaaaaggcgtgccactggaggcaagaagaaggcctggaggaagaagaggaagtatgagctcggtcgtcagccagctaacactaagctttcgagcaacaagactgtgaggcgtattcgtgttagaggtggaaatgttaagtggagagctctcaggttggataccggtaacttctcatggggaagtgaagctgttactcgcaaaactcgtctccttgatgttgtctacaattcctcaaacaatgagcttgtgagaactcaaacccttgtgaaaggtgctatcatccaggttgatgctgccccattcaagcaatggtaccttcagcactatggtgtagacatcggtaggaagaagaagacacctgctgctgctgctgctgccaagaaggatacccccgaggagggtgaagccgctgcaccagctgcagaggaagcaaagaaaagcaaccatgttcagaggaagattgagaagcgtcaagaagctcgtaccctcgatgcccatattgaagaacaattcagtagcggaaggttgtatgcttgcatctcttctcgccctggacaatgtggcagagctgatggatacatcttggaaggaaaggaactcgagttctacgtgaagaaacttcagaggaagaagggaaaggctgctggtgctgctgcttaaagagtgtgttacttgctttttacaccttctccttatatgagttaatttgttttagttatcgccagtcggtactactactgtctaggacatgttatgagccactgatagaaacaacttttgaaaagattttgtttggctagtctgtgaactgagaagtaatttttgctctaaaatagtactactttgtttttgtgtttatgttacaatgttttgatggttttcttttctcttgtttgatcatttatttattctaaattaccatgttattagtttttcgtacaagaaatttgtgtttatgttacaatgttttgatggttttcttttctactgtcttgaaatcataattgctgaaaatttgaaaatgctagtctcttgtttgatcatttatttattctaaattaccatgttattagtttttcgtacaagaactttaattcccattagattggagaatgtgtttatacaattacacaactttcaaaactcaacaa

SEQ ID NO: 6723 - DNA, 837 bp, Flaveria ramosissima
tcagaggcgcagaagacccattgtgatctgcaaacatgggtatctctcgtgattcgatgcacaagaggcgtgccactggtggcaagaagaaggcatggaggaagaagcgaaagtacgagctcggaagacagcctgcgaacactaaaatatccagcaacaagactgttagaagggttagggttagaggaggtaatgttaagtggcgtgcattgaggttagatacaggtaactactcttgggggagtgaggctgtaaccagaaagacccgtattttggatgtggtttacaatgcatcaaacaatgagttggtcaggactcaaactctagtgaaaagtgccattgttcaggttgatgctgcgccattcaaacaatggtatttacaacactatggtgttgatattggtcgcaagaagaaagcagcagctactgctacaaagaaagagggagaggaagtagaagctgccactgaggagacaaagaagagcaatcatgttgtgagaaaattggagaaacgtcaagaggagcgtaaacttgacccacatgtagaagagcaattttcaagtggccgtcttttggctgctatttcatcacgccccggccaatgtggtcgtgctgatggatacatcttggaaggtaaggagcttgagttctacatgaagaagctccagaagaagaaaggaaagggtgctgcttaagttttcttttattttccttttttactctgcaaggcatggaaccaaaattttgatgtgttttgtttgttaaaatgccgactttaatgaatgtttcaggtcattgtaagctctactgtctttattaatactagtactattgatt

SEQ ID NO: 6724 - DNA, 940 bp, Helianthus annuus
tttgaacacatcttattaaagcattctctaaccgaaccctacccttctctttgtcgaggtaggcggaggagcatcccagtgatctgcaaacatggggatatccagagactcgatgcacaagagaagggccactggtggcaagaagaaggcctggaggaagaagcgaaagtatgagctcggaagacagccagcaaacaccaaaatttccagcaacaagactgttagaagagtcagagttcgaggaggtaatgtcaagtggcgtgctttgaggttggatacaggtaactactcttggggtagtgaggctgtaacccgaaagacccgtattttggatgtggtttacaatgcatccaacaatgagttggtcagaactcaaactcttgtgaaaagtgcaattgttcaagttgacgctgcaccatttaaacagtggtacttacaacactatggtgtggagattggtcgcaagaagaaagcagctgctgctaagaaagagggagaggaggcagaggctgccactgaggaggcaaagaagagtaatcatgttgtgaggaagttggagaaacgtcaagaggagcgcaaacttgaccctcatgtagaagagcagttctcaagtggtcgtcttttggctgctatttcatcacgccccggtcaatgtggacgtgctgatggatatatcttggagggtaaggagcttgagttctacatgaagaaactccagaaaaagaaaggaaagggtgctgcttaagttttatttccttttttactctgcaaggcatgggactgaaattttgatgtgtttgtttgttaaaatgccgactttatgaatgttttgggtctttgtaagctttatcatcctttattaatactagcactattgattcagtcagatcgttttctttatattttctacgtaaattatatttcataatttttaaaatgc

SEQ ID NO: 6725 - DNA, 821 bp, Helianthus annuus
ggcggaggagcatcccagtgatctgcaaacatggggatatccagagactcgatgcacaagagaagggccactggtggcaagaagaaggcctggaggaagaagcgaaagtatgagctcggaagacagccagcgaacaccaaaatttccagcaacaagactgttagaagagtcagagttcgaggaggtaatgtcaagtggcgtgctttgaggttggatacaggtaactactcttggggtagtgaagctgtaacccgaaagacccgtattttggatgtggtttacaatgcatccaacaatgagttggtcagaactcaaactcttgtgaaaagtgcaattgttcaagttgatgctgcaccatttaaacagtggtacttacaacactatggtgtggagattggtcgcaagaagaaagcagctgctgctaagaaagagggagaggaggcagaggctgccactgaggaggcaaagaagagtaatcatgttgtgaggaagttggagaaacgtcaagaggagcgcaaacttgaccctcatgtagaagagcagttctcaagtggtcgtcttttggctgctatttcatcacgccccggtcaatgtggacgtgctgatggatatatcttggagggtaaggagcttgagttctacatgaagaaactccagaaaaagaaaggaaagggtgctgcttaagttttatttccatttttactctgcaaggcatgggactgaaattttgatgtgtttgttaaaatgccgactttttgaatgttttgggtctttgtaagctttataatcctttattaatactagcactattgattcagtca

SEQ ID NO: 6726 - DNA, 847 bp, Helianthus annuus
aggcggaggagcatcccagtgatctgcaaacatggggatatccagagactcgatgcacaagagaagggccactggtggcaagaagaaggcctggaggaagaagcgaaagtatgagctcggaagacagccagcaaacaccaaaatttcgagcaacaagactgttagaagagtcagagttcgaggaggtaatgtcaagtggcgtgctttgaggttggatacaggtaactactcttggggtagtgaggctgtaacccgaaagacccgtattttggatgtggtttacaatgcatccaacaatgagttggtcagaactcaaactttagtgaagagtgcaattgttcaagttgatgctgcaccgtttaaacaatggtacttacaacactatggtgtggaaattggtcgcaagaagaaagcagctgctgctaagaaagagggagaggaggcagaggctgccactgaggaggcaaagaagagtaatcatgttgtgaggaagctggagaaacgtcaagaggagcgcaaacttgaccctcatgtagaagagcagttctcaagtggtcgtcttttggctgctatttcatcacgccccggtcaatgtggacgtgctgatggatatatcttggagggtaaggagcttgagttctacatgaagaaactccagaaaaagaaaggaaagggtgctgcttaagttttattcccttttttactctgcaaggcatgggactgaaattttgatgtgcttgtttgttaaaatgcgactttatgaatgttttgggtctttgtaagctttatcatcctttattaatactagcactattgattcagtcagattgttttctttatattttct

SEQ ID NO: 6727 - DNA, 1131 bp, Amorphophallus konjac
tctcttctctacagctcgctccctcgagctccagggtctcgccccctctctgcgaaaatgggtatctctcgggattccatgcacaagaggcgcgccacgggaggcaagaagaaggcctggaggaagaagcgaaagtacgagctggggcgccagccagcaaacacgaagctttcgagcaacaagacggtgagaagggtgcgggtgaggggagggaacgtgaagtggagggcgctgaggctggacacgggcaactactcgtgggggagtgaggccgtcacccgcaagacccgtatcctcgatgtggtctacaatgcctccaacaacgagctcgtacgcacgcagacgcttgtgaagagcgcgatcgtgcaggttgatgccgctccgttcaaacaatggtacctccagcactatggggttgacattgggcgcaagaagaagcagcaaccagctgccgccgccgccaagaaggaaggcgaggagggcgaggggcctgcagaagagacaaagaaaagcaaccatgttactaggaaaatagagaagcgccagcagggacgcaagctagactcacacatagaagagcagtttggtggtgggaggttgttggctgctatctcatcccggcccgggcagtgtggacgtgctgatggctacatactggaggggaaagagttggaattctacttgaagaagatccagaggaagaaagggaagggagctggtgcttctgcttaagatccttttaccgcaggcctgtttacttcacatttttatgtatctcctctttgctaggcacagttttgaggtaatatccgttgccatctgtggttctgtcgagctgcttgagtgacatggtcttgaccttttagatgttttttttgtaatgcaagcagacgctgtcattcttgtttaaatgtttgaagtgcgttcaatctagattttgcctaccttgtgctgtgccgctcggtgcagtggaccctctctgcttcaccggcggtgggagggtgtgggttcgatcctgcgctccacttgtcgacagagagaactaaaagagagaaggggagagagaaagagagggataatttattttattttcttttttagataattaaacagtgacttgatttatactct

SEQ ID NO: 6728 - DNA, 1107 bp, Humulus lupulus
tacggccgggggacaggagtggctctaaggttttagccgaagcggagaagaagaagaagaagagctctagttcgaccttagcttcgtctgcagccatgggtatctctcgtgattctatgcacaaaaggcgtgccactggaggcaagaagaaggcttggaggaagaagagaaagtacgagctcggtcgtcagccagctaacactaagctttccagcaacaagactgtaaggcgtattcgtgtccgaggtggaaatgtcaagtggagagctctcagattggatactggtaacttctcatggggaagtgaagctgttactcgcaaaactcgtctcctcgatgtggtctataatgcttcaaacaatgagcttgttagaactcaaactttggtgaaaggtgctattatccaggttgatgcagccccattcaagcaatggtatcttcagcactatggtgtagacattggtaggaagaagaagacggctgctgctgccaagaaggaaacccccgaggagggagaagcagcaccacctgctgaggaaaccaagaagagtaaccatgttcagaggaagattgagaagcgtcaacaagctcgtacactcgactcacatattgaagagcagttcagtagtgggaggttgtacgctgccatctcttctcgccctggacaatgtggcagagctgatggatacatcttggaaggaaaggaactcgagttctacgtgaagaagcttcagaggaagaaggggaaggctgctggtgctgctgcttaaagagtgtgatactttccttttttccccttatccttatatgagttaatttgttttagttggcaacagttggtactactgctaggacatgttatgagccactgatagaaagaactttgaaaagattttgtttggcattatcagattagaatctttggctagtctgtgaaccagaagtaatttttgctctaaatagtactacttgtttggttttgtgtttgtttacctttcgattcagcttttgttcacgttgttctgatgattatctgttgcatctccttagtttataaaaattactgaaattttagcacagattaactcgcaattttctctattggag

SEQ ID NO: 6729 - DNA, 967 bp, Gossypium raimondii
catataaacggcagagtagggttttagctggtgcagtggctgtgagcgtaagacgaaagagagcaattgaaacagttctttgcgccgctcagccaacatgggtatttccagggattccatgcacaagaggcgtgccactggtggcaagaagaaggcttggaggaagaagcgaaagtatgaacttggtcgtcagccagcaaatactaagctctctagcaacaagactgtaaggagaatccgtgttagaggaggcaatgtgaagtggagggcattgagattggatacaggcaactattcatggggtagcgaagctgtcacccgcaagacccgtattcttgatgtggtatataatgcctcaaacaatgagcttgtcaggacacagaccctcgtaaagagtgctattgttcaagtggatgctgctccctttaagcaatggtaccttcaacactatggtgttgatattgggaggaagaagaagacagcagctaagaaggaagctactgaggacggagaagttgctgccgaggaaactaagaagagtaaccatgtgctaaggaagcttgagaagcgccagaaggaacgtacacttgatgctcacattgaagaacaatttggctctggtagattgttggcatgcatttcttcccggccaggtcaatgtggcagagctgatggatacatattggagggtaaagagctagaattctatatgaagaaaatccaaaggaagaagggcaagggcgctggagctgcttagatgcagtatttcaaatggtctactctctcatcaatgtggtttttgttgcctttaaattttgttctctttattttcctacaattgaggatatggtacatttttattgtgaactctttaggcatttgttcaagtccttgttaaattgtgctgttcttttaatcaaaagttaaagaaaaaagaattattgttatatgcggcttctcctttcca

SEQ ID NO: 6730 - DNA, 1140 bp, Gossypium raimondii
gaacacaacaataaatccatttaattacaacttatggaaacgcagcatatcaacgcagagtacatggggcagtggctgtgagcgtaagacgaaagagagcaattgaaacagttctttgcgccgctcagccaacatgggtatttccagggattccatgcacaagaggcgtgccactggtggcaagaagaaggcttggaggaagaagcgaaagtatgaacttggtcgtcagccagcaaatactaagctctctagcaacaagactgtaaggagaatccgtgttagaggaggcaatgtgaagtggagggcattgagattggatacaggcaactattcatggggtagcgaagctgtcacccgcaagacccgtattcttgatgtggtatataatgcctcaaacaatgagcttgtcaggacacagaccctcgtaaagagtgctattgttcaagtggatgctgctccctttaagcaatggtaccttcaacactatggtgttgatattgggaggaagaagaagacagcagctaagaaggaagctactgaggacggagaagttgctgccgaggaaactaagaagagtaaccatgtgctaaggaagcttgagaagcgccagaaggaacgtacacttgatgctcacattgaagaacaatttggctctggtagattgttggcatgcatttcttcccggccaggtcaatgtggcagagctgatggatacatattggagggtaaagagctagaattctatatgaagaaaatccaaaggaagaagggcaagggcgctggagctgcttagatgcagtatttcaaatggtctactctctcatcaatgtggtttttgttgcctttaaattttgttctctttattttcctacaattgaggatatggtacatttttattgtgaactctttaggcatttgttcaagtccttgttaaattgtgctgttcttttaatcaaaagttaaagaaaaaagaattattgccctatgcggcttctcctttccaggattcgattgaatttttgcaccaagttgcgtatggatgaatgaatacgattgcctatttatatggatcggacctggttttgattagacacgttcatggatcttattagtttgggctaggctcaatctcaattttct

SEQ ID NO: 6731 - DNA, 895 bp, Euphorbia esula
  misc_feature (5)..(7): n is a, c, g, or t
  misc_feature (863)..(863): n is a, c, g, or t
gggannnctagaaggtgagcaggtagcagcggcgtcgacgatcagccaggatgggtatctccagagactccatgcataagaggcgtgccactggtggcaagaagaaggcctggaggaagaagcgaaagtatgagcttggtcgtcagcctgcaaataccaagctctcaagtaacaagacagtaagaagaatccgtgtgagaggaggtaatgtcaagtggagagcgctgagattggatacagggaatttttcttggggaagtgaggctgtcacccgaaagactcgtctccttgatgttgtttacaatgcttcaaataatgaacttgtgaggacacaaactttggtgaagagtgcaattgttcaggtggatgcagctccatttaagcagtggtatcttcaacactatggtcttgatattggtaggaagaagaaggctgtagcagctaagaaggagactaccgaggaaggagatggtgctgctcctgctgctcaagtagaggaaaccaaaaagagcaatcatgtggccaggaagattgagaaacgccagaaggatcgtaagctagattctcacattgaagagcaatttggcgggggtagattattggcctgcatttcatcccgtcctggtcaatgtggcagagctgacgggtatattttggaaggtaaggaactggaattctatatgaagaagcttcaaaagaagaagggcaagggtgccagtgctgcataataacaaaaaattttgactctttttttgttccattttggatatgatgccataccttagcttcaaacttggtgcaattttcatttttctgctataatttcttctttgttttggaggagttagattttatttggcatngcagatattttatttcaaaatactttcttagc

SEQ ID NO: 6732 - DNA, 1396 bp, Panicum virgatum
aaccagaagagcggcggcgcgggcggaccagaaggaggccgcgtagcagcagcagcaagccgggcaagggcacccgccgccaccatgggaatctcgcgtgactcgatgcacaagcgccgggccaccggtgggaagcagaaggcctggaggaagaagcgaaagtatgaactcgggcgccagcctgctaacaccaagctgtccagcaacaagacagtgaggagggtccgtgtccgtggaggtaatgtgaagtggagggctctacgcctggatactggtaactactcatggggtagcgaggctgttactcgcaagacccgtatcctggatgttgtctacaacgcgtcaaacaatgagcttgttcggacccagacccttgtgaagagcgccattgtgcaagttgatgctgccccattcaagcagtggtaccttactcactatggagtggacattggtaggaagaagaaggccccggctgctaagaaggatgctggagggtcaagagggtgaggccacagctgaggaaacaaaaaagagtaaccatgtccagaggaagcttgagaagcgccagcagggacgcacacttgacccgcacattgaggagcaatttggcagcggaaggttgttggcatgcattgcttctcgccctgggcagtgtggccgagctgacggttacatccttgagggtaaagagctcgagttctacatgaagaagctccagaggaagaagggcaagggtgccgcagcttagaaacattatattgtctggaagcgtggcctatcttatcctttactctgggttttgttagttctcaagtatgttatgtcgtgttgcagacctgatgaacagccaagtgaatcaactctagcttcaaggaactgagaattttcaccttctgtggtattctcttgatatttaaattcacagtttattgacagtttgtgttcagcagttttggtttatctctgagatggctcgttgaatggtgtatttcctgtttggttttcattcgttgcttgcgaacgtctggcaaaattgataacagcaagacatgcataaagccttacaatgatctttgtttgcatccacccatcgatgaaatgatgatgtgttaaaactgtagaatagaattcaacgcttttgcaattgttgtatgtcagtgtcgttgctaaagtcgctcgttctaactctccattttgttctctcaatcatcatttccactaacccaacaaatgccagatttggcttcgtctatctccatcaaaccaactagccttgatttgctcttttcgactaatgaacgtttaacaagatctaccgattattattgttaaaataaaaaaatcaagactgaaaagctaatggcttctttgatcttccatgtcttttgattacaac

SEQ ID NO: 6733 - DNA, 859 bp, Panax ginseng
tcatttgggttgtaggaggagaatccaccgtctgcaaacatgggtatttctcgggattcgatgcacaaaaggcgtgccactggaggcaagaagaaggcttggaggaagaagcgaaagtatgagctcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgtggtgtataatgcatcaaataatgaattggttaggacacagacattggtgaagagtgccattgttcaggttgatgctgcaccatttaagcaatggtatcttcagcactatggtgttgacattggtcgcaagaagaaatcctctgctgctgccaagaaagaaggagaggagggtgaagctgctactgaggaagcgaagaagagcaaccatgtacaaagaaaaattgagaagcgtcaagaggatcgtaagattgatgcacatattgaagaacaatttggaggtggtcgtcttttagctgcaatttcctcacgacctggtcaatgcggtcgttctgatggatacattttggagggtaaggagttggagttctacatgaagaaactccagaggaagaaaggaaagggcgcagcagcttaaaatttcgtgacttgaatgtagtttgaattctgaattttttctctatattactttttttacttcttcaggcatgaaactgaagaactattaagctcatagttagtttcatttcttgttgtctcgagtgttgaagaagaatatttgaattttctttattttt

SEQ ID NO: 6734 - DNA, 917 bp, Lupinus angustifolius
gaaacactgcagtcacaaaaagcaaccgagagagaacggagagtgtgctcaacgcgccgccaatatgggtatttctagggattccatgcataagaggcgtgccactggtggcaaaaagaaggcatggagaaagaagagaaagtatgagctcggtcgtcagccagcaaacaccaagttatcaagcaacaaaacagtgaggaggattcgtgttaggggtggaaatgtcaagtggagggcattaagattggacactggaaacttttcatggggtagtgaagctgtggctcgcaagacccgtcttcttgatgttgtttacaatgcctccaacaatgagctggtgcgaactcagaccctggtcaagggagcaattgttcaggttgatgctgctccattcaagcaatggtaccttcagcactatggtgttgaagttggtaggaaaaagaaaacagcatccaagaaggatactgcagaggagggtgaagcagctgctgctgaagaaaccaagaaaagtaaccatgtccagagaaaaattgagaagcgccagacagatcgtaaccttgattcccacattgaagagcagtttggtggtggtcgattgcttgccgctatttcctctcgccctggtcaatgtggcagggctgatgggtacattttggaaggtaaggaactggagttttacctgaagaaactccagaagaagaagggaaagggtgctgcctaattttattgtttcccatatttttacatggctttagttgtttttgtttgagtttgttaaacattgaaagcaattttagctttgaatgacattgttggtctactactgtaggataatgcccttcttgaacgtgttatcagttttatgcaattgtcattaaattttgtttttcatcatgttactcatatatacatttctc

SEQ ID NO: 6735 - DNA, 944 bp, Oryza sativa
gagagagcgaggcacagctaccggcggcgcagccacacagcagcagcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcgaagaacagtttggcagtgggaggttgctggcctgcatttcttcccgccctgggcagtgtggccgagcagatggctatatccttgagggcaaggagctggaattctacatgaagaagctccagaggaagaagggcaagggtgcctcagcttagagcaagtctttctttgttgctggttctacactgaaagaactacccttttttgttccctgagagctcctatgttatgtttgcagacgcatagctgtttttttaggattaaacaactttagcatgatgacatgagaatgggttatgtactctggatgttattaagttaaaatatttactttctgccagctcgttcataa

SEQ ID NO: 6736 - DNA, 906 bp, Sorghum bicolor
caaccagaagtgcggcggcgcaggcggaccaggaggaggcggaggagaagcagcggagccaagccaccgccgccaccatgggtatctcgcgtgactcgatgcacaagcgcagggccaccggtggaaagcagaaggcctggaggaagaagcgaaagtatgagctcgggcgccagccggccaacaccaagctgtcaagcaacaagacagtgaggagggttcgtgttcgtggaggtaatgtgaagtggagggctcttcgcctggatactggtaactactcatggggaagtgaagctgttacccgcaagacccgtatccttgatgttgtctacaatgcatcaaacaacgagcttgtgaggactcaaacccttgtgaagagtgccattgtgcaagttgatgctgccccattcaagcagtggtacctcactcactatggagttgacatcggtaggaagaaaaaggctcctgctgcaaagaaggaagctgctgagggacaagagggtgaggcagcagctgaggaagcaaagaagagcaaccatgtgaagaggaagcttgagaagcgtcaggagggacgcgagcttgatgcgcacattgaagagcaatttggcagtggaaggttgctggcgtgcatttcctcccgccctggacagtgtggccgagctgatgggtacattcttgagggtaaagagcttgagttctacatgaagaagcttcagcgcaagaagggcaagggcgccgcagcttagagcattctcatggatggtcttacgccgaaatgtgtggcctattaaatattactcttgcttttttgttagtcgtctcaagttcagagcgtctatgtcatgttttgcagacctgagaacactattttctgaaaatgaatcaactctatctagctcttaagaattg

SEQ ID NO: 6737 - DNA, 915 bp, Manihot esculenta
cgcttttctttctctgaaaccctagcgtctgtgtggaagtttggacttgtgaggcggatagaagctaagaactttcctctgcaaaaatggggatttctcgtgattcgatgcacaagaggcgtgccactggtggcaagaagaaggcttggaggaagaagagaaagtatgagcttggaaggcagcctgcaaacacaaaactgtcaagcaacaagacagtcaggagaattagggtcagaggtggaaatgtcaagtggcgtgctttgaggcttgataccggaaactattcatggggtagtgaggctgttactcggaagaccagaattcttgatgtggtgtacaatgcatctaacaatgagcttgtccgtactcaaacattggtgaagagtgcaattattcaggttgatgctgcaccattcaagcagtggtatcttcagcattatggagttgacataggtcgcaagaagaaaactgcagctgccaagaaagaaggagaggaaggtgaagctgccactgaggaagtgaagaagagtaaccatgtcttaagaaagctggagaagagacagcagactcgcaaacttgaccctcatattgaagaacaatttggtagtggtcgtctattagcttgcatctcatcccgccctggtcagtgtggccgtgctgatgggtacatcttggagggtaaagagttggagttctacatgaagaaacttcagaggaagaagggtaagggagctggtgctgcctaaaatttttgttgtcagaacctcatattatgatcggacttgtgttcccaccttattatttcccttataattggaccatgtatttttatgagatgagcaactaagcttgttttaccaactagtttttattgtggaattaatagaatcgtttaccagtcgtgtttcatacaaa

SEQ ID NO: 6738 - DNA, 958 bp, Coffea canephora
tggatcccccgggctgcaggttcagaacccccgccgccgcctggtttacagcactagtgggaggagcaccgccaccgccgctgtcaacatgggtatttcacgtgattctatgcacaagagacgtgccactggtggcaagaagaaggcctggaggaagaagagaaagtatgagcttggtcgtcaagctgcaaatactaaactgtcaagcgacaagacagtgaggagaatccgagtgagagggggcaatgtcaagtggagggctctcagattggatactggaaactattcttggggaagtgaagctgtcacccgcaaaacccgtatccttgatgtcgtctacaatgcctctaacaatgaacttgtgagaactcaaaccctagtgaaaagtgccattgttcaggtggatgctgccccattcaagcaatggtaccttcagcactatggtgttgatattggcaggaagaagaaggcagtggttgtgaagaaggaaggagaggaaggtgaagctgctgcagcaactgaggaaaccaagaaaagtaaccatgttctcaggaagattgagaagcgccagaaagagcgtaagcttgatgcccacattgaagaacaatttggatctggtaggttgttggcttgcatttcttcccgaccgggtcagtgtggaagagcggatggatatatcttggaaggaaaggaactggaattttatatgaagaagatccagaggaagaagagtaagagtactggtgctgcctaagctgctgatacacctgagctctttactggatcagatgcagtagtagctttagacgcttttgatggcatcattctcttgctttttcatccagtacttgtgcgccatatgtaaccaaatattgtactgaaaagttttgatattcgactggctagaacctaaactatgtgtactgaagttgcgatttgctgttaaaaaaaaaaaaaa

SEQ ID NO: 6739 - DNA, 839 bp, Fagopyrum esculentum
agcaaccatgggtatttctcgtgattctatgcacaagaggcgtgccactggaggcaagaagaaggcttggaggaagaagcggaagtatgagcttggaaggcaaccagctaacacaaagctttcaagcaacaagacagttaggagggttagggttagaggtggtaatgtgaagtggcgtgctctgcgattggatactgggaattattcatggggtagtgaggctgttaccaggaagacccgtgtcttggatgtggtgtacaatgcatctaacaatgagttggttaggacacaaactttggtgaagagtgccattgtacaagttgatgctgcaccattcaagcaatggtatctccagcattatggagttgatattggtcgcaagaagaagactgtttccgctaagaaagaaggagaggagggtgaagctgcagaggaagcaaagaagagcaaccatgtacagagaaagttggaaaaacgccagcaaggtcgcactctggaccaacacattgaagaacagttttcgggtgggcgcttgttggctgccatctcttcacgcccgggccagtgtggtcgtgctgatggatacattttggagggcaaggagctagagttctatatgaagaaactccagaagaagaagggcaaggcagcgggtgccgcttaaaattttggtgctcagagcaacatagtaatagagtataatcttccttttgttaaaagttcagccctatctaatttgttattgggacccatgatctcttttgtagcccctgtgggctttcttgctgctgttgcaatctcttttagggttagccatgtttgttgaattaaatgcaaaa

SEQ ID NO: 6740 - DNA, 1047 bp, Flaveria ramosissima
gggtacatgggagtttggaggcgcagccataaaccctacacgaagatcaccgatcatctgcaaccatgggtatctctcgtgattccatgcacaagagacgtgcgactggtggaaagaagaaggcgtggaggaagaagcgaaagtatgagctcggaagacagccagccaataccaagatctccagcaacaagactgttaggagggttagggttcgtggtggtaatgtgaagtggcgggccctgaggttagacacaggtaactactcttggggaagtgaggctgtgactcgaaagacccgtattttggatgtggtttacaatgcatccaataatgagttggtcagaacccagacacttgtcaagagtgcaattgttcaggtggatgctgcacctttcaagcaatggtatctgcagcattatggtgttgaaatcggtcgcaagaagaaaaccgctgcttctgcaggcaagaaagagggagaggaagcagaaggtgcaacagaggaggccaaaaagagtaatcatgttgtgaggaaacttgaaaaacgtcaagaggaaaggaaactggacccccatgttgaagaacaattttccagtggtcgtcttctagctgccatctcatcacgccctggccaatgtggtcgtgctgatggatacatactggaagggaaagaacttgaattctacatgaagaaacttcagaagaagaaaggaaagggtgctgctgcttaaaaccatatttccttatattagctttgtattttttatttatttttgaggaatggcatgaccaatagctttgacttctttgagtgttgactgtatctttgctatttagtgtcatgactttgaaatgacgcatgttgatcgaatttaagggttaagggagagctgtcttttaagacttgtttgtgatgttaatttgtttagaggtctgtttggtaaaccttgtgttaagttatacaaaacgccgttaaggtacttttgaatcatttagtatatttgagaacttattacaataaaagttcatgaatcaataaaggttatttaa

SEQ ID NO: 6741 - DNA, 975 bp, Leymus cinereus x Leymus triticoides
agaccaaaccaaagctgcggcggcgcgggcataggaggcgaagcagcagcggagccaagccaccgacgccaccatgggtatctcgcgtgactccatgcacaagcgccgggccaccggcgggaagcagaaagcatggcggaagaagcgaaagtatgagctcggccgccagcctgccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagaggctgaggttgctgctgctgccacagaggaagcaaagaagagcaacaatgtccagaggaagcttgagaagcgccagcagggacgtacactggactcacacattgaggagcagttcagcggtggaaggttgctggcctgcatttcgtctcgccctggacagtgtggcagagctgatgggtacatcctggagggcaaggagctggagttctacatgaggaagctccagaagaagaaaggcaagggtgccacagcttaggcggaagagctgcgtgttactcgttggattttcttagttgttgcgtccatgtcatgtttgcagacatactgaacaccattttctgtaaaccgttttgagtctaggttgaactgagaatgttttgcctgctttggttgtgatctaaagctatcgagattctattatgtgttctaaagtattttcatctgttaagtgaaattttgttctcgcatctcaaaaaaaaa

SEQ ID NO: 6742 - DNA, 909 bp, Allium cepa
ggggaccctgtgagagagcgagtagagggaggtagacggcgacaatctcaaatcatgggtatctcacgtgattctatgcacaaaagaagggccactggtggcaagaagaaggcatggagaaaaaagcgaaagtatgagatgggacgccaaccagccaacacaaaactatcctccaacaaaacagtgaggagaatacgtgttcgaggtggaaatgtgaagtggagggcgcttaggttggacactggcaactattcgtggggcagtgaggcagttacgcgaaagacccgtatccttgatgtggtatacaatgcttccaacaatgagcttgttaggactcagactctggtcaagagtgccattgttcaggttgatgctgcacctttcaaacagtggtatcttacgcactacggtgttgacattggtaggaagaagaaagcaccgactacaggaaagaaggaagcagccgaggagagtgaacctgctgctgcagaagtgaagaaaagcagccatgtactaaggaagcttgaaaaacgtcaaaaggaacgtacacttgatagtcatattgaggagcagttcggcagcggtagacttttggcttgcatctcttctcgccctggccaatgtggcagagctgatggatatattttggaaggaaaagagcttgagttctacatgaagaagctccaaaagaagaagggcaaggcagctgctgcttaattttttagtatttcatgttttggccaacttgtttcattgaattgtttgttttaaggagaacacttgtttagcttaaatgcttttgtcctgagaatttttgtgatgttttatttaattttaacatatgctaaaactgttgttttgtcttacttttcatgtggtttccgttatattacacgtttattattcttg

SEQ ID NO: 6743 - DNA, 1006 bp, Pseudoroegneria spicata
  misc_feature (4)..(6): n is a, c, g, or t
  misc_feature (10)..(10): n is a, c, g, or t
ccgnnncttncgccgttgctgtcgtcctgcgagaccaaaccaaagctgcggcggcgcgcgcataggaggcgaagcagcagcggagccaagccaccgacgccaccatgggtatctcgcgtgactccatgcacaagcgccgggccaccggtgggaagcagaaggcatggagaaagaagcgaaagtatgagctcggccgccagcctgccaacactaagctttcgagcaacaagacagtgaggagggtccgtgttcgtggaggtaacgtgaagtggagggctctccgtctggacactggtaacttctcatggggaagtgaggctgtgacccgcaagacccgtctcctggatgtggtttacaattcatcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagaggctgaggttgctgctgctgccacagaggaagcaaagaagagcaacaatgtccagaggaagcttgagaagcgccagcagggacgtacactggactcacacattgaggagcagttcagcggtggaaggttgctggcctgcatttcgtctcgccctggacagtgtggcagagctgatgggtacatcctggagggcaaggagctggagttctacatgaggaagctccagaagaagaagggcaagggtgccacagcttaggcggaagagctgcatgttacttcggattttcatagttgttgcgtccatgtcgtctatgtttgcagacatactgaacaccatgttctgtaatcggttcgagtctagtttgaactgagaatgttttgcctgattagcttgtgatctaaagctatcgagattctatattatgtgttccgccttacagtattttcatctcttaagtgaaattttgctctctcatttca

SEQ ID NO: 6744 - DNA, 1145 bp, Oryza sativa
atccggcccaacagcgctaaaccctagcccgcggaggcacctatataatccgcgacccaagcgtgagaggcgagagagcgaggcacagctaccggcggcgcagccacacagcagcagcaggtgaggaggagaggagacccgccgccgccgccgccatgggtatctcgcgtgattccatgcacaagcgccgcgccacgggcggcaagcagaaggcatggcgcaagaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcgaagaacagtttggcagtgggaggttgctggcctgcatttcttcccgccctgggcagtgtggccgagcagatggctatatccttgagggcaaagagctggaattctacatgaagaagctccagaggaagaagggcaagggtgcctcagcttagagcaagtctttctttgttgctggttctacactgaaagaactacccttttttgttccctgagagctcctatgttatgtttgcagacgcatagctgtttttttaggattaaacaactttagcatgatgacatgagaatgggttatgtactctggatgttattaagttaaaatatttactttctgccagctcgttcataattttgacattatcgatctgtcgtgatctgcccattatgtttgcgcagagttgcattttgttatctactaaaagcctaaaaggatgtttgatcggactagctacgcttcaggagtgtactccctccacccc

SEQ ID NO: 6745 - DNA, 1363 bp, Sorghum bicolor
gcctgtgaataagccctaaccctcggccgaggcgcctcccttatataaaccgacaccctagggtttccctctctcccttgtgatacccaaccagaagtgcggcggcgcaggcggaccaggaggaggcggaggagaagcagcggagccaagccaccgccgccaccatgggtatctcgcgtgactcgatgcacaagcgcagggccaccggtggaaagcagaaggcctggaggaagaagcgaaagtatgagctcgggcgccagccggccaacaccaagctgtcaagcaacaagacagtgaggagggttcgtgttcgtggaggtaatgtgaagtggagggctcttcgcctggatactggtaactactcatggggaagtgaagctgttacccgcaagacccgtatccttgatgttgtctacaatgcatcaaacaacgagcttgtgaggactcaaacccttgtgaagagtgccattgtgcaagttgatgctgccccattcaagcagtggtacctcactcactatggagttgacatcggtaggaagaaaaaggctcctgctgcaaagaaggaagctgctgagggacaagagggtgaggcagcagctgaggaagcaaagaagagcaaccatgtgaagaggaagcttgagaagcgtcaggagggacgcgagcttgatgcgcacattgaagagcaatttggcagtggaaggttgctggcgtgcatttcctcccgccctggacagtgtggccgagctgatgggtacattcttgagggtaaagagcttgagttctacatgaagaagcttcagcgcaagaagggcaagggcgccgcagcttagagcattctcatggatggtcttacgccgaaatgtgtggcctattaaatattactcttgcttttttgttagtcgtctcaagttcagagcgtctatgtcatgttttgcagacctgagaacactattttctgaaaatgaatcaactctatctagctcttaagaattgagattttccggttgtattttcgtgatgcttattttgcttgtttactagctgcaacagttcctgttaaagcaggtttggtttcgcgatgagattgtgcgggtatgattgattttctgttttaaggtttaacatgtactgtgcaatgaatcaaacgtgtttgctagatttttggagctggcagcgtcaagacgatctgcttttattgctggaccaaagctatgaattaaacttgtttctcttataaaacaaaaataatttgatttcaagtctcactttggctccttgttaaacatctacgaatttagtctcgcacacgtgaggaggccatgatatataatattatgtcggccatgatatataatattacgtc

SEQ ID NO: 6746 - DNA, 906 bp, Juglans hindsii x Juglans regia
  misc_feature (22)..(22): n is a, c, g, or t
  misc_feature (207)..(207): n is a, c, g, or t
  misc_feature (487)..(487): n is a, c, g, or t
  misc_feature (576)..(576): n is a, c, g, or t
gggctccgcagaagttgagagnatttgtgggagacagcagccctagaactcccacactgccaaaatgggtatctctcgggattcaatgcacaagaggcgtgccactggaggaaagaagaaggcttggaggaagaagcgcaagtatgagctcggaaggcaacctgcaaacacaaagctgtcaagcaacaagacagttaggaggattanggttcgaggtggaaatgttaaatggcgtgctctgaggcttgacactggaaactactcatgggggagtgaagctgtgacccggaagactcgtcttcttgatgtggtctataatgcatccaacaacgagctggttcgtactcagactttggtgaagagtgctattgttcaggttgatgcagcaccgttcaagcagtggtatctccagcactatggggtggacattggtcgcaagaagaagacttcagcttccaccaagaaagaaggggaggagggtgatgcngctgctgctgttgctgaggaggtgaagaaaagcaaccatgtccagaggaagctggagaagcgtcaacagaatcgcaagcttgacctacncattgaagagcaatttggtagtggtcgtttattagcttgtatctcatcaagacccggtcagtgtggccgtgctgatggatacatcttggaaggcaaagagcttgaattctacatgaagaagatccagagaaagaagggcaagggggctggagctgcctaaaattttgttacccgaacttcatatcagaatttctgttttgttggaattcgtttcctccccataggcattgaacttaaaagcttaggcgaaccagtttacgagaagctttttgtcatggtacttttgacttgttaattggaatattgtcattgatgacttaatattattat

SEQ ID NO: 6747 - DNA, 815 bp, Medicago truncatula
agagagagggagaggaagagggtgaggcagagagagcaagcttcatcaagatgggtatttccagggattccatgcacaagaggcgtgccactggtggcaagaagaagagctggagaaagaagcgaaagtatgagcttggtcgccagccagccaacactaagctttctagcaacaagacagtcaggaggatccgtgtcagaggtggcaatgtgaaatggagagcacttagattggacaccggaaatttctcgtggggtagtgaggcagtgactcgcaagactcgtcttctggatgtggtttacaatgcctcaaacaatgagcttgttcgtactcagactctggttaagagtgccattgtccaagttgatgctgcaccattcaagcagtggtatcttcagcactacggtgttgaagttggtaggaaaaagaaaacagcagccaagaaggattctgcagaggaggctgaagttgttgctgaagaagttaagaaaagtagccatgtgcagagaaaacttgagcagcgtcagaaagataggcaacttgattcccacatcgaagagcagtttggtggtggacgtttgcttgcctgcatttcatcacgccctggtcaatgtggcagggctgatgggtacattcttgaaggcaaggagctggagttttacatgaagaaattacagaaaaagaagggaaagagtgctgcttaattgaagtgtttttcaatttatatatgacttcgtttgtttctcttagatactgatatttggaaccattcaagtttatgtttttttttggttgagtgttaattggacacctgg

SEQ ID NO: 6748 - DNA, 837 bp, Chenopodium quinoa
tcccacatattcatagtagaacctctcagaaaccctagtttctggttctcccaacttctgcaaaaatgggtatttctcgtgattctatgcacaagaggcgtgccactggtggcaagaagaaggcctggaggaagaagcgaaagtacgagcttgggagacagccagctaacaccaagctatcaagcaacaagacagttaggagggttagggttcgtggtggtaatgtcaagtggcgtgcactgaggttggatactggtaacttttcatggggtagcgaagctgtgactcgcaagacccgtcttctggatgtcgtttacaatgcatccaacaatgagttggttaggacccagactttggtgaagagtgccattgtccaggttgatgctgcaccttttaagcagtggtatctccagcattacggagttgagattggacgcaagaagaagaatgtagctgcaaagaaagaaagcgaggaggctgagaccactgaagaagccaaaaagagcaaccatgttgcgaggaagctggaaaagcgtcagcagacccgcactttggattctcacattgaagaacaattcggtggtggtcgtttgttggcctgcatttcttcccgtcctggtcaatgtggccgtgctgatggatatatactggagggcaaagaactggaattctacatgaagaaaatccagaagaagaagggcaaatctgctgcttaattttttgctgtagaatcatagtcagatatgttatatctttttttggttgatcgtagtcgtgttgagttcaactctgttaattcttccaaaacattttgtaatgtgtagtgtgatgctttta

SEQ ID NO: 6749 - DNA, 790 bp, Chenopodium quinoa
ctctagttcctccaattctgcaaaaatgggtatttctcgtgattccatgcacaagaggcgtgccactggtggcaagaagaaggcctggaggaagaagcgaaagtacgagcttgggagacagccagctaataccaagctttctagcaacaagacagttaggagggttagggttcgtggtggtaatgtcaagtggcgtgcattgaggttggatactggtaacttttcatggggtagtgaagctgtgactcgcaagactcgtcttctggatgtcgtttacaatgcatccaacaatgagttggttaggacccagactttggtcaagagtgccattgtccaggttgatgctgcaccttttaagcagtggtatctccagcattacggagttgagattggacgcaagaagaagaatgttgctgcaaagaaagaaagcgaggaggctgagaccaccgaagaagccaaaaagagtaaccatgttgcgaggaagctggaaaagcgtcagcagacccgcactttggactctcacattgaagaacaattcggcggtggtcgtttgttggcctgcatttcttcccgtcctggtcaatgtggccgtgctgatggatatatacttgagggcaaagaactggaattctacatgaagaaaatccagaagaagaagggcaaatctgctgcttaattttttgctgtagaatcatagtcagatatgttatatctttttttggttgatggtagttgtgttgagttcaactctgttaattcgtccaaaactttttgtaatgtgtagtgtgct

SEQ ID NO: 6750 - DNA, 694 bp, Ambrosia trifida
ggtatttcaagagactctatgcacaagagacgtgccactggtggcaagaagaaggcctggagaaagaagcgaaagtatgagcttggtcgccaaccagcgaacactaaaatctccagcaacaaaaccgttagaagggttagagttaggggtggcaacgtgaaatggcgtgcattgaggttagatacaggtaactactcttggggaagtgaagctgtcactcgaaagacccgtattttggatgtggtgtacaatgcatcaaacaatgagttggtcaggactcaaaccttagtcaaaagtgcaattgttcaagttgatgctgcaccgtttaagcaatggtatttgcaacattatggtgttgagattggtcgcaagaagaaagcggcagccgctgctaccaagaaagagggagaggaagctgaagctgccactgaggaggcaaagaagagcaaccatgtggtgagaaagttggagaaacgtcaagaagagcgcaaacttgacccccatgttgaagagcagttttcaagtggtcgtcttttggccgctatttcatcgcgtcctggccaatgtggtcgtgctgatggatacattttggagggtaaggaacttgaattctacatgaagaagctccagaaaaagaaggaaagggtgctgcttaaaccttattcagtttccatctttagatttggtttttttt

SEQ ID NO: 6751 - DNA, 1060 bp, Phaseolus vulgaris
gtatccaagcagaactagggtttcatatataatacgcattatggtgagggttttatcagagaggggccgtacccagagaagaagctagggaggaagaggggagagagaattttgaacgctaaatcaagatgggtatttccagggattccatgcacaagaggcgtgcaactggaggcaagaagaaggcgtggagaaagaagagaaagtatgagcttgggcgccaatcagccaacaccaagttatcaagcaacaagacaattaggaggattcgtgttagaggtggcaatgtaaaatggagggcactgaggttggacactggaaattactcatggggtagtgaggcagtaacccgcaagactcgtattctagatgttgtttacaatgcctcaaacaatgagcttgtgagaactcagacgttggtcaagagtgctattgttcaggttgacgctgctcctttcaagcagtggtaccttcagcactatggtgttgaaattggccgaaaaaagaaagcagcatccaagaaggactctactgaggaggctgatgctgctgctgaagaaaccaagaaaagtaaccatgtgcagagaaaacttgagaagcgccagaaagatcgcaaacttgatgcccacattgaagaacaatttgctggtggcagattgttggcatgtatttcttctcgccctggacaatgtggcagggctgatgggtacattctggaagggaaggagctggagttttacatgaagaaactgcagaagaagaagggaaagggtgctgcttaattttagcgttttccaagtttctatttggctttagttcttggaaattggtacaattcaggataatgtatgttttcgacttttggtggagatcatctttagtgtgaacgttttgttagttttatgccaatttcaaccaaaattttgtttttattgttactcataattttaatttgaagacagggatgcattatgaccacgatttgttcttatttaaaaacaactgtatgtatggagcatattttctcgtgaagttatgtttccttacccgaacttatgca

SEQ ID NO: 6752 - DNA, 974 bp, Phaseolus vulgaris
cattatggtgagggtttatcagagaggggccgtacccagagaagaagctagggaggaagaggggagagagaattttgaacgctaaatcaagatgggtatttccagggattccatgcacaagaggcgtgcaactggaggcaagaagaaggcgtggagaaagaagagaaagtatgagcttgggcgccaatcagccaacaccaagttatcaagcaacaagacaattaggaggattcgtgttagaggtggcaatgtaaaatggagggcactgaggttggacactggaaattactcatggggtagtgaggcagtaacccgcaagactcgtattctagatgttgtttacaatgcctcaaacaatgagcttgtgagaactcagacgttggtcaagagtgctattgttcaggttgacgctgctcctttcaagcagtggtaccttcagcactatggtgttgaaattggccgaaaaaagaaagcagcatccaagaaggactctactgaggaggctgatgctgctgctgaagaaaccaagaaaagtaaccatgtgcagagaaaacttgagaagcgccagaaagatcgcaaacttgatgcccacattgaagaacaatttgctggtggcagattgttggcatgtatttcttctcgccctggacaatgtggcagggctgatgggtacattctggaagggaaggagctggagttttacatgaagaaactgcagaagaagaagggaaagggtgctgcttaattttagcgttttccaagtttctatttggctttagttcttggaaattggtacaattcaggataatgtatgttttcgacttttggtggagatcatctttagtgtgaacgttttgttagttttatgccaatttcaaccaaaattttgtttttattgttactcataattttaatttgaagacagggatgcattatgaccacgatttgttcttatttaaaaacaactgtatgta

SEQ ID NO: 6753 - DNA, 1094 bp, Beta vulgaris
ctctctctttcttcttcacactctctctgtatcaacatcagagaggcgaaatagccgaaaccctagtttcttcttcatcctaactgcaaaaatgggtatttctcgtgattctatgcacaagaggcgtgccactggtggcaagaagaaggcatggaggaagaagagaaagtacgagctcgggaggcagcctgctaacacaaagctttcgagcaacaagacagttaggagggttagggttcgaggtggtaatgtcaagtggcgcgcactgaggttggacactggcaatttctcatggggtagcgaggccgtgactcgcaagacccgtctcttagatgttgtttacaatgcatccaacaatgagttggtgaggacacagactttggtgaaaagtgccattgtccaggttgatgctgcaccatttaagcaatggtatctccagcattatggagttgacgttggacgcaagaagaaggctgctgctgctgccaagaaagaaactgaggaaggtgagactacagaggaagctaaaaagagcaaccatgttgcaagaaagctggagaaacgtcagcagaatcgcactttagatgcccacattgaagaacaatttggtggtggtcgtttgctagcttgcatttcatcccgccctggtcaatgtggccgcgctgatggatacatcctagaaggcaaagagctcgaattttacatgaagaaaatccagaggaagaagggaaaggcagctgcttaatttttttttgctgtagaatcataggcagagttatgaattttgtttctttttctatcatcaattactatttactgtgggattggacctagtcttgttgagatttaaatccatggtattcgccaaagtgtttttgtaactgtaatgtgactgtgttttctatgttgcctctagtcaaagaactctggatctgatttctcgccccagtgttgtcttatggttgagttttataaccttggacagtccctttttacgtggtgctatgcttgggttgagaaattaagtcaaatttttgtggtatggaagagatgatataaacaaggtagtaaaccttagaaatgcatattatcca

SEQ ID NO: 6754 - DNA, 844 bp, Flaveria ramosissima
ctcttcgtcgaggttgagttcagaggcgcagaagacccattgtgatctgcaaacatgggtatctctcgtgattcaatgcacaagaggcgtgccactggtggcaagaagaaggcctggaggaagaagcgaaagtacgagctcggaagacagcctgcgaacactaaaatatccagcaacaagactgttagaagggttagggttagaggaggtaatgttaagtggcgtgcattgaggttagatacaggtaactactcttgggggagtgaggctgtaaccagaaagacccgtattttggatgtggtttacaatgcatcaaacaatgagttggtcaggactcaaactctagtgaaaagtgccattgttcaagttgatgctgcgccatttaaacaatggtatctacaacactatggtgttgatattggtcgcaagaagaaagcaggagctactgctacaaagaaagagggagaggaggcagaagctgccactgaggagacaaagaagagcaatcatgttgtgagaaaattggagaaacgtcaagaggagcgtaaacttgacccgcatgtagaagagcagttttcaagtggccgtcttttggctgctatttcgtcacgccccggccaatgtggccgtgctgatggatacatattggaaggtaaggagcttgagttctacatgaagaagctccagaagaagaaaggaaagggtgctgcttaagttttatttctttttctttttttactctgcaagacatggaaccaaaattttgatgtgttttgtttgttaaaatgtcgactttaatggatgtttccggtcattgtactctctactgtcgttattaatacta

SEQ ID NO: 6755 - DNA, 870 bp, Flaveria ramosissima
ttgtgatctgcaaacatgggtatctctcgtgattcgatgcacaagaggcgtgccactggtggcaagaagaaggcttggaggaagaagcgaaagtacgagctcggaagacagcctgcaaacactaaaatatccagcaacaaaactgttagaagggttagggttagaggaggtaatgttaagtggcgtgcactgaggttagatacaggtaactactcttgggggagtgaggctgtaaccagaaagacccgtattttggatgtggtttacaatgcatcaaacaatgagttggtcaggactcaaactctagtgaaaagtgcctattgttcaagttgatgctgcgccatttaaacaatggtatctgcaacactatggtgttgatattggtcgcaagaagaaagcaggagctactgctacaaagaaagagggagaggaggcagaagctgccaccgaggagacaaagaagagcaatcatgttgtgagaaaattggagaaacgtcaagaggagcgtaaacttgacccgcatgtagaagagcagttttcaagtggccgtcttttggctgctatttcatcacgccctggccaatgtggccgtgctgatggatacatactggaaggtaaggagcttgagttctacatgaagaagctccagaagaagaaaggaaagggtgctgcttaagtttttatttctctttccttttttactctgcaagacatggaacaaaaattttgatgtgttttgtttgttaaaatgttgactttaatgaatgtttctggtcactattgattttatatggtttttattattttcttatccagattctttctcaaaatacacttctgacatttcttataaagttgctacttggaact

SEQ ID NO: 6756 - DNA, 816 bp, Flaveria ramosissima
ttgtgatctgcaaacatgggtatctctcgtgattcgatgcacaagaggcgtgccactggtggcaagaagaaggcttggaggaagaagcgaaagtacgagctcggaagacagcctgcaaacactaaaatatccagcaacaaaactgttagaagggttagggttagaggaggtaatgttaagtggcgtgcactgaggttagatacaggtaactactcttgggggagtgaggctgtaaccagaaagacccgtattttggatgtggtttacaatgcatcaaacaatgagttggtcaggactcaaactctagtgaaaagtgccattgttcaagttgatgctgcgccatttaaacaatggtatctacaacactatggtgtcgatattggtcgcaagaagaaagcaggagctactgctaccaagaaagagggagaggaagtagaaactgccgctgaggagacaaagaagagcaatcatgttgtgagaaaattggagaaacgtcaagaggagcgcaaacttgacccacatgtagaagagcagttttcaagtggccgtcttttggctgctatttcttcacgccccggccaatgcggtcgtgctgatggatacatcttggaaggtaaggagcttgagttctacatgaagaagctccagaagaagaaaggaaagggtgctgcttaagtttattttattttctttttactctgcaggcatggaaccaaaattttgatgtgtttgtttgttaaaatgttgactttaatgaatgtttcaggtcattgtaagctctactgtttttattaatacttagttactattggttct

SEQ ID NO: 6757 - DNA, 845 bp, Guizotia abyssinica
cggacatatgcccggtgattctgccattacggggcggggacgatgtttagttcagaggcgcaggagcacctctgtgatctgcaaacatgggtatctctcgtgattcgatgcacaagagacgtgccactggtggcaagaagaaggcctggaggaagaagcgaaagtatgagcttggaagacagcctgcaaacactaaaatatccagcaacaagactgttagaagggttagggttcgaggtggtaatgttaagtggcgtgcattgaggttagatacaggtaactactcttggggaagtgaggctgtaacccggaagacccgtattttggatgtggtttacaatgcctcaaacaatgaattggtcaggactcaaactctagtgaaaagtgcgattgttcaagttgatgctgcaccatttaaacaatggtatctacaacactatggtgttgatattggtcgcaagaagaaggcggcagccactgctaccaagaaagagggagaggaagctgaaactgccacagaagaggcaaagaagagcaatcatgttgtgagaaagttggagaaacgtcaagaggagcgtaaactcgaccctcatgtagaagagcaattttcaagtggccgtcttttggctgccatttcctcacgccccggccagtgtggtcgtgctgacggatacatcttggagggtaaggagcttgagttctacatgaagaagctccagaagaagaaagggaagggtgcagcttaagttttatttcctttttatcttatactctgcaaggcatggaactgaaattttgatgtgttttgtttgttaaaatgctgaattttattatactagtactat

SEQ ID NO: 6758 - DNA, 937 bp, Actinidia deliciosa
  misc_feature (827)..(827): n is a, c, g, or t
  misc_feature (886)..(886): n is a, c, g, or t
atcactgatatatgcggctacggggctcgtgctagagagagagagaccctagaatcctccgtttgcaaccatgggtatttctcgggactccatgcacaagaggcgtgccactggaggcaagaagaaggcgtggaggaagaagcgaaagtacgagcttggaagacaacctgctaacactaagttgtcgagcaacaagaccgttcgaagggtgagagttcgcggtgggaatgtgaagtggcgtgcattgaggttggatacaggtaacttctcttggggaagcgaggccgtgacaaggaagacccgtattttggatgtggtttacaatgcgtcgaataatgagctggttcggacccagacattggtaaagagtgcaatcattcaggttgatgcagctccatttaagcaatggtatcttcagcactacggagttgacattggtcgcaagaagaaaactgctgctgctgccgccaaaaaagaaggagaggaaggtgaggcagctactgaggaagcgaagaagagcaatcatgtcgtgagaaaactggagaagcgtcagcaggagcgcaagcttgacacgcacgttgaagagcaatttggtggtgggcgtttgttagctgcaatttcctcccgacctggccagtgtggtcgtgctgatggttacatattggagggcaaagagcttgagttctacatgaagaagatccagaggaagaaaggaaagggtgctgcttgaagttttgtacctgaacttcatcttggaattcaactcattttcccaattttttccttatttcttaaggcttggaactgaaacttcgttgagccaattngttagcctcgtcgttttgttatgtgttgtcacctgttaagtgattattatggacatgtntttgtgtttctaaattttgatgggtagaactttcgacatcagttttctgtt

SEQ ID NO: 6759 - DNA, 1110 bp, Lactuca sativa
gttgattgctacaatatttcatgaaaaaatatccatgggccgagaaaatttgtttgggccaagtgattgggcctccacatttcaccgaggccactagggttttgagtagatacgaatagaagtaatcagcctcacccttttaagccattgccctgcgaaaccctaaactttctctttgtcacccaagagttcgacttcagaggcgcaggaggatccttctgatctgcaaacatgggtatctctcgtgattcgatgcacaagagacgtgccactggtggcaagaagaaggcctggagaaagaagcgaaagtatgagcttggaagacagcctgcaaacactaaaatatcgagcaacaagacagttagaagggtgagagttcgtggtggaaatgtgaagtggcgagcattgaggttagatacaggaaactactcatggggaagtgaagctgtaacaagaaagacacgtatcttggatgtggtttacaatgcatcaaacaatgaattggtgaggacacaaacactagtgaagagtgctattgttcaagttgatgctgcacctttcaaacaatggtaccttcagcactatggagttgacattggtcgaaagaagaaagctccagctgcttctgctgctaagaaagatggagaggaagtagaaggtgctactgaggagacaaaaaagagcaatcatgttgctaggaagatagagaagcgtcaagaggaacgcaaactggacccacatgttgaagagcaattttcaagtggtcgtttattggctgccgtttcatcacgccctggccaatgtggtcgtgctgatggatatattttggagggaaaagagcttgagttttacatgaagaaactccagaagaagaaaggaaagggtgctgcttaaattgtttttaatatgcttatttttattcagtttgagttttaatagattttatctttctttttttaccctgtgaaagccttgaaactgaaattttgacgttttaaaatgttgtttttgaatgttaagtctatgtaaggtttactctacttcttatcgataccagtagtactacaactattgattcaaacacgtaattattctatattattatgcaaa

SEQ ID NO: 6760 - DNA, 966 bp, Arachis hypogaea
gggggggaaggtggtagcaggagaggcgatgcgcgttttggttcagccaagatgggtatttccagggattctatgcacaagaggcgcgccactggtggcaagaagaaggtttggaggaagaagaggagtatgagcttgggcgccagccagccaacactaagttatcgagcaataagacggtcaggaggattcgtgttagaggtggcaatgtgaagtggagggcattgaggttggataccggaaactattcatggggaagtgaagctgtgactcgcaagactcgtattcttgatgttgtttacaatgcctcaaacaatgagctcgtgagaactcagactcttgtcaagagtgccattgttcaggttgatgctgccccattcaagcagtggtaccttcagcattatggtgttgatattggcaggaagaagaaaacagctgctgccaagaaggatgctgaggaaggtgagacccccacggaggaagccaagaaaagcaaccatgtgcagagaaaaatcgagaaacgtcagaaagatcgtaagcttgatccccatattgaagagcagtttggtggtgggagattgctggcttgcattgcttctcgacctggtcaatgtggcagggctgacggctatattttggaaggtaaggagcttgaattttacatgaagaaaatccagaagaagaagggaaagggtgctgcctaattgttctattctcatacttgtattatggatttattcgtttttgttggggattggttccattcttggtgatttttgcaccgtcatcaccttctgaatgaagccataacacgttagtgtgacttaacgcgtatgttccttttgtttttgttttttttcttcttaaattatgagtactagtaattttcatcaaaatgttttgaattgatagataatacttcgcttaattatattggcagatcaagttagagatgcataaggatat

SEQ ID NO: 6761 - DNA, 909 bp, Arachis hypogaea
gtgcttttgaatcagccaagatgggtatttccagggattctatgcacaagaggcgcgccactggtggcaagaagaaggtttggaggaagaagagaagtatgagcttggacgccaaccagccaacactaagctatcgagcaataagacggtcaggcggattcgtgttagaggtggcaatgtgaagtggagggcattgaggttggatacaggaaactattcgtggggaagtgaagctgtgacgcgcaagactcgtattcttgatgttgtttacaatgcctccaacaacgagctcgtgagaactcagacccttgtcaagagtgccattgttcaggttgatgctgctccattcaagcagtggtaccttcagcattatggtgttgatattggcaggaagaagaaaacagcagctgccaagaaggatgctgccgaggaaggtgagacccctgcagaggaagccaagaaaagcaaccatgtgcaaagaaaaatcgagaaacgccagaaagatcgcaaacttgatccccatattgaagagcagtttggtggtgggagattgctggcttgcattgcttctcgacctggtcaatgtggcagggctgacggctacattttggaaggtaaggagcttgaattttacatgaagaaaatccagaaaaagaagggaaagggtgctgcttagttgtacttttctcgtacttgtattttggaattagttgtctctgttggagattggttccattctgggtgatgtttcaccgtcatcaccttctgagtgaagccatggcactttagtgtgacttaatgcgaatcatagttttgttttaaatgtgttttttcatttcttttcttttttggttattgatgagaactagtagtttcctcaaatgttttgaaattgatattcatgataac

SEQ ID NO: 6762 - DNA, 972 bp, Arachis hypogaea
gtgcttttggttcaaccaagatgggtatttccagggattctatgcacaagaggcgcgccactggtggcaagaagaaggtttggaggaagaagagaagtatgagcttggacgccagccagccaacactaagttatcgagcaacaagacggtcaggaggattcgtgtaagaggtggcaatgtgaagtggagggcattgaggttggatacaggaaactattcgtggggtagtgaagctgtgactcgcaagactcgtattcttgatgttgtttacaatgcctcaaacaatgagctcgtgagaactcagacccttgtcaagagtgccattgttcaggtggatgctgctccgttcaagcagtggtaccttcagcattatggtgttgatattggcaggaagaagaaaacagcagctgccaagaaggatgctgccgaggaaggtgagacccccgcagaggaagccaagaaaagcaaccacgttcagagaaaaatcgagaaacgccagaaagatcgtaagcttgatccccatattgaagagcagtttggtggtgggagattgctggcttgcattgcttctcgacctgggcaatgtggcagggctgatggctatattttggaaggtaaggagcttgagttttacatgaagaaaatccagaagaagaagggaaagggtgctgcctaattattctattctcacacttgtattttggatttggtcgtctctgttggagattggttacattcttggtgatttttcaccgtcatcaccttctgaatgaagccattacttgttagtgtgacctaatgcgaaattttgttcttttttggaagattactagtaattttcagtaaaaagttttgaaattgatattgatggatggataacctcgcttaattatgttgtcaaatcaagataataatgtgcgtaatgcctttttcttccataaacataattttgaccaaaaaaaaaaaaaaaaa

SEQ ID NO: 6763 - DNA, 922 bp, Arachis hypogaea
gtgcttttggttcagccaagatgggtatttccagggattctatgcacaagaggcgcgccactggtggcaagaagaaggtttggaggaagaagagaagtatgagcttggacgccagccagccaacaccaagttatcgagcaataagacggtcaggaggattcgtgttagaggtggcaatgtgaagtggagggcattgaggttggatacaggaaactattcgtggggtagtgaagctgtgactcgcaagactcgtattcttgatgttgtttataatgcctcaaacaatgagctcgtgagaactcagacccttgtcaagagtgccattgttcaagttgatgctgctccattcaagcagtggtaccttcagcattatggtgttgatattggtaggaagaagaaaacagcagctgccaagaaggatgctgccgaggaaggtgagaccccggccgaggaagccaagaaaagcaaccatgtgcagagaaaaatcgagaaacgccagaaagatcgtaagcttgatccccatattgaagaacagtttggtggtgggagattgctggcctgcattgcttctcgacctggtcaatgtggcagggctgacggctatattttggaaggtaaggagcttgaattttatatgaagaaaatccagaagaagaagggaaagggtgctgcttaattgttctattctcatacttgtattttggatttggtcgtttctgttggagaatggctccattcttggtgatttttcaccgtcatcaccttctgaatgaagccatagcacatgttagtgtgacctaatgcgtaattttatttattttggaagagtactagtaattttcattaaaaatgttttgaaattgatattgatggataacctcgcttagttatattgtcaaatcaagataataatgtgcgtaat

SEQ ID NO: 6764 - DNA, 909 bp, Tripterygium wilfordii
tctttatcggactccgctttctgaagccgtagtctcttgttggagagtgaagactcgggaggagaaggaagccatcggcctcctctgcgaaaatgggtatttctcgtgattctatgcacaagaggcgttccactggaggcaagaagaaggcttggaggaagaagagaaagtatgagcttggaaggcaatctgccaatactaagctgtcaagcaacaaaacagttaggaggattagggtccgaggtggaaatgtgaagtggcgtgctttgaggctcgatacaggaaactactcctggggaagtgaggctgtgacccggaaaactcgtattcttgatgtggtgtacaatgcatccaacaatgagcttgtccgaactcagactttggttaagagtgctattgttcaggtagatgctgcccctttctaagcagtggtatctccagcactatggagtcgacattgggcgtaggaaaaaaggtgcagcttctgctaagaaggaaggagaggaaggtgatgctgctgccgctgccactgaggaggctaagaagagtaaccatgtactgaggaagcttgaaaagcgccaacagaatcgcaagcttgatcagcatattgaagaacaatttggaagtggccgtttaatggcttgcatctcatcacgacctgggcagtgtggccgtgctgatggatatatcttggagggcaaagagctcgagttttacatgaagaagattcagaggaagaagggcaagggctctggtgctgcctaaaattttgctagccagatcttatccctggattaatttcttctctcgtttacccattctgtttaggaatgaaacttggaatgagatatacagttaaatttgaagcgtgaagttgtgttgaattgtcaagttagagctttatgaatt

SEQ ID NO: 6765 - DNA, 908 bp, Arachis hypogaea
ctccgttgttattctgctgagtaaccagcagcggcaccttcgacttccaaaatgggtatctctcgtgattctatgcacaagaggcgcgccactggtggcaagaagaaggtttggaggaagaagagaaagtatgagcttggaaggcaaccagcaaacacaaagctctccagcaacaaaactgttaggaggatcagggttcgaggtgggaatgtaaaatggcgtgctttgaggcttgacactgggaactactcttggggtagtgaagctgtgactcgcaaaacgaggattctcgatgtggtgtataatgcatccaacaatgaacttgttcgaactcagactttggtcaagagtgccatcgtccaggttgatgctgcacctttcaaacaatggtatctccagcattatggtgtcgacattggtcgcaagaagaagagtgcaacttctggcaagaaagaaggggaggatgctgaaactgcaaccgaagaagtgaagaagagtaaccatgtcttgagaaagttggagaagcgtaaacaaacccgggtgcttgatcctcacattgaagaacaatttggaagtggtcgcctcttggctagtatctcatcccgccccggtcaatgtggtcgtgctgatggatatatattggagggcaaagagcttgagttctacatgaagaagcttcagaaaaagaagggcaagggtgctgcttaagatgttgtatttcctcctttttagttttctttgaattatcttgttgaaactattacatcttagacaatcaaggtgatcattttgctagaatgtctactttctatgggttgttttggtagtgatgttgggttgtaaacaaaaccctgaactttgaactgtttaatgatattgatagtgagtcctatttaaattaaaaaaaa

SEQ ID NO: 6766 - DNA, 1042 bp, Manihot esculenta
aggagcagctcagcgagaggaagtgtagcactctacggcgcagccaagatgggtatctccagggactccatgcacaagagacgtgccactggtggcaagaagaaggcttggaggaagaagagaaagtatgagcttggtcgtcagcctgcaaatactaagctatcaagcaacaagacagtaaggagaattcgagttagaggaggcaatgttaagtggagagccctgagattggacacaggaaattattcttggggtagtgaggctgtcacccgcaagactcgtattcttgatgtggtttacaatgcctcaaacaatgagcttgttaggacacaaactttggtgaagagtgcaattgttcaagttgatgctgctccatttaaacaatggtatcttcagcactatggtgttgacattggcaggaagaagaagactgctgtgaagaaggaaacttctgaggaaggagaaggtgctactgccactgctactgcagaggaaaccaagaaaagcaaccatgttcaaaggaagcttgagaaacgccagaaagaccgtaagcttgattcccatatagaagagcagtttggtggtggtagattgttagcctgcatctcatcccgtcctggtcagtgtggcagagctgacgggtacatattggaaggtaaggagctggagttctatatgaagaagatccagaggaagaagggcaagggtgcaggtgctgcataaatatcaagtttgtcaagttttgctgcccactgtttgggttatttagttttggttccttcgagttttagaatgtgatttgatgcccaatcgaagcctattcaaatgatgcacattctggttaagggccgttagtgtcaacttgttactttttcttattcacataatttcactgttttgctttaaatattgtcggcattgacttttcacttcagtgtgcttcattaggtatgtcgttcttttggttcaaggactaaaaattgttctaattataattcatgattaccaatgaaaacataatggaaatttttttatttaaagc

SEQ ID NO: 6767 - DNA, 887 bp, Gossypium hirsutum
cagtggctgtgagcgtaagacgaaagagagcaattgaaacagttctttgcgccgctcagccaacatgggtatttccagggattccatgcacaagaggcgtgccactggtggcaagaagaaggcttggaggaagaagcgaaagtatgaacttggtcgtcagccagcaaatactaagctctctagcaacaagactgtaaggagaatccgtgttagaggaggcaatgtgaagtggagggcattgagattggatacaggcaactattcatggggtagcgaagctgtcacccgcaagacccgtattcttgatgtggtatataatgcctcaaacaatgagcttgtcaggacacagaccctcgtaaagagtgctattgttcaagtggatgctgctccctttaagcaatggtaccttcaacactatggtgttgatattgggaggaagaagaagacagcagctaagaaggaagctactgaggagggagaagttgctgtcgaggaaactaagaagagtaaccatgtgcaaaggaagcatgagaagcgccagaaggaacgtacacttgatgctcacattgaagaacaatttggctctggtagattgttggcatgcatttcttcccggccaggtcaatgtggcagagctgatggatacatattggagggtaaagagctagaattctatatgaagaaaatccaaaggaagaagggcaagggcgctggagctgcttagatgcagtatttcaaatggtctactctctcatcaatgtggtttttgttgcctttaaattgtgttctctttattttcctacaattgaggatatggtacatttttattgtgaactctttaggcatttgttcaagtccgttaaattgtgctgttcttttaatcaaaa

SEQ ID NO: 6768 - DNA, 990 bp, Vinca minor
gaacagagacccgccgccgtctcgtctacttcagccgtagcagcaacgccgccaccaccaccgtcgcaagcatgggtatttctcgagattccatgcacaagagacgtgcgactggtggcaagaagaaggcctggaggaagaagagaaagtatgagcttggccgtcagcctgctaatacgaaactctctagcaacaagactgtgaggagaattcgtgttagaggaggcaatgtcaagtggagggcccttagattggacactggaaactactcttggggaagtgaggctataacccgtaaaactcgtatcctcgatgtggtctacaatgcctcaaacaatgagcttgtgagaactcaaacattggtgaaaagtgccatagttcaggtggatgctgcaccattcaagcaatggtaccttcagcactatggtgttgatattggtagaaagaagaaggcagcagctgctgctaagaaggaaggagaggaggctgaaggtggtgcagccacagaggaagccaagaagagcagcaatcatgtccagaggaagattgagaaacgccaaaaagatcgtacactggaccctcacattgaggagcagtttggctctggtaggttgttggcatgcatttcatcccgtccaggtcaatgtggcaggtctgatgggtatatcttggaaggaaaagaacttgaattttacatgaagaaattacagaggaagaagggcaagagtgccagtgccgcctagacaccggtggacatcagctcttatttgtttgagttagatgcattagtccataagtttattgatttaagttccaagtatgaatggagtgcctgtaacctatacgaaacttgcaaattttgctttccaggctaagttagacttagttctgtgacctgtatggttggttttaggtttcgtttgaaatatgatatatttctttttgcgatcgatgtataagccaacaatttaagggttgcttattatagaa

SEQ ID NO: 6769 - DNA, 886 bp, Arabidopsis lyrata
gccattcttaaacctctgaagctcgtgagaacaaaaagcttgaatcaaacgcttttgaaatcatgggtatctctcgtgattcaattcacaagagacgtgccactggtggtaagcagaagatgtggagaaagaagagaaagtatgagcttggaagacaaccagctaacactaagctgtcaagtaacaagacagtgaggaggatccgtgtgcgtggtgggaatgtaaagtggagagctttgaggctcgatactggaaacttctcgtggggaagtgaagctgtgacccgtaagactaggatcttggatgtggcttacaatgcatcaaacaatgagcttgttcgtacacaaactcttgtgaagagtgctattgttctagttgatgccgctccctttaaacaagggtatctccaacactatggagttgatattggtcgcaagaagaaagctgctgcagccaagaaagaaggagaggaaggagatgcagtaaccactgaggaagtaaagaagagcaatcatattcaaaggaagctggagatgcgacaagaaggccgagcacttgactcgcaccttgaagagcagtttagcagtggaaggttgcttgcatgtatcgcatcaagacccggacaaagtggccgtgctgatgggtacatattggaaggaaaagagctcgaattctacatgaagaaacttcaaaaaaagaagggcaagaatgctggtgctgcataagaaacaaacacattttttattctagtaacttaacgtttttgatcttgatagttgaaaagccttatttattcttttgttgagtttagagtttgcattgagagatcttcatgtttatggatattgatcatttatagtcaaatttcgcaaattccattgaataa

SEQ ID NO: 6770 - DNA, 887 bp, Gerbera hybrid cultivar
gctcgaactgccaaactctggttttctcctgcagaggtcgatttcagaggcgcatctaaaccctagaggaggatccttcgtgacctgcaaacatgggtatctctcgtgattcgatgcacaagagacgtgccaccggtggcaagcagaagacctggagaaaaaagcgaaagtacgagctcggaagacagccagccaacactaaaatatcgagcaacaagactgttcggagggtgagggtccgtggtggtaacgttaagtggcgtgccttgaggttggacacaggtaactactcttggggtagtgaggctgtcacccgaaagacgcgaatcttggatgtggtttacaatgcatcaaacaatgagttggtcaggacccagactctagttaagagtgcaattgttcaagttgatgctgcgccttttaaacaatggtatcttcaacactatggagttgacattggccgcaagaagaaagtggctgctgctgctaccaagaaggagggagaggaagcagaaggtgctaccgaggagaccaagaagagtaatcatgttgtgaggaagctggagaagcgtcaagaggaacgcaaacttgactcacacgttgaagagcaattctctagtggtcgtcttttagcagccatttcttcacgtcctggccagtgtggacgtgctgatggatacatcttggagggaaaagagcttgaattttacatgaagaagctccagaagaagaaagggaaaagtgctggtgctgcttaaaaccattttggtttatttttataggttaaagtttgtttttgcatggaactcagattttgatgtgttttgttgatcaacttttgtgaaatgttgtggacttggaagtataacttatggatactagcccta

SEQ ID NO: 6771 - DNA, 1108 bp, Populus trichocarpa
gtaatttaaacgaactagggttttaaaagcctcagtcccttccagtcgtctcgtctcaaaccgtagcaccagcagctctgtgcagagaaacctcaaaatcttatctctgcaaaaatggggatttctcgtgattctatgcacaagaggagggcgactggaggaaagaagaaagcctggagaaagaagagaaagtatgagctcggaaggcaacctgcaagcactaagctctctagcaacaagacagtgaggaggattcgggttcgaggaggaaatgtgaagtggcgtgctctgagacttgatactggaaactactcatgggggagtgaggctgtgaccagaaagaccaggattcttgatgtggtgtacaatgcatctaacaatgagttggtccgtactcagactttggtgaagagtgccattgttcaggttgatgctgcacctttcaagcagtggtatctccagcactatggtgtggacattggtcgcaagaagaaaaccgcaccagctgccaagaaggaaggagaggatggtgaggctgctgttgaggaggagaagaagagcaagcatgtccagagaaagctggagaagagacaacagactcgcaagcttgacccacatatcgaagaacaatttggtggtggtcgtttgctagcttctatttcatcacgtcctggtcagtgtgggcgtgctgatggatacatcttggagggcaaagagttggagttttacatgaagaagatacaaaggaagaagggcaagggagctggggctgcctagagttatgttatttgaattttcttttcacatcagttatctattttcaccttattttacttcattttggatttgcaacttatgatgggaaattaaacttcaagctagacctgtcatttgaatttttagtagaatatttggtgtcgtgcacctcacattaagattgtcgtgtgttgagttgaatgatgatgggcttcttagcggaatcctactcctgacctggtaactagtcgtcgttatacctgtgcttgcacgagattgatccgaatcattcatatacatgatgcgatacacttgaaatcatgcatttgctaagctatagaatggattctct

SEQ ID NO: 6772 - DNA, 963 bp, Tabernaemontana elegans
cttgagagaacagagaccgccgtctcgtctactgcagccgtagcagcagcaccgccaccaccgtcgcaaccatgggtatttctcgagattcaatgcacaagagacgtgccactggtggaaagaagaaggcctggaggaagaagaggaagtatgagcttggtcgtcagcctgctaatacaaagctgtctagcaacaagactgtaaggagagtccgtgttagaggagggaatgttaagtggagggcccttagattggatactggaaactactcttggggaagtgaagccgtaacccgcaaaactcgtattcttgatgtggtctacaatgcctcaaataatgagcttgtgagaactcaaacacttgtgaaaagtgccatagttcaggtggatgctgccccattcaagcaatggtacgttcagcactatggtgttgatattggtaggaagaagaaggcagcagctactaagaaggaaggagaggagggtgaaggcactgcagccacagaggaaaccaagaaaagtaatcatgttctcaggaagcttgagaagcgccaaaaagatcgtaagcttgatgctcacattgaggagcagtttggctctggtagattgctggcttgcatttcatcccgcccaggtcaatgtggcagggctgatggatatatcttggaaggaaaggaacttgaattttatatgaagaaaatacagaggaagaagggcaagagtgctggtgctgcctagacaccaatggacttcagctctcatctgtctgatgcattagttcgtatgtttcttgctttctgttctattagtatcaatccggcgtcttgtaaccaatacaaaacttgaaaattttgtttccgtgctagaagctagactactttcggtgacctttatgtttgatctttagttttggttgagatatgatgatgcttgttttgctttcaatctcataaaatatttggta

SEQ ID NO: 6773 - DNA, 894 bp, Vinca minor
gagtgaaagagagactctttgagggaccttagagagacccgccgccgtctcgtccacttcagccgtcgctgcaccgcagctaccaccgtcgcaaccatgggtatttctcgggattccatgcataagagacgcgagactggtggcaagaagaaggcctggaggaagaagagaaagtacgagcttggacgtcagcctgcaaataccaaactctctagcaacaaaactgtgaggagaattcgtgttagaggagggaatgtcaagtggagggcccttagattggatactggaaactactcttggggaagtgaggctgtaacccgcaaaactcgtatcctcgatgtggtctacaatgcctcaaacaatgagcttgtcagaactcaaacattggtgaaaagtgccataattcaggtggatgctgcaccatttaagcaatggtaccttcagcactatggcgttgatattggtaggaagaagaaggcagcaactgctaagaaggaaggggaggaggctgaaggtgttgcagccgccacagaggaagccaagaagagcaaccatgtccaaaggaagattgagaaacgccaaaaagatcgtactcttgaccctcatattgaggagcagtttggctctggtagattgttggcatgcatttcatcccgtcctggtcaatgtggcaggtctgatggatatattttggaaggaaaggaacttgaattttatatgaagaaattacagaaaaagaagggcaagagtgcgggtactgcctagacacaaatggacttcattctctcatctgagttatatgcatagtccataagtttattgcttttaattctagtgtgcgctgtttcctgtaaccaaatacgaaactttaagttagactacctgtatgtttgg

SEQ ID NO: 6774 - DNA, 796 bp, Vinca minor
gagaccgtcgtcgcctccactacttcaaccgttgagcaccaccacaaccaccaccgtcacaaccatgggtatttctcgagattcaatgcataagagacgtgccactggtggcaagaagaaggcctggaggaagaagagaaagtacgagctcggacgtcagcctgctaataccaaactctccagcaacaagacggtgaggagaattcgtgtcagaggaggcaatgtcaagtggagggcccttagattggatactggaaacttttcatggggaagtgaggctgtaacccgcaaaactcgtttactcgatgtggtctacaatgcctcaaacaatgagcttgtgagaactcaaacattggtgaaaagtgccataattcaggtcgatgctgcgccattcaagcattggtaccttcagcactatggtgtggatattggtaggaagaaaaaggcaactgctactaagaaggaaggagaggaggctgaaggcgctgcagccacagaggaaaccaagaaaagcaaccatgtccagaggaagattgagaaacgccaaaaagatcgtgcacttgaccctcacatagaggatcagtttggttctggtaggttgtttgcatgcatttcatcccgtccgggtcaatgtggcagggctgacgggtatatcttggaaggaaaggaacttgaattttatatgaagaaattacagaggaagaagggcaagagtgctggtgctgcctagacaccattggacttcagcgccttttcgagttagatgcattactccctaagtttcttgctttcagtt

SEQ ID NO: 6775 - DNA, 962 bp, Phaseolus vulgaris
ggggagccaagaagcagagagatacacagagtgtgttgttgttgcttcttcgccacaactcaacaacatgggtatctccagagattctatgcacaagaggcgtgccactggtggcaagaagaaggcatggaggaagaagagaaagtatgagcttggtcgccagcctgctaacactaagctgtcaagcaacaagacagtcaggaggattcgtgttagaggtggcaatgttaagtggagggcacttaggttggatactggaaattactcctggggaagtgaagctgtaactcgcaagacgcgtatacttgatgtggtatacaatgcctcaaacaatgagcttgtgcgtactcagactcttgtcaaaagtgctattgttcaggttgatgctgctccattcaaacagtggtatcttcagcactatggtcttgacattggtaggaagaagaagacagctgccaagaaggattctgccgaggagggtgacgctgcagcagcagaagaagccaaaaagagtaaccatgtgcaaagaaaactggagaaacgccagaaggatcgcaagcttgatgctcacattgaggagcagtttgccggtgggcgtttgcttgcttgcatttcctctcgccctggtcaatgtggcagatgtgacggctacatcttggaaggtaaagagttggaattttacatgaagaaactccagaagaagaagggcaagggcgctgcctgattttagtttttcccaaatttttatatatggctttagtcgtttttatttgttgctggtaccattcatgctgatgttttgtgccacaggacatcatttagtgcaaactatcatcttagtattttgcaaattgacacttaattttgttttgaattgtttttgctacccatgagttacaatttttattaatgaattccttgcaatccttattaatgggagtattcagggagggtgttttcaa

SEQ ID NO: 6776 - DNA, 811 bp, Arnica chamissonis
ccctagttttctctcagaggcgaagtggtatccatcgttatctgcaaacatgggtatctctcgtgattcgatgcacaagagacgtgccaccggtggcaagaagaaggcatggagaaagaagagaaagtatgagcttggccgtcaaccggcaaacactaaaatatccagcaacaagactgttagaagggttagagttcgaggtggcaatgtgaaatggcgtgcattgaggttagatacaggcaactactcctgggggagtgaggctgtaacccgaaagacccgtattttggatgtggtgtacaatgcatcaaacaatgagctggtcaggactcaaaccctagtgaaaagtgcaattgttcaagttgacgctgcaccatttaaacaatggtatttgcaacactatggtgttgatattggtcgcaagaagaaagcggcatctactgctaccaagaaagaaggcgaggaagtagaaaccgccactgaggaggcaaagaagagcaatcatgtagtgaggaaattggagaaacgtcaagaggagcgtaaacttgaccctcacgttgaggagcagttttcaagtggtcgtcttttggctgctatttcatcacgtccaggccaatgtggccgggctgacggatacattttggaaggcaaggagcttgagttctacatgaagaagcttcagaagaagaaaggaaagggtgctgcttaaacccttttggcttattctgcaaattttgatgtgttctgtttgttaaaatgttaacacttgtatgaaagctgcttaaggctccttgtaaactttatcttttat

SEQ ID NO: 6777 - DNA, 1269 bp, Hordeum vulgare
gtaaaccctaagcccggacgtcgtcctatttaatcccacctcttagggttctcttcctccctcctccgagaccaaaccaaagctgcggcggcgcgggcataggaggcgaagcagcagcggagccaagcaaccgacgccaccatgggtatctcgcgtgactccatgcacaagcgccgggccaccggtgggaagcagaaggcatggaggaagaagcgaaagtatgagcttggccgccagcctgccaacactaagctttcgagcaacaagacagtgaggagggtccgtgttcgtggaggtaatgtgaaatggagggctctccgtctggacactggtaacttctcatggggtagtgaggccacaacccgcaagacccgtctcctggatgtggtttacaattcgtcaaacaatgagcttgtgaggactcagacccttgtgaagaatgccattgtgcaagttgatgctgcccctttcaagcagtggtacctgactcattatggagtggaaatcggtaggaagaagaaagctgctgccgctgccaaaaaggatgctgctgaggggcaagaggctgaggttgctgctgctgccacagaggaagcaaagaagagcaacaaagtccagaggaagcttgagaagcgtcagcaggggcgcactctggactcacacattgaggagcagttcagcggtggaaggttgctggcttgcatttcgtctcgccctgggcagtgtgggagagctgatgggtacatccttgagggcaaggagctggagttctacatgaggaagctccagaagaagaagggcaagggtgccacagcataggcgctgaagagctgcatgttactcgttgggttttcttagttgttgcgtcaatgtctgtttacagacatactgaacaccattttctgtaaacggttccggtctaggttgaactgagaatgttttgcctgctttggttgtgacctaaagctatcgagattctattatgtgttccgtcctaaagtattttcatctgttcagtgaagttttgttcttgcttctccatgttgatttgctgccgattttactgtttgatttgtgtcccttaatcctgtaagcaaggaaatttcaatcatggaatttttgcccaaacggtgcttgtttctaagatagacggcggcaatcttcgaataaggagaaacgtgcttcgtgcttgtttggccagcagctcaggcggcctaatccttcgaatctccgaccctacccacattaggcgtcttacgcgtctctctg

SEQ ID NO: 6778 - DNA, 1102 bp, Phaseolus vulgaris
agtggaggtggatcagcaaaaaagtagggttccgtgtgtgttaaaatatataaggcgaaatattagggtttttccagtgagccaagaagcagagagatacaatacagagtgtgttgttgttgcttcttcgccacaactcaacaacatgggtatctccagagattctatgcacaagaggcgtgccactggtggcaagaagaaggcatggaggaagaagagaaagtatgagcttggtcgccagcctgctaacactaagctgtcaagcaacaagacagtcaggaggattcgtgttagaggtggcaatgttaagtggagggcacttaggttggatactggaaattactcctggggaagtgaagctgtaactcgcaagacgcgtatacttgatgtggtatacaatgcctcaaacaatgagcttgtgcgtactcagactcttgtcaaaagtgctattgttcaggttgatgctgctccattcaaacagtggtatcttcagcactatggtcttgacattggtaggaagaagaagacagctgccaagaaggattctgccgaggagggtgacgctgcagcagcagaagaagccaaaaagagtaaccatgtgcaaagaaaactggagaaacgccagaaggatcgcaagcttgatgctcacattgaggagcagtttgccggtgggcgtttgcttgcttgcatttcctctcgccctggtcaatgtggcagatgtgacggctacatcttggaaggtaaagagttggaattttacatgaagaaactccagaagaagaagggcaagggcgctgcctgattttagtttttcccaaatttttatatatggctttagtcgtttttatttgttgctggtaccattcatgctgatgttttgtgccacaggacatcatttagtgcaaactatcatcttagtattttgcaaattgacacttaattttgttttgaattgtttttgctacccatgagttacaatttttattaatgaattccttgcaatccttattaatgggagtattcagggagggtgttttcaatgactataaatgtgcaataggtatttaaatatatgcctcatttttgaaataactagtattat

SEQ ID NO: 6779 - DNA, 1008 bp, Beta vulgaris
gttaataccttcaaaggctaaatagccgaaaccctaatttcttcttcatctcaactgcgcaaaaatgggtatttctcgtgattctatgcacaagagacgtgccactggtggcaagaagaaggcgtggaggaagaagagaaagtacgagctcgggagacagcctgctaacacaaagctgtcgagcaacaagacagttagacgggttagggttcgtggtggtaatgtgaagtggcgtgcattgaggttggatactggaaatttctcatggggtagtgaggctgtgactcgcaagacccgtctcttggacgtcgtttacaatgcatccaacaatgagttggttaggacacagactttggtgaaaagtgccattgtccaggttgatgctgcaccatttaagcaatggtatcttcagcactatggagttgaaattggacgcaagaagaaggctgctgcatctgctaagaaagaagctgaggagggtgagaccacagaggaagccaaaaagagcaaccatgttgcaagaaagctagagaagcgtcagcagactcgtactttggacgctcacatcgaagaacaatttggtggtggtcgtctattagcctgcatttcatcccgccctggtcaatgtggccgtgctgatggatacatcttggaaggcaaagagctggaattctacatgaagaaaatccagaggaagaagggcaaggcagctgcttaagtttcgctatatttatagtcagcttcgagagttctcttcatttttttcggttggtcctagtcttctctagtttaactcaatgggaattcttccaaaacgtttttgtaatcagtagtgtgatactttcatatttacgttaccttgagttgaaaagtttttggctctcatttctctcctgttttctgtttcatggttgagctatataacaagtgatatatgaaatttttggggacatacgtttaagaaagatatgatattctagaattcgagcggggtaataccgaagggcg

SEQ ID NO: 6780 - DNA, 960 bp, Cyamopsis tetragonoloba
cacgaggcacagaagtgaagcgagctagagagagagggagagaagagagagagtgtgcgtctctaacacttcgccaagatgggtatttctagggattccatgcacaagaggcgtgccactggtggcaagaagaaggcatggagaaaaaagagaaagtatgagcttggacgccagccagcaaataccaagttatcaagcaacaagacagtcagaagaattcgtgttagaggtggtaatgtgaaatggagagcattgaggttggacactggaaattactcgtggggaagtgaagcagtaacccgcaagactcgtattctagatgtggtttacaatgcctcaaacaatgagcttgtgcgaacccagaccctggtcaagagtgctattgttcaagttgatgctgcaccattcaagcagtggtaccttcaacactatggagttgatattggtaggaaaaagaaagcagcgtccaagaaggacactacagaggagggcgaagctgctgctgaagaaactaaaaagagtaaccatgtgcagaggaagcttgagaagcgccaaaaagagcgtaatcttgactcccacattgaagagcagtttggtggtggtcgattgctggcttgtatttcttctcggcccggtcaatgtggcagggctgatgggtacattctggaaggtaaggaactggaattttacatgaagaaactccagaggaagaagggaaagggtgcagcttaagtttagtgccttccaaatttctatatggcttaagtttttatttgagattttggtacaattcagattatgtagtacttttttggatgactttcggttgaccacccgtaggatgtgaaagttttacgccaatttcaaccaaaatttatttttaaccgctcacgatgttgaaaatttacatttttcctcaattgaatgtttagcatttttgttggttactattaaaaaaaa

SEQ ID NO: 6781 - DNA, 887 bp, Flaveria ramosissima
ttttagcaaaccctagctttctctttgagttcagaggcgcagttgtatccattgttatctgcaaacatgggtatctctcgtgattcgatgcacaagagacgtgccactggtggcaagaagaaggcctggagaaagaagcgaaagtatgagcttggtcgtcaaccagcaaacactaaaatatccagcaacaagactgttagaagggttagagtacgaggtggtaatgtgaaatggcgtgcattgaggttagatacaggtaactactcttgggggagtgaggctgtgacccgcaagacccgtattttggatgtggtttacaatgcatcaaacaatgagctggtcagaactcaaaccctggtgaagagtgctattgttcaggttgatgctgcaccatttaaacaatggtatctacaacactatggtgttgatatcggtcgcaagaagaaaggggcagcagctgctaccaagaaagagggagaggaagcagaaaccactactgaggaggcaaagaagagcaatcatgtagtgagaaaattagagaaacgtcaagaggatcgtaagcttgacccgcatgttgaggagcagttttcaagcggtcgcctgttggctgcaatctcatctcgtcccggccaatgtggtcgtgctgacggatacattttggagggtaaggagcttgagttctacatgaagaagcttcagaagaagaaaggaaagggtgctgcttaaaccttttaggtttattcagttttaatctcttgattttatttccttttttactctgcaagttttgatgtgttttgtttgttaaaatgttacaactcttatgaatgctgtactttaaggtttattagtaaacttcattcttttatctatactagttcaattgc

SEQ ID NO: 6782 - DNA, 803 bp, Flaveria ramosissima
tgggtatctctcgtgattccatgcacaagagacgtgcgactggtggaaagaagaaggcgtggaggaagaagcgaaagtatgagctcggaagacagccagccaataccaagatctccagcaacaagactgttaggagggttcgggttcgtggtggtaatgtgaagtggcgtgctcttaggttggacacaggtaactactcctggggaagtgaggctgtgactcgaaagacccgtattttggatgtggtttacaatgcatccaataatgagttggtcagaacccagacacttgtcaagagtgcaattgttcaggtggacgctgcacctttcaagcaatggtatcttcagcattatggtgttgaaatcggtcgcaagaagaaaaccgctgcttctgcaggcaagaaagagggagaggaagcagaaggtgcaacagaggaggccaaaaagagtaatcatgttgtgaggaaacttgaaaaacgtcaagaggaaaggaaactagacccccatgttgaagaacaattttccagtggtcgtcttctagctgccatctcatcacgccctggccagtgtggtcgtgctgatggatacatactggaagggaaagagcttgaattctacatgaagaaacttcagaagaagaaaggaaagggtgctgctgcttagaaccatatttccttatattagctttgtattttttatttattttcgagaatggcatgaccaatagctttgtcttttttgaatgttgactgtatttttgcgtttagtgtcatgaccttcaaatgacgtgtgtttgaataaacg

SEQ ID NO: 6783 - DNA, 900 bp, Flaveria ramosissima
ttcatcttttaactctactgaaccctaatactctttccgccattgaagtagctcgagctcataggtccgccataaaccctagaggatcatcctccttactctgcaaacatgggtatctctcgtgattcgatgcacaagagacgtgccactggtggcaagaagaaggcctggagaaagaagcgaaagtatgagcttggccgtcaaccagcaaacactaaaatatccagcaacaagactgttagaagggtcagagtacgaggtggtaatgtgaaatggcgtgcattgaggttagatacaggtaactactcttgggggagtgaggctgtgacccgcaagacccgtattttggatgtggtttacaatgcatcaaacaatgagctggttagaactcaaactctggtgaagagtgctattgttcaagttgatgctgcaccatttaaacaatggtatctacaacactatggtgttgatatcggtcgcaagaagaaaggggcagcagctgctaccaagaaagagggagaggaagcagaaaccactactgaggaggcaaagaagagcaatcatgtagtgagaaaattagagaaacgtcaagaggatcgtaaacttgaccctcatgttgaagagcagttttcaagtggtcgcctgttggctgcaatctcatctcgtcccggccaatgtggtcgtgctgacggatacattttggagggtaaggagcttgagttctacatgaagaagcttcagaagaagaaaggaaagggtgctgcttaaaccttttaggtttattcagtttatatcttgatttttatttccttttttactctgcaagttttgatgtgttttgtttgttaaaatgttacaactcttatgaatgctgcttaaggtttattgttaaactttttt

SEQ ID NO: 6784 - DNA, 1060 bp, Setaria italica
ctctcttccctgtgataccgaaccagaagagcggcggcgcgggcggaccaggaggaggcggagaaccagcagcggggaccaagtcaccgccgccaccatgggtatctcgcgtgactcgatgcacaagcgccgggccaccggtgggaagcagaaggcctggaggaagaagcgaaagtatgagctcggccgccagccagctaacaccaagttgtcaagcaacaagacggtgaggagggttcgtgtccgtggaggtaatgtgaagtggagggctctccgcctggatactggtaactactcatggggaagtgaggctgttacccgcaagacccgtatccttgatgtggtctacaatgcttcaaacaatgagctcgtgaggactcagaccctcgtgaagagcgccattgtgcaagttgatgctgccccattcaagcagtggtacctgacacactatggagtggacatcggtaggaagaagaaggcacctgctgccaagaaggatggtgctgagggacaagagggtgaggctgcagctgaggaaaccaagaagagcaaccatgtccagaggaagcttgagaagcgtaaggacggacgcgcacttgacccgcacatcgaggagcaatttggcagtggaaggcttttggcttgcattgcttcccgccctgggcagtgtggccgggctgatgggtacatccttgagggtaaggagcttgagttctacatgaagaagctccagaagaagaagggcaagggcgcagcagcttagaggcattctcatgcatgtttggaaggggtgacctatgaaatatttactctgggttttttttgttagttgtctcaagggcagagcatctatgtcgtatttgcagacctgatgagcacagtattttctaaaaatgaatcaactctagcgaagaactgagaattttcacctgccgtggttgtattctcgtaatatttaggttctatgttttgtttgtgctgcagcagtttctgtgtttagcagtttcgttttttatccatgagatggctgtggaaaatggtggatttcatgtttgacttt

SEQ ID NO: 6785 - DNA, 1038 bp, Setaria italica
cttccctgtgataccgaaccagaagagcggcggcgcgggcggaccaggaggaggcggagaaccagcagcggggaccaagtcaccgccgccaccatgggtatctcgcgtgactcgatgcacaagcgccgggccaccggtgggaagcagaaggcctggaggaagaagcgaaagtatgagctcggccgccagccagctaacaccaagttgtcaagcaacaagacggtgaggagggttcgtgtccgtggaggtaatgtgaagtggagggctctccgcctggatactggtaactactcatggggaagtgaggctgttacccgcaagacccgtatccttgatgtggtctacaatgcttcaaacaatgagctcgtgaggactcagaccctcgtgaagagcgccattgtgcaagttgatgctgccccattcaagcagtggtacctgacacactatggagtggacatcggtaggaagaagaaggcacctgctgccaagaaggatggtgctgagggacaagagggtgaggctgcagctgaggaaaccaagaagagcaaccatgtccagaggaagcttgagaagcgtaaggacggacgcgcacttgacccgcacatcgaggagcaatttggcagtggaaggcttttggcttgcattgcttcccgccctgggcagtgtggccgggctgatgggtacatccttgagggtaaggagcttgagttctacatgaagaagctccagaagaagaagggcaagggcgcagcagcttagaggcattctcatgcatgtttggaaggggtgacctatgaaatatttactctgggttttttttgttagttgtctcaagggcagagcatctatgtcgtatttgcagacctgatgagcacagtattttctaaaaatgaatcaactctagcgaagaactgagaattttcacctgccgtggttgtattctcgtaatatttaggttctatgttttgtttgtgctgcagcagtttctgtgtttagcagtttcgttttttatccatgagatggctgtggaaaatggtg

SEQ ID NO: 6786 - DNA, 746 bp, Citrus sinensis
aatagaggcagctagggttttagagcgggagcaaggagagagtacgttacagtgagcagcgccgcagcagcagctacagctcagccaagatgggtatttccagagattcaatgcataagagacgcgccactggtggcaagaagaaagcttggaggaagaagcgcaagtacgaacttggtcgtcagcctgcaaataccaagctctctagcaacaagactgtacggagaattcgtgtcagaggaggcaatgtgaagtggagggccctgagactggacactgggaactattcctggggtagcgaggctgtcacccgcaagacccgtatcctggatgttgtttacaatgcctctaataatgagctcgtcaggactcaaactctggtgaagagtgccattgtgcaagtggatgcagcgccttttaagcaatggtaccttcagcactatggcgttgacattggtaggaagaagaaggcagttaccaagaaggaaaccacagaggagggagaaggtgcagcagcagcagcagaagaaactaagaagagcaatcatgttgttaggaagcttgaaaagcgccagaaggaccgcacactcgatcctcacattgaagagcaatttggtgctggtaggttgttggcctgcatttcttcacggccaggtcaatgtggcagagctgatgggtacatactagaaggtaaggagctggaattttacatgaagaagctccagagaaagaagggcaagggtgca

SEQ ID NO: 6787 - DNA, 985 bp, Cajanus cajan
ttaaccaaagcaagggagcgagaggcattgttggttcttggttacaactctctctgccaacatgggtatttccagggattctatgcacaagaggcgtgccactggtggcaagaagaaggcctggaggaagaagagaaagtatgagcttggtcgtcagcctgctaacactaagctgtcaagcaataagacagtaaggaggatccgtgttagaggtggcaatgtgaaatggagggcactgagattggataccggaaattactcctggggaagtgaagctgtaactcgcaagactcgtatacttgatgtggtttacaatgcctcaaacaatgagcttgtgcggactcagacacttgtcaaaagtgctattgttcaggttgatgccgctccatttaaacagtggtaccttcagcactatggtgttgatattggtaggaaaaagaagtctgctgccaagaaggattctgccgaggagggtgatgctactgctgttgctactgcagaagaatccaaaaagagtaatcatgtgcagagaaaattggagaagcgccagaaggatcgaagtctcgatccccacattgaggagcagtttggtggtggtcgtttgcttgctagcatttcatctcgacccggtcaatgtggcagagctgatggctacattctggaaggtaaggagttggaattttacatgaagaaacttcaaagaaagaagggaaagggtgctgcttgattttagtgtttaccaaatttttatgtggctttagttgtttttatttgttgctggttccatttaaggggatgttttgtgctacaggacatcgtttagtgcgaactattttattagtcctttgcagattgacaattttgtttatccctctttcaatgaagaattttaaaagtttggttatttaagaatgattgtataattaactcaagggtttgtttattaggagcaaagtgagaaggttaagtttgatactatttgcac

SEQ ID NO: 6788 - DNA, 932 bp, Secale cereale
agcagcagcggagccaagcagccgacgccaccatgggtatctcgcgtgactccatgcacaagcgccgggccaccggcgggaagcagaaggcatggaggaagaaacgaaagtatgagctcggccgccagcctgccaacactaagctttcgagcaacaagacagtgaggagggtccgtgttcgtggaggtaacgtgaagtggagggctctccgtctggacactggtaacttctcatggggtagtgaggctgtgacccgcaagactcgtctcctggatgtggtttacaattcatcaaacaacgagcttgttagaactcagacccttgtcaagaatgccattgtgcaagtggatgctgcccctttcaagcagtggtacctgactcattatggagtggaaatcggtaggaagaagaaagctgctgcagctgctaagaaggatgctgctgctgagggacaagaggctgaggtagctgcagctgccacagaggaagcaaagaagagcaacaatgtccagaggaagcttgagaagcgtcagcagggacgcacactggactctcacattgaggagcagttcagcggtggaaggttgctggcctgcatttcatctcgccctggacagtgtggcagagctgatgggtacatcctggagggcaaggagctggagttctacatgaggaagctccagaagaagaagggcaagggtgccacagcttaggcggaagagctgctgcatgttactcttattttcttagttgttgcgtccatgtcatgtttgcagacatactgaacaccattttctgtaaacggtttgagtcctaggttgaactgagaatgttttgcctgctttggttgtgatctaaagatatccagattctattatgtgttagttaaaacaaaaaaaaaaaaaaaaaaaaaaaaaaaaaaaataaaaaaa

SEQ ID NO: 6789 - DNA, 1005 bp, Saccharum officinarum
tccatctgctcacctgccgtaccggttcgcaagtttcgggtcgagcgtcccgtcaaccagaagagcggcggcgcgggcggaccaggagtaggaggcggaggagcagcccagcgaagccaccgccgccaccatgggtatctcgcgtgactcgatgcacaagcgccgggccaccggtggaaagcaaaaggcctggaggaagaagcgaaagtatgagcttgggcgccagccggccaacaccaagttgtcaagcaacaagacagtgaggagggttcgtgttcgtggaggtaatgtgaagtggagggctcttcgcctggatactggtaactactcatggggaagtgaagctgttacccgtaagacccgtatcctcgacgtggtctacaatgcatcaaacaatgagcttgtgaggactcaaacccttgtgaagagtgccattgtgcaagttgatgctgccccattcaagcagtggtacctcactcactatggagttgacatcggtaggaagaaaaaggctcctgctgcaaagaaggaatctgctgagggacaagagggtgaggcagcagctgaggaaacaaagaagagcaaccatgtcaagaggaagcttgaggagcgtcagaagggacgtgagcttgacgctcacattgaagagcaatttggcagtggaaggttgctggcatgcatttcttcccgccctggacagtgtggccgagctgatgggtacatccttgagggtaaagagcttgagttctacatgaagaagcttcagcgcaagaagggcaagggcgctgcagcttagagcattctcatgtatgggaaggggcagggcgctgcagcttagagcattctcatggatggtcctccgctgaaatgtgtggcctattaaaatattactctggctttttttttgttagtcgtctcaagttcagtctatgtcatgttttgcagacctgatgagaatactgttttctgaaaatgaatcaacttatctagctcctaagaattgag

SEQ ID NO: 6790 - DNA, 749 bp, Helianthus annuus
ctttcacttttctcagaggcgcatcttcatctgcaaccatgggtatttcgagagattcgatgcacaagaggcgtgccactggtggcaagaagaaggcctggaggaagaagcgaaagtatgagcttggtcgtcaaccagcaaacaccaaaatctctagcaacaagactgttagaagggttagagttcgaggtggtaatgtgaaatggcgtgcattgagattagataccggaaactactcttggggtagtgaggctgtcacccgaaagacccgtattttggatgtggtctacaatgcatcaaacaatgagttggtcaggactcaaaccctagtgaaaagtgcaattgttcaagttgatgctgcgccatttaaacaatggtatttgcaacactatggtgttgatattggtcgcaagaagaaagcatccgtcactgctaccaagaaagagggagaggaagcagaagctgccgctgaggaggcaaaaaagagcaaccatgtggtgagaaagttggagaaacgtcaagaagagcgcaaacttgaccctcatgttgaagaacagttttcaagtggtcgtcttttggcagctatttcatcacgccctggccaatgtggtcgtgctgatggatatattttggagggtaaggagcttgaattctacatgaagaagctccagaaaaagaaaggaaagggtgctgcttaaagctttttaaggcttcttcagtttccatctttagatttgtattttcttttt

SEQ ID NO: 6791 - DNA, 1300 bp, Panicum virgatum
ccgcacgcacaccttctggtctcccttggaaacgggccaggtccgtgcaaaacagcgagggctctatccgtgggccgactagtagcccaggactgagctcacgggtgacgagttggcccagaaaccggcccagcacgccgcggagacggctcaactaaaccggatagggtttagtcctctctccagggggtgcggcgccaactccgcaggtataaatatcctcactgggcggagtctagggtttttagtcctctctccaggcggcgcctccacatctcgtctctcggatcgggaggcgaaaccaaggaggaagcggagcagaagcagccaggccagcccaccgccgccaccatgggtatctcgcgtgactcgatgcacaagcgccgggccaccggtgggaagcagaaggcctggaggaagaagcgaaagtacgagcttggccgtcagccagccaacaccaagttgtcaagcaacaagacggtgaggagggtccgtgtcagagggggtaatgtgaagtggagggctctccgcctggatactggtaactactcctggggaagtgaggctgttacccgcaagacccgtatccttgatgtggtctacaacgcgtcaaacaatgagctcgtgaggactcagacccttgtgaagagcgccattgtgcaggttgatgttgccccattcaagcagtggtacctaacacactatggagtggatatcggtaggaagaagaaggcagctgctgccaagaaggatgctgctgagggacaagagggtgaggctgcagctgaggaagcaaggaagagcaaccacgtccagaggaagcttgagaagcgtcagcaaggacgcacacttgacccccacattgaagagcaatttggcagtggaaggctgttggcgtgcatttcttcccgccctgggcagtgtggcagagctgacgggtacatccttgagggtaaagagctggagttctacatgaagaagctccagaggaagaagggcaagggtgctgcagcttagaggcattcttatggatgttctacactgagggtggcttttttgttagtattgtcaagcgcagtgtttaacgagcacaatattttctaaattgaatcaactaaactagctaagaattaagaattttcacctgtcatggttgcattctcgtgaggttctgttttcttgtgctgcaacagtttgtgtctagcagttgtggtttatctatgatatggctgtggaattggtgtgcttcctatttgattttactgagtgtttacaagccatcgagaaatttgaactgagc

SEQ ID NO: 6792 - DNA, 1120 bp, Triticum aestivum
ccttcctccttgcgagaccaaaccacagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttacttgttggattttcttagatgttgcgtccatgtcatgtttgcagacatactgaacaccattttctgtaaactgttcgagtcctaggttgaactgagaatgttttgcctgttttggttgtgatctaaagctatccagattctattatgtgttgttctaccttgcagtattttcatctgttcagtgaaattttgttctcgcatctccatgttgatttgatgcaagttttgccttccatgatgtagtttgatatgtgtggtttttgcagttgcaaatgaacttcatcgtatctgaattccttaattatggaagtatagtattttcccttgcgcttt

SEQ ID NO: 6793 - DNA, 793 bp, Flaveria ramosissima
cttaccaaaccctacgattctcttcgtcgaggttgggttcagaggcgcaggagcacccattgtgatctgcagacatgggtatctctcgtgattcgatgcacaagaggcgtgccactggtggcaagaagaaggcctggaggaagaagcgaaagtatgagcttggaagacagcctgcgaacactaaaatatccagcaacaagactgttagaagggttagggttagaggaggtaatgttaagtggcgtgcactgaggttagatacaggtaactactcttgggggagtgaggctgtaaccagaaagacccgtattttggatgtggtttacaatgcatcaaacaatgagttggtcaggactcaaactctagtgaaaagtgccattgttcaagttgatgctgcgccatttaaacaatggtatctacaacactatggtgttgatattggtcgcaagaagaaagcagcagctactgctacaaagaaagagggagaggaagtagaagctgccactgaggagacaaagaagagcaatcatgttgtgagaaaattggagaaacgtcaagaggagcgtaaacttgacccacatgtagaagagcaattttcaagtggccgtcttttggctgctatttcatcacgccccggcaatgcggtcgcgctgatggatacatattggaaggtaaggagcttgagttctacatgaagaagctccagaagaagaaaggaagggtgctgcttaagttatatttctttttcttgtttactctgcaaggcatggaaccaaaattttgatgtgttttg

SEQ ID NO: 6794 - DNA, 917 bp, Arachis hypogaea
ctccgttgttattctgctgagtaaccagcagcggcaccttcgacttccaaaatgggtatctctcgtgattctatgcacaagaggcgcgccactggtggcaagaagaaggtttggaggaagaagagaagtatgagcttggaaggcaaccagcaaacacaaagctctccagcaacaaaactgttaggaggatcagggttcgaggtgggaatgtaaaatggcgtgctttgaggcttgacactgggaactactcttggggtagtgaagctgtgactcgcaaaacgaggattctcgatgtggtgtataatgcctccaacaatgaacttgttcgaactcagactttggtcaagagtgccatcgtccaggttgatgctgcacctttcaaacaatggtatctccagcattatggtgtcgacattggtcgcaagaagaagagtgcaacttctggcaagaaagaaggggaggatgctgaaactgcaaccgaagaagtgaagaagagtaaccatgtcttgagaaagttggagaagcgtaaacaaacccgggtgcttgatcctcacattgaagaacaatttggaagtggtcgcctcttggctagtatctcatcccgccccggtcaatgtggtcgtgctgatggatatatattggagggcaaagagcttgagttctacatgaagaagcttcagaaaaagaagggcaagggtgctgcttaagatgttgtatttcctccattttagttttctttgaattatcttgttgaaactattacatcttagacaatcaaggtgatcattttgctagaatgtctactttctatgggttgttttggtagtgatgttgggttgtaaacaaaacccggaactttgaactgtttaatgatattgatagtgagtcctatttaaattaaattagcactgccatta

SEQ ID NO: 6795 - DNA, 875 bp, Secale cereale
agcagcagcggagccaagtccagtccgaacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgccccttgaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgttggcctgcattttgtctcgccctggacagtgtggcaaagctgatgggtacatcctggagggcaaggagctggagttttacatgaggaagctccagaaaaaaaagggcaagggtgccccagcttaggctgaaaagctgctgcatgttactcgttggatttttttagatgttgggtccatgtcatgtttgcagacatactgaaccccattttttgtaaacggttcgagtcctaggttgaactgagaatgttttgcctgttttggttgtgatttaaagctatccagattt

SEQ ID NO: 6796 - DNA, 827 bp, Panicum virgatum
cgcggccgccgccacctatataaacgaaccctcgtttcgctctcctcttccctgcgagacccaaccacaagagcggcggcgcgggcggaccaggaggaggccgcggagcagcaggagcagccgggcaaggccaccgctgccaccatgggtatctcgcgtgactcgatgcacaagcgccgggccaccggtgggaagcagaaggcctggaggaagaagcgaaagtatgagcttggccgccagccagccaacaccaagttgtcaagcaacaagacggtgaggagggtccgtgtccgaggaggtaatgtgaagtggagggctctccgcctggataccggtaactactcatggggtagtgaggctgttacccgcaagacccgtatcctggatgttgtctacaatgcgtcaaacaatgagcttgttcggacccagacccttgtgaagagcgccattgtgcaagttgatgctgccccattcaagcagtggtacctcactcactatggagtggacattggtaggaagaagaaggccccggctgctaagaaggatgctgcgagggtcaagagggtgaggccgcagctgaggaaaccaagaagagtaaccatgtccagaggaagcttgagaagcgccagcagggacgcacacttgacccgcacattgaggagcaatttggaagtggaaggttgttggcatgcattgcttctcgccctgggcagtgtggccgagctgacggttacatcattgagggtaaagagctcgagttctacatgaagaagctccagaggaagaagggcaagggtgccgcagcttagaagcaatatattgtctgg

SEQ ID NO: 6797 - DNA, 949 bp, Capsicum annuum
tgccgccgcagtgcgaaaatcaccggaaccctaagtatcttccgtcgccggcaaccatgggtatttctcgggattcgatgcacaagagacgtgctactggaggtaagaagaaggcatggaggaagaagagaaagtatgagatgggaaggcagtctgcaaatacaaagctggtgcataatgctaagactgttaggaggataagggtccgaggaggaaatgtgaagtggcgtgcgttgaggttggacactggaaactactcctggggcagtgaagctgttactaggaagacccgtttattggatgtggtgtacaacgcctcaaacaatgagttggttaggacacaaactcttgtgaagagcgctattgttcaggttgatgcggctccatttaagcagtggtacctccagcactatggtgttgaagttggtcgcaagaagaagagtgctgccaagaaggaaggagaggaggctcctgaggctgctgcagaggagaagaaaagtaaccatgtccaaagaaagctggaaaagcgtcaacaggatcgtaagattgacccacatgttgaagagcaatttgctagtggtcgtctattggctgcaatctcgtcacgacctggccaatgcggccgtgctgatggttacatcttggagggtaaggagttggagttttacatgaagaagctacagaaaaagaaaggaaagggtgcaagtggtgctactgcttaagatcataagttttatatcagtttgcttctgttattactcctcttgatagaatgagaattatgaacatctttatctattagatctggcaaacttttttgtaatgtgatgtcacgtgattttgaggacatgttcatctttgcatcacttatgttttctatttggctatatcattcagacaagtcttgtggtcattcaaccttctggtttatcattgttgagaatgttga

SEQ ID NO: 6798 - DNA, 944 bp, Solanum tuberosum
ggctaagctctcagcaaccatgggtatctcaagagattctatgcacaagagacgtgccactggtggcaagcagaaaacttggaggaagaagcgaaagtacgagcttggacgccaatcagctaataccaagatttccagtaacaagacagtcagacgaattcgtgtgcgaggtggtaatgtgaagtggagggcactgagattggatacaggaaactattcatggggtagtgaggcagtcacacgcaagactcgtatccttgatgtggtttacaatgcctcgaacaatgagcttgtccgcacacaaactcttgtcaagagtgcaatcgttcaagttgatgctgcaccctttaaacagtggtacctccagcactatggcgttgacattggtaggaaaaagaagggggccgctaagaaggaaactacaaccgaggagggtgaagctgctgctccagctgaggaagctaagaagagcaaccatgtagtccggaaaattgagaaacgccagaaggatcgtacacttgatagtcacctcgaagagcaattcagctctggtaggctatatgcctgcatctcatcccgccctggtcaatgtggccgagctgatgggtacattttggaagggaaagagttggaattctatatgaagaaacttcaaaagaagaaaggcaaggcatctggtgcttctgcttaagtggttctttcggaatgtccagactagtttgtgcttcttttttttccctttgttaattaagcttcaattttgagagtatgtatttgtatgcaaccataagttcagaatgactggccttcattattagcatttttttgtagtttgaaattttactgcagttttgctaaagctgtgtcctatatttgctcaattcgacaccttggatcttgtcctacatttcagtgtgtagtcatataatcccaagtagaaaata

SEQ ID NO: 6799 - DNA, 962 bp, Solanum phureja
ggagagcagagtgaaggagtaaggtcggcttaagctctcagcaaccatgggtatctcaagagattctatgcacaagagacgtgccactggtggcaagcagaaaacttggaggaagaagcgaaagtacgagcttggacgccaatcagctaataccaagatttccagtaacaagacagtcagacgaattcgtgtgcgaggtggtaatgtgaagtggagggcactgagattggatacaggaaactattcatggggtagtgaggcagtcacacgcaagactcgtatccttgatgtggtttacaatgcctcgaacaatgagcttgtccgcacacaaactcttgtcaagagtgcaatcgttcaagttgatgctgcaccctttaaacagtggtacctccagcactatggcgttgacattggtaggaaaaagaagggggccgctaagaaggaaactacaaccgaggagggtgaagctgctgctccagctgaggaagctaagaagagcaaccatgtagtccggaaaattgagaaacgccagaaggatcgtacacttgatagtcacctcgaagagcaattcagctctggtaggctatatgcctgcatctcatcccgccctggtcaatgtggccgagctgatgggtacattttggaagggaaagagttggaattctatatgaagaaacttcaaaagaagaaaggcaaggcatctggtgcttctgcttaagtggttctttcggaatgtccagactagtttgtgttaattaagcttcaattttgagagtatgtatttgtatgcactgcctttaccataagttcagaatgactggccttcattattagcatttttttgtagtttgaaattttactgcagttttgctaaagctgtgtcctatatttgctcaattcgacaccttggatcttgtcctacatttcagcgtgtagccatataatcacaagtagaaaatact

SEQ ID NO: 6800 - DNA, 682 bp, Euphorbia peplus
ccccctgggtatctccagagactccatgcataagaggcgtgccactggtggcaagaagaaggcctggaggaagaagcgaaagtatgagcttggtcgtcagcctgcaaataccaagctctcaagtaacaagacagtaagaagaatccgtgtgagaggaggtaatgtcaagtggagagcgctgagattggatacagggaatttttcttggggaagtgaggctgtcacccgaaagactcgtctccttgatgttgtttacaatgcttcaaataatgaacttgtgaggacacaaactttggtgaagagtgcaattgttcaggtggatgcagctccatttaagcagtggtatcttcaacactatggtcttgatattggtaggaagaagaaggctgtagcagctaagaaggagactaccgaggaaggagatggtgctgctcctgctgctcaagtagaggaaaccaaaaagagcaatcatgtggccaggaagattgagaaacgccagaaggatcgtaagctagattctcacattgaagagcaatttggcgggggtagattattggcctgcatttcatcccgtcctggtcaatgtggcagagctgacgggtatattttggaaggtaaggaactggaattctatatgaagaagcttcaaaagaagaagggcaagggtgccagtgctgcataa

SEQ ID NO: 6801 - DNA, 747 bp, Triphysaria pusilla
ctcatctgaatcctcctccagcaaccaaccatgggtatttcccgggattccatgcacaagaggcgtgcaactggaggtaagcagaagacatggaggaagaagcgaaagtatgagctcggaagacaaccggcaaacacgaagttgtcgagtaacaaaactgtacgcagggtcagggttcgtggtgggaatgttaaatggcgcgcattgaggctagatacaggaaacttttcctggggtagtgaagctgtgacccgaaagacacgtattttggatgttgtttacaatgcatccaacaatgagttggttaggacccagactttggtcaagggtgctatcattcaagttgatgctgcgcctttcaagcaatggtatcttcagcattatggagtcgagattggtcgcaagaaaaagactgctgctgctgccaagaaggatggagaggagactgaggctgctgctgctgctgaagaggcaaagaagagcaaccatgtcaaaagaaaaattgagaagcgacaggaggaacgtaaaatagacgcgcatattgaggaacaatttggtggtggccgtttgttagcttccatctcctcacgcccaggccagtgtggccgtgctgacggttacattttggagggcaaggagttggagttttacatgaagaaacttcagaggaagaagggaaagggtgctggtggtgtttaatttatgtcttcaaggacaaagcatatttttcgattcagtatttgttat

SEQ ID NO: 6802 - DNA, 1182 bp, Aristolochia fimbriata
taagtgtttagggttttatagtagcggaaggctttcccctcagcttctcatctcccttcgttcgagaaacgccggaggtcgaaaaccagacgtccgtggtctttctccttcggaagccaaaatgggtatttccagggattcgatgcacaagaggcgcgccaccggcggcaagaagaaagcatggagaaagaagcgcaagtacgagcttgggcgtcagcctgcgaatacgaagctctctagcaacaagaccgtccgaagggtgcgtgtgcgtggaggcaatgtgaagtggcgggcccttcgtctggacactggtaattactcgtggggcagcgaagcagtcacccgcaagacccgtgtccttgatgtggtatataacgcgtcaaacaacgagcttgtgcgaactcaaacgttagttaagaatgccatagttcaagttgatgccgcacccttcaagcaatggtacttacagcactatggtgttgacatcggaaggaagaagaaggcatcacagactgtgaagaaagaaggagaggaaggcgaggctgcaacccaagaggaagcgaagaaaagtaaccatgtggtcaggaagctagagaaacgccaacagggccgcacacttgaccctcatattgaagaacagtttggcagtggcagacttttagcttgcatctcatctcgccctggccagtgcgggcgtgcagatgggtatatcttggagggtaaggagctggaattctacacaaagaaaatccacaggaagaaaggcaagggtactgcaagtgctgcttaaatgagaaagtttttcttcatgtttctgttcttaagtgcaagatatacgctttcagagccaaacagtttggaagagtattgtatgagttaaaaaatagtggcattaccttttcccttttccttttctttttgcatagtggtcgtgagtggctgatgctttcgtgtttattcgagtccgttggtgcctatttgttttgtacttggcactgtggttcagccattcttagggcatgagaaagcaggtgggacgtacatgaggccttttcctcttaccatttcgtctggtgtttacttataatatctcttttcttttaatcgaagataaaggagtcccgaactatgttagattttaaacccatctaattgaagtttactgaacaaagaaattttatg

SEQ ID NO: 6803 - DNA, 1052 bp, Aristolochia fimbriata
cgggggcttctcttctcactctggctcctctcgtcccgtcttgagacgccggaggtcgaaaagcggacgccctttgcgtttctcattcgcaagccaaaatgggtatttccagggactcgatgcataagaggcgcgccaccggaggcaagaagaaggcgtggaggaagaagcgaaagtacgaacttgggcgtcagcctgcaaataccaagctctcgagtaacaagaccgtccgaaggatacgtgtgcgtggaggcaatgtgaagtggcgggcacttcgtctggatactggtaattactcatggggcagtgaagcagtcactcgcaagactcgtatccttgatgtcgtatataatgcctcaaacaacgagcttgtgcgaactcagacgttggtgaagagtgccatagtgcaagttgatgctgcacctttcaagcagtggtacttgcaacactatggtgttgacatcggaaggaagaaaaaggtttcccaggttgtgaagaaggaaggagaggatggtgagtctgctcctcaagaggaggcaaagaaaagtaatcatgtggtcaggaagttagagaaacgccaacagggccgctctcttgaccctcatattgaagaacagtttggtagtggcaggcttttggcttctatctcttctcgcccaggccagtgtgggcgtgctgatgggtatatcttggaaggtaaggagctggagttctacatgaagaaaatccagaggaagaagggcaagggcagtgctggtgctgcttgaatgagaaagttttgatccccatttctcgtgttctagttctcttagtacaagatatatgttttcggagccatcagttgggaatttttagtattagataaactatttcagaactactctttttaaaatgcatttgcatagtgacgattgttggctgaccttatcaatggaattctctcgtgtgccaatttatttgtagttttgcccaaaatgtgtcctttaatgctttgtgacattttcgttgaggattccacgccatgtgctagaaacatttatctgcttcattac

SEQ ID NO: 6804 - DNA, 950 bp, Manihot esculenta
agcgactgtgtcgaggttcagactcgcgaggcggataagagcttgggatcttttatcggcaaaaaaatgggtatttctcgtgattcaatgcataagaggcgtgccactggtggcaagaagaaagcttggaggaagaagagaaagtatgagcttggaaggcagcctgcaaacacaaaactgtctagcaacaagacagtcaggaggatcagggtcagaggtggaaatgtgaagtggcgtgccttgaggcttgacacaggaaactactcttggggtagtgaggctgttactcggaagaccaggattcttgatgtggtatacaatgcatctaacaatgagttggtccgaactcaaactttggtgaagagtgccatcgttcaggttgatgctgcacctttcaagcagtggtatcttcagcactatggagttgatgttggtcgcaagaagaaaactgcagctgtgaagaaagagggagaggaaggtgaagccactactgatgaagtgaagaagagtaatcatgtcatgagaaagctggagaagagacagcaaactcgcaagcttgacccccatattgaagaacaatttggtggtggtcgtctattagcttgcatctcatcgcgacctggtcaatgtggacgtgctgatgggtacatcttggagggtaaagagctggagttctacatgaagaaactgcagagaaagaagggcaagggagctggtgctgcttgaaattttgtgatctgaccctctattcagttcagatttgtttctccacctaattattccccttatgtttggacattgatttttttttttttaaaaatgagatgatttgctaagtttgtagcaccaactagttttattgttgaattcatagttagaaaccaaatgatgcttttgatttacgggattacctcatctatatattttttttatatgtggagtttgatggt

SEQ ID NO: 6805 - DNA, 1153 bp, Ricinus communis
gcataagaccaataggctaaaaactcgtcagccgttggatcatttaatcaacgatgataaaacactaaacatcatgcgcgcaagtgcgaacgaggtcatagaatcagctataagtgcaatatataagcgtaaaaccccgcttcagtcttgcttctcttgaaaccctagccctagccgtctgtgttggaacctttgcattctgcagtctttcctctactgcaacaatgggtatttctcgtgattctatgcacaagaggagggccactggtggcaagaagaaggcttggagaaagaagagaaagtatgagctcggaaggcagcctgcaagcacaaaactgtctagcaacaagacagtgaggagaattagggttcgaggtggaaatgtgaagtggcgtgctttgaggcttgatactggaaactactcttggggtagtgaagctgttacccgaaagaccagaattcttgatgtggtgtacaatgcatctaacaatgagcttgttcgtactcaaactttggtgaagagtgccattattcaggttgatgcagcacctttcaagcagtggtatcttcagcactatggagttgacattggccgcaagaagaaaactgcagctgccaagaaggaaggagaggaaggtgaagctgctactgaggaagtgaagaagagcaatcatgttttgagaaagctggagaagagacaacagatccgcaagcttgacccacatattgaagaacaatttggtggtggccgtctgctagcttgcatctcatcacgccccggtcagtgcggccgtgctgatgggtacattttggagggcaaagagctggagttttacatgaagaagctccagaggaagaagggaaagggagctggtgctgcctaaaattttgttgtctgaactccatattaagattagacttttatctttacattaattgttgcccttctgtttggatcatagttttctatgagatgagcagtcaaaacttgtagcaccaaccaggatttgttgaattcttaattagaatgacagtgtcttttgttttacatatttacatgtcatgattttgaatgatggtaatgattattgagtgccttttttaaggttccagtttttcatttatgagcacgcagttggttatatttataaat

SEQ ID NO: 6806 - DNA, 738 bp, Cirsium arvense
ttgggaggtcgtgtttcataaacctagaggaggatcatccatcatctgcaaacatgggtatatctcgtgattccatgcacaagagacgcgccactggtggcaagaagaaggcctggagaaagaagcgaaagtatgagcttggaaggcagcctgccaacaccaagatatccagcaacaagactgttcgaagggtgagggttcgaggtggtaatgtgaagtggcgtgcgttgaggttggatacaggaaactactcatggggaagtgaggctgtgacaaggaagacacgtatattggatgtggtttataatgcatcaaataacgagttggttaggacccaaactttagtgaagagtgctattgttcaggttgatgctgcaccttttaagcaatggtatcttcagcactatggagttgagatcgggcgcaagaagaagccagctgctgctgccataaaaaaggagggagaggaagctgaagtggctactgaggagaccaagaagagcaaccatgttgtgaggaaattagagaagcgtcaagaggaacgtaagcttgatcaacacgttgaagagcaattctctggtggtcgtcttttagcagcaatttcatcacgccctggccagtgtggtcgtgctgacgggtacatattggagggtaaagaacttgagttctacatgaagaagcttcagaagaagaaaggaaagagtggtggtgctgcttaaacaatatcaagttttcttt

SEQ ID NO: 6807 - DNA, 1092 bp, Cucurbita pepo
ttaccgcgccgactgctaatcggctgctgccgtcacggttgcatcaggaaccttagaaatcttcctcgggaaggaactctcaacgcgtcaaaatgggtatctctcgtgattctatgcacaagaggcgagccactggaggcaagaagaaggcttggaggaagaagagaaagtatgagctcggacggcagcctgccaacactaagatatccagcgacaagtcaatcaggaggattagagttcgtgggggtaatgtgaagtggcgtgcatttaggctcgacactggaaactactcatggggtagtgaggctgtgactaggaagacccgtattcttgatgtggtgtacaatgcatcaaacaatgagcttgtccgtactcaaactttggtgaagagtgccattgttcaggttgatgccgcaccgtttaaacagtggtatcttcagcactatggagtggatattggaaggaagaagaagactgcagcatctgctaagaaggaagaggaaggcgatgctgctgctgctgctgctactgaggaggcgaagaagagtaaccacgtccagcgtaagctggagaaacgtcaacaggagcgtaagcttgacccacatattgaagagcaattcagcagtggtcgtttgatggcttgtatctcttccagaccaggtcaatgtggtcgagcagacggatatattttggagggcaaagagcttgaattctacatgaagaagctccaaaggaagaagggaaaaggagctggtgctgcttaaacaactctgtcattgagatgttttctagccgtatgtccttttctatgattctatctgcctttttgtcttatgaagacgatgagttatttgcagctaaaagatgaaacaattacttatgaacgtcgattttgatgatattagttgtttgattaggcattactttcttttagctcaagatttgaatttggtctaattgagtgattgcatttcagaagattcaaaaacaatcattcatctttctctaactagttgtcttgactttattttctcaataatgctgtttggctctttttacgaatatctcgccgtcctcggaatatatactgta

SEQ ID NO: 6808 - DNA, 915 bp, Gerbera hybrid cultivar
ttccgcacgaggcgatttcagaggcgcgccataaaccctagaggaggatcctcaataatctgcaaacatgggtatctctcgtgattccatgcacaagagacgtgccactggtggcaagcagaaggcgtggagaaagaagcgaaagtatgaactcggaaggcagcctgccaacaccaagatttcaagcaacaagactgttcggagggttagggttcgaggtggtaatgtgaagtggcgcgccttgaggttggatacaggtaactactcatggggtagtgaggctgtgacgcgaaagactcgtatcttggacgtggtttataatgcatcaaacaatgagttggtcaggacccagactttagtcaagagtgcaattgttcaggtagatgctgcaccttttaagcaatggtatcttcagcactatggagtcgacattggtcgcaagaagaaagctacaacagctgccaaaaaagagggagaggaagttgaaggccctactgaggagacgaagaagagcaaccatgttgttaggaagctggagaagcgtcaagaggaacgcaaacttgaccaacacgttgaagagcagttctcaagtggccgtcttttagcagcaatctcatcacgccccggccagtgtggtcgtgctgatgggtacatattggagggaaaagagcttgagttttacatgaagaagctgcagaagaagaaaggaaagagtgctggtgctgcttagaacttcttgtttcaaatctttaagtttatgatttcgaacctaaatgcgttgaactaaaattttgtttgttagcttttgagtttgatgaatgcaaaccgatgatgtaagatttcaacacattctcatggtttcacttttgtattgacatcaattttatgcaaagttagacgtacagatgtctgatt

SEQ ID NO: 6809 - DNA, 939 bp, Jatropha curcas
gtagcgtccctctggagatttgcacttgtgaggcagtgaaaagcttaattcactctctctgcaaaaatgggtatttctcgtgattcgatgcacaagaggcgtgccactggaggcaagaagaaggcatggaggaagaagagaaagtatgagctcggaaggcagcctgcaaacacaaaactgtctagtaacaagacagtcaggagaattagggttagaggtggaaatgtgaagtggcgtgctttgaggcttgatactggaaactactcctggggaagtgaggctgttactagaaagaccagaattcttgatgtggtgtacaatgcatctaacaatgagctggttcgtactcaaaccttggtgaagagtgccattgtccaggttgatgctgcaccatttaaacagtggtatcttcagcactatggagttgatattggccgcaagaagaaagttgcggctaccaagaaggaaggagaggaaggtgaaggtgctactgaggaagtgaagaagagtaatcatgttttgagaaagctggagaagagacagcagactcgcaagcttgatcctcatattgaagaacaatttgctggtggtcgtctaatggcttgtatctcatcacgccctggtcagtgtggccgtgctgatgggtatattctggagggtaaggagctggagttctacatgaagaagatccagaggaagaagggcaagggagctggggctgcctaaaattttgcaatccaaactttctattcagatcagacttgtctcccccctctttcttttccttgtgtctggagattgtattttttatgagatgagagattaaacttgtagcagcaactattattatcgttgaattcccaattagaaacctaatattgtcttttatttaacagcagcataagatgatcttttgatttaaaagggggggcccggtac

SEQ ID NO: 6810 - DNA, 849 bp, Tropaeolum majus
tttgaaaccctagtttgcctgttggaggatactctcgcgttgaatcctatctgccaaaatgggtatttctcgtgactccatgcacaagaggcgtgccactggaggcaagaagaaggcttggaggaagaagcgaaagtatgagctcggaaggcagccggctaacacaaagctttcgagcaacaagacagttaggaggatcagagttcgtggtggaaatgttaagtggcgtgccctgagactcgacactggaaatttctcatggggtagtgaggcggtgactcgcaagactagacttcttgatgtcgtgtacaatgcatctaacaatgagcttgtacgtactcaaacattggtgaaaagtgccattgttcaggttgatgctgcaccatttaagcaatggtacctccagcactacggtgttgacgttggtcgcaagaagaaaacagctgtttcggccaagaaagaaggagaggaaggtgaagctgtctccgaggaggcaaagaagagcaatcatgttgctagaaagctcgagaaacgtcaacagactcgcgaattagactcacatattgaggagcaattcagcggtggtcgtcttttggcttgtattgcatcccgccctggacagtgtggtcgtgctgatggatatatattggaaggcaaagagctagagttctacatgaagaagttacagaagaagaaaggaaagggagctggtgctgcctaaaattttgtgtaacatccatttcatttggtcttcatatcagaatgacatttttgcctcattttactttttttaacattaaagttagatgagaagtttaaaattatttgcaattgaactgtgttaatgtg

SEQ ID NO: 6811 - DNA, 783 bp, Capsicum annuum
tcagcaaccaaccatgggtatctcccgtgactctatgcataaaagacgtgccactggtggcaaacagaaagcttggaggaagaaaagaaagtacgagcttggacgtcaacctggtaatactaagatctcaagtaacaagacagtcagacgcattcgtgttcgtggtggcaatgtgaagtggagggcactgagattggatacaggaaactattcatggggtagtgaggctaccacccgtaagactcgtatacttgatgtggtctataatgcctcgaacaatgagcttgttcgcacacagactctagtcaagagtgcaattgttcaggttgatgcagcaccctttaaacagtggtacctccagcactatgatgttgacattggtaggaagaagaaggcggctgctaagaaggaaaccgctgaggagggagaaggtgctgctgctgcggaaactaagaagagcaaccatgtactccgaaaaattgagaagcgccaggctgatcgcaaacttgattctcaccttgaagaacaatttggatctggtagactcttggcctgcatctcatctcggcctggtcagtgtggcagagctgatgggtatatcttggaaggcaaagaacttgagttttatatgaagaaactacagaagaagaagggcaaggctgcagctgcttaaattggagctcttcaatttttgagactaatttaattatttttcctttttacccgttaatcgacttggtttgttaggatttttttctatatgcagtatttctttatcttgcc

SEQ ID NO: 6812 - DNA, 1015 bp, Phalaenopsis aphrodite
aaggaggcggctgacggtgcaagagggtgagaggcaatcggtactaatccgctggaatgggtatctctagggattccttgcacaagaggcgagccaccggcggcaagaagaaggcgtggaggaagaagagaaaatacgagctgggccgacagccggcgaatactaagctttctagcaacaaaacggtgaggagggttcgagttcgcggaggaaatgtgaagtggagggctctacgtttggatacaggaaactattcttggggaagcgaggctgtgacccgcaagaccagaattctcgatgtggtatataatgcttcgaacaatgagcttgtgaggacgcagactcttgtgaagagtgctatagtgcaagttgatgccgcccctttcaagcaatggtaccttcagcactatggtgttgagcttggcaggaagaagaagagcactgcggcatctaagaaggattcttccgaggttcatgacggcgaagccgcacaagaggaatcaaaaaagagcaaccatgtcgaaaggaagctggagaagcggcagcaagttcgcactctagatccacacatcgaggagcaatttggcagcggacgtttacttgcaagcatctcatctcgtcctggtcaatgtggtcgagccgacggttacatacttgaaggcaaagagctggagttctacttgaagaaaatccagaggaagaaaggcaagagtgctggtgctgcttagtgagttatttagcctctcattaggggttgctttgtgctttcttggaccctctacattgaactgcagcacctgaaatattaatttctttagagactttgatttttcatttgtttgttttccctgctaccacagaacaaaggagccattataacttagttcaaagttttgagggtgtttttgttattttgataattaactgagggttttttgggaaatgaatgcatatttgtatggtttactcatttaggacatttaaatatacacaaatataattgtgtttgactaat

SEQ ID NO: 6813 - DNA, 945 bp, Plantago ovata
ggggccctacctctcccagatcttagttccgcctccaccatgggtatctctcgagattcgatgcacaagaggcgtgctactggaggcaagaagaaggcctggaggaagaagagagagtatgagctcggacgccaaccagccaatacaaagctgtcaagtaacaagacagtgagaagagttcgtgtcagaggaggtaatgtcaagtggagagccttaagattggatactggaaatttctcatggggtagtgaggctgttacccgcaagacacgtattcttgatgtcgtctacaatgcttctaacaatgagcttgtcagaacacaaactctggtcaaaggtgccatcatccaggttgatgctgctccattcaagcaatggtaccttcagcattatggagttgatgttggcaggaagaagaagtctgctgctaccaagaaggaagtaacggaggaagccgctgatgcaaatgctgcagcagaggaaacaaagaagagtaaccacgtggtaaggaaaattgagaaacgacaagaaggtcgcacactcgattcccaccttgaggaacaatttggctctggcaggttgtatgcctgcatctcttctcgacctggtcaatgtggcagatccgatggatatattcttgaagggaaggaacttgaattctacatgaagaagcttcagaagaagaagggaaaaggtgctggagctgctgcttaatcaatccgtatatgaaaaatgagcttcgtttgagtttattaacttgtggtctgtccgtgattacttgtttttcggcataaacagcaatagaattttgtctttgcctcattcctataacggattttggtcgatgaattaggaattttttactctcgagtatactcccattactttgtttgtcttatgagtacacgatatttacttgaaatcagtttccaagatcaaagtttg

SEQ ID NO: 6814 - DNA, 964 bp, Rhizophora mangle
ggtctctgtgggaggtttggggcttgtgaggcagagaaacaattagagtcctctctctgcaaaaatggggatttctcgcgattcgatgcacaagaggcgtgccacgggaggcaagaagaaggcttggagaaagaagcgcaagtatgagcttggaaggcagcctgcaagcacaaagctgtctagcaacaagacagtaaggaggattagggttcgaggagggaatgtgaagtggcgtgctctgaggctcgatactggaaactactcatggggtagtgaggctgtgactaggaagactagaattcttgatgtggtatacaatgcatctaacaatgagctggttcgtactcaaactttggtgaagagtgccattgttcaagttgatgcagcacctttcaagcagtggtatctccagcactatggagttgacattggtcgcaagaagaaaactgtaacagccaccaagaaggaaggagaggaaggtgaagcaactacagaggaagcaaagaagagcaaccatgtattgaggaagctggagaagagacaacaaaatcgccagcttgattcacatattgaagagcaatttggaagtgggcgcttattagcatgcatttcatcacgccctggtcaatgtggccgtgctgacggatatatcttggagggtaaagagctggagttctacatgaagaagatacagaggaagaagggcaagggagctggtgctgcctaatattttgttgcccaagctttacagttatcagaccagtgtttcaaccttattttcccttattttagaacagttgaagttatgatgagaccagcaatcaaacttgaagcttctagctgtgctattgttgatcatttggttagaatatttatcagtggtgcttgttctattaaatagcattgtcatacattcagtccttgtcttgatggtcttgtgggtgcatttcccttttgattctgt

SEQ ID NO: 6815 - DNA, 924 bp, Triphysaria pusilla
gcgccgcatctgtttcttctctgcaaccatgggtatttctcgggattccatgcacaagaggcgtgcaactggaggaaagcagaagacatggagaaagaagcgaaagtatgagctcggaagacaaccagcaaacacaaagttgtcgagcaacaagactgtgcgcagggtgagggttcgtggtgggaatgttaaatggcgtgcattgaggctggatactggtaacttttcatggggtagtgaagctgtgacccgaaagacccgtattctggatgtcgtttataatgcatccaacaatgagttggtcaggacccagactttggtgaagggtgctatcattcaagttgatgctgcacctttcaagcagtggtaccttcagcattatggagtcgagattggtcgcaagaaaaagactgctgctgctgccaagaaggatggagaggagactgaggctgctgctgctgctgaagaggcaaagaagagcaaccatgtcaaaagaaaaattgagaagcgacaggaggaacgtaaaatagacgcgcatattgaggaacaatttggtggtggccgtttgttagcttccatctcctcacgccctggccagtgtggccgtgctgatggttacattttggagggcaaggagttggagttttacatgaagaaacttcagaggaagaagggaaaaggtgccagtggcgcgtaatttatttcgactacaaaccatatcttacaacttggtattgttatcttcgcttttggcctgtaagacctgaaattttgtttcgtaccaaacaatttttgtcgaacactagtgtgttatctcgtttacgattaaatgtccttttaatatctcgtctccttcattttatcgactattttcagtcatttgactttaatttgtagttaattccatgaaaatgatttaaagtt

SEQ ID NO: 6816 - DNA, 1019 bp, Triphysaria pusilla
ataaattgcaactccaggtcgaacttaatcttttttccctgctgtaattgcgccgcatctgtttcttctctgcaaccatgggtatttctcgggattccatgcacaagaggcgtgcaactggaggaaagcagaagacatggagaaagaagcgaaagtatgagctcggaagacaaccagcaaacacaaagttgtcgagcaacaagactgtgcgcagggtgagagtccgtggaggtaatgtgaagtggcgtgcattgaggctggatactggtaacttttcatggggtagtgaagctgtgacccgaaagacccgtattctggatgtcgtttataatgcatccaacaatgagttggtcaggacccagactttggtgaagggtgctatcattcaagttgatgctgcacctttcaagcagtggtaccttcagcattatggagtcgagattggtcgcaagaaaaagactgctgctgctgccaagaaggatggagaggagactgaggctgctgctgctgctgaagaggcaaagaagagcaaccatgtcaaaagaaaaattgagaagcgacaggaggaacgtaaaatagacgcgcatattgaggaacaatttggtggtggccgtttgttagcttccatctcctcacgccctggccagtgtggccgtgctgatggttacattttggagggcaaggagttggagttttacatgaagaaacttcagaggaagaagggaaaaggtgccagtggcgcgtaatttatttcgactacaaaccatatcttacaacttggtattgttatcttcgcttttggcctgtaagacctgaaattttgtttcgtaccaaacaatttttgtcgaacactagtgtgttatctcgtttacgattaaatgtccttttaatatctcgtctccttcattttatcgactattttcagtcatttgactttaatttgtagttaattccatgaaaatgatttaaagtttctaaaaaaaaaaaaaaaaaaaaaaaaaaagaaaaaaaaaactaaa

SEQ ID NO: 6817 - DNA, 1170 bp, Panicum virgatum
ctccaaggtttcgctctcctcttccctgcgagacccaaccagaggagcggcggcgcgggcggaccaggcggaggaggcggagcagcagcagccgggcgaggccaccgacgccaccatgggtatctcgcgtgactcgatgcacaagcgccgggccaccggtgggaagcagaaagcctggaggaagaagcgaaagtatgagctcggccgccagcctgctaacaccaagctgtccagcaacaagacagtgaggagggtccgtgtccgtggaggtaatgtgaagtggagggctctccgcctggataccggtaactactcatggggtagtgaggcggttactcgcaagacccgtatcctggatgttgtctacaacgcgtcaaacaatgagcttgttcgaacccagaccctcgtgaagagtgccattgtgcaagttgatgctgccccattcaagcagtggtacctcactcactatggagtggacattggtaggaagaagaaggccccggctgctaagaaggatgctgctgggtcaagagggtgaggccacagctgaagaaacaaaaaagagtaaccatgtcctgaggaaggttgagaagcgccagcagggacggacacttgacccgcacattgaggagcaatttggcagtggaaggttgttggcatgtattgcttctcgccctgggcagtgtggccgagctgacggttacatccttgagggtaaagaactcgagttctacatgaagaagctccagaggaagaagggcaagggtgccgcagcatagaagcattgtattgtctggaagcgggtggcctatcttatcctttactctgggttttgtcagtcctcaagtatgttatgtcgtgttgcagaccagatgaacacctattttctgaaagtgaatcaactctatcttcaaagaactgagaattttcaccttctgtggttgtattctcttgatgtttaggttcacaatttattgacagtttgtgttcagcagttttggttttatctctgagatgtcacgctgaatggtgtatttcctgttggttttcattcgttgcttgcgaacatctggcgaaagtgataacagctagacatgcataaatcttgacaatgagctttgtttgcatcaaccgatgaatagatgatgtgttaaaactgtataatagaat

SEQ ID NO: 6818 - DNA, 980 bp, Panax ginseng
tttccgctgctggtatttgggttctttcaccttctacaaccatgggtatttctcgtgattcgatgcacaagaggcgtgctactggaggcaagaagaaggcttggaggaagaagcgaaagtatgagcttggaagacaacctgcaaacacaaagttgtctagcaacaagacagttcggagggtaagggttcgtggtgggaatgtgaagtggcgtgccttgagattggatacagggaactactcttggggtagtgaagctgtgacccgtaagactcgaatcctggatgtggtctataatgcatcaaataatgaattggttaggacccagacattggtgaagagtgctattgttcaggttgatgcagcaccatttaagcaatggtatcttcagcactatggtgttgacattggtcgcaagaagaaatcctctgctgctgctgccaagaaagaaggagaggagggtgatgttcctatcgaggaggcgaagaagagtaaacatgtcctgagaaaaattgaaaagcgtcaagaggatcgtaagattgacgcacatattgaagagcaatttgggggtggccgtctattagctgcaatttcatcacgacctggccaatgtggtcgtgctgatggatacatcttggagggcaaggagctggagttctacgtgaagaaactccagaggaagaaaggaaagggtgctgcagcttaaaatttgtgacctgaatggagttgcaattcagaacatttctgttttctgttttactttttcagagatggaaccaaagaactattcagctctcatagttggctttgtttcttgtcacgtctctgagtgttaaaggagaattttagcatcatctttaattttcaacagtggtagtattattgacttaatttcagttttattattatatgcttggttttggcatttattatgtatacctaatttcagttttatgattatagatttaatatcatctttatg

SEQ ID NO: 6819 - DNA, 989 bp, Glycine max
gggcgcgcacccagagaggaagcttagagagagagagagagagagagagagagaggagagagtattggcgcttcatcaagatgggtatttctagggattccatgcacaagaggcgtgccactggtggcaagaaaaaggcttggagaaagaagagaaagtatgagcttgggcgtcaggcagcaaacaccaagttatcaagcaacaagacaatcaggaggattcgtgttagaggtggcaatgttaaatggagggcattgaggctggatactggcaattactcatggggtagtgaagcagttactcgcaagactcgtattctagatgttgtttacaatgcctcaaacaacgagcttgtgcgaactcagaccctggtcaagagtgctattgtccaggttgatgctgctcctttcaggcagtggtaccttcagcactatggtgttgaaattggtagaaaaaagaaagtggcagccaagaaggattctactgaggaaggtgaggctgctgctgaagaaactaagaaaagtaaccatgtgcagagaaaacttgagaaacgccagaaagatcgtaatcttgactcccacattgaagagcaatttggtggtgggcgattgttggcctgtatttcttctcgtcccggacaatgtggcagggctgatgggtacattcttgaaggtaaggagctggagttttacatgaagaaactccagaggaagaagggaaagggtgctgcttaattttagtgttttctaaacttctatttggctttagttcttggaagttggtaccaattcaaatgtacgttttttatgactgtgggtcgaccacctctagggaattggacatcctttagggtgaacgttttattagtttatgccaatttcaaccaaattttgttttgtttgtttatgttactgataatttgaaaggcggggatgcatgagtattctacttactattaacatcattagataaagaaaattgcagttttt

SEQ ID NO: 6820 - DNA, 870 bp, Cirsium arvense
gaggatcgtcggccatctgcaaccatgggtatttctcgtgattccatgcacaaaagacgtgcaactggaggcaagaagaaggcgtggaggaagaagcgaaagtatgagctcggaagacagcctgccaacacaaagatctccagcaacaagactgttaggagggtgagggttcgtggtggtaatgtgaagtggcgtgcattgaggttggataccggtaattactcatggggaagtgaggctgttacacgaaagacacgtatcttggatgtggtttacaatgcatccaacaatgagttggtcaggacccaaaccttggtgaagagtgcaattgttcaggttgatgctgcaccatttaagcaatggtatcttcagcactatggtgttgaaattggtcgcaagaagaaagtagctgctaaaaaagagggagaggaagcagaagctgcaaccgaagaggccaagaagagtaaccatgttgtgaggaagctggagaaacgacaagaggaacgcaaacttgacccacatgttgaagaacaattctctggtggacgtcttttagcagcaatctcatcacgccctggccagtgtggtcgtgctgatggatacatattggaagggaaagagcttgaattctacatgaagaagcttcaaaagaagaaaggaaagggtgctgctgcttaaatcttattataatagatttgtatcttctttttttctatttatttattttgatgaggaaggcatgaactcgggataatattttggtgagtctttcttagttaacttcgacttttatgaatatcgcttccctcactattgttttgactagtatatttttgcatactctcgactatcaagcagaagtttaccccc

SEQ ID NO: 6821 - DNA, 923 bp, Vigna unguiculata
cgtacccagacaagaaactagggaagaagagggaagggagagtgttgaacgcttcatcaagatgggtatttccagggattctatgcacaagaggcgtgcaactggaggcaagaagaaggcgtggagaaagaagagaaagtatgagcttgggcgccaatcagcaaacaccaagttgtcaagcaacaagacaatccggaggattcgggttagaggtggtaatgtaaaatggagggcactgaggttggatactggaaattactcatggggtagtgaagcagtaacccgcaagactcgtattctagatgttgtctacaatgcctctaacaatgagcttgtgagaacccagactttggtcaagagtgctattgttcaggttgatgctgctcctttcaaacagtggtaccttcaacactatggtgttgacattggcagaaaaaagaaagcagcaaccaagaaggactctaccgaggagggtgatgctgctgctgctgaagaaactaagaaaagtaaccatgtgcagagaaaaattgagaagcgccagaaagatcgcaaacttgatgcccacattgaagagcaatttggtggtggcagattgttggcatgtatttcttctcgccctggacaatgtggcagggctgacgggtacattctggaaggtaaggagctggagttttacatgaagaaactccagaaaaagaagggaaagggtgctgcttaattttagcgttttccaaggttctatttacctttagttcttggaaattggtacaattcaagatgatgtatgtttttacgactgttggtggagatcatctttagtgtgaacgttttgttagttttatgccaatttcaaccaaaattttgttttaattgttactcataattttaattttaatcttgaagacgggatgcatgagggtttt

SEQ ID NO: 6822 - DNA, 1065 bp, Solanum melongena
agggttttagttcaaagcggaagattggtgcgagggactgcggcttagctttcagtaaccatgggaatctcacgagactctatgcacaaaaggcgtgccactggtggaaagcagaaaacatggaggaagaagcgaaagtatgagcttggccgtcaacctgctaatactaagatatcaagtaacaagactgtcagacgaattcgtgttcgtggtggtaatgtgaaatggagggcattgagattggatacaggaaactattcatggggtagtgaggcgactacccgtaagactcgtatccttgatgtggtctacaatgcctcgaataatgaacttgttcgcacacagactcttgtcaagagtgcaattgttcaggttgatgcagcaccctttaaacagtggtacctccagcattacggtgttgacattggtaggaagaaaaaaggggcagctgctaagaaggaaactgctgaggagggtgaaggtgctgctgctgaggaaactaagaagagcaaccatgtactccgtaaaattgagaagcgccaggtggatcgcaaactcgaccctcaccttgaagaacaatttagttctggtagactatatgcctgcatctcatctcgccctggtcagtgtggcagagctgatgggtatatcttggagggcaaagagcttgaattctatatgaagaaactacagaagaagaagggcaaggctggagctgcttaattggagctctttgatttttgagattaacttgtgttctttttttctctttttccccactagtcaacttttattttgtgcgcatatttttctatatgcagtattctttgatcttaccatgagttaatcattgatgcctggacttcgtctatcgttggcatttgttacttgtttcagttttattcttaatttttgtttgccatataaacctactccacaggtgttactggctaaactagggctggttttatttcaatgacctacttggtttccaagcattttgtaacattttgaaccataaaaatcgccttttctataaattttttagcatggttggaatatcat

SEQ ID NO: 6823 - DNA, 791 bp, Flaveria ramosissima
atcggaagttgagtttggaggctcaccggagatctgcaaacatgggtatctctcgtgattctatgcacaagagacgtgccactggtggaaagaagaaggcatggaggaagaagcgaaagtatgagcttggaaggcagccggcgaacaccaagatctccagcaacaagactgttaggagggttcgggttcgtggtggtaacgtcaagtggcgggccctgaggttggatactggtaactactcatggggaagtgaggctgtgacccgtaagacccgtattttggatgtggtttacaatgcatcgaacaacgagttggtcagaactcagacgcttgtcaagagtgcaattgtccaggtggacgctgcacctttcaagcaatggtatcttcaacactacggtgtggatattggccgcaagaagaaaaccgctgcttctacaaccaaaaaagagggagaggaagcagaaggtgcaaccgaagaggccaaaaagagtaatcatgttgtgaggaaactggaaaagcgtcaagaggaccgcaaactggaccctcatgttgaagaacaattctcaagtggtcgtcttctagctgccatctcatcacgccctggccagtgtggtcgtgctgacggatacatattggaagggaaagagcttgaattctacatgaagaagctccaaaagaagaaaggaaagggtgctgctgcttaagaccatatttccattgatagatttgtatttcttttatttatttttgaggactcataattttgttgacctttgttagttaggtatatt

SEQ ID NO: 6824 - DNA, 928 bp, Pennisetum glaucum
ctcgcgtgactcgatgcacaagagccgggccaagccaccgccgccaccatgggtatctcgcgtgactcgatgcacaagcgccgggccaccggtggtaagcagaaggcctggcggaagaagcggaagtatgagctgggccgccagcctgctaacaccaagctgtccagcaacaagacagtgaggagggtacgtgtccggggaggaaatgtcaagtggagagctctccgcctggatactggtaactactcatggggaagtgaggctgttacccgcaagacccgtatcctggatgttgtctacaatgcgtcaaacaatgagcttgttcgcacccagacccttgtgaagagcgctattgttcaagttgatgctgccccattcaaacagtggtacctcactcactatggagtggacattggtaggaagaagaaggcggctgcagccaagaaggatactgcagagggtcaagagggtgaggctgcagctgaagaattaaagaaaagtaaccatgtcaagaggaagcttgagaagcgcaaggaggcacgtgcacttgatgcgcacattgaggaacaatttagcagtggaaggttgttggcgtgcatcgcttctcgtcctggacagtgtggccgagctgatgggtacatccttgagggtaaggagctcgagttctacatgaagaagctccagaagaagaagggcaagggtgctgcagcttagatgcattgtcttgctacaagggcggcctatcttatccttttactctgggttttgttagtcctcaagtatgttatgtcgtgttgcagacctgattgaacacctattttctaaaagtgaatcaactctagcttcaaagaactgagaatgttcaccctgccgtggttgtattctcgtggtgtttaggttcactgtttattgacagtttgtgtccggc

SEQ ID NO: 6825 - DNA, 1049 bp, Mimulus guttatus
ttttattttctgttgctggcagtaccgccgtctttacacctctgatcggagcttagaaatcctccgccggcaatcatgggtatttctagggattccatgcacaagaggcgtgaaactggaggaaagaagaaagcctggaggaagaagcgaaagtacgagctcggaagacagccagcgaacacaaagctgtcgagtaacaagacagtgcgtagagtgagggtgcgtggtggtaatgtgaagtggcgtgcgttgaggctcgatactggaaatttctcttgggggagtgaggctgtgaccagaaagacccgtattctcgatgtggtttacaatgcgtcgaacaatgagttggttaggacaaagactttggtgaagagtgctattattcaagttgatgctgcgcctttcaagcagtggtaccttcagcattatggagtcgacatctctcgcaagaagaaggctgctgtcaagaaggaaggagaggaggctgaggctgctgccaccgaagaggcgaagaagagcaaccatgtgcagaggaaaattgagaagcgccaagaggagcgtaaaatcgacacacatattgaggagcaatttggcagtggtcgtttgttagctgccatttcttcacgcccaggccagtgcggccgtgctgatggttatattctggaggggaaggagttggagttttacatgaagaaaatccagaagaagaaaggaaaaggtgcaactgcataagctgctgtcttgtgctgattacggaagttttccgatccaaacccttaatttcatattttatgtttatcgttcgaaagagtggaacaatagtttggttgatctttttagagttatatttcacatttcatttgtcactgatgtgaggataatcttttaattagaggctcgagttttgttttctttttggctgattgattgctttgatctattggctgcggacttagctgttgtaagttttgtttattttgttaaattcgaattgaaattatccgattttcgtaaaatttatagtaattagttggcctcgattatatcac

SEQ ID NO: 6826 - DNA, 946 bp, Avena sativa
gtctctcctcctgcgagctcccaccaaaactgcggcggcgcgcgaatagaaggcgaagcagcagcagagccaatccaccgacgccaccatggggatctcgcgtgactccatgcacaagcgccgggccactggtgggaagatgaaggcatggcgtaaaaaacgaaagtatgagctcggccgccagccagccaacacgaagctgtccagcaacaagactgtgaggagggtccgtgttcgtggaggtaatgtcaagtggagggctctccgcctggatactggcaacttctcatggggaagtgaagctgtgacccgcaagacccgtctcctggatgttgtttacaatgcgtcgaacaatgagcttgttcgaacacagaccctcgtgaagaatgctattgtgcaagttgatgctgcccccttcaagggttggtatctgacgcactatggcgtggacattggtcggaagaagaaagctcctgctgctgccaagaaggaagcttctgagggacaagagggtgaggttgctgcagttgccgcagaggaggcaaagaaaagcaacaatgtccagcgcaagcttgagaagcgtcaacagggccgtactctggactcccacattgaagagcagttcagtggtggtaggctgttggcctgcatctcctcccgccccgggcagtgcggcagagctgatgggtacatcctggagggcaaggagctggagttctacatgaggaagctccagaagaagaagggcaagggtgctgcggcttagataacagtctcctgtgtgctctatccgctggatgttatatttcattccctgagttttgatagttgttgcgtctatgttatgatgtactgaatactatgttctgcaagtgagtcactatgtttgaacgactgagaatattttgcctgcttcagtaacctttgatattcttcgttttgttgt

SEQ ID NO: 6827 - DNA, 1013 bp, Populus trichocarpa
atctccctacttcagtttctttcgcgcgttgctgctgtgagtgtgcagatttgggattgctctagagggaatagaaaatggggatttctcgtgattctatgcacaagagacgtgctactggtggcaaaaagaaagcttggaggaaaaagagaaagtatgaactcggaaggcaacctgcaagcactaaattgtcaagcaacaagacagtcaggaggattagggttcgaggaggaaatgtaaagtggcgtgctctgaggcttgatactggaaactactcatggggcagtgaggctgtgacccgaaagaccagaattcttgatgtggtgtacaatgcatctaacaatgaactggttcgtactcagactttggtgaagagtgccattgttcaggttgatgctgcgcctttcaagcagtggtatctccagcactatggtattgacattggccggaagaagaaaaccacagctgcaaagaaggaaggagaggaaggtgaagctgttactgaggaggtcaagaagagcaaccatgtactgagaaagttggaaaagagacaacagattcgcaagcttgacccacatattgaagagcaatttggcagtggccgtttattagctagtatttcatcacgtcctggtcagtgtggccgtgctgatgggtatatcttggagggcaaagagttggagttctacttgaagaagatacagaggaagaagggcaagggagctggtgcataaaattttgtttcccaaacttgtaatttccgagtaggcttcttcaaccttcaccttatattttcccttcttttggatgttgaactgatggtgagatgagaaattgaactttgaaaacctataaaattgttgagctgtccattagaatcatagtttggtccctgtccagtaatactcgtgttttggttttgactcaatgaattactaatcgttcttgtccagtgatgatcatgttgtgttttggttttgactcaatgaattactaaaattatttacggttta

SEQ ID NO: 6828 - DNA, 1038 bp, Solanum tuberosum
ttgtgaggggtgcggcttagctctcagtaaccatgggtatctcacgagactccatgcacaaaaggcgtgccactggtggcaagcagaaaacctggaggaagaagcgaaagtacgagcttggccgtcagcctgctaatactaagatctcaagcaacaagacagtcagacgcattcgtgttcgtggtggcaatgttaaatggagggcactaagattggatacaggaaattattcatggggtagtgaggctaccacccgtaagactcgtatccttgacgtggtctataatgcctcaaacaatgaacttgttcgtacacagactcttgtcaagagtgcaatcgttcaggttgatgcagcaccctttaaacagtggtacctccagcattatggtgttgacattggtaggaagaaaaagggggctgctgctaagaaggaaactgctgaggagggagaaggtgctgctgcggctgaggaaactaagaagagcaaccatgttctccgaaaaattgagaagcgcctgacagatcgcaaacttgattctcaccttgaagaacaatttagttctggtagactatatgcttgcatctcatctcgccctggtcagtgtggcagagctgatgggtatatcttggagggcaaagaacttgagttctatatgaagaaactacagaagaagaagggcaaggctgcagctgcttaattggagctctttgaattttgagactaatttatatgttttttttcctttttcctattagacaacttggttttgtgaggatatttttctatatgcagtattctttaatcttacgatgagttgacattgacgcctggacttcgtttattgttggcattcattacttgtttcagcttattctgaatttttgtttgccatataaacatacgccgcaggtcgttctggctgaattaatgttgcttttatttcagtgatccgtttgggttggtttcctagcattttcaactataaaaatattttttagcatgtttggacatcaattattattccgatatttcaaagt

SEQ ID NO: 6829 - DNA, 1255 bp, Oryza sativa
gacccgatcaccgcctgcgaagtaaaccctaagccacggccgcctccctatataagcccacccactagggtttcgcccgcctctcctcccccccgctagttcccaaccagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctggactcgcacattgaagagcaatttggcagcggaaggctcttggcctgcatctcctcccggcctgggcaatgtggcagagctgatgggtacatcctggagggcaaagagcttgagttctacatgaagaagctccagaggaagaagggcaagggtgctgcagcttagagcgttctctcgagtgtgttttacgctggaaggcccgcctattttattcagtggattttgttagtcatgtttgcgtctatgtcgtgcctacagaccctactgaacaccaattttctgaaagaatgatgaatcaactcttagcttggaagaactgattgtgagaattttcacatgctatggttgtattctcgtggtatttaggttccatgtgtactcagctacagcattctgttatgttttatgcccttccaaggttttagtttttcggtctaagacggtgatggaagtacattttgctggccacgactgatgccctgcagtgaccatccttcaggatgagagcagactgagcatcctacagtcaagcaactctttggttgtttcagtttctgtccatctccaaaatagc

SEQ ID NO: 6830 - DNA, 984 bp, Solanum phureja
ttcgttcaaagcggaagagtggtgtgagggagtgcggcttagctatcagtaaccatgggtatctcacgagactctatgcacaaaaggcgtgccactggtggcaagcagaaaacctggaggaagaagcgaaagtatgagcttggccgccagcctgctaatactaagatctcaagtaacaaaacagtcagacgcattcgtgttcgtggtggcaatgttaaatggagggcactaagattggataccggaaattattcatggggtagtgaggctaccacccgtaagactcgtatccttgatgtggtctataatgcctcaaacaatgaacttgttcgtacacagactcttgtcaagagtgcaatcgttcaggttgatgcagcgccatttaaacagtggtacctccagcattatggtgttgacattggtaggaagaaaaagggggctgctgctaagaaggaaactgctgaggagggagaaagtgctgctgctgctgaggaaactaagaagagcaaccatgttctccgaaaaattgagaagcgcctggcagatcgcaaacttgattctcaccttgaagaacaatttagttctggtagactatatgcttgtatctcatctcgccctggtcagtgtggcagagctgatgggtatatcttggagggcaaagaacttgagttctatatgaagaaactacagaagaagaagggcaaggctgcagctgcttaattggagctctttgaattttgagactaatttatatgtttttttcctttttccttttaaacaacttggttttgtgaggatatttttctatatgcgtattctttagtcttacgatgagttgacattgacgcctggacttcgtttattgttggcattcattacttgtttcagcttattctgtgtttttgtttgcgccgcaggtcgttctggctgaattagtgttgtttttatttcagttacccatttgtgttggtttccaagcatttt

SEQ ID NO: 6831 - DNA, 1267 bp, Glycine max
tgggtgagcttgcatgaaagcccaatgggcgcccaattggttgacccgtaatgaggtcgggtctgtatccaacatttcagactagggcttgatatatactcagggttttatcagagaggggcgcgcacccagagaggaagcttagagagagagagagagagagagagagagaggagagagtattggcgcttcatcaagatgggtatttctagggattccatgcacaagaggcgtgccactggtggcaagaaaaaggcttggagaaagaagagaaagtatgagcttgggcgtcaggcagcaaacaccaagttatcaagcaacaagacaatcaggaggattcgtgttagaggtggcaatgttaaatggagggcattgaggctggatactggcaattactcatggggtagtgaagcagttactcgcaagactcgtattctagatgttgtttacaatgcctcaaacaacgagcttgtgcgaactcagaccctggtcaagagtgctattgtccaggttgatgctgctcctttcaggcagtggtaccttcagcactatggtgttgaaattggtagaaaaaagaaagtggcagccaagaaggattctactgaggaaggtgaggctgctgctgaagaaactaagaaaagtaaccatgtgcagagaaaacttgagaaacgccagaaagatcgtaatcttgactcccacattgaagagcaatttggtggtgggcgattgttggcctgtatttcttctcgtcccggacaatgtggcagggctgatgggtacattcttgaaggtaaggagctggagttttacatgaagaaactccagaggaagaagggaaagggtgctgcttaattttagtgttttctaaacttctatttggctttagttcttggaagttggtaccaattcaaatgtacgttttttatgactgtgggtcgaccacctctagggaattggacatcctttagggtgaacgttttattagtttatgccaatttcaaccaaattttgttttgtttgtttatgttactgataatttgaaaggcggggatgcatgagtattctacttactattaacatcattagataaagaaaattgcagttttttaaattactgattatcctatctgaccttctttctctcgatggttgtgaaagatattctttttttaatcaagttatttgaaacatggtagttatttcaggcctaaatgtgtttttggtttctgatagatgactgggattaagggaccaataacatatcgca

SEQ ID NO: 6832 - DNA, 949 bp, Solanum lycopersicum
ggtgttgttcgttcaaagcggaagagtggtgtgtgagggagtgcggcttagttctcagtaaccatgggtatctcacgagactctatgcacaaaaggcgcgccaccggtggcaagcagaaaacatggaggaagaagcgaaagtacgagcttggccgtcagcctgctaatactaagatctctagtaacaagacagtcagacgcattcgtgttcgtggtggcaatgttaaatggagggcactaagattggatacaggaaattattcatggggtagcgaggctaccacccgtaagactcgtatccttgacgtggtctataatgcctcaaacaatgaacttgttcgcacacagactcttgtcaagagtgcaatcgtgcaggtggatgcagcaccctttaaacagtggtacctccagcattatggtgttgacattggtaggaagaaaaagggggctgctgcgaagaaggaaactgctgaggagggagaaggtgctgccgctgaggaaactaagaagagcaaccatgtactccgaaaaattgagaagcgccaggcggagcgcaaacttgattctcaccttgaagagcaatttagttctggtagattatatgcttgcatctcatctcgccctggtcagtgtggcagagctgatgggtatatcttggagggcaaagaacttgagttctatatgaagaaactacagaagaagaagggcaaggctgcagctgcttaattggagctctttgaatttagaggctaatttatatgtttctttttcctttttccttgaacaagttggttttgtgaggatatttttctatattcagtattctttaatcttactatgagttgacattgacgcctgaactacgtttattgttggcattcattacttgtttcagcgtattctgaatttttggttgccatataaacatatgttgctggtcgttctggct

SEQ ID NO: 6833 - DNA, 915 bp, Tragopogon dubius
tcttgagcttgcaggcgcggcataaaccctagaggaagaacgtcggccatctgcaaacatgggtatctctcgtgattctatgcacaagagacgtgccactggaggcaagaagaaggcatggagaaagaagcgaaagtatgagctcggaaggcagccagccaacacaaagatctcaagcaacaagactgttaggagggtgagagttcgtggtggtaatgtgaagtggcgtgcattgaggttggatacaggtaacttctcttggggaagtgaggcagttacacgcaagacccgtatcttggatgtggtttacaatgcatccaacaacgagttggttaggacacaaaccctagtcaagagtgcaatcgttcaggttgacgctgcaccttttaagcagtggtatcttcaacactatggtgttgacattggtcgcaagaagaaaccagctgtttcagccaccaaaaaagagggagaagaagcagaaggtgctgcaacagaggaggccaaaaaaagtaaccatgttgtgaggaaactggaaaagaggcaagaggaacgtaaacttgatgcacatgttgaagaacaattctccagtggtcgtcttttggctgcaatctcatcgcgccctggccagtgtggtcgtgctgatggatacatattggaaggaaaagagcttgaattttacatgaagaagttgcagaagaagaaaggaaagggtgctgctgcttaagttgggttattatagatttgtatttctctttcttatttatttttgaggatgacatgattgagaatttcgttgagctttgtacttttgatgttgaaggacaagtgcaaggttcacattatttgttttgacaacatttttgcatcttttgtttaagtccatgtcttttgaacgaaaaaaaaaaaaaaaaaagt

SEQ ID NO: 6834 - DNA, 1092 bp, Cicer arietinum
ccgggtccgttcaaccctaattggcacatatataaatcatcacaaatattagggttttcactctgagtggtgcgagagaccttgtagcaactagtggagtgcgcctcgcatctttcaccatgggtatttctagggattctatgcacaaaaggcgtgccactggtggcaagaagaaggcatggaggaagaagagaaagtacgagcttggtcgccagccagctaacaccaagctatcaagcaacaaaactgttagacgcattcgtgttagaggtggcaatgtgaagtggagagctctcagattggatactggaaatttctcatggggaagtgaagctgtcactcgtaaaacccgtttgctcgatgtggtttacaatgcttccaacaatgagcttgtgcgaactcagacccttgtgaagagtgctatcgtgcaggttgatgctgctcctttcaagcagtggtatcttcaacactacggtgttgaaattggaaggaaaaagaaaactgcttccaaaaaagatacaccaggaggccgaagctgttacagaagaagccaaaaagagtaaccatgtccaaagaaaattagagacccgccagaaagaacgccagcttgattcccacattgaagagcagtttggtggtgggcgtttgcttgcatgcatttcatctcgacctggtcaatgcggcagggctgatggttacattcttgaaggaaaagagcttgaattttacatgaagaaactccagaggaagaagggcaagggtgccgcttgattgtactgtttccaaatttttattatcgttctagttgtgcttcatttgatgccgatggtcaacattctccttttggatatgatgccatctggcatttagtgcgaacgttctgtttagttttttgacagttgtttcttgattttgttgttaactgtgatatttatgattaacaattttgtcactcaatatgttttcaatcgtaattttcttttactttgttaaactgcaatgtctaattgtgagttgcaatagataagttaaatttcaaaggatcaatttttacaaaattctgctgtcgacaattcataagcaaagttttcg

SEQ ID NO: 6835 - DNA, 687 bp, Flaveria ramosissima
atgggtatctctcgtgattctatgcacaagagacgtgctactggtggaaagaagaaggcgtggaggaagaagcgaaagtatgagcttggaaggcagccagcgaacaccaagatctccagcaacaagactgttaggagggttagggttcgtggtggtaacgtcaagtggcgggccttgaggttggatactggtaactactcatggggaagtgaggctgtgacccgtaagacccgtatattggatgtggtttacaatgcatcgaacaacgagttggtcagaactcaaacgcttgtcaagagtgctattgtccaggtggatgctgcacctttcaagcaatggtaccttcaacactacggtgtggatattggccgcaagaagaaaaccgctgcttctacaaccaaaaaagagggagaggaagcagaaggtgcaactgaagaggccaaaagagtaatcatgttgtgaggaaactggaaaagcgtcaagaggaccgcaatctggaccctcacgtggaagaacaattctcaagtggtcgtcttctagctgcgatctcatcacgccctggccagtgtggtcgtgctgatggatacatattggaagggaaagagcttgaattctacatgaagaagctccaaaagaagaaaggaaagggtgctgctccttaagaccatatttcccttgatagatttg

SEQ ID NO: 6836 - DNA, 794 bp, Flaveria ramosissima
atgggtacctctcgtgattctatgcacaagagacgtgccactggtggcaagaagaaggcgtggaggaagaagcggaagtatgagctcggaaggcagccagcaaacaccaagatctccagcaacaagactgttaggagggttagggttcgtggtggtaatgtcaagtggcgggccttgaggctggatactggtaattactcatggggaagtgaggctgtgacccgtaagacccgtattttggatgtggtttacaatgcatcgaacaatgagttggtcagaactcagacacttgtcaagagtgcaattgtccaggtggatgctgcacctttcaagcaatggtatcttcaacactacggtgtggatattggccgcaagaagaaaaccgctgcttctacaaccaaaaaagagggagaggaagcagaaggcgcaaccgaagaggccaaaaagagtaaccatgttgtaaggaaactggaaaagcgtcaagaggaccgcaaactggaccctcatgttgaagaacaattctcaagtggtcgtcttctagctgccatctcatcacgccctggccagtgtggtcgtgctgacggatacatattggaagggaaagaacttgaattctacatgaagaagctccaaaagaagaaaggaaagggtgctgctgctcaagaccatatttcccttgatagatttgtatttcttttatttattttttgaggactcattatttttgttgacctttgtttgttaggtttgagttatttgaattgttgaatttcattttcatgtctgtttgatac

SEQ ID NO: 6837 - DNA, 964 bp, Medicago truncatula
tataaacaaaaaagacttgggcctgtttatgatgggtcgggtcagacccaacccttgttcagagagtatataagagacaacacattagggtttaacattctgcttgagccgaagctagttgaagcgcatcgtgcatcgtttcatccagtttcttcaagatgggtatttcacgagattctatgcacaagagacgtgaaactggtggcaagaagaaggcatggaggaagaagagaaagtacgagctcggtcgccagccagctaacacaaaactatcaagcaacaagacagtgaggaggattcgtgttagaggtggaaatgtgaagtggagagctctgagattggataccggtaacttctcatggggaagtgaagccgtcactcgcaaaacccgtttgctcgatgtggtgtacaatgcttccaacaatgagttggtgcgaactcagactcttgtgaagagtgctattgttcaggttgatgctgctcccttcaagcaatggtaccttcaacactatggtgttgatattggtagaaagaagaaaaatgttagcaagaaagaggaggaggctgaggctgctacagaagaagtcaaaaagagtgcccatgtgcagagaaaattagagcaacgccagaaagaacgccagcttgatgcccacattgaggagcagtttggtggtggacgattgcttgcatgcatttcttctcgacctggtcaatgcggcagagctgatggctacattcttgaaggtaaggagctagaattctacatgaagaaactccagaagaagaagggcaagggtgccgcttgattgtattgtttccatgtttttgtattgcattagttgttttaaatgagaccagtatcgaacaaagagatgttgtgcttcagctgatgctgttggttaacattttaatatctcttaatcttttgacgatagtgtcttgattttcctttagactgttcttg

SEQ ID NO: 6838 - DNA, 846 bp, Arnica chamissonis
cccttctctttgtcgaggttgagttcagaggcgcattgtgatctgcaaacatgggtatctctcgtgattcgatgcacaagagacgtgccactggtggcaagaagaaggcctggaggaagaagcgaaagtatgagcttggaagacagcctgcaaatactaagatatccagcaacaagactgttagaagggttagggttcgaggtggtaatgttaagtggcgtgcattgaggttagatacaggtaactactcttggggtagtgaggctgtaacccgaaagacccgtattttggatgtggtttacaatgcatcaaacaatgagttggtcaggacgcaaactctagtgaaaagtgcaattgttcaagttgatgccgcaccatttaaacaatggtatctacaacattacggtgttgatattgggcgcaagaagaaagctgtagctactgctaccaagaaagagggagaggaagctgaaactgctactgaggagacgaaaaagagcaatcacgttgtgagaaaattggagaaacgtcaagaggagcgtaaactagaccctcacgtagaagagcagttttcaagtggccgtcttttggctgctgtttcttcacgcccaggccaatgtggtcgtgctgacggatacattttggagggtaaggagcttgagttctacatgaagaagctccagaagaagaaagggaagggtgctgcttaagttttatttccttttccttttttactctgcaaggcatggaactgaaattttgatatgttttgtttgttaaaatgttgactttaatgaacgtgtctctgtaagttttactatcttctattaatactagtactattga

SEQ ID NO: 6839 - DNA, 830 bp, Centaurea maculosa
gagtccggaggcggcataaaccctagaggaggaggaagaagaaggatccttcgccatctgcaaccatgggtatttctcgtgattccatgcacaagagacgtgcaactggaggcaagaagaaggcgtggaggaagaagcgaaagtatgagctcggaagacagccagccaacacaaagatctccagcaacaagaccgttaggagggttcgtgttcgtggtggtaatgttaagtggcgtgcattgaggttggataccggtaacttctcgtgggggagtgaggccgtgacacgaaagacccgtatcttggatgtggtttacaatgcatccaacaatgagttggtcaggacccagaccctggtgaagagtgccatcgttcaggttgatgcagcaccatttaagcaatggtatcttcagcactatggtgttgacattggtcgcaagaagaaaggagctgcagctgcccccaaaaaagagggagaggatgctgaaggtgcaaccgaggaggctaagaaaagtaatcatgttgtgaggaagttggaaaagcgacaagaggaacgcaaactggatgcgcatgttgaagaacaattctccggtggtcgtctctatgcagcaatctcatcacgacctggccagtgtggtcgtgctgatggatacatattggaaggcaaagagcttgaattctacatgaagaagcttcaaaagaagaaaggaaagggtgctgcttaaatcttgttataggtttgtattttcttttttatttatttaatttgaggaaggcatgactcaggactccgtgttgagcgttcttagttaacttcgactttaacgagt

SEQ ID NO: 6840 - DNA, 868 bp, Centaurea maculosa
  misc_feature (6)..(6): n is a, c, g, or t
  misc_feature (8)..(8): n is a, c, g, or t
  misc_feature (27)..(27): n is a, c, g, or t
  misc_feature (95)..(95): n is a, c, g, or t
  misc_feature (762)..(762): n is a, c, g, or t
ggggancngagtccggaggcggcatanaccctagaggaggaggaagaagaaggatccttcgccatctgcaaccatgggtatttctcgtgattccntgcacaagagacgtgcaactggaggcaagaagaaggcgtggaggaagaagcgaaagtatgagctcggaagacagccagccaacacaaagatctccagcaacaagaccgttaggagggttcgtgttcgtggtggtaatgttaagtggcgtgcattgaggttggataccggtaacttctcgtgggggagtgaggccgtgacacgaaagacccgtatcttggatgtggtttacaatgcatccaacaatgagttggtcaggacccagaccctggtgaagagtgccatcgttcaggttgatgcagcaccatttaagcaatggtatcttcagcactatggtgttgacattggtcgcaagaagaaaggagctgcagctgcccccaaaaaagagggagaggatgctgaaggtgcaaccgaggaggctaagaaaagtaatcatgttgtgaggaagttggaaaagcgacaagaggaacgcaaactggatgcgcatgttgaagaacaattctccggtggtcgtctctatgcagcaatctcatcacgacctggccagtgtggtcgtgctgatggatacatattggaaggcaaagagcttgaattctacatgaagaagcttcaaaagaagaaaggaaagggtgctgcttaaatgttgttataggtttgtattttcttttnttatttattaatttgaggaaggcatgactcaggacttcgtgttgagcgttcttagttaacttcgactttaacgagtatgttgaaggaatagtgcaagatttgctaa

SEQ ID NO: 6841 - DNA, 866 bp, Cichorium intybus
gcgggcatcttgagctcgaggcgccggcggatccttcctgatctgcaaacatgggtatctctcgtgattcgatgcacaagagacgtgccactggtggcaagaagaaggcctggagaaagaagcgaaagtatgagcttggaagacagcctgcaaacacaaaaatttccagcaacaagacagttcgaagggttagggttcgtggtggaaatgtgaagtggcgtgcattgaggttagatacaggaaactactcatggggaagtgaggctgtaaccagaaagacacgtattctggatgttgtttacaatgcatcaaacaatgagttggtgagaactcaaactctagtgaagagtgcaattgttcaagttgatgctgcaccatttaaacaatggtatcttcaacactatggagttgacattggtcgcaagaagaaaacaactgccaccaagaaagaaggagaggaagtagaaggtgctactgaggaaacaaaaaagagcaatcatgttgctagaaaaattgaaaaacgtcaagaagaccgcaaactggacccacatgttgaggagcaattttcaagtggtcgtttattagcagcaatttcatcgcgccctggccaatgtggtcgtgctgatggatatattttggagggtaaggagcttgagttttacatgaagaaactccagaagaagaaaggaaagggcgctgcttaaattgttgagtttgaatgagtttgaatttataggtttttatttccttttgttaagtgaaagctatggaactgaaattttgatgtgtttttaaaatgttgtctttttaatgaatctttatgagttgatgtaagctttactacaccgctttgagtattaaagaag

SEQ ID NO: 6842 - DNA, 874 bp, Cirsium arvense
tgtcactcgagttcagaggcgcaagaggagcctttctgatctgcaaatatgggtatctctcgtgattcgatgcacaagagacgtgccactggtggcaagaagaaggcgtggaggaagaagcgaaagtatgagctcggaagacagcccgctaacactaagatatcgagcaacaagacagttagaagggtcagggttcgaggtggtaacgtgaagtggcgtgctttgaggttagatacaggtaactactcttggggaagtgaggctgtcaccaggaagacacgtatcttggatgtggtttacaatgcatcaaacaacgagttggtcaggacccaaactctagttaagagtgcaatcgttcaggttgatgctgcaccctttaaacaatggtatcttcaacactatggagttgacattggtcgcaagaagaaaccctcagctactgctaccaagaaagagggagaggaggcagaggctgctactgaggaggcaaaaaagagcaatcatgttgtgaggaaactggagaaacgtcaagaagagcgcaaacttgacccccatgttgaggagcaattttcaggtggtcgtcttttagccgcaatttcatcgcgccctggccagtgtggtcgagctgatggatatatcttggagggtaaggagctagagttctacatgaagaagctccagaagaagaaaggaaagggtgctgcttagaagcatttaatcttatcgaatttgaatttatagatttttatttcctttcgcccatggaaccgaaattttgatgtgttatgtttgttaaaatgtgacttttttatgaatcttttaagggttgatcaatgtaagcttttactcaaaaaagaaaaaagtaccgactgcg

SEQ ID NO: 6843 - DNA, 921 bp, Vigna unguiculata
gaagcagagagatacaatacagagtgtgtcgttgcttcttcgccacaactcaacaacatgggtatctcccgagattctatgcacaagaggcgtgccactggtggcaagaagaaggcctggaggaagaagagaaagtatgagcttggtcgccagcctgctaacactaaactgtcaagtaacaagactatcaggaggatccgtgttagaggtggcaatgtgaagtggagggcattgagattggatactggaaattactcctggggaagtgaagctgtaactcgcaagactcgtatacttgatgtggtatacaatgcctcaaacaatgagcttgtgcgtacgcagacccttgtcaaaagtgctattgttcaggtcgatgctgctccattcaaacagtggtatcttcagcactatggtgttgacatcggtaggaagaagaagacagttgccaagaaggattctgcagaggagggtgaagctgcagcagcagaagaagccaaaaagagtaaccatgtgcaaagaaaactagagaagcgccagaaggatcgcaagcttgatgctcacattgaggaacagtttggtggtgggcgtttacttgcttgcattgcctctcgacctggtcaatgtggcagagctgatgggtacattctggaaggtaaagagttggaattttacatgaagaaactccagaagaagaaggggaaaggcgctgcttgattttagtttttccaaaatttttatatatggctttagtcgtttttatttgttggtggtaccattcattctgatgttttgtgccacaggacatttagtgcaaactatcatcctagtatttgcaaattgacacttaatttttgtttttaactgtttttgcttctgatgagttacaatttttattaatgaatgcctttcagtccttaaaaa

SEQ ID NO: 6844 - DNA, 928 bp, Vigna unguiculata
ggagggagtcaagaagcagagagatacaatacagagtgtgtcgttgcttcttcgccacaactcaacaacatgggtatctcccgagattctatgcacaagaggcgtgccactggtggcaagaagaaggcctggaggaagaagagaaagtatgagcttggtcgccagcctgctaacactaagctgtcaagtaacaagactatcaggaggatccgtgttagaggtggcaatgtgaagtggagggcattgagattggatactggaaattactcctggggaagtgaagctgtaactcgcaagactcgtatacttgatgtggtatacaatgcctcaaacaatgagcttgtgcgtacgcagacccttgtcaaaagtgctattgttcaggtcgatgctgctccattcaaacagtggtatcttcagcactatggtgttgacatcggtaggaagaagaagacagttgccaagaaggattctgcagaggagggtgaagctgcagcagcagaagaagccaaaaagagtaaccatgtgcaaagaaaactagagaagcgccagaaggatcgcaagcttgatgctcacattgaggaacagtttggtggtgggcgtttacttgcttgcattgcctctcgacctggtcaatgtggcagagctgatgggtacattctggaaggtaaagagttggaattttacatgaagaaactccagaagaagaaggggaaaggcgctgcttgattttagtttttccaaaatttttatatatggctttagtcgtttttatttgttggtggtcccattcattctgatgttttgtgccacaggacatttagtgcaaactatcatcctagtatttgcaaattgacacttaatttttgtttttaactgtttttgcttctgatgagttacaatttttattaatgaatgcctttcagtcctt

SEQ ID NO: 6845 - DNA, 935 bp, Taraxacum officinale
cttttaagccactccccctcaaaaccctacctctcttcctcatccaagagctcgaggtcagcggcgcacggagcatcttcgtgatctgcaaacatgggtatctctcgtgattctatgcacaaaagacgtgccactggaggcaagaagaaggcgtggagaaagaagcgaaagtacgagctcggaagacagccagcaaacaccaaaatctcgagcaacaagactgttcgaagagttagggttcgtggtggcaacgtcaagtggcgtgcattgaggttagacacaggcaactactcatggggaagtgaggccgttaccagaaagacacgtatcctggatgtggtttacaacgcatcaaacaacgagctggtgaggacacagacactcgtcaagagtgccattgttcaagtcgatgctgcacctttcaaacaatggtaccttcagcactatggagttgacattggacgcaagaagaaagcaccagtttcagctaccaagaaagagggagaggaagtagaaggtggtactgaggaaacaaagaagagcaaccatgttgttaggaaattggagaaacgtcaggaagaaaggaaacttgacgcacatgttgaagagcagttttcaagtggtcgtttattggctgcaatttcttcacgccctggtcaatgtggtcgtgctgatggatacattttggagggaaaggagcttgagttctacatgaagaagctccagaagaagaaagggaagggtgctgcttaaattgttttgatgatggttattgagtttgatttaatagaattttatctcctttgttttaccctctaaagttatggaactgaaattttgatgtggtttttttgttaaaatgttgtttttaatgaatttataagagtagtaagctttattccctatcgatttaatcacatggttttgtttaacca

SEQ ID NO: 6846 - DNA, 2073 bp, Medicago truncatula
atatggcagatatgggatctagaatggtatgtgacaatgtgtgtggctgcacaattccgtgtgctggtggttccacttgcaggtgcacagggagtgaatcctcaagtgaagttgatcacacaacatgttcttgtggggagcactgtggttgcaacccatgcgcatgtcctaagaatgttgcagctggaactggttgcaaatgttcctcagcttgcgcatgcatttccagagatagtagagataaaaggcttgcaactggcggcaagaggaagacatgcatcaagaagagaaaatttttggtccgtttgcttttttacaattttgttactttgttgtggaatttgcggttcttaatgaatatggaattagggttggcgtacaggtatgagcttggtcgccagccagccaacactaagctttctagcaacaagacagtcaggaggatccgtgtcagaggtggcaatgtgaaatggagagcacttagattggacaccggaaatttctcgtggggtagtgaggcagtgactcgcaagactcgtcttctggatgtggtttacaatgcctcaaacaatgagcttgttcgtactcagactctggttaagagtgccattgtccaagttgatgctgcaccattcaagcagtggtatcttcagcactacggtgttgaagttggtaggaaaaagaaaacagcagccaagaaggattctgcagaggaggctgaagttgttgctgaagaagttaagaaaagtagccatgtgcagagaaaacttgagcagcgtcagaaagataggcaacttgattcccacatcgaagagcagtttggtggtggacgtttgcttgcctgcatttcatcacgccctggtcaatgtggcagggctgatggctacattttggaaggtaaggagttggaattctacatgaagaaactccagagaaagaagggcaagagtgccgtgtttaaggaaggctatggcttgaaacaagctcctagagcttggaataagaggtttcactctatccctgcttatcaagacttctcaaggtgtgtggttgattttggagtatatgttttgatgacagatggaaagctgcaatgttgcaaaaaccaccgtagaaggaaactagatgttggcaaaagcgcatcgtgcatcgtttcatccagtttcttcaagatgggtatttcacgagattctatgcacaagagacgtgaaactggtggcaagaagaaggcatggaggaagaagagaaagtacgagctcggtcgccagccagctaacacaaaactatcaagcaacaagacagtgaggaggattcgtgttagaggtggaaatgtgaagtggagagctctgagattggataccggtaacttctcatggggaagtgaagccgtcactcgcaaaacccgtttgctcgatgtggtgtacaatgcttccaacaatgagttggtgcgaactcagactcttgtgaagagtgctattgttcaggttgatgctgctcccttcaagcaatggtaccttcaacactatggtgttgatattggtagaaagaagaaaaatgttagcaagaaagaggaggaggctgaggctgctacagaagaagtcaaaaagagtgcccatgtgcagagaaaattagagcaacgccagaaagaacgccagcttgatgcccacattgaggagcagtttggtggtggacgattgcttgcatgcatttcttctcgacctggtcaatgcggcagagctgatggctacattcttgaaggtaaggagctagaattctacatgaagaaactccagaagaagaagggcaagggtgccgcttgattgtattgtttccatgtttttgtattgcattagttgttttaaatgagaccagtatcgaacaaagagatgttgtgcttcagctgatgctgttggttaacattttaatatctcttaatcttttgacgatagtgtcttgattttcctttagactgttcttggttatttatgatttacaattttgtcaatgaatatgatttgcaattacttccgtttaatttctgaatactgcaatggctagtttcatagtactgac

SEQ ID NO: 6847 - DNA, 732 bp, Citrus sinensis
agggttttagagtgggagcaaggcgagagtacgttacagtcagcagcgccgcagcagcagctacagctcaaccaagatgggtatttccagagattcaatgcataagaggcgcgccactggtggcaagaagaaagcttggaggaagaagcgcaagtacgaacttggtcgtcagcctgcaaataccaagctctctagcaacaagactgtacggagaattcgtgtcagaggaggcaatgtgaagtggagggccctgagactggacactgggaactattcctggggtagcgaggctgtcacccgcaagactcgtatcctggatgttgtttacaatgcctctaataatgagctcgtcaggactcaaactctggtgaagagtgctattgtgcaggtggatgcagcgccttttaagcaatggtaccttcagcactatggcgttgacattggtaggaagaagaaggcagttaccaagaaggaaaccacagaggagggagaaggtgcagcagcagcagcagaagaaactaagaagagcaaccatgttgttaggaagcttgaaaagcgccagaaggaccgcacactcgatcctcacattgaagagcaatttggtgctggcaggttgttggcctgcatttcttcacgcccaggtcaatgtggcagagctgatgggtacatactagaaggtaaggagctggaattttacatgaagaagctccagagaaagaagggcaagggtgc

SEQ ID NO: 6848 - DNA, 909 bp, Papaver somniferum
aaaccctactctgaagtttatcaggcaacgcagtcgagaggtttctctttccatctgcaaacatgggtatctctcgtgattctatgcacaaaagacgtgcaactggagggaaaaaaaaggcttggaggaagaagcgaaagtacgagctcggaagacagcccgcaaacaccaaactttcgagcaacaaaactgttcgaagagttagggttcgtggaggtaatgtgaaatggagagctcttagactagatacaggaaattactcatggggaagtgagactgtaaccaggaaatctcgtattcttgatgtcgtttacaacgcatctaacaacgagttggttaggactcagactttggttaagggtgctattgttcaagttgatgctgctccatttaagcaatggtatcttcaacattatggtcttgatattggacgtaagaagaagaatacttctgccaagaaagaaggagaggaggctgaggctgtagctgaggaagcaaagaagagcaaccatctcctgaggaaaattgagagtcgtcaagaagatcacaagcttgactcacatattgaagagcaattcagtggtggacgattattggcttgtatctcatctcgccctgggcagtgtggtcgtgctgatgggtacattctggaaggcaaagagcttgagttctaccagaagaagctccagaagaagaagggcaaaggagctgcttagaggctgtctctagctacttgttatcttttttagctactctcttcttaaatttatacatttggactattagtatgaagtgttctaatctagattgaagttttgtttctttaagccagtttttgtaatgtctttgatcgaacaaatgtcagtttaaacatcaaatttgctaagtcggatatcatctcagttttct

SEQ ID NO: 6849 - DNA, 1071 bp, Aquilegia formosa
cactctcaacacagcttctctttctcattagggtttcaacttgagcagcaaaaacccttgttgcaaccatgggtatttctcgtgattcgattcacaaaaggcgtgccactggaggcaaacagaaggtttggaggaagaagcgaaagtacgagcttggaagacaaccagcaaacaccaagctttccagcaacaagactgtaagaagaattagggttcgtggtggaaacgtgaagtggagagctttgaggttagatactggaaatttctcatggggtagtgaagctgttacccgaaagacccgtgttcttgatgttgtttataatgcatcaaacaatgagttggttcgtactcagactttggtgaaaggtgctattattcaagttgatgctgctccatttagacaatggtatctccagcattatggtcaggatattgggaggaagaagaagggtgctgctgctgccgccaagaaagaaggcgaggaggctgagactgttgctgaggaagcaaagaaaagcaaccatgttcaaagaaagattgaaaagcgtcaagaagataaaaagcttgatgctcacatcgaggagcaattttcaggtggtcgtttattggctgccatctcatctcgacctggtcagtgcggtcgttgcgatggatacatcttggagggaaaagagctggagttctacatgaagaagatccagaggaagaagggcaagggtagtgcaggcgctgcctagacagattacatggagggttgagcccttgtgttatcaaaaaactataagattagttattaaagttctgttttcctgaacttcatttttgggtttatttgttatggtacctttgactgtttaatgtctttcagactaaagtgttttttttatggctgttagctttagtaattaatggctcttgtttcttatagacttcagttattatgcacatgttttgttcagaagtttcttgttgtaggagtgaattagtgatactggaaatatcactgaagctggtagttttatttgaaaaccaaaggacaagtttatcagttaacacaagtatgttgcagtc

SEQ ID NO: 6850 - DNA, 846 bp, Heritiera littoralis
gggctgatgttgtgagcgtgaaacaaaagatagcaactgggtctgtacctcgcgccgctcagacaacatgggtatttccagggattccatgcacaagaggcgcgccactggtggcaaaaagaaggcttggaggaagaagagaaaatatgaacttggtcgtcaacctgcaaatactaagctctcaagcaacaagactgtaaggagaatccgtgttagaggagggaatgtgaagtggagagctttgagattggatacaggcaactattcatggggtagtgaagctgtcacccgcaagacccgaattcttgatgtggtgtacaatgcctcaaacaacgagcttgtcaggacacagactcttgtaaagagtgccattgttcaagtggatgctgctcccttcaagcaatggtaccttcagcattatggtgttgatattggtaggaagaagaagacagcagctaagaaggaagctagtgaggaaggagaaggtgctgctgaggaaactaagaagagtaaccatgtgcaaaggaagcttgagaagcgccagaaagatcgtaaacttgacactcacattgaagaacaatttggtgctggtaggttgttggcatgcatttcttcccggccaggtcaatgtggcagagctgatggatgcattttggagggtaaagagctagagttctatatgaagaaaatccagaggaagaagggcaagggtgctggagctgcttagatgcagtttttcacatgtccaactctgaccaatgtgattttgtttgctttatgttgtgttcctttatggctaccatcgaagatgtgatacatttttaattgtgaacattttacgtagat

SEQ ID NO: 6851 - DNA, 1091 bp, Prunus persica
gggttgagagtttactttagccgaagcgcagcggagagagctcgttcgcggtctcaactcaccgaagctctctctctccagtcgggaaccatgggtatctcacgtgactcgatgcacaagagacgtgccactggaggcaagaagaaggcatggaggaagaagagaaagtatgagctcggccgtcagcctgcaaatactaagctttcaagcaacaagactgttaggcgaatccgtgtgcggggaggcaatgtgaaatggagagctctcaggttggatactggtaacttctcatggggtagtgaagctgttactcgtaaaacccgtctcctggatgttgtatacaatgcctcaaacaatgaacttgttagaacccaaactctggtgaaaagtgccattgtccaggtggatgcagctccatttaagcaatggtaccttcaacattacggagttgaaattggcagaaagaagaagactgctgctgctgctaagaaggataccccagaggagggagaagcaactacagaggaagcaaagaagagtaaccatgttgcgagaaagcttgagaagcgtcagcaaggtcgcaccctggacggccatattgaagagcagtttgggggtgggagattgcttgcttgcatatcttcccgtccaggccaatgtggcagagctgatgggtacatcttggaaggtaaggaactggagttttacatgaagaagctccagaggaagaagggaaagggtgctggtgctgctgcataaacacttcattgaccagacttttgtcccttttggcttcgcatgagatttgttttagtttgaaccttttaatttgcctagggacatacatgttggttgcctgtgctaatgcaagtctttcaagttttctaggcatctctggtattccagatttagaagattttgacaattttgctgaccgagctgggtccttttattgttatttgatatttttattgtgctagtcaaagtaatttactggatgagtcaatgtagagtttggtggattttgatacatttctatccagagttttatgaactctatatatcttgtggcaatcaattggcgttttgaa

SEQ ID NO: 6852 - DNA, 1008 bp, Cenchrus ciliaris
gagaagaagccagaggagggggaggcggagcagcagtagccgggccaagccaccgccgccaccatgggtatctcgcgtgactcgatgcacaagcgccgggccaccggtgggaagcagaaggcctggaggaagaagcgaaagtatgagctcggccgccagcctgcaaacaccaagctgtccagcaacaagacggtgaggagggtccgtgtccggggaggaaatgtcaagtggagggctctccgcctggatactggtaactactcatggggaagtgaggctgttacacgcaagacccgtatcctggatgttgtctacaatgcgtcaaacaatgagcttgttcgcacccagacccttgtgaagagcgctattgtgcaagttgatgctgccccatttaagcagtggtacctcactcactatggagtggacattggtaggaagaagaaggcccctgctgcagccaagaaggatactgcagagggtcaagagggtgaggctgcagctgaagaagcaaagaaaagtaaccatgtcaagaggaagcttgagaagcgcaaggaggcacgtgcacttgacgcgcacattgaggaacaatttagcagtggaaggttgttggcgtgcatcgcttctcgtcctggacagtgtggccgagctgatgggtacatccttgagggtaaggagctcgagttctacatgaagaagctccagaagaagaagggcaagggtgctgcagcttagatgcattatcttgctccaagggtggcctatcttatccttttactctgggttttgttagtcctcaagtatgttgtgttgcagacctgattgaacacctattttctaaaagtgaatcaactctagcttcaaagaactgagaatgttcaccctgccgtggttgtattctcgtgatgtttaggttcactgtttctggacagtttctgttcagcagttttggtttatctcatattgctttctgaatggtgtatttcttgtttggtctttattggttggttg

SEQ ID NO: 6853 - DNA, 1166 bp, Cenchrus ciliaris
aggaggaggaggaagaggagcagcagtagccgggccaagccaccgccgccaccatgggtatctcgcgtgactcgatgcacaagcgccgggccaccggtggtaagcagaaggcctggcggaagaagcggaagtatgagctgggccgccagcctgctaacaccaagctgtccagcaacaagacagtgaggagggtacgtgtccggggaggaaatgtcaagtggagagctctccgcctggatactggtaactactcatggggaagtgaggctgttacccgcaagacccgtatcctggatgttgtctacaatgcgtcaaacaatgagcttgttcgcacccagacccttgtgaagagcgctattgttcaagttgatgctgccccattcaaacagtggtacctcactcactatggagtggacattggtaggaagaagaaggcccctgctgcagccaagaaggatactgcagagggtcaagagggtgaggctgcagctgaagaattaaagaaaagtaaccatgtcaagaggaagcttgagaagcgcaaggaggcacgtgcacttgatgcgcacattgaggaacaatttagcagtggaaggttgttggcgtgcatcgcttctcgtcctggacagtgtggccgagctgatgggtacatccttgagggtaaggagctcgagttctacatgaagaagctccagaagaagaagggcaagggtgctgcagcttagatgcattgtcttgctacaagggcggcctatcttatccttttactctgggttttgttagtcctcaagtatgttatgtcgtgttgcagacctgattgaacacctattttctaaaagtgaatcaactctagcttcaaagaactgagaatgttcaccctgccgtggttgtattctcgtggtgtttaggttcactgtttattgacagtttgtgtccggcagttttggttgatctctcagattgctttttgaatgttgtgttttctgtttgatctttatttgttggttgcgaatgttgcgattatctgccagacaagcacaaacttgatgaggagctctgcagccactgattacatgctgttgtgttaatacggtgcttgatacctgaggtctagtgttgattttacaccatgaggtatgcatccatttgttttaagaagatgttgcaac

SEQ ID NO: 6854 - DNA, 902 bp, Cenchrus ciliaris
ggagcaccagcggagggggaccaagccaccgccgccaccatgggtatctcgcgtgactcgatgcacaagcgccgggccaccggtgggaagcagaaggcctggaggaagaagcgaaagtacgagcttggccgccagccagctaacaccaagttgtcaagcaacaagacggtgaggagggtccgcgtccgtggaggtaatgtgaagtggagggctctccgcctggatactggtaactactcttggggaagtgaggctgttacccgcaagacccgtatccttgatgtggtctacaatgcttcaaacaatgagcttgtgaggactcagaccctcgtgaagagcgccattgtgcaagttgatgctgccccattcaaacagtggtacctcacgcactatggactggacatcggtaggaagaagaaggcacctgctgccaagaaggatggtgctgagggacaagaggctgaggctgcagctgacgaaactaagaagagcaaccatgtcaagaggaagcttgagaaacgcaaggagggacacaaacttgacccccacattgaggagcaatttggtagtggaaggctgttagcttgcattgcttcccgccctggtcagtgtggccgtgctgacgggtacatccttgagggtaaggagcttgagttctacatgaagaagcttcagaagaagaagggcaagggtgcagcagcttagagccatatgcatgtttggaaggggtgacctatcaaatattatatggcttttttgttagttgtctcaagggcagagtatgtcgtgtttggtttgcagacctgatgagcacaatattttctaaaaatgaatcaactctagccaagaattgagaatatgcaccggactgtggttgtattctcgtagtctcgagggggggc

SEQ ID NO: 6855 - DNA, 1028 bp, Echinacea purpurea
caatcacgagcccagttctgactctggactagggttttgaacagactaggggccggggttcatcttattaaagcattctctaaccaaaccctacccttctcttcttcacttgaatccagaggcggagcttcccttccctgtgatctatctgcaaacatggggatatccagagactccatgcacaagagacgggccactggtggcaagaagaaggcctggagaaagaagcgaaagtatgagcttggaaggcagcctgccaacactaagatttccagcaacaagactgtaagaagggtaagggttagaggcggtaatgtgaaatggcgggctttgaggttggatactggtaactactcatggggaagtgaggctgtgacacgtaagactcgtattttggatgtggtctacaatgcatcaaacaatgagttggtcagaactcagacacttgtcaagagtgcaatcgtccaggtggacgctgcgcccttcaagcaatggtatcttcaacattacggtgttgatattggccgcaagaagaaagcagctgctgcagtcaaaaaagatggagaggaagcagaaggtgcaacagaagaagccaaaaagagtaaccatgttgtgaggaaactggaaaaacgtcaagaggaacggaaactggaccctcatgttgaagaacaattctccagtggtcgtcttctagctgccatctcatcacgccccggccagtgtggtcgtgctgatggatacattttggaagggaaagagcttgagttctacatgaagaagcttcagaagaagaaaggaaagggtgctgctgcttaaaagcacatttctctatgatagatttgtatttcttgtttattttttaagtaaaggcaggactatgaggttgacttttctttgattgttgactgtattttcgcatttagtgtcatgaccttcaaatgacccatgtttcatcgaattaaaagcgtctttagtctgttttagacaaggttgtgcaaggttcaaaccgaaccgaaactaaatttttg

SEQ ID NO: 6856 - DNA, 931 bp, Festuca arundinacea
aaccaaagctgcggcggcgcgggcgtagaaggcgaagcaggggcggagccaagccaccggcgacaccatgggtatctcgcgtgactccatgcacaagcgccgggccaccggtgggaagatgaaggcgtggaggaagaagcgaaagtatgagctcggccgccagccagctaacactaagctgtccagcaacaagactgtgaggagggtccgtgtccgtggaggtaatgtgaagtggagggctctccgcctggatactggtaacttctcatggggaagtgaggctgtgacccgcaagacccgtctcctggatgtggtttacaacgcgtcaaacaacgagctggtgcgcacccagactcttgtgaagaacgccattgtccaagttgatgctgctcccttcaaggggtggtatctgacacactatggagtggacattggtcgcaagaagaaaaccactgctgctgcaaagaaggacgcagctgagggacaagagggtgaggtcgctgcagctgccacagaggaggcaaagaagagtaacaatgtccagcggaagctggagaagcgtcagcagggacgcactctggatgcccacattgaggagcagttcagtagtggaaggctgttggcctgcatctcatcccgccctggccagtgtggcagagccgatgggtacattctggagggcaaagagctggaattctacaccaggaagctccagaagaagaagggcaagggtgccgcagcttagatcacaccttcctgtgtgctttatggcaggcctgcgtatttcatttcctggattttgatagttgttgcgtccatgttactatgttgcaaacgtgctgaacactattttctgcaagtgaatcgactctaggttggaaccttaaaaaaaaaagaaaaaaaaacaaaagtactctgcgttgataccact

SEQ ID NO: 6857 - DNA, 997 bp, Festuca arundinacea
caaccaaagctgcggcggcgcgggcgtagaaggcaaagcaggagaggagccaagccaccgacgccaccatgggtatctcgcgtgactccatgcacaagcgccgggccaccggtggaaagatgaaggcgtggcgcaagaagcgaaagtatgagctcggccgccagcctgctaacacgaagctgtccagcaacaagacagtgaggagggtccgtgtccgtggtggtaacgtgaagtggagggctctccgcctggatactggtaacttctcctggggaagtgaggctgtcacccgcaagacccgtcttctggatgtggtgtacaatgcgtcaaacaatgagcttgtacgcacacagaccctggtgaagaacgccattgtccaagttgatgctgctcccttcaaggggtggtatctgacacactacggagtggacattggtcgcaagaagaaaacccctgctgttgcaaagaaggacgctgctgagggacaagaaggtgaggttgctgcagctgccacagaggaggcaaagaagagtaacaacgtccagcggaagctggagaagcgtcagcagggacgcactctggactcccacattgaggagcagttcagcagcggaaggctgttggcctgcatctcatcccgccctggccagtgtggcagagccgatgggtacattctggagggcaaggagctggaattctacaccaggaagctccagaagaagaagggcaagggtgccgcagcttagatcacaccttcctgtgtgctttatggcaggcctgcgtatttcatttcctggattttgatagttgttgcgtccatgttactatgttgcaaacgtgctgaacactattttctgcaagtgaatcgactcttggttggaacttctaagaatattttgccaggttcagtaactgtgatattacgaccaaaaaaaaaaaaaaaaaaaaaaaaacaaaaaaaaaaaaaaaaaaaaaaaaaaaaaaaaaaaaaaaaaaa

SEQ ID NO: 6858 - DNA, 976 bp, Festuca arundinacea
agtggtatcaacgcagagtacggggggctctttcctcctgcgagactcaaccaaagctgcggcggcgcgggcttagaaggcgaagcagcggaggagccaagccaccgacgccaccatgggtatctcgcgtgactccatgcacaagcgccgggccaccggtgggaagatgaaggcgtggcggaagaagcgaaagtatgagcttggccgccagcccgctaacactaaactctccagcaacaagacagtaaggagggtccgtgtccgtggaggtaatgtcaagtggagggctctccgtctggatactggtaacttctcatggggaagtgaggctgtgacccgcaagacccgtctcctggatgtggtttacaatgcatcaaacaatgagcttgtccgaacccagaccctggtgaagaacgccattgtccaagttgatgctgctcccttcaaggggtggtatctgacacactatggagttgacattggtcgcaagaagaaaacccctgctgctgccaagaaggacgcagctgagggacaagagggagaggttgctgcagctgccacagaggaggctaagaagagtaacaacgtccagcggaagctggagaagcgtcagcagggacgcactctggatgcccacattgaggagcagttcagcagtggaaggctgttggcctgtatctcttcccgccctggccagtgtggcagagccgatgggtacattctggagggcaaagagctcgagttctacaccaggaagctccagaagaagaagggcaagggtgccgcagcttagatcccaccttactgggttttgtcctctatattatgttgtaaacgtgctgaacactattttctgcaagtgaatcgattctaggttggaacctctgagaatattttgcctggttcagtaaccgtagtattcttcaatctgctgtgtactatttacgactgtcattctctactccgtttggttatt

SEQ ID NO: 6859 - DNA, 950 bp, Panax ginseng
aagcagtggtatcaacgcagagtacatggggctctccaaatctcctcccgagtttggtccgtttccgctgctggtatttgggttctttcaccttctacaaccatgggtatttctcgtgattcgatgcacaagaggcgtgctactggaggcaagaagaaggcttggaggaagaagcgaaagtatgagcttggaagacaacctgcaaatacaaagttgtctagcaacaagacagttcggagggtaagggttcgtggtgggaatgtgaagtggcgtgccttgagattggatacagggaactactcttggggtagtgaagctgtgacccgtaagactcgaatcctggatgtggtctataatgcatcaaataatgaattggttaggacccagacattggtgaagagtgctattgttcaggttgatgcagcaccatttaagcaatggtatcttcagcactatggtgttgacattggtcgcaagaagaaatcctctgctgctgctgctgccaaaaaaggagaggagggtgatgttcctatcgaggaggcgaagaagagtaaacatgtcctgagaaaaattgaaaagcgtcaagaggatcgtaagattgacgcacatattgaagagcaatttgggggtggccgtctattagctgcaatttcatcacgacctggccaatgtggccgtgctgatggatacatcttggagggcaaggagctggagttctacgtgaagaaactccagaggaagaaaggaaagggtgctgcagcttaaaatggagttgcaattcagaacatttgtgttttctattttactttttcagagatggaaccaaagaactattcagctctcatagttagctttgtttcttgttatgtctcttgagtgttgaaggagaattttggcatcatctttaattttcaacagtggtagtattatcgacttaatttcagctttat

SEQ ID NO: 6860 - DNA, 1032 bp, Oryza sativa
tcccccccgctagttcccaaccagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccatttaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctggacgcgcacattgaagagcaatttggcagcggaaggctcttggcctgcatctcctcccggcctgggcaatgtggcagagctgatgggtacatcctggagggcaaagagcttgagttctacatgaagaagctccagaggaagaagggcaagggtgctgcagcttagagcgttctctcgagtgtgttttacgctggaaggcccgcctattttattcagtggattttgttagtcatgtttgcgtctatgtcgtgcctacagaccctactgaacaccaattttctgaaagaatgatgaatcaactcttagcttggaagaactgattgtgagaattttcacatgctatggttgtattctcgtggtatttaggttccatgtgtactcagctacagcattctgttatgttttatgcccttccaaggttttagtttttcggtcta

SEQ ID NO: 6861 - DNA, 958 bp, Glycine max
ggggcgcacccagagaggaggaagctttgagagagagagagggaggagggagagtgttgacgctccatcaagatgggtatttctagggattccatgcacaagaggcgtgccactggtggcaagaagaaggcctggagaaagaagagaaagtatgagcttgggcgtcaggccgcaaacaccaagttatcaagcaacaaaactatccggaggattcgtgttcgaggtggcaatgttaaatggagggcattgaggttggataccggcaattactcatggggtagtgaagcagttactcgcaagactcgtattctagatgttgtttacaatgcctcaaacaatgagcttgtgcgaactcagaccctggtcaagaatgctattgttcaggttgatgctgctcctttcaagcagtggtaccttcagcactatggtgttgaaattggtagaaaaaagaaagtggcatccaagaaggactctactgaggagggtgaggctgctgctgaagaaactaagaaaagtaaccatgtccagagaaaacttgagaaacgccagaaagatcggaaacttgactcccacattgaagagcaatttggtggtggccgattgttggcctgtatttcttctcgtcctggacaatgtggcagggctgatgggtacattctggaaggtaaggagctggagttttacatgaagaaactccagaggaagaagggaaagggtgctgcttaattttagtgttttatgaacttctatttggctttagttcttggaagttggtacaattcaagatgtacgctttttgactgttggtcgatctcctttagggtgatgccataggacatccttagtgtgaacgttttattagcgtacatcttgaatttgagacagggatgcatgagtattctacttgtcattaccatatcatcagataagagaacaaaactgcgctgattttgaaatt

SEQ ID NO: 6862 - DNA, 859 bp, Triphysaria pusilla
cctcgtctgcctttgctcgtgttctcagctgggagcctagaatcctcaaccagcaatcatgggtatttctcgggattctatgcacaagaggcgttcaactggagggaagcagaagacatggaggaagaagcgaaagtacgagctcggaagacaaccggcaaacacgaagctgtcaagcaacaagactgtgcgcagagtgagagttcgtggaggtaacgtgaagtggcgtgcattgaggttggataccggaaacttttcgtggggtagtgaagctgtgacccgaaaaacccgtattctagacgttgtttataatgcatccaacaacgagttggttaggacccagactttggttaagggtgccgtcattcaagtcgacgctgcacctttcaagcaatggtatcttcagcattacggggtcgaaattggccgcaagaagaagactgctgctgcctctgccaagaaggacggagaggaaactgaggctgctgctgctgctgaagaggcgaagaagagcaaccatgtgaaaagaaaaatcgagaagcgtcaggaggagcgtaaaatagacgcacatatcgaggaacaatttggcggtggccgtttgttagctgctatttcatcacgcccaggccagtgtggccgtgctgacggttacattttggagggcaaggagttggagttttacatgaagaaacttcagaggaagaagggaaagggtgctggtggtgtttaatttatgtcttcaaggacaaagcatatttttcgattcagtatttgttattttttctttatggcttgtacgaccagaacaatagtttggtattgaacgattttgatatgttactagtgcgacatcacattt

SEQ ID NO: 6863 - DNA, 1039 bp, Triphysaria pusilla
cggaatatgcacggaaataccgccattagtgacggaggactttcagttttgcctttgcctcaactggaaaaaaatcggagcctagaatcctcaaccagcaatcatgggtatttctcgggattctatgcacaagaggcgtgcaactggaggcaagcagaagacatggaggaagaagcgaaagtacgagctcggacgacaaccggcaaacacgaagctgtcgagcaacaagactgtgcgcagagtgagagttcgtggaggtaatgtgaagtggcgtgcattgaggttggataccggaaacttctcatggggtagtgaagctgtgacccgaaaaacccgtattctagatgttgtttacaatgcgtccaacaatgagttggttaggacccagactttggttaagggtgccgtcattcaagtcgacgctgcacctttcaagcaatggtatcttcagcattacggggtcgaaattggccgcaagaagaagactgctgctgcctctgccaagaaggacggagaggagactgaggctgctgctgctgaagaggcgaagaagagcaaccatgtcaaaagaaaaattgaaaagcgtcaggaggagcgtaaaatagatgcgcatatcgaggaacaatttggaggtggccgtttgttagctgctatctcctcacgcccaggccagtgtggccgtgctgacggttacattttggagggcaaggagttggagttttacatgaagaaacttcagaggaagaagggaaagggtgctagtggtgtttaatttatgtcttcgaggacaaagcatatttttcgattcagtatttttatctttgttttttggcctgcagtctagaacaatagtttgttatcgaactattttgatctgttactagtgcgacatcacatttacaattaattatccatcgttggttgattgactgattttagtcgtttatacaaaaaaaaaaaaaaaaaaaaaaaaaaaaaaaaaaaaaaaaaaaaaaaaaaaaaaaaaaaaaaaaaaaaaaaaaaaaacaaaaaaaaaaaa

SEQ ID NO: 6864 - DNA, 962 bp, Solanum lycopersicum
ggtgttgttcgttcaaagcggaagagtggtgtgtgagggagtgcggcttagttctcagtaaccatgggtatctcacgagactctatgcacaaaaggcgcgccaccggtggcaagcagaaaacatggaggaagaagcgaaagtacgagcttggccgtcagcctgctaatactaagatctctagtaacaagacagtcagacgcattcgtgttcgtggtggcaatgttaaatggagggcactaagattggatacaggaaattattcatggggtagcgaggctaccacccgtaagactcgtatccttgacgtggtctataatgcctcaaacaatgaacttgttcgcacacagactcttgtcaagagtgcaattgtgcaggtggatgcagcaccctttaaacagtggtacctccagcattatggtgttgacattggtaggaagaaaaagggggctgctgcaaagaaggaaactgctgaggagggagacggtgctgccactgaggaaactaagaagagcaaccatgtactccgaaaaattgagaagcgccaggcggagcgcaaacttgattctcaccttgaagagcaatttagttctggtagattatatgcttgcatctcatctcgccctggtcagtgtggcagagctgatgggtatatcttggagggcaaagaacttgagttctatatgaagaaactacagaagaagaagggcaaggctgcagctgcttaattggagctctttgaatttagaggctaatttatatgtttctttttcctttttccttgaacaagttggttttgtgaggatatttttctatattcagtattctttaatcttattatgagttgacattgacgcctgaactacgtttattgttggcattcattacttgtttcagcgtattctgaatttttggttgccatataaacatatgttgctggtcgttctggctgagttagtgttgc

SEQ ID NO: 6865 - DNA, 1048 bp, Amborella trichopoda
acagataaaagcgcccctttccctctccatttgagcttagagcagcgtatcagaggcaagcaatctgagcgctcaagatgggtatctctcgtgattctatgcacaagaggcgtgccacaggagggaagaagaaggcctggaggaagaagagaaagtatgaattggggcggcagcctgcaaacacaaagctgtccagcaacaagacagtgagaagagtacgcgttagaggaggcaatgtaaagtggagggccctcaggttggataccggtaattactcgtggggaagcgaggctgttactcgcaagactcgtattcttgatgtggtttacaatgcttcaaacaacgaacttgtgaggactcaaactttggtgaagagtgctattgtgcaagtggatgctgccccttttcgccagtggtacctccagcattatggtattgatattgggaggaagaagaagacgggagctgcaaagaaggaaggagaggagggtgaagctgcaattgaagaagtcaataagagcaaacatgttcttaggaagctagagaaacgtcaggagggacacaaacttgatccccacattgaggagcagtttggaggtggtcgattgcttgcttgcatctcttcccgccctgggcaatgtggacgagctgatggatacattctagagggaaaggagcttgagttttacatgaagaagattcagaggaagaagggtaagggtgcttctgcttgaacttgcaaattatttgcacgtttttgtggttttacacccttgtggttttcaagagatttaattgggaatgcatttttggggattggattaggcatctatttgatgaggttagtttttgggatttggtcaaaccttttgtaactagggatcaaggacaattttgcagcattgtcgcctatgttaaggaactgttctgttccattttccgcattttgttttaattcagtttcttttttcttctgtcaaaatattgatgcatgcatccactgtgagactacttcaaaacttagcagcaagtgaatcttttgctccct

SEQ ID NO: 6866 - DNA, 942 bp, Antirrhinum majus
ggcgctgtgaggagaccaatcggaaaccctagaatccgttagcaaccttcaatcatgggtatctcacgtgattctatgcataagaggcgtgctactggaggcaagaagaaggcctggagaaagaagagaaagtatgagctcggaagacagccagcaaacaccaagttgtcgagcaacaagactgtgcgcagagttagagtccggggaggtaatgtgaagtggcgtgcattgaggttggacacaggaaactactcttggggtagtgaagccgtgacccgaaagacccgtgttctggatgtcgtctacaatgcatcaaacaatgagttggtcagaactcaaactttggtgaagggtgctattgttcaggttgatgcggcaccattcaagcagtggtatcttcagcattacggagttgagattggtcgcaagaagaaaactgctgccaagaaggaaggagaggaagctgaggccaccgctactgaagaggtaaagaagagcaatcatgttcagaggaaaattgaaaagcgccaacaagagcgcaagattgacgcacatattgaggaacaatttggcggaggccgtttgttggctgcaatctcgtcacgcccagggcaatgtggtcgctgtgacggttatatcctcgaaggcaaggagttggaattttacatgaagaaacttcagaggaagaaaggaaagggtgcaggtggtgcttagtttttgtagtaagatcatcaaaaaattcccagtcccaaacttcttttgtcgtcccttgtcgctaaatctatggaatcgactaaacagaaattgttcgagtttttttgagatactatttatttttaaggtgaattttgattaaattttacttacgtcttgactcttggattgctctgatgtagctattgcaatttttgctatgtgttttacatgttcgattaaaagcgg

SEQ ID NO: 6867 - DNA, 871 bp, Arnica chamissonis
tttttatttttcgtcggccatctgcaaacatgggtatctctcgtgattccatgcacaagagacgtgcgactggtggcaagaagaaggcctggaggaagaagcgaaagtatgagctcggaagacagccggccaataccaagatctccagcaacaagactgttaggagggttcgggttcgtggtggtaatgtcaagtggcgcgccctgaggttggacacaggtaattactcatggggaagcgaggctgtgacacgaaagactcgtattttggatgtggtttacaatgcatccaacaatgagttggtcagaacccagacacttgtcaagagtgcaatagtccaggtggatgctgcacctttcaagcaatggtatcttcaacactatggtgttgagattggtcgcaagaagaaaaccgtcactcctgcaggcaagaaagagggagaggaagcagaaggtgcaacagaggaggctaaaaagagtaaccatgttgtgaggaaactggaaaaacgtcaagaggaacggaaactggacccccatgttgaagaacagttttccagtggtcgtttgctagctgccatctcatcacgccccgggcagtgtggtcgtgctgatggatacatattggaaggaaaagagcttgaattctacatgaagaagctccagaagaagaaaggaaagggtgctgctgcttaaaaccatatttctttataggagatctgtgttttttatttattttgaggaatggcatgactaagagctttgacttttttgaatggtgactatttctgtgtttagtgtcatgaccttcgaatggcgcgtgtttgatcaagtttaaggcttaagagcgttttaaacggtctacccttttaagg

SEQ ID NO: 6868 - DNA, 855 bp, Persea americana
gagagagaaagagaagccatcagcaatcgttcgtctcctccacaactctgcaaaatgggtatctctcgagactccatgcacaaaagacgtgccaccggcggaaagaagaaagcttggaggaagaagagaaagtacgagctaggccggcagccagcaaacactaagctctcgagtaacaagacagtgaggagagttcgtgtccggggagggaatgtgaaatggagagcactgcgactggacacgggcaactactcatggggaagtgaggctgttactcgtaaaacccgtgtcctcgacgtggtttacaatgcatcaaacaatgagcttgtaaggacacagactctggtgaagagtgccattgttcaggtagatgctgcacctttcaagcaatggtatcttcagcactatggtgttgacattggtcggaagaagaaggctcctgcagtcaagaaggaagctgccgaggagggcgaaggtgcaacagaagaagtgaagaagagcaaccacgtaaccaggaagttggagaagcgtgtgcaaggtcacaaacttgacccccacatcgaggaacagtttagtggtggtaggttgctggctgccatttcatctcgccctggtcaatgtggtcgagctgatggatacatcttggaaggaaaggaacttgagttctacatgaagaagatccaaaggaagaaaggcaagggtgctgcagcttagtcgaactttcaccaattttattttggttctgttattagacctagatttgttgtgtctttatgctgtatatggacatggtcaatgggaggttgtaattttccatctgaatgtggttgaccttaattttactttgcaattgta

SEQ ID NO: 6869 - DNA, 979 bp, Catharanthus roseus
ggcacgagggtgagagaggcgtttgagagaacagagaccgccgtctcgtttactgcagctgtagcagcaggaccgaagtcgcctccaccactaccgtcgcaaccatgggtatttctcgagattccatgcacaagaggcgtgccactggtggcaagaagaaggcctggaggaagaagagaaagtatgagctcggccgtcagcctgctagtaccaaactctctagcaataagactgttaggagagtccgtgttagaggaggcaatgttaagtggagagccctgagattggatactggaaattattcttggggtagtgaggctgtaacccgcaagactcgtattcttgatgtggtctacaatgcttcaaacaatgagcttgtgagaactcaaacactggtgaaaagtgccattgttcaggttgatgctgcacctttcaagcaatggtaccttcagcactatggtgttgatattggtaggaagaagaaggcagcagctaccaagaaggaaggagaggaggctgaaggtggtgcagccacagaggaaaccaagaaaagcaatcatgttgtcaggaagcttgagaaacgtcaaaaagatcgtaagcttgaccatcatattgaggagcaatttggctctggtaggttgttggcgtgcatttcatcccgtccaggtcaatgtggcagggctgacggatatatcttggaaggaaaggaacttgaattttatatgaagaaactacagaggaagaagggcaagagtgctggtgctgcctagacaccaaaggacttgagctccttttcgagtcagacgcattagtccatatgttttttgctttcagtttttcgtatcaaaccggtgtcctgtaaccaatacgcaactctaaaattttggtttccatgctagaagttggaccattttctgtgagctccatgttttggttaagatgatatatttgtattgctttatctcataaaccttagttt

SEQ ID NO: 6870 - DNA, 875 bp, Castanea mollissima
gagagcacttcgctgcggggccaagatgggtatctcaagagactctatgcacaagagacgtgccactggtggcaagaagaaagcttggagaaagaagcgcaagtatgagcttggtcgccagccagcaaatactaagctctcaagcaacaagacagtaaggagaatccgtgtgagaggtggaaatgtgaagtggagggcccttagattggatacagggaatttttcatggggtagtgaggctgtcactcgcaaaacccgtctccttgatgtggtttacaatgcctcaaacaacgaacttgttaggacacaaactctggtgaagagtgccattgttcaagtggatgcagctccatttaagcaatggtaccttcaacactatggtgttgatgttggtaggaagaagaaggcgaccactaagaaggaaaccgcagaggagggggaaggtgctgctacagctacagaggaaactaagaagagcaatcatgttcagaggaagattgagaagcgccagaaagatcgtcagcttgatccgcatattgaagagcagtttggttctggtaggttgttggcctgcatctcttctcgacctggtcaatgtggcagagctgatgggtacatattggaagggaaagaacttgaattctatatgaagaaactccagcggaagaaaggaaaggctggtgctggtgcttaattgtactgtgttagtgttttgatgttgactagttgaatctttatttttaggctatagcttccattgaagaagaggcttttgctaagcatttttgctgttacctgattggtgaccacttgaacgatgtcaattgttggggcatcatctcttagaacatttttggtaacacattgggtttaat

SEQ ID NO: 6871 - DNA, 898 bp, Cichorium intybus
gcgcggcatccaccctagaggaggatcgtctgccatctgcaaacatgggtatctctcgtgattccatgcacaagagacgtgcgactggtggcaagaagaaggcatggagaaagaagcgaaagtatgagctcggaaggcagcctgccaacacgaagatctcaagtaataagactgttaggagggtgagagtccgtggtggcaatgtaaaatggcgtgcattgaggttggatacaggcaactactcatggggtagtgaggctgtgacccgcaagactcgtatcttggatgtggtttacaatgcatccaacaatgagttggtcaggacccaaaccctggtgaaaagtgcaattgttcaggttgatgctgcaccattcaagcaatggtatcttcaacactatggtgttgacattggtcgcaagaagaaacaggctccttcagctaccaaaaaagagggagaggaaggagaaggtgcaacagaggaggccaagaaaagtaatcatgttgtgaggaaacttgagaagcgtcaagaggaacgcaaacttgacccacatgttgaagaacagttttctagtggtcgtcttctagctgctatttcatcgcgccctggccagtgtggtcgtgctgatggatacatattggaagggaaagagcttgaattctacatgaagaagctgcagaagaagaaaggaaagggtgctggtactgcttaattttgcttattatagatttgtatctttcttgtttattttcaaggaaagcatgactgagaattttgttgagctttcacttctatggattttcaaggactagtgcagggttcatgctattgattttgactacatttttgcatcctttgttttttaattgctcatattactgcatccaaaaaccttatacg

SEQ ID NO: 6872 - DNA, 1104 bp, Cucumis sativus
gaaaagacctctaatgaaatatgtcctctattaaagagcttaatgggcagaaagcctgcatttttatttccaactcagcccatgaatcaagttattcggcccataatggagcccacaacagtgctgctactgactcgaaaccctaatttatattcatctccttcctccttataatacctcactcaattcctgagcacccaatcttaccgtcgccgccgcctgctgccgggtaactcctcttcgtgtaggagcttcagtctcgtcaacatgggtatctctcgagattctatgcacaagaggcgtgcaactggagggaagaagaaggcttggaggaagaagagaaagtatgagcttggaaggcaacctgccaacactaagttatcaagtgacaagtcaatcaggaggattcgagttcgtgggggtaatgttaagtggcgagcttttagactcgacactggaaactactcgtggggtagtgaggctgtgtctaggaaaacccgtattctagatgtggtgtacaatgcatccaacaatgaacttgttcgtactcaaactttggtgaagagtgccgttgttcaggttgatgctgcgccattcaagcaatggtatcttcagcactatggagtggatattggaaggaagaagaagactgcagcatctgctaagaaggacgaggaaggtgatgctgctgctgctgctgctgaggaggtgaagaagagtaatcatgttcagcgcaaactggagaaacgtcaagagggtcgtaagcttgacccacatattgaagagcaattcagcagcggtcgtttgatggcttgcatttcatcaagacccggtcaatgtggtcgtgctgatggatatatcttggagggcaaagaacttgagttctacatgaagaagctccagagaaagaagggaaaaggtgctggtgctgcttaagttttgtcgttaagatattttgtagccatgtttccttctatgattctatctgtctttttttggtctgatgaagacgaagtgttgcagctaagatgaaacaattatttatgaactccaattttgctgttattagttgattaatcacattactttccttagcctgttcca

SEQ ID NO: 6873 - DNA, 830 bp, Taraxacum officinale
gtgcggcataaaccctagaggaggatcgtccgccatctgcaaacatgggtatctctcgtgattccatgcacaaaagacgtgcaactggtggaaagaagaaggcctggaggaagaagcgaaagtatgagctcggaaggcagccagccaacaccaagatctcaagcaacaagactgttcgaagggtccgtgttcgtggtggaaacgtgaagtggcgtgcattgaggttagatacaggaaactactcatggggtagcgaagccgtcacacgcaaaacccgtatcttggatgtcgtttacaatgcatctaacaacgagttggtcagaacccaaactctagtcaaaagcgccattgttcaagttgatgctgcacctttcaagcaatggtatcttcaacactatggtgttgacattggtcgcaagaagaaagtagtcccttcagccaccaaaaaagaaggagaggaagcagaaggtgcaacagaagaagctaagaaaagtaaccatgttgtgaggaaacttgaaaagcgtcaagaagaacgcaaactggacccacatgttgaagaacagttttcaagtggtcgtcttcttgctgctatttcatctcgccctggccagtgtggtcgtgctgatggatacattttggaaggtaaagaacttgaattctacatgaagaagttgcagaagaagaaaggaaagggtgctgctgcttaagtttggtttttatagatttccatctttttttctttgtatttttgttaaggaaggcatgactttgagctttttgacttttatggatgttgaacattattggttttgttgacatggttttccatc

SEQ ID NO: 6874 - DNA, 815 bp, Flaveria ramosissima
accatgggtatctctcgtgattccatgcacaagagacgtgccactggaggaaagaagaaggcgtggaggaagaagcgaaagtatgagctcggaagacagccagccaatactaagatctccagcaacaagacagttaggagagtaagggttcgtggtggtaatgtgaagtggcgagcactgaggttggacacaggcaactactcttggggaagcgaggctgtgacccgaaagacccgtattttggatgtggtttacaatgcatccaacaatgagttggtcagaacccagaccctcgtcaagagtgcaatcgtgcaggtggatgctgcacctttcaaacagtggtatctgcaacactatggtgttgacattggtcgcaagaagaaaaccgctgcttcttcaggcaagaaagagggagaggaagcagaaggtgcgacagaggaggccaaaaagagtaatcatgttgtgaggaaacttgaaaaacgtcaagaggaaaggaaactggacccccatgttgaagaacaattttccagtggtcgtcttctagctgccatctcatcacgccctggccagtgtggtcgtgctgatggatacatattggaagggaaagagcttgaattctacatgaagaaacttcagaagaagaaaggaaagggtgcttctgcttaaaaccatatttccttatattagctttgtattttttatttattttcgaggaatggcatgaccaatagctttgacttttgaatgttgactgtatttttgcatttagtgtcatgaccttcaaatgacgcatgtttgatcaaatttaagggtta

SEQ ID NO: 6875 - DNA, 693 bp, Flaveria ramosissima
tgggtatctctcgtgattctatgcacaagagacgtgccactggtggaaagaagaaggcgtggaggaagaagcgaaagtatgagcttggaaggcagccagcgaacaccaagatctccagcaacaagactgttaggagggttagggttcgtggtggtaatgtcaagtggcgggccttgaggttggatactggtaactactcatggggaagtgaggctgtgacccgtaagacccgtattttggatgtggtttacaatgcatcgaacaacgagttggtcagaactcagacgcttgttaagagtgcaattgtccaggtggacgctgcacctttcaagcaatggtatcttcaacactacggtgtggatattggtcgcaagaagaaaaccgctgcttctacaaccaaaaaagagggagaggaagcagaaggtgcaaccgaagaggccaaaaagagtaatcatgttgtgaggaaactggaaaagcgccaagaggaccgcaaactggaccctcatgttgaagaacaattctcaagtggtcgtcttctagctgccatctcatcacgccctggccagtgtggtcgtgctgacggatacatattggaagggaaagagcttgaattctacatgaagaagctccaaaagaagaaaggaaagggtgctgctgcttaagaccatatttcccttgatagatttgtatttc

SEQ ID NO: 6876 - DNA, 1136 bp, Lactuca sativa
gaggttttgggctttcagcctatagtaggttttctgtaagtgtagagaggcgatccgcctcgccttttaagtccttacaaaccctaattatatatcggaagtcttgagttcggaggcgcggcataaaccctagagtaggaggatcgtccgccatctgcaaacatgggtatctctcgtgattccatgcacaagagacgtgcgaccggtggcaagaagaaggcctggagaaagaagcgaaagtatgagctcggaagacagcctgccaacacgaagatctcaagcaacaagactgttagaagggtgagagttcgtggtggaaacgtgaagtggcgtgctttgaggttggatacagggaactactcctggggtagtgaggctgtgacccgtaagacccgtatcttggatgtggtttacaatgcatccaacaatgagttggtcaggacccaaactcttgtcaagagtgccattgttcaggtcgatgctgcacctttcaaacaatggtatcttcaacactatggtgttgaaattggtcgcaagaagaagccagctccttcagccaccaaaaaagagggagaggaagtagaaggtgcaacagaggaagcgaagaaaagtaatcatgttgtgaggaaattggaaaagcgtcaagaggaacgcaaacttgaccaacatgttgaagaacagttctccagtggtcgtcttcttgcagctatctcttcacgccctggccagtgtggtcgtgctgatggatacatattggaagggaaggagcttgaattctacatgaagaagttgcagaagaagaaaggaaagggtgctggcactgcttaagttggttttttatagatttgtatttcttatttattttaagggaggcatgactgagattttcgtttttctattgatgttgaaagactaatgccgggttcatgctgttggttttgttaacaattttgcttctattgttgccatgtttcagcatctcgaaaaacgcttttaagatttgtttatttggcaattaatctagagttgtcaacttatttagcaagaggagttaggcctgcaaaataaatcttaatttaacttcgatggatagttgcataaaagtattttaacttactaaaaatgttgaaaagttt

SEQ ID NO: 6877 - DNA, 938 bp, Tropaeolum majus
cggccgggggcaggtcacttaaaaagggggagctttaaatcacgcagctaaagcagcggtgttcaggagccgcgcatctttatctccgcagcaaccatgggtatctcacgtgattccatgcacaaaaggcgtgccactggaggcaagaagaaggcatggaggaagaagcgaaagtacgagcttggacgccagcctgctaacaccaagctttcaagcaacaagactgtcaggaggatccgagtgagaggtggaaatgttaagtggagagcccttagattggatactggaaacttctcatggggtagtgaagctgttacccgaaaaactcgtcttctggatgtggtttacaatgcctctaacaatgagcttgttagaacacagaccttagtgaaaagtgcgatagttcaagttgatgcagcaccattcaagcagtggtatcttcaacactacggtgttgatgttggcaggaagaagaaagccgctgccaccaagaaggatacccaagaggagggtgaagcgaccactgaggaggccaaaaaaagcaaccacgttgtaaggaagattgagaagcgtcagcaagacaggaagctggatgcccatattgaggagcagtttggaggtggtaggttgctagcctgcatttcctcccgaccaggccaatgtggcagagctgatggatacatcttggaagggaaggaacttgaattttacatgaaaaagctccagaagaagaagggcaagagtgctggtgctgcctaaatcttttgcttctttggttgtttttttcacaagctgtttttactttttgttctctttattcctttatgcttaggaagtttgtatgcaattctctagctatctggagttgatgctttgactcacagcatgctataattaaatcttgagctttagaattaatactattattagtggcttta

SEQ ID NO: 6878 - DNA, 1012 bp, Tropaeolum majus
ggcttatttccagcaacagcagagtcgcgtcaagtcgcctgcaaccatgggtatctctcgtgattctatgcataagaggcgcgccactggaggcaagaagaaggcgtggagaaagaagcgaaagtatgagctcggtcgtcagccagctaacaccaagctatcaagcaataaaactgtcaggaggatccgtgtgagaggaggaaatgttaagtggagagccctcagattggataccggaaacttttcatggggtagtgaagctgtcactcgtaagacacgtcttctcgatgtggtctacaatgcatccaacaatgagcttgtcagaacccaaactcttgtgaaaagtgcaatcgttcaggttgatgctgcaccattcaagcagtggtaccttcagcactacggtgttgatgttggcaggaagaagaaaactgttgctgccaaaaaggatacccaagaggaaggtgaagccactgtcacagaggaggcaaagaagagtaaccatgttgtgagaaagattgagaagcgtcaacaagaacgtaaactcgatgctcacatcgaggagcagtttggaggtggtaggttgttggcttgtatcgcatctaggccaggtcaatgtggcagagctgatgggtacatccttgaaggtaaggaacttgagttttacatgaaaaaactgcagaagaagaaaggaaagggtgctgctgcttaaagcctttttcttgtcctacttttatacatgttatttgtattgttggtcggttcagaaatgttggtagacaaattgcattcatttctggattaatagttttgactctctagcaaacccttgattaagttttgtgatggactaatttatttttgtgctactgatcgaagagagttttctagttgttcttatcaagtgttacctaaccaaccttccggtttccaaaacaagagggtttcagtgaccaaaaacaataagggtgtgggagtatgtatgtccaacctgccacagtttactcttctaaaa

SEQ ID NO: 6879 - DNA, 930 bp, Avena sativa
ctgcgagctccaaccaaaactgcggcggcgcgggcatagaaggcgaagcagcagcggagccaagccaccgacgccaccatgggtatctcgcgtgactccatgcacaagcgccgggccaccggtgggaagatgaaggcttggcgcaagaaaaggaagtatgagctcggccgccagccagccaacactaagctgtccagcaacaagacagtgaggagggtccgtgtccgtggtggtaatgttaagtggagggctctccgcctggatacaggcaacttctcatggggaagtgaagctgtgacccgcaagacccgtctcctggatgtcgtctacaatgcgtcgaacaatgagctcgttcgtactcagaccctggtgaagaacgctattgtgcaagttgatgctgcccccttcaagggttggtatctgacacactatggcgtggacatcggtcggaagaagaaagctcctgctgctggcaagaaggaagcttctgagggacaagagggtgaggttgctgcagctgccacagaggaggcaaagaagagcaacaatgtccagcgcaagcttgagaagcgtcaacagggtcgtactctagactcccacattgaagagcagttcagcggtggaaggctgttggcctgcatctcctcccgccctgggcagtgcggcagagctgatgggtacatcctggagggcaaggagctggagttctacatgaggaagctccagaagaagaagggcaagggtgctgcggcttagataacagtctcctgtgtgctctatggctggctgcatatttcattccctgttttttgttagttgttgcgtccatgttgtgtactgaacactattttctgcaagtgagtcgactctaggtttgaacgactgagaatattttgcctgcttgagtaaccttgatattcctcgatctgt

SEQ ID NO: 6880 - DNA, 983 bp, Avena sativa
ctcctgcgagacccaaccaaagctgcggcggcgcgagcatagaaggcgaagcagcagcggagccaagccaccgacgccaccatgggtatctcgcgtgactccatgcacaagcgccgggccaccggtgggaagatgaaggcatggaggaagaagagaaagtatgagctcggccgccagccagccaacactaagctgtccagcaacaagacagtgaggagggtccgtgtccgtggaggtaatgttaagtggagggctctccgcctggatactggtaacttctcatggggaagtgaggctgtgacccgcaagacccgtctcttggatgtcgtttacaatgcgtcaaacaatgagcttgtccgtactcaaacactggtgaagaacgctattgtgcaagttgatgctgcccccttcaagggttggtatctgacgcactacggtgtggacatcggtcggaagaagaaaactcctgctgccaagaaggaagcttctgagggacaagagggtgaggctgctgcagttgccacagaggaggcaaagaagagcaacaacgtccagcggaagctggagaagcggcaacagggtcgtactctggactcccacattgaggagcagttcagcggtggaaggctgttggcctgcatctcttcccgccctgggcagtgcggcagagctgatgggtacatcctggagggcaaggagcttgagttctacatgaggaagctccagaagaagaagggcaagggtgccgctgcttagataacagtctcctgtgtgctttaaggcaggctgcatatttcattccctgggttttgttagttgttccgtccatgttatgtttgcagacgtactgaacactattttctgcaagtgagtcgactgagaatattttgcctgcttcagtaaccttgatattcctcgatatgttgtgttccatttatcattgccattttcttactgagcacgtttgatttattgctaaaaaa

SEQ ID NO: 6881 - DNA, 822 bp, Allium cepa
aatattagggttagcctttcaagcgtccctgtgagagagcgagaagagggaggcagacctccagtctttaatcatgggtatctcacgtgattctatgcacaaaagaagggccactgggggcaagaagaaggcatggagaaagaagagaaagtatgaaatgggccgccagccagccaacacaaagctatcctccaacaaaacagtgaggagaattcgtgttcgaggtggaaatgtgaagtggagagcacttaggttggacactggcaactactcatggggcagtgaggcggttacgcggaagacccgtatcctcgacgtggtatacaatgcctcaaacaatgagcttgtgaggactcaaactttggtcaagagtgctattgttcaagttgatgctgcacctttcaaacagtggtatcttacacactatggtgttgacattggtaggaagaagaaggcagtcgccacaggaaagaaggaagcaactgcaactgaggagagtgaaccagtggcagaagtgaagaaaagtgaccatgtaaaaaggaagcttgagaagcgtcaaaaggagcgcacacttgattctcatattgaggagcaatttggtagcggtagacttttggcatgcatctcttctcggcctggccaatgcggcagagctgatgggtatattttggaagggaaagagcttgagttctacatgaagaagctccaaaagaagaagggcaaggcagctgctgcttcttaatttttcagtatttcatgtattttgtcaacttgtttcgttgaattgtttgttttttaggagagaacctgtttagcttatat

SEQ ID NO: 6882 - DNA, 1029 bp, Orobanche aegyptiaca
gtcattttcttctttcttcctagctggctgcaagtgtgccgccgttcagtcgctgcgttccatcggtgatatatcggaaccctagaaccacagccgggaaccatgggtatttcacgggattcgatgcacaagagacgtgccactggagggaaaaagaaggtttggaggaagaagagaaagtatgagctcggaagacaaccagctaacacaaagttatctagcaacaagacagtgcgtagggtgagagttcgtggaggtaatgtgaagtggagggccttgaggttggacactggaaacttctcttgggggagtgaagccgtgaccagaaagacccgtattctggatgttgtttacaacgcatcaaacaatgaactggttaggacccaaacattggtgaaaggggctattattcaagttgatgctgcacctttcaagcaatggtaccttcagcattatggtgttgaagttggtcgcaagaagaagactactgctgctgctgcaaagaaagaaggagaggagactgaggctgctgccactgtggaagtggagaagagtaaccatctccagagaaaacttgaaaagcgccaacaggatcgcaaaattgattcacatattgaggaacaatttggtggtggccgtttgttagctgcaatctcctcccgtcctggccagtgtgggcgtgctgatgggtacatcttggagggtaaggagttggagttctacatgaagaaacttcagaagaaaaaggggaagggtgctggagctgcttaaaatccttctgccccattctccatctgagacgacactgctttgtttctttatacattttctgtttaatgccccggaccaaatgagcttttgcgagttagttttgtttaacttttcatttgccatactattgatttcttgaggagacttatgaagttttttcactttgttttgatatgttcgctgctatgtttattttttaaatcatgtacctggtagtttgctccatgtcctgtaatatgctaaactactaaattcaat

SEQ ID NO: 6883 - DNA, 685 bp, Pteridium aquilinum
caactgagtctgtcactcgcgccgttcagccaacatgggtatttccagggattccatgcacaagaggcgtgccactggtggcaagaagaaggcttggaggaagaagcgaaagtatgaacttggtcgtcagcctgcaaatactaagctctcaagcaacaagactgtaaggagaattcgtgttagaggagggaatgtgaagtggagagcattgagattggatactggcaactattcatggggtagtgaggctgtcacacgtaagacccgtattctcgatgtggtatataatgcctcaaacaatgagcttgtcaggacacagactcttgtaaagagtgccattgttcaagtggatgcagcgccttttaagcaatggtaccttcagcattatggtgtcgacattgggaggaagaagaaaacagcagctaagaaggaagctactgaggaaggagaaggtgttgctgaggaaactaagaagagcaaccatgtcgttaggaagcttgagaagcgccagaaagatcgtaaactcgatgctcatattgaagaacaatttggtgctggtaggttgttggcatgcatttcttcacggccaggtcaatgtggcagggctgatggatacatattggagggtaaagagctggagttctatacgaataaaatccagaggaagaagggcaagggtgctgga

SEQ ID NO: 6884 - DNA, 1228 bp, Sesamum indicum
cgacgtcgttaaaagatgaaatcgagagggtgtaattgtaattgtatcatctagggttttcagcgtaagtgtgttaaagccccatcccgcttcagcttacggtttcctcctcttgctggctgcaattttaccgcggtctcagtctctgcattccatcggagattaaccggagccctagaatcttcgtcggcaatcatgggtatttctcgggattccatgcacaagaggcgtgctactggaggaaagaagaaggcttggaggaagaagagaaagtacgagctgggtagacaacccgcaaatacaaagttgtcgagcaacaagacggtgcgcagagtgagagttcgtggtggtaatgtcaagtggcgtgccttgaggctggatacaggaaactactcttgggggagtgaagctgtgacccgaaagactcgtattctggatgttgtttataatgcatctaataatgagttggttaggacccagactttggtaaagagtgctattattcaagttgatgctgcaccattcaagcagtggcatcttcagcattatggagttgacattggtcgcaagaagaagactgctgccaagaaggaaggagaggaggctgaggctgctgctactgaagaggtaaagaagagtaaccatgtccagagaaagatagaaaagcgtcaacaagaccgcaagattgatccacatattgaggaacagttcagtagtggccgtttgctagctgctatctcctcacgcccaggccagtgtgggcgtgctgatggttacattttggaaggcaaggagttggagttttacatgaagaaacttcagagaaagaaaggaaagggtgcaagcggagcttaatttggttcgagctcatgaaaattctccaatctagaatgttactcttcgactttgttgttgtcattggaaggagggggtagtttggttgagctttccagagttacattgaacattatttcacttgtcactgaggtcatatctcgaggacgctcattgttagttttgtgatctttagctgattgattgctttgatcttttcactgtggaattagttgtaattattttcttgaatgtccgttagtttttgccccataagtgctttctcatgcaaatttatgttattggattttggtaattcgatgacattaatttgacaatcaactcttgtgattccataaattgtgaattcatttttagcaacatcaaaagaaac

SEQ ID NO: 6885 - DNA, 1228 bp, Glycine max
attgcttgttgcacctagcatatcccaaagtgaagctgtatcaggtcagatgtgggtgagcttgcaagaaagcccaattggggcccaattggttgacccgtaatgaggcggggtctgtatccaacatatcaaactagggtttcatatatattcagggttttatcatagaggggggcgcacccagagaggaggaagctttgagagagagagagggaggagggagagtgttgacgctccatcaagatgggtatttctagggattccatgcacaagaggcgtgccactggtggcaagaagaaggcctggagaaagaagagaaagtatgagcttgggcgtcaggccgcaaacaccaagttatcaagcaacaaaactatccggaggattcgtgttcgaggtggcaatgttaaatggagggcattgaggttggataccggcaattactcatggggtagtgaagcagttactcgcaagactcgtattctagatgttgtttacaatgcctcaaacaatgagcttgtgcgaactcagaccctggtcaagaatgctattgttcaggttgatgctgctcctttcaagcagtggtaccttcagcactatggtgttgaaattggtagaaaaaagaaagtggcatccaagaaggactctactgaggagggtgaggctgctgctgaagaaactaagaaaagtaaccatgtccagagaaaacttgagaaacgccagaaagatcggaaacttgactcccacattgaagagcaatttggtggtggccgattgttggcctgtatttcttctcgtcctggacaatgtggcagggctgatgggtacattctggaaggtaaggagctggagttttacatgaagaaactccagaggaagaagggaaagggtgctgcttaattttagtgttttatgaacttctatttggctttagttcttggaagttggtacaattcaagatgtacgctttttgactgttggtcgatctcctttagggtgatgccataggacatccttagtgtgaacgttttattagcgtacatcttgaatttgagacagggatgcatgagtattctacttgtcattaccatatcatcagataagagaacaaaactgcgctgattttgaaattactgattatcctatccataatattctctctcacaatggtagtagaaatatttttttaagggtaaataatcatttttgtctctgaatatgtaattcatta

SEQ ID NO: 6886 - DNA, 929 bp, Helianthus annuus
gaacctgtagcaatcaatccgcatcaccttttaagccatttcgaaaccctaatttcatctccgaagttgagagtttagaggagcggcgtaacatctgcaaccatggggattagtcgtgacagtatgcacaagaggcgtgccactggtggcaagaagaaggcctggagaaagaagcgaaagtatgagcttggaaggcagccagcaaacactaagatctccagcaacaagaccgttaggagggttagggttcgtggtggtaatgtcaagtggcgggctttaaggttggataccggtaactactcatggggaagtgaggctgtaacacgcaagacccgtattttggatgtggtttacaatgcatcgaacaatgagttggtcagaactcagacacttgtcaagagtgcaatcgttcaggttgacgccgcacctttcaagcaatggtatcttcaacactacggtgttgatatcggccgcaagaagaaaacagttgctgctacaaccaaaaaagagggagaggaagcggaaggtgcaacagaagaggccaaaaagagtaaccatgttgtgaggaaactggaaaaacgtcaagaggagcgcaaactggaccctcatgtcgaagaacaattctctagtggtcgtcttttagctgccatctcttcacgtcctggccagtgtggtcgtgctgacggatacatattggaagggaaagagcttgaattctacatgaagaagctccagaagaagaaagggaagggtgctgctgcttaaaatcatgtttcctaataatagagttgtatttcttttatttatttttgaggaatgacaggactcggattttgttgacttttgttagttaggtttgagttttgttgactatatttctacatttattgtcatgacttccatatgcatgcatgcatgtttaaattcta

SEQ ID NO: 6887 - DNA, 948 bp, Helianthus annuus
ccttcaccttatatacaactccatagccgcaggagcataaaccctaatccgagaggcggaggatcatcaccacccagctgcaaccatgggtatcagcagagatagtatgcacaagagacgcgccactggaggcaagaagaaggcctggaggaagaagcgaaagtatgagctcggaagacagccagcaaataccaagatttcgagcaacaagactgttaggagggttagggttcgtggtggtaatgttaagtggcgggcgttgaggttggataccggtaactactcatggggaagtgaggctgtgacccgaaagacccgtattttggatgtggtttacaatgcatccaacaatgagttggtcagaacccaaacacttgttaagagtgcaattgttcaggtggatgctgcaccttttaagcaatggtatttgcaacactatggtgttgatattggtcgcaagaagaaagccgctgctgcagtcaaaaaggacggagaggaagcagaaggggcaacagaggaggccaagaagagtaaccatgttgtgaggaaactggaaaaacgtcaagaggaacgcaaactcgacccacatgttgaagaacagttttccagtggtcgtcttcttgctgccatctcatcacgccctgggcagtgtggtcgtgccgatggatacatattggaaggaaaagagctagaattctacatgaagaagctgcagaagaagaaaggaaagggtgctgctgcttaagagcatctttctttattatagatttgtatttcttatttatttttgaggaatggcatcatgactaagagctttgacgttttttttgaatgttgactatattttcgcatttagtgtcatgaccttcaaatgacccatgtttgatcgaattaaaagtgtgtcaagttttttagataggacctaagccggtttaaagttcaaaccga

SEQ ID NO: 6888 - DNA, 850 bp, Helianthus annuus
tagagtttagaggagcggcgtaacatctgcagccatggggattagtcgtgacagtatgcacaagaggcgtgccactggtggcaagaagaaggcctggagaaagaagcgaaagtatgagcttggaaggcagccagcaaacaccaagatctccagcaacaagactgttaggagggttagggtccgtggtggtaatgtcaagtggcgggctttaaggttggataccggtaactactcatggggaagtgaggctgtaacacgcaagacccgtattttggatgtggtttacaatgcgtcgaacaatgagttggtcagaactcagacacttgtgaagagtgcaatcgttcaggttgacgccgcacctttcaaacaatggtatcttcaacactacggtgttgatatcggccgcaagaagaaaacagttgctgctacaaccaaaaaagagggagaggaggcggaaggtgcaacagaagaggccaaaaagagtaaccatgttgtgaggaaactggaaaagcgtcaagaggagcgcaaactggaccctcatgtcgaagaacaattctctagtggtcgtcttttagccgccatctcttcacgtcctggccagtgtggtcgtgctgacggatacatattggaagggaaagagcttgaattctacatgaagaagctccagaagaagaaagggaagggtgctgctgcttaaaatcatgtttcctaataatagagttgtatttcttttatttatttttgaggaatgacaggactcggattttgttgacttttgttagttaggtttgagttttgttgactatttttctacatttattgtcatgacttccatatacatgcatgcatg

SEQ ID NO: 6889 - DNA, 919 bp, Trigonella foenum-graecum
ctggctggatttttctaccggcggccgggggcttgagccggagctagtgagagaggatcctgcatcgttgtttcatctagtttcttcaagatgggtatttccagggattctatgcacaagaggcgtgagactggtggcaagaagaaggcatggaggaagaagagaaagtacgagctcggtcgccagccagctaacaccaagctgtcaagcaacaagacagtcaggaggattcgtgttagaggtggaaatgtgaagtggagagctctgcgattggataccggtaacttctcatggggaagtgaagccgtcactcgcaagacccgtttgctcgatgtggtttacaatgcttccaacaatgagttggtcagaactcagacccttgtgaagagtgctattgtgcaggttgatgctgctcctttcaagcagtggtaccttcaacactatggtgttgaaattggtaggaaaaagaaaactgttggcaagaaagaggaggaagctgaggctgctacagaagaagtcaaaaagagtgcccatgtgcagagaaaattagaacaacgccagaaagatcgccaacttgatgcccacattgaagagcaatttggtggtggacgattgcttgcatgcatttcttctcgacctggtcaatgcggcagagctgatggctacattctggaaggtaaggagttagaattctacatgaagaaactccagaagaagaagggcaagggtgctgctgcttaattgtatcgtttccatgtttttgtattgctttagttttaaatgagatcagtaccaaacaaagaggtgttttgtgcttcagttgttgctgttgattaacattttaatatctcttggtcatttgacaatagcgtcttgattttgctttaaactgttttggttatttatgatttacaatttt

SEQ ID NO: 6890 - DNA, 944 bp, Triphysaria pusilla
tgctcgtattctcagttggagacgaatcggagcctccgccagcaatcatggggatttctcgggattccatgcacaagaggcgtgcaactggaggcaagcagaagacctggaggaagaagcgaaagtatgagcttggaagacaaccggcaaacacaaagttgtcgagcaacaagactgtgcgcagggtgagagttcgtggaggtaatgtgaagtggcgtgcattgaggttggataccggtaacttttcctggggtagtgaagctgtgacccgaaagacccgtattctggatgttgtttacaatgcgtccaacaacgagttggttaggactcagactttggttaagggtgctgtcattcaagttgatgctgcgccgttcaagcaatggtatcttcaacattatggagttgaaattggccgcaagaagaagactgctgctgctgccaagaaggatggagaggagactgaggctgctgctgctgctgaagaagcaaagaagagcaaccatgtcaaaagaaaaatcgagaagcgacaggaggagcgtaaaatagatgcgcatatcgaggaacaatttggtggtggtcgtttgttagctgctatttcctcacgcccaggccaatgtggccgtgctgatggttacattttggagggcaaggagttggaattttacatgaagaaacttcagaggaagaaaggaaaaggtgcaggaggtgcttaagtcaatcaagaatgtcattttgatctttttttgcttacttttgcaatcaattcacaattttcaatcagtgtttgcctgaactttgtagagttatattgaacaaagttttcaattgtcagtgactaaattatcctttatttatttatttgccctctttctcggttgaatgtcgattgattgcttcaaccttttggcttttgaatttgatttaactattgtgcactttac

SEQ ID NO: 6891 - DNA, 810 bp, Triphysaria pusilla
caaccatgggtatttctcgggattccatgcacaagaggcgtgcaactggagggaagcagaagacatggaggaagaagcgaaagtatgagctcggaagacaaccggcaaacacgaagttgtcgagtaacaaaactgtacgcagggtgagggttcgtggtgggaatgttaaatggcgcgcattgaggctagatacaggaaacttttcctggggtagtgaagctgtgacccgaaagacacgtattttggatgttgtttacaatgcgtccaacaatgagttggttaggacccagactttggtcaagggtgctatcattcaagttgatgctgcgcctttcaagcaatggtatcttcagcactatggagtcgaaattggccgcaagaaaaaaactgctgctgctgccaagaaggatgtagaggagactgaggctgctgctgctgctgaagaggcaaagaagagcaaccatgtcaaaagaaaaatcgagaagcgacaggaggagcgtaaaatagatgcgcatatcgaggaacaatttggtggtggtcgtttgttagctgctatttcctcacgccccggccaatgtggccgtgctgatggttatattttggagggcaaggagttggaattttacatgaagaaacttcagaggaagaaaggaaaaggtgcaggaggtgcttaagtcaatcaagaatgtcattttgatcgttttttgctttctattgcaatcaattcacaattttcaatcagtgtttgcctgaactttgtagagttatattgaacaaagttttcaattgtcagtgactaaattatccttt

SEQ ID NO: 6892 - DNA, 1009 bp, Setaria italica
ctcttccctgcgagacccaaccagcggagcggcggcgcgggcggaccaggaggaggaggaggcggagcggcagcagccgagccaagccaccgccgccaccatgggtatctcgcgtgactcgatgcacaagcgccgggctaccggtgggaaacagaaggcctggaggaagaagcgaaagtatgagcttggccgccagcctgctaacaccaaactgtccagcaacaagacagtgaggagggtacgtgtccgtggaggaaatgtgaagtggagggctctccgcctggatactggtaactactcatggggaagtgaggctgttacccgcaagacccgtatcctggatgttgtctacaatgcgtcaaacaatgagcttgttcgcacccagacccttgtgaagagtgctattgtgcaagttgatgctgccccattcaagcagtggtacctcactcactatggagtggacattggtaggaagaagaaggcccctgctgccaagaaggatgctgctgagggtcaagagggtgaggctgcagctgaggaaacaaagaagagtaaccatgtcacaaggaagcttgagaagcgcaaggtggggcgccaacttgacccacacattgaggagcaatttggcagtggaaggttgttggcgtgcattgcttctcgccctgggcagtgtggccgagctgatgggtatatccttgagggtaaagagctcgagttctacatgaagaagctccagaagaagaagggcaagggtgctgcagcttagatgcatcttcttgctcgaagggcggcttatcttatcctttactctgggttttgttagtccacaagtatgttatgtcgttgcagacctgatgaacacctattttctgaaagtgaatcaactctagcttcaaagaactgagaattttcaccctgtcgtggttgtattctcgtggtgtttaggttcactgtttattgacagtttgtgttcagcagttttggtttatctctcagatggctttctgaa

SEQ ID NO: 6893 - DNA, 827 bp, Centaurea maculosa
ctctttctctttctctttctcagtcgacttccagaggcagagagggccgcaggtggaagaaagccgcaagcatgggtatctctcgtgattcgatgcacaagagacgtgccactggaggaaagaagaaggcctggaggaagaagcgaaagtatgagctcggaagacagccagccaacactaaaatttccagcaacaagaccgttcgaagggtcagggttcgaggtggaaatgtgaagtggcgtgcgttgaggttggataccggtaacttctcttggggaagtgaggccgtcaccaggaagacccgtatcttggatgtggtttacaatgcatccaacaacgaattggtcaggacccagactctagtgaagagtgcaatcgttcaggttgatgctgcaccttttaaacaatggtatcttcaacactatggagttgacattggtcgcaagaagaaaccatcagcaactgctgcaaagaaagagggagaggaggcagaggctgctaccgaggaggcaaagaaaagcaaccatgttgtgaggaaactggagaagcgtcaagaagagcgcaaacttgacggccatgttgaggagcaattttctggtggtcgtctttatgccgcaatttcttcacgccctggccagtgtggccgagctgatggatacatcttggagggaaaggagcttgagttctacatgaagaagctccagaagaagaaagggaagggtgctgcttagaagcattatgagtttgaatttatagattttatttcctgtggaaggcatggaaccgaaattttgatgtgttttgtttgttaaaatgtgacttctatg

SEQ ID NO: 6894 - DNA, 1000 bp, Chenopodium quinoa
tgattctatgcacaagaggcgtgccactggtggcaagaagaaggcttggagaaagaagcgaaagtatgagctcggtagacagccagctaacactaagctgtcaagcaacaagactgttaggagggttagggttcgtggtggtaatgtcaagtggcgtgcactgaggttggatactggtaacttttcgtggggtagtgaggctgtcactcgtaagacccgtcttctggatgtcgtttacaatgcatccaacaatgagttggttaggacacagactttggtgaagagtgccattgtccaggttgatgctgcaccatttaagcagtggtatctccagcattacggagttgaaattggacgtaagaagaaggctgctgctgctgccaagaaagaaacagaggagggtgagaccacagaagaaacaaaaaagagcaaccacgttgcgagaaagcttgagaagcgtcagcagactcgcacattagactctcacatcgaagaacaattcggtggtggtcgtttgttggcctgcatttcttcccgccctggtcaatgtggtcgtgctgatggatatattttggaaggaaaggaactggaattctacatgaagaaaatccagaagaagaagggcaagtcagctgcttaagtgttagctgtagaatgtcagagttgagagtttatttttacattttgatgatttagcccccaaacgttttggaatttgtagcgtggtactttcatatttaaatcgcctctagctaaactctggctgacatttttgactccaatgttctgttccaatgtttgagctataattgatatactgctatgaacctatcatctatggatttgttttcgtgacatcctacctcattgtttagagatggctagtatttcgtaaaaaatcattgtatatcatgagcaaaagagggagctattacacgatattggcaaggatttgtttattcaggagagcaggacaattgcattaagtagattaatatct

SEQ ID NO: 6895 - DNA, 1043 bp, Actinidia deliciosa
ctcatatatgcggctgcggggctcgtgagagagagagaaaccctagaatcctccgtctgcagccatgggtatttctcgggattccatgcacaagaggcgtgccactggaggcaagaagaaggcgtggaggaagaagcgaaagtacgagcttggaagacaacccgctaacactaagttgtctagcaacaagacagttaggagggtgagagttcgtggtgggaatgtgaagtggcgtgcattgaggttggatacaggtaatttctcgtggggaagtgaggctgtgacaaggaagacccgtattctggatgtggtttataatgcgtcgaacaatgagcttgttcgcacccagacattggtgaagagtgcaatcatccaggtcgatgcagctccatttaagcaatggtatcttcagcactacggagttgacattggtcgaaagaagaaaaccactgctgctgctgctgccaaaaaggaaggagaggagggtgatgcagctactgaggaggcgaagaagagcaatcatgtcatgagaaaactgcagaagcgtcagcaggagcgcaagcttgacacgcatgttgaagagcaatttggcggtgggcgtttgttagctgcaatttcctcccgacctggccagtgtggtcgtgctgatggttacatattggagggcaaagagcttgagttctacatgaagaaaatccagaggaagaaaggaaagggtgctgcttgaagttttttacccgaacatcttggaattcagctcattttcccaattttttctttacttcttaaggtttggaaatgaaacttggttgaaccaattagttagcctgatgttttattatggtattgtcacctgttaagtgattcttatggacatgtttttgtgctgcttctaaattttgatgggtagaactttcaacatcagttttctgttatgttaaagggtcatagtttcctattttgtgatggatgtgcaatcgggttatcattgactaatgtgataatgtgatcattaaatctgcttgatgatataataaaaaaaa

SEQ ID NO: 6896 - DNA, 808 bp, Triphysaria pusilla
catgggtatttctcgggattccatgcacaagaggcgtgcaactggaggcaagcagaagacatggaggaagaagcgaaagtatgagctcggaagacaaccggcaaacacgaagttgtcgagtaacaaaactgtacgcagagtgagggttcgtggtgggaatgttaaatggcgtgcattgaggctggatacaggaaacttttcctggggtagtgaagctgtgacccgaaagacacgtattttggatgttgtttacaatgcgtccaacaatgagttggttaggacccagactttggtcaagggtgctatcattcaagttgatgctgcgcctttcaagcaatggtatcttcagcactatggagtcgaaattggccgcaagaaaaaaatactgctgctgccaagaaggatgtagaggagactgaggctgctgctgctgaagaggcaaagaagagcaaccatgtcaaaagaaaaattgagaagcgacaggaggagcgtaaaatagatgcgcatatcgaggaacaatttggtggtggccgtttgttagctgctatttcctcacgcccaggccagtgtggccgtgctgacggttacattttggagggcaaggagttggaattttacatgaagaaacttcagaggaagaaaggaaaaggtgcaggaggtgcttaagtcaatcaagaatgtcattttgatctttttttgcttactattgcaatcaattcacaattttcaatcggtgtttgcctgaactttgtagagttatattgaacaaagttttcaattgtcagtgactaaattatcctttatttat

SEQ ID NO: 6897 - DNA, 1077 bp, Cicer arietinum
gccaccctatttgaaaaaaaaaagcccaatttcgtaacccatctaggtttgatatatgttagggtttatcagaaatatagtcgtcacatagatacagagagagggagagggagaaagggagagagcgagcgagttcaagcttcatcaagatgggtatttctagggattccatgcacaagaggcgtgccactggtggcaagaagaaggcctggagaaagaagagaaagtacgagcttggtcgtcagccagcaaacactaaattatcaagcaacaagacagtcaggaggatccgtgttcgagggggtaatgtgaagtggagagctcttagattggatactggtaacttctcatggggtagtgaagcagtaactcgcaagactcgtcttctggatgtggtttacaatgcctcaaataacgagcttgtccgaacacagactcttgttaagggtgctattgtccaggtggatgctgcaccattcaagcagtggtaccttcagcactatggtgttgaaattggtagaaaaaagaaatcagctgcagccaagaaggattctgtagggaggttgaagccgccactgaagaagccaagaaaagtaatcatgtgcagaggaaacttgagaaccgtcaaaaagatcgtcagctagattcccacattgaagagcagtttggtggtggtcgtttgctggcctgtatttcatctcgtcctggtcaatgtggcagggctgatgggtacatccttgaaggtaaggaactggaattttacatgaagaagttacagaggaagaagggaaagggtgctgcttaattgtagtgttttccgtcttatatatgacttcatttgtttttaatagtgcaacaatatttggtacctttcaagttgatgtcatttgctttggatgagacaatgtttattggacaacctttaggttgatgccctaagacttctttagtgtcaaaccttcactagttttgtgacagtttataaaattttttgtcttaatttattcttattactgaatattatactacttcagtcaactgttttgcgatttttagctggattaattttgaattgag

SEQ ID NO: 6898 - DNA, 921 bp, Fraxinus spp
gtggctttcagttgtaccgccgtttctccctctgcaatcaatagaggactcgccggaaccctagaaaccgccacttcgcaaccatgggtatttcacgggactcgatgcacaagaggagagccactggaggcaagaagaaggcttggagaaagaagagaaagtatgagcttggaaggcaaccagcaagtactaagttgtcaagtaacaaaacagtacgaagggtgagggttcgaggaggtaatgtgaagtggcgtgccttgaggctggacacaggaaactactcttgggggagtgaagctgtgacccggaagactcgtattcttgatgtggtttataatgcatcgaacaatgagttggttaggacccagactttggtgaagagtgccattgttcaagtggatgctgcaccattcaagcagtggtaaccttcagcactatggagttgacattggtcgcaagaagaagacagctgccaagaaggaaggagaagatactgatgctgctgctactgaagagacgaagaagagcaaccacgtccagagaaaaattgaaaagcgtcaacaggatcgcaagcttgacccccatgttgaggagcaattcggtagtggccgtttattagcttcaatctcttcacgccctggacagtgtgggcgtgctgatggatatattttggagggcaaagaattggagttttacatgaagaaactccagaggaagaagggaaagggtaccagtggtgctgcctagattcttattatacttgtctttttcatctttgcaatggctctcgctttcaagaattagattgaacttttcaattgtcatagtaatcaatttttgtggagaattatgttaaagtcttcctttttggtaacgtctttgatcttcttgttggtaataaattagcagcattttaaccag

SEQ ID NO: 6899 - DNA, 831 bp, Secale cereale
cgccaccatgggtatctcgcgtgactccatgcacaagcgccgggccaccggcgggaagcagaaggcatggaggaagaaacgaaagtatgagctcggccgccagcctgccaacactaagctttcgagcaacaagacagtgaggagggtccgtgttcgtggaggtaacgtgaagtggagggctctccgtctggacactggtaacttctcatggggtagtgaggctgtgacccgcaagactcgtctcctggatgtggtttacaattcatcaaacaacgagcttgttagaactcagacccttgtcaagaatgccattgtgcaagtggatgctgcccctttcaagcagtggtacctgactcattatggagtggaaatcggtaggaagaagaaagctgctgcagctgctaagaaggatgctgctgctgagggacaagaggctgaggtagctgcagctgccacagaggaagcaaagagagcaacaatgtccagaggaagcttgagaagcgtcagcagggacgcacactggactctcacattgaggagcagttcagcggtggaaggttgctggcctgcatttcatctcgccctggacagtgtggcagagctgatgggtacgatcctggagggcaaggagctggagttctacatgaggaagctccagaagaagaaagggcaagggtgccacagcttaggcggaagagctgctgcatgttactcttattttcttagttgttgcgtccatgtcatgtttgcagacatactgaacaccattttctgtaaacggtttgagtcctaggttgaactgagaatgttttgcctgctttggttgtgatc

SEQ ID NO: 6900 - DNA, 1139 bp, Eucalyptus grandis
cgataatgacctcctcgtctcactaagccaaccctataagaagcacgtggtggaggcagctagggacggtaagcgaagccgagtcgcagagcccagagcaagcccccgccgctccgccaagatgggtatctcccgggactccatgcacaagaggcgcgccaccggtggcaagaagaaggcctggaggaagaagcgaaagtatgagttgggtcgtcagccagccaacactaaactttcaagcaacaagactgtaaggagaatccgtgtgagaggaggcaatgtcaagtggagagccctgaggctggacactgggaattactcatggggtagcgaggctgtcacccgcaagacccgtatccttgatgtggtctacaattcctcgaacaacgagcttgtgagaacacagaccctggtgaagagtgcaattgttcaggttgatgcggctccatttaagcagtggtacctccagcattatggtgtcgatattggtaggaagaagaaggcagcagcagctaagaaggaagctaccgaggagggtgaagccgcgcctgctgaggaagcaaagaagagtgctcatgttttgaggaagcttgagaagcgtcagaaggaccgtcaacttgacgcacatattgaagaacaatttggatctggtaggttgttggcctgcatttcttcccgacctggtcaatgtggcagatctgatgggtatattctggagggaaaagagctggaattctacatgaagaagatccagaggaagaagggcaaggccggagctggtgcagcttgagtgtaccattttcattgatttggtacccattttgaggagcttgttttggattataatttttgtgatccggtcttcaagaactgctaagttgaggcctgtgtggtcaaaatgtcatttttgtagcttgtcctttagaccatatgattactattctctttgttctctttgctatatggttccggcttgttgacgaaacaatctcgttaagcattgatgctattgctcttccttggacattgacaaatacttgcatgaaggaatcatctaaagaaacaaaacgatggaagtgcagtactaagaactggaggaaggtttaaaccagctacatataggcctttcttcccgatcc

SEQ ID NO: 6901 - DNA, 990 bp, Solanum tuberosum
gtcccgcttgaagagcccttctccgttgcagtgcgaaatcaccggaaccctaggatacttcgtcgccggcaaccatgggtatctctcgtgattcgatgcacaagagacgtgccactggaggcaagaagaaggcatggaggaagaagcgaaagtatgagatgggaagacagtctgcaaatacaaagctggtgcctaatgctaagactgttaggaggatcagggtccgaggaggcaatgtgaagtggcgtgctttgaggttggacactggaaattactcttggggtagtgaagctgttactaggaagacccgtttattggatgtggtctacaacgcctcaaacaatgagttggttaggacacaaactctagtgaagagtgcaattgtgcaagttgatgcagctccattcaagcagtggtatctccagcattacggtgttgaaattggtcgcaagaagaagagtgctgccaagaaggaaggagaggaggctgctgaggctgctgcagaggagaagaaaagtaaccatgtccaaagaaagctggaaaagcgtcaacaggatcgtaagattgacccacatgttgaagagcaatttgctagtggtcgtctattggcggcaatctcatcacgacctggccaatgtggccgtgctgatggttacatcttggagggtaaggaactggagttttacatgaagaagctacagaaaaagaaagggaagggtgcaagtggtgctactgcttaagagttgtaactcatcatcagaagttttatatgagattacctctgttattactctccatagaatgggaattaagaacatcctttagctattattagagtttaagatcagacttatcttttttgtaatgtgatgtcacatgattttgacaggttcatcttacatcactaatgttttcttcagatacattaagataagtcttgtgtcagctttcagattttacattgttgagaactttgcatactatgagttc

SEQ ID NO: 6902 - DNA, 1022 bp, Solanum phureja
ctcatttagccgtcccgcttgaagagcccttctccgttgcagtgcgaaatcaccggaaccctaggatacttcgtcgccggcaaccatgggtatctctcgtgattcgatgcacaagagacgtgccactggaggcaagaagaaggcatggaggaagaagcgaaagtatgagatgggaagacagtctgcaaatacaaagctggtgcctaatgctaagactgttaggaggatcagggtccgaggaggcaatgtgaagtggcgtgctttgaggttggacactggaaattactcttggggtagtgaagctgttactaggaagacccgtttattggatgtggtctacaacgcctcaaacaatgagttggttaggacacaaactctagtgaagagtgcaattgtgcaagttgatgcagctccatttaagcagtggtatctccagcattacggtgttgaaattggtcgcaagaagaagagtgctgccaagaaggaaggagaggaggctgctgaggctgctgcagaggagaagaaaagtaaccatgtccaaagaaagctggaaaagcgtcaacaggatcgtaagatcgacccacatgttgaagagcaatttgctagtggtcgtctattggcggcaatctcatcacgacctggccaatgtggccgtgctgatggttacatcttggagggtaaggaactggagttttacatgaagaagctacagaaaaagaaagggaagggtgcaagtggtgctactgcttaagagttgtaactcatcatcagaagttttatatgagattacctctgttattactctccatagaatgggaattaagaacatcctttagctattattagagtttaagatcagacttatcttttttgtaatgtgatgtcacatgattttgacaggttcatcttacatcactaatgttttcttcagatacattaagataagtcttgtgtcagctttcagattttacattgttgagaactttgcatactatgagttcaaattttttttggttttccac

SEQ ID NO: 6903 - DNA, 1035 bp, Solanum lycopersicum
gaatctcatttagccgtcccgctagaagagcccttcaccgttgcagtgcaaacccaccggaaccctaggatacttcgtcgccggcaaccatgggtatctctcgggattcgatgcacaagagacgtgccactggaggcaagaagaaggcatggaggaagaagcgaaagtatgagatgggaagacagtctgcaaatacaaagttggtgcctaatgctaagactgttaggaggatcagggtccgaggaggcaatgtgaagtggcgtgctttgaggttggacactggaaattactcttggggtagtgaagctgttactaggaagacccgtttattggatgtggtctacaatgcctcaaacaacgagttggttagaacacaaactctagtgaagagtgctattgtgcaagttgatgcagctccatttaaacagtggtatctccagcactatggtgttgaaattggtcgcaagaagaagagtgctgccaagaaggaaggagaggaggttgctgaggctgctgcagaggagaagaaaagtaaccatgtccaaagaaagctggaaaaacgtcaacaggatcgtaagattgacgcacatattgaagagcaatttgctagtggtcgtcttttggcggcaatctcatcacgacctggccaatgtggtcgtgctgatggttacatcttggagggcaaggaactggagttttacatgaagaagctacagaaaaagaaagggaagggtgcaagtggtgctactgcttaagagttgtaactcatcatcaaaagttttatatgagattgcctctgttattactctccatagaatgggacttaagaacatcctttagctattattagagtttagatcagacttatcttttttgtaatgtgatgtcacatgattttgacaggttcatctttacatcactaatgttttcttcagactaatatcattaagataagtcttgggtcaactttcagattttacattgttgagaactttacacacactgatttttattttgtttttgtttttccactct

SEQ ID NO: 6904 - DNA, 996 bp, Solanum lycopersicum
catttagccgtcccgctagaagagcccttcaccgttgcagtgcaaacccaccggaaccctaggatacttcgtcgccggcaaccatgggtatctctcgggattcgatgcacaagagacgtgccactggaggcaagaagaaggcatggaggaagaagcgaaagtatgagatgggaagacagtctgcaaatacaaagttggtgcctaatgctaagactgttaggaggatcagggtccgaggaggcaatgtgaagtggcgtgctttgaggttggacactggaaattactcttggggtagtgaagctgttactaggaagacccgtttattggatgtggtctacaatgcctcaaacaacgagttggttagaacacaaactctagtgaagagtgctattgtgcaagttgatgcagctccatttaaacagtggtatctccagcactatggtgttgaaattggtcgcaagaagaagagtgctgccaagaaggaaggagaggaggttgctgaggctgctgcagaggagaagaaaagtaaccatgtccaaagaaagctggaaaaacgtcaacaggatcgtaagatcgacccacatattgaagagcaatttgctagtggtcgtcttttggcggcaatctcatcacgacctggccaatgtggtcgtgctgatggttacatcttggagggcaaggaactggagttttacatgaagaagctacagaaaaagaaagggaagggtgcaagtggtgctactgcttaagagttgtaactcatcatcaaaagttttatatgagattgcctctgttattactctccatagaatgggacttaagaacatcctttagctattattagagttcagatcaggacttatcttttttgtaatgtgatgtcacatgattttgacaggttcatctttacatcactaatgttttcttcagactaatatcattaagataagtcttgggtcaactttcagattttacattgttgagaactttacacac

SEQ ID NO: 6905 - DNA, 944 bp, Solanum lycopersicum
acaaggaggggagcagagtgaggggagtaaggtcggcttaagctctcagcaatcatgggtatctcaagagattctatgcacaagagacgtgccactggtggcaagcagaaaacttggaggaagaagcgaaagtacgagcttggacgtcaaccagctaataccaagatttccagtaacaagacagtcagacgaattcgtgtgcgtggtggtaatgtgaagtggagggcactgaggttggacactggaaactattcatggggtagtgaggcagtcacacgcaagactcgtatccttgatgtggtttacaatgcctcgaacaatgagcttgtccgtacacaaactcttgtgaagagtgcaattgttcaagttgatgcagcaccatttaaacagtggtacctccagcactatggtattgacattggtaggaaaaagaagggggccgctaagaaggaaactacaaccgaggagggagatgctgctgaggaagctaagaagagcaaccatgtagtccggaaaattgagaaacgtcagaaggatcgtacccttgatagtcaccttgaagagcaattcagctctggtaggctatatgcctgcatctcatcccgccctggtcaatgtggccgagctgatgggtacattttggaagggaaagagttggaattctatatgaagaaacttcaaaagaagaaaggcaaggcatctggtgcttctgcttaagtgattctttcggtatgtccagactagtttgtgttaatcaagcttcaattttgagagtgtatgtgtttgtatacactaccttttaccataagttcaaagtgatgactggtcttcattattaccatttttttgtagtttgaaattttactacatttcagcgtgtagtcatatataatcacaggcagaaaatactatattatatggattttaaatttaccattttgaag

SEQ ID NO: 6906 - DNA, 1032 bp, Solanum lycopersicum
aaattgaaactagggtttttagttatcttttcatcactacaaggaggggagcagagtgaggggagtaaggtcggcttaagctctcagcaatcatgggtatctcaagagattctatgcacaagagacgcgccactggtggcaagcagaaaacttggaggaagaagcgaaagtacgagcttggacgtcaaccagctaataccaagatttccagtaacaagacagtcagacgaattcgtgtgcgtggtggtaatgtgaagtggagggcactgaggttggacactggaaactattcatggggtagtgaggcagtcacacgcaagactcgtatccttgatgtggtttacaatgcctcgaacaatgagcttgtccgtacacaaactcttgtgaagagtgcaattgttcaagttgatgcagcaccatttaaacagtggtacctccagcactatggtattgacattggtaggaaaaagaagggggccgctaagaaggaaactacaaccgaggagggagatgctgctgaggaagctaagaagagcaaccatgtagtccggaaaattgagaaacgtcagaaggatcgtacccttgatagtcaccttgaagagcaattcagctctggtaggctatatgcctgcatctcatcccgccctggtcaatgtggccgagctgatgggtacattttggaagggaaagagttggaattctatatgaagaaacttcaaaagaagaaaggcaaggcatctggtgcttctgcttaagtgattctttcggtatgtccagactagtttgtgttaatcaagcttcaattttgagagtgtatgtgtttgtatacactaccttttaccataagttcaaagtgatgactggtcttcattattaccatttttttgtagtttgaaattttactacatttcagcgtgtagtcatatataatcacaggcagaaaatgctatattatatggattttaaatttaccattttgaagaagcttggccatttaacaagtggatttgaatggcaaaaacctttaggcag

SEQ ID NO: 6907 - DNA, 843 bp, Theobroma cacao
gcgggggctgtgagcgtgtaaccgaaagagagcaactgagtctgtcactcgcgccgttcagccaacatgggtatttccagggattccatgcacaagaggcgtgccactggtggcaagaagaaggcttggaggaagaagcgaaagtatgaacttggtcgtcagcctgcaaatactaagctctcaagcaacaagactgtaaggagaattcgtgttagaggagggaatgtgaagtggagagcattgagattggatactggcaactattcatggggtagtgaggctgtcacacgtaagacccgtattctcgatgtggtatataatgcctcaaacaatgagcttgtcaggacacagactcttgtaaagagtgccattgttcaagtggatgcagcgccttttaagcaatggtaccttcagcactatggtgtcgacattgggaggaagaagaaaacagcagctaagaaggaagctactgaggaaggagaaggtgttgctgaggaaactaagaagagcaaccatgtcgttaggaagcttgagaagcgccagaaagatcgtaaactcgatgctcatattgaagaacaatttggtgctggtaggttgttggcatgcatttcttcacggccaggtcaatgtggcagggctgatggatacatattggagggtaaagagctggagttctatacgaagaaaatccagaggaagaagggcaagggtgctggagctgcttagatgcagtatttcacatgtcctactctcaccaatgtgattttgtttgctttagattttgttcctttatggctaccatttaagatatgatacattttaatgtgaacattttactttttc

SEQ ID NO: 6908 - DNA, 1054 bp, Amorphophallus konjac
ggggtccgaccgctgctctcctcttcgttgcctcagattagggttttacggaagaggagcagtctcggcgcaggtcgcagcgggggagggggagacgagcggcggccatcgccagagcccggctccgctgctaagatgggtatctcccgggactccatgcacaagaggcgcgccaccggcgggaagaagaaggcctggaggaagaagcgcaagtacgagctggggcggcagccggcgaacacgaagctgtcgagcaacaagacggtgaggcgggtgcgcgtgagggggggcaacgtgaagtggagggcgctgcggctggacaccgggaactactcctgggggagcgaggcggtgacccggaagacccgtatactggacgttgtctacaacgcctccaacaacgagctggtgcgcacgcagacgctcgtgaagagcgccatcgtacaggtggacgccaccccgttcaagcagtgggtactccagcactatggcgtcgacatcgggaggaagaagaagggccccgccgccgccgccaagaaggaggccactgagggacaagagggtgaagctgcagcagatgaagccaaaaagagcaatcatgtttttaggaaattggagaagcgtcaacaaggtcgcaaactcgactcccacattgaggaccaatttggtggtggaagattgtttgcttgcatctcttctcgccccggtcaatgtggcagggctgacggatacatactagaaggaaaggaactagagttttacatgaagaagatccagaagaagaagggcaagggtggtgccggtgctgcctaaaaggttctactcagttaatttggtatcacatttgtttctcaaaatctgttcttctacggacatgcctgtctgaagttggagacgtagaaattgtgttcaaggattttgtcattagtaatgtttcaggttgcattcagggaaaacagaattactatctttacataatctcgtcatgacgggagttgtcagaatctcaatgaacctgctatcgtgatgtcagtaatcgtcctttagccagtac

SEQ ID NO: 6909 - DNA, 1717 bp, Theobroma cacao
aataaatacagcaaaacagcaatttgcataaataaacaatctttaggatcaaaccacttaattgctatcatcaaaggcatatagttttctccaagcaaagaaggctttgatttcgaagaatgacgattaaccttcggcctcaggcccaatttacacccttttatatatattgctaatctttcctccacaatgtagagacggactattacgccatcgtttaggtagggttccaacttaccgcaaagccagcatataaataggacagaggtagggttttagctggtgctgtgagcgtgtaaccgaaagagagcaactgagtctgtcactcgcgccgttcagccaacatgggtatttccagggattccatgcacaagaggcgtgccactggtggcaagaagaaggcttggaggaagaagcgaaagtatgaacttggtcgtcagcctgcaaatactaagctctcaagcaacaagactgtaaggagaattcgtgttagaggagggaatgtgaagtggagagcattgagattggatactggcaactattcatggggtagtgaggctgtcacacgtaagacccgtattctcgatgtggtatataatgcctcaaacaatgagcttgtcaggacacagactcttgtaaagagtgccattgttcaagtggatgcagcgccttttaagcaatggtaccttcagcactatggtgtcgacattgggaggaagaagaaaacagcagctaagaaggaagctactgaggaaggagaaggtgttgctgaggaaactaagaagagcaaccatgtcgttaggaagcttgagaagcgccagaaagatcgtaaactcgatgctcatattgaagaacaatttggtgctggtaggttgttggcatgcatttcttcacggccaggtcaatgtggcagggctgatggatacatattggagggtaaagagctggagttctatacgaagaaaatccagaggaagaagggcaagggtgctggagctgcttagatgcagtatttcacatgtcctactctcaccaatgtgattttgtttgctttagattttgttcctttatggctaccatttaagatatgatacattttaatgtgaacattttactttttcaatatctgttaaaattgttctggttttttttttttaatcaaaagttaaaattattgtcattgtcagtatcctcccttctccagaatttgatagtagtacacttagaactgtttacctgccagcttcttatttactacttattattgtgctaaaacttgggttgaaatgacatggatttcaagtcccgaacacctgagattgaattggaaagtgaaattgattgcatagttgagtgaataggaatgaaaatgatggttattacaatatacagaagaggaaagaaatgagaatatatacagagtagagggatggtttgataaattttataagttgataggtaaattgtcatactttgaattattaattgggagttgtggggacagaatagatagtgaaaaaaattagagaggatgggatgatagaagattattgtacgtaagttgcatggcggggtgaggtagcacaattattgctatagctaatggtgagcatagtgtgtcaagggcccaatgaaatctacagcttgacctcattccctggaggtcgaggtcattatctgtttgtttgtttgaaaaagataaaaccactaatatctt

SEQ ID NO: 6910 - DNA, 1013 bp, Manihot esculenta
agggttcatgtgagccggaagtgagggggaagtgtagctcttcagccgctcagtcaagatgggtatctccagagattccatgcacaagaggcgcgccactggtggcaagaagaaggcttggaggaagaagagaaagtatgagcttggtcgccaacctgcgaataccaagctctcaagcaacaagacagtaaggaggattcgagttagaggaggcaatgttaaatggagagccctgagattggacacgggaaattattcatggggtagtgaggctgttacacgcaagactcgtattcttgatgtggtttacaatgcttcaaacaatgagcttgtaagaacacaaactttggtgaagagtgcaattgttcaagtggatgctgctccatttaagcaatggtatcttcagcactatggtgttgacattggcaggaagaagaagactgttgctaagaaggaaacttctgaggaaggagaaggtgctgctgtagaggaaactaagaagagcaaccatgtccaaaggaagcttgagaaacgccaaaaagatcggaagcttgatccccatatagaagagcagtttggtggtggtagattgttggcttgcatctcatcccgtcctggtcaatgtggcagagctgacgggtacatattagagggtaaggagttggaattctatatgaagaagctccagaggaagaagggcaagggcgccggtgcggcataaacatcaagtttgtcaagttttttgctttctattttttgggttatttcagttttggttcctttttatgttttagaatgtgatttgatacgcttttcatagtctgcccaaatgaaacacattttgttttgagggatgttagtgtcaacttgtctcctctcctttttcttcctataatttctttgttatggagtttctaatatttcgttgcattgcaaggcttcccaacattcagtgtgcttgggaatgtggctcctacgatttatgaggttaatagccattctagttagatttc

SEQ ID NO: 6911 - DNA, 903 bp, Citrus clementina
aatagagactgctagggttttagagcgggagcaaggcgagagtacgttacagtcagcagcgccgcagcagcagctacagctcagccaagatgggtatttccagagattcaatgcataagaggcgcgccactggtggcaagaagaaagcttggaggaagaagcgcaagtacgaacttggtcgtcagcctgcaaataccaagctctctagcaacaagactgtacggagaattcgtgtcagaggaggcaatgtgaagtggagggccctgagactggacactgggaactattcctggggtagcgaggctgtcacccgcaagactcgtatcctggatgttgtttacaatgcctctaataatgagctcgtcaggactcaaactctggtgaagagtgctattgtgcaggtggatgcagcgccttttaagcaatggtaccttcagcactatggcgttgacattggtaggaagaagaaggcagttaccaagaaggaaaccacagaggagggagaaagtgcagcagcagcagcagaagaaactaagaagagcaaccatgttgttaggaagcttgaaaagcgccagaaggaccgcacactcgatcctcacattgaagagcaatttggtgctggtaggttgttggcctgcatttcttcacgcccaggtcaatgtggcagagctgatgggtacatactagaaggtaaggagctggaattttacatgaagaagctccagagaaagaagggcaagggtgcgggagccgctgcttagaatcattattgcccatgcatctgttttgatctttagttgattttgtttgttttatgtatgggaccttgacgggctacaattaaagagcacaagggtgatatgtttagtgttttttttttttttaataagaacattctttacc

SEQ ID NO: 6912 - DNA, 1057 bp, Lactuca sativa
gaaaatggcactcgactataaccacaaggagataaagtatcaactcaactaaacttatccaactctgcagtgtacattagggctaccttcttcacacaaaagaccaacgggaggagccgcctgagggagcagaggtcagccgccggttatcttcaacctccgccaacatgggtatctcacgagactcgatgcacaagaggcgcgccaccggagggaagcagaagacatggaggaagaagcgaaagtacgagcttggtcgtcagcctgctaacacgaagatctcaagcaacaagactgtaaggagagttcgagtgagaggaggcaacgtgaagtggagagctcttagactcgacactggaaattactcatggggaagcgaagcagttactcgcaaaactcgtattctcgatgtggtctacaacgcatcaaataacgagcttgtgagaacacaaactctcgtcaaaagtgccattgttcaagttgatgcagctccattcaagcaatggtaccttcaacactatggagtcgacattggtaggaagaagaaaactgctgctaccacaaagaaggatacagaggaaggagaaggggctacagaggaagcaaaaaagagtaaccatgttcagagaaagattgagaagcgtcaagaagaacgtaagcttgatccccatgttgaagaacagtttagttctggaaggttgtatgcttgcatttcttctcgaccaggtcaatgtggtagagccgatggatacattttggaaggaaaggagcttgagttctatgtgaagaagcttcaaagaaagaagggaaaaagtgctggtgctgcattttgagagtgttgagctcttttggtatgtttttggttgtttcatttacgtagttaaaccaattttaatcgttttagttgcatgttatctttgatcatttcataaagtttataagattttgatttgcgcacttgtctggttattgatttgctagatgatctttgttgttttgcaatgatgctaatcctgtcatcttaattggatgttttttgattttattttaaagaaaa

SEQ ID NO: 6913 - DNA, 1336 bp, Prunus mume
cgaaggagggcttgagagtttactttagccgaagcgcagcggagagagctcgttcgccgtctcaagtcaccgaagctctctctccagtcggaaaccatgggtatctcacgtgactcgatgcacaaaagacgtgccactggaggcaagaagaaggcatggaggaagaagagaaagtatgagctcggtcgtcagcctgcaaatactaagctttcaagcaacaagactgttaggcgaatccgtgtgcggggaggcaatgtgaagtggagagctctcaggttggatactggtaacttctcatggggtagtgaagctgttactcgtaaaacccgtctcctggatgttgtatacaatgcctcaaacaatgaacttgttagaacgcaaactctggtgaaaagtgccattgtccaggtggatgcagctccatttaagcaatggtaccttcaacattatggagttgaaattggcagaaagaagaagactgctgctgctaagaaggataccccagaggagggagaagcaactacagaggaagcaaagaagagtaaccatgttgcgagaaagcttgagaagcgtcagcaaggtcgcaccctggacgcccatattgaagagcagtttgggggtgggagattgcttgcttgcatatcttcccgtccaggccaatgtggcagagctgatgggtacatcttggaaggtaaggaactggagttttacatgaagaagctccagaggaagaagggaaagggtgccggtgctgctgcataaacacttcattgaccggacttttgtcccttttggtttcgcatgagatttgttttagtttgaaccttttcatttgtctagggacatacatgttggttgcctgtgctaatgcaagtctttcaagttttctaggcatctctggtattccggatttagaagattttgacaattttgctgaccgagctgggtcttttattgttatttgatatttttattgtgctagtcaaaagtaatttactggacgagtcaatgtagagtttggtggattttgttacatttcaaaccagagttttatgaactctatatatcttgtggcaatcaattggcgttttgaagcattgaaatcttgttcatcaacaatggtgattgatttgctgggattcagttaactggatttgagatgctggagtgcagcctgcaaaaatttaacttgtagctacagattggaaccgcttttacagattacaaaattttatctttaggtttcgaaatatctttccacgccaattcattttcatggacttgctgaccttcatgaactttcagtcttcaaacagtccaagcttgtcttcgtctt

SEQ ID NO: 6914 - DNA, 999 bp, Thalictrum flavum
gggtttcaacttgaagagcaaaacccttcgctgcaaccatgggtatttctcgtgattctatgcacaaaaggcgtgccacaggaggcaaaaagaaggcttggaggaagaagcgaaagtatgagcttggaagacaaccagcaaataccaagctatcaagcaataagactgtaaggaggattagggttcgtggtggaaacgtgaagtggagagctttgaggttggatactggaaatttttcatggggtagtgaggctgtgacccggaagacccgtattcttgatgtggtttacaatgcttccaacaatgagttggttcgtactcagactttggtgaaaggtgctatcattcaggtggatgctgcgccattcaaacaatggtacctccaacattatggtcaagacattggccgaaagaagaaaggtgctgcagctgccgccacaaaaggcgaggagggtgagactgttgcggaggaagccaagaagagcaaccacgtccaaaggaagattgaaaagcgtcaagaaggcagaactcttgatgctcacatagaggaacaatttggtggaggtcgtttattggctgccatctcatctcggcctggtcaatgtggtcgtgcagatggatacatcctggaaggcaaagagctagaattctacatgaagaagctacagagaaagaaggggaagggtagtgcaggagctgcctagatccaattgcatggagggttgagttattgtgttgtcaaactattatatgagttaccatagatctgaatttcccgaactgcatttttggagaaaattgttatgttagttatgactgtatgatgtctttcattttttcagatggtaatgacttttttaaaagctctgcatactaggagtgattacaagtatcactgaatctagtccatctatttgagaacccaaaggtgatattatcaggcaatcatccttacacccttttcttcctgataatagcaatgatacaatttgtttaaca

SEQ ID NO: 6915 - DNA, 796 bp, Triphysaria pusilla
ggagcctagaatcctcaaccagcaatcatgggtatttctcgggattctatgcacaagaggcgttcaactggagggaagcagaagacatggaggaagaagcgaaagtacgagctcggacgacaaccggcaaacacgaagctgtcgagcaacaagactgtgcgcagagtgagagttcgtggaggtaacgtgaagtggcgtgcattgaggttggataccggaaatttttcgtggggtagtgaagctgtgacccgaaaaacccgtattctagatgttgtttacaatgcgtccaacaacgagttggttaggacccagactttggttaagggtgccgtcattcaagttgacgctgcgcctttcaagcaatggtatcttcagcattacggggtcgaaattggccgcaagaagaagactgctgccgccgctgctaaaaaggacggagaggagactgaggctgctgctgctgaagaggcgaagaagagcaaccatgtaaaaagaaaaatcgagaagcgtcaggaggagcgtaaaatagatgcgcatatcgaggaacaatttggaggtggccgtctgttagctgctatctcctcacgcccaggccagtgtggccgtgctgacggttacattttggagggcaaggagttggagttttacatgaagaaacttcagaggaagaagggaaaaggtgctagcggtgtttaatctatgtcgtgagcacaaaccatattttccaattcagtattgttatcatttctttttggcctgtatgacaagaacaatagtttggtatcgaactattttg

SEQ ID NO: 6916 - DNA, 822 bp, Triphysaria pusilla
catgggtatttctcgggattccatgcacaagaggcgtgcaactggaggcaagcagaagacatggaggaagaagcgaaagtatgagctcggaagacaaccagcaaacacgaagttgtcgagtaacaaaactgtacgaagggtgagggttcgtggtgggaatgtgaaatggcgcgcattgaggctagatacaggaaacttttcctggggtagtgaagctgtgacccgaaagacacgtattttggatgttgtttacaatgcgtccaacaatgagttggttaggacccagactttggtcaagggtgctatcattcaagttgatgctgcgcctttcaagcaatggtatcttcagcactatggagtcgaaattggccgcaagaaaaaaactgctgctgctgccaagaaggatgtagaggagactgaggctgctgctgctgaagaggcaaagaagagcaaccatgtcaaaagaaaaatcgagaagcgacaggaggagcgtaaaatagatgcgcatatcgaggaacaatttggtggtggtcgtttgttagctgctatttcctcacgccccggccaatgtggccgtgctgatggttatattttggagggcaaggagttggaattttacatgaagaaacttcagaggaagaaaggaaaaggtgcaggaggtgcttaagtcaatcaagaatgtcattttgatcgttttttgctttctattgcaatcaattcacaattttcaatcagtgtttgcctgaactttgtagagttatattgaacaaagttttcaattgtcagtagaactaaaattaataacccaaaaaaaaaaaaaaa

SEQ ID NO: 6917 - DNA, 870 bp, Antirrhinum majus
  misc_feature (849)..(849): n is a, c, g, or t
cggcacgaggttcaagcacgagggcattcagtcggaaccctagagttcgccacttccaatcatgggtatctcacgagattcgatgcacaagaggcgcgccactggtggaaagaagaaggcgtggagaaagaagcgaaagtatgaactcggaagacagcctgcgaatactaagttatcgagcaacaagactgttcgccgtgttagggttcgtggaggtaatgtgaaatggcgtgcattgagattggacactggtaactactcgtggggaagcgaagcggtgactcgtaaaacgcgtattctcgacgtggtgtacaatgcgtcgaacaacgaattggttaggactcagactttggtgaagggtgctattgttcaagttgatgctgcaccattcaagcagtggtatcttcagcactatggcgtcgagattggccgcaagaagaagactgctgccaagaaggaaggagaggaggctgaggctgctgctaccgaggaggtaaagaagagcaaccacgtccaacgaaaaattgaaaagcgccaacaggatcgcaagattgacgcacatattgaggagcaatttggcggtggtcgattgttggctgcgattgcctcacgccctggccagtgtggacgttgtgatggttatattctggaaggcaaagagttggagttttacatgaagaaactccagaggaagaaaggaaagggtgcaggtggtgcttaattttgtatcaagctcatcaattttccagtcccagactatgtttattttctttattgtttttgaatctgttaaatgaactacatagaaatttcttgagttctttcttggtgtaatactttatatcttanaagaattatgattatgaaaaa

SEQ ID NO: 6918 - DNA, 833 bp, Antirrhinum majus
cggaaaccctagattccgttagcaccttcaatcatgggtatctcacgtgattctatgcacaagaggcgtgccactggaggcaagaagaaggcctggagaaagaagagaaagtatgagctcggaagacagccagcaaacaccaagttgtcgagcaacaagactgtgcgcagagttagagtgcgaggaggtaatgtgaagtggcgtgcattgaggttggatacgggaaactactcatggggtagtgaagccgtgacccgcaagacccgtattctggatgtcgtttacaatgcatcaaacaatgagttggtcagaactcaaactttggtgaagggtgctattgttcaggttgatgccgctccattcaagcagtggtatcttcagcattacggagttgagattggtcgcaagaagaagactgctgccaagaaggaaggagaggaagctgaggccacagctactgaagaagtaaagaagagcaatcatgttcagaggaaaatagaaaagcgccaacaagagcgcaagattgacgcacatattgaggaacaatttggcggaggccgtttgttggctgcaatctcgtcacgcccagggcaatgtggtcgctgtgacggttatatcctcgaagggaaggagttggaattttacatgaagaaacttcagaggaagaaaggaaagggtgcaggtggtgcttagtttttgtagtaagatcagaaattttcccagtcccaaactttttttggccattaccgctaaatctatggaattgactaaacagaaattgctcgagtgtttttttgagatactattttatttttaaaggtgaattttgatta

SEQ ID NO: 6919 - DNA, 1021 bp, Artemisia annua
gccggtcatcaacaaccatgggtatctcacgtgactctatgcacaaaagacgtgcaactggtggcaagcaaaagacttggaggaagaaacgaaagtacgagcttggtcgtcagccagctaacacgaagatctcaagcaacaagactgtaaggagagtccgagtgaggggaggcaacgttaagtggagagcccttaggttagacactggaaattactcatggggaagtgaagcagttactcgcaagactcgtatccttgatgtggtctacaatgcatcaaacaacgagcttgtgagaactcagactcttgtgaaaggtgctattgttcaagtggatgctgccccgttcaagcaatggtatttgcagcattacggggttgacttaggtaggaagaagaaagctgctgctactaagaaggaaggagaggaaggagaaggaaccgcagaggaagcaaaaaagagcaaccatgtccagagaaagattgagaagcgccaggaagagcgtaaacttgatgcccatgtggaagaacagttcaattctggtcggttgtatgcttctatctcttctcgcccaggtcaatgtggtagagctgatggttatatattggaaggcaaggagcttgaattctatatgaagaagcttcaaagaaagaagggcaagggtgctggtgctgcataagccttacgtgtattttagtttcttgaaagtcagcttgcagtagtgtgttggaactttgaaacttaagtgctggcgctgccataactgttggtgtatgttagtttcttaagagacggattgtgttggtatgttggaacttggaagcttttgttttgtttcgataacagtttgttagaccaagttgtagttgcatgttttgtgcaaaccgtgacatataatgttataaagtgggcttgtcttataacctattgctgaatcaaccttgttattatttagctatctaataactgtaatatggtgtttttgttgtcagatatatatgaacatacctgtcagattttgac

SEQ ID NO: 6920 - DNA, 1002 bp, Musa acuminata
ccatatttgggctcgattcgtgggcttcgacgcgggctagggttttattcccgttcatcacgtgtttggcacgtgcactggttgcttcggagcaaagacgttagggtttcggagggcatataagagagaagaagcttgcgacggcgaaatcctagagaccccaagtgtcgccaccgctctgccaaaatgggtatctcacgggactccatgcataagaggcgcgccaccggaggcaagaagaaggcctggaggaagaagagaaagtatgagttggggaggcaaccggcaaacacaaaactttcgagcaacaaaacggtgaggagggtccgagtccgtgggggcaatgtgaagtggagggcccttcggttggacagtgggaattactcgtggggaagtgaggctgtgacgcgcaagacccgtatccttgatgtggtctataacgcttcgaacaacgaacttgtgaggacacagaccctcgtgaagagtgccatcgtgcaggttgatgctgcccccttcaggcagtggtacctccagcattacggggttgagattggaaggaagaagaaggccccaacagcttccaagaaagacgcaatggaggagggtgaagctgctgcagaggaagaaaagaagagcaaccacgtaaccaggaagctggagaagcggcagcaggggcggatacttgatcctcacattgaggatcaatttggtgctggaaggttgttggcttgtatatcttctcgtcccggtcaatgtgggagatctgatgggtacattttggaaggaaaggagctcgagttctacacaaagaagcttcagcggaagaagggcaagggtgctgccgcttgaggaaaccacttatttctctgattccaccgtgagtttcaaaacgatatagttatgcactttatttcaagctttatttttgaattggagagatgttctcttatcgaaaatttgacattgtgaaatagagatgagttcaaacactgtattagactc

SEQ ID NO: 6921 - DNA, 897 bp, Eschscholzia californica
aaggaggttttgaagatcaacaaagaaaaccctaaatctctattgttctctctgcaagatgggtatttctcgtgattccatgcacaagagacgtgccactggaggcaaaaagaaagcttggaggaagaagcgaaagtacgagctcggaagacaaccagcaaacacaaagttatcaagcaacaaaacagtaagaagggttagggttagaggaggaaatgtgaaatggcgtgcattgagacttgatactggtaattactcatggggaagtgaaacagtgacaagaaaaacccgtattcttgatgtggtttataatgcatcaaacaatgaacttgttagaacccaaactttggtgaagagtgctattgttcaagttgatgctgctccatttaaacaatggtatcttcagcattatggacttgatattggtaggaagaagaagggttcctcagctgctgctgcacccaagaaagaaggggaggagggtgaagctgtcaccgaggaggcaaagaaaagcaaccacgtagctaggaaacttgagtcacgccaaaaagatcacaagcttgatccacatattgaagaacaatttagtggtggtcgtttattggctgcaatctcctctcgtcctggtcaatgtggtcgagctgatggatatatcttagaggggaaagagttggagttctacatgaagaagttacagaagaagaagggcaagggtgctgctgcttaaatcttttcttctattatctctcttccttggacaaaatgtttttcatgtttcttttacatctataacatgcttagatcaagtttaagtggggtttagttcaattttgactatataatctgaattcatctcattatcctttctgtctaaaacaatcttggttgaatgcattt

SEQ ID NO: 6922 - DNA, 805 bp, Fagopyrum esculentum
agagcaaccaaccaaccaaccatgggtatctctcgtgattctatgcacaagaggcgtgccaccggtggcaagaagaaggcctggaggaagaagagaaagtatgagcttgggagacagccagctaacacaaagctgtctagcaacaagacagttagaagggttagggttcgaggtggtaatgtgaagtggcgtgccctacgtttggatactggaaattattcatggggtagtgaggctgtcaccaggaaaactcgtatcctagacgtggtgtacaatgcatctaacaatgagttggttaggactcagaccttggtgaaaagtgccattgtgcaggttgatgctgcaccttttaagcaatggtatctccagcattatggagttgacattggccgcaagaagaagactacttctaagaaggaagcatcaggagaggacggattagatggtggggaagaagcaaagaagagcaaccatgtacagaggaagttggagaagcgacaggagggtcgctctttggatgcacacatagaggaacagtttagcagtggacgtcttttggctgcaatctcttcgcgccctggccagtgtggtcgttgtgatggatacatcttggagggtaaagaactggaattctacatgaagaagctccaaaagaagaagggaaagtcagcaggtgctgcttaaattgatgttgccaatttttttgtttattttgatctgaaagttttgatggatgataatcagaaaactgagttgtttttcttgtaaaactcttgactatctcattgattggaatataaaggtt

SEQ ID NO: 6923 - DNA, 957 bp, Cucumis melo
gagcacccactactaccgtcgccgccgcctgctgcctgctgccgggtaagtcctcttcgtgtaggagcttcagactcgtcaacatgggtatctctcgagattctatgcacaagaggcgtgccactggaggaaagaagaaggcttggaggaagaagagaaagtatgagcttggaaggcaacctgccaacactaagttatcaagtgacaagtcaatcaggaggattcgagttcgtgggggtaatgtgaagtggcgagcttttagacttgatacgggaaattactcatggggtagtgaggctgtgactaggaaaacccgtattctagatgtggtgtacaatgcatcgaacaatgaacttgttcgcactcaaactttagtgaagagtgccattgttcaggttgatgccgcaccattcaagcaatggtatcttcagcactacggagtggatattggaaggaagaagaagactgcagcatctactaagaaggacgaggaaggtgatgctgctgctgctgaggaggtgaagaagagtaaccacgttcagcgtaaactggagaaacggcaagagggtcgtaagctcgacccacatattgaagagcaattcagcagtggtcgtttgatggcttgtatttcatcaagacccggtcaatgtggtcgtgctgatggatatatcttggagggcaaagaacttgagttctacatgaagaagctccagagaaagaagggaaaaggtgctggtgctgcttaatttttgtcgttaagatattttgtggccgtgtttccttctatgattctgtctttttttggtctaatgaagacgataagttgttgcagctaagatgaaacaattatttatgaactccaattttgctgttattagttgtttaattacattactttccttagtctgttccataattagaacattttttataagcgtagaattttctctagttgcc

SEQ ID NO: 6924 - DNA, 951 bp, Quercus alba
agacaaccagggttttaacatttagagagagagagagagagagagagagagcacttcgctgcggggccaagatgggtatctcaagagattccatgcacaagagacgtgccactggtggcaagaagaaagcttggagaaagaagcgcaagtatgagcttggtcgccagccagcaaatactaagctctcaagcaacaagacagtaaggagaatccgtgtgagaggtggaaatgtgaagtggagggcccttagattggatacagggaatttttcatggggtagtgaggctgtcactcgcaaaacccgtctccttgatgtggtttacaatgcctcaaacaacgaacttgttaggacacaaactctggtgaagagtgccattgttcaagtcgatgcagctccatttaagcaatggtaccttcaacactatggtgttgatgttggtaggaagaagaaggcaaccactaagaaggaaaccacagaggagggggaaggtgctgctacagctacagaggaaattaagaagagcaatcatgttcagaggaagattgagaagcgccagaaagatcgtcaacttgatccgcatattgaagagcagtttggttctggtaggttgttggcctgcatctcttcccgacctggtcaatgtggcagagctgatgggtacatattggaagggaaagaacttgaattctatatgaagaaactccagcggaagaagggaaaggctggtactggtgcttaattgtactgtgttagtgttttgatgttgcctatattgaatctttatttttaggctatagcttccattgaagaagaggcttttgctaagcatttttgctgttacctgattggtgaccacttgaacgatgtcaattgttgtggcatcatctcttagaacatttttggcaacacattgggtttaattcatttattacggggccttttatttttct

SEQ ID NO: 6925 - DNA, 960 bp, Olea europaea
tacagggtttgcattttgcaccgccgttcaggcaattgaggttcaacggaacagtaggagcccccgccggaaaccatgggtatttcacgggattcgatgcacaagaggcgtgcaactggaggcaagaagaaggcgtggagaaagaagagaaagtatgagcttggaagacaaccagcaaacacaaagttgtcaagtaacaagaccgtgcgtagggtgagggtcagaggaggtaatgtgaagtggcgtgccctgaggctggatacagggaactactcttggggaagtgaagctgtgacccggaagactcgtatcctagatgtggtgtataatgcgtcaaataatgagttggtgaggactcaaactttggtgaagagtgctattgtgcaagtggatgctgcaccattcaaacagtggtatctgcagcactatggagttgatattggcaggaagaagaaggctgctgccaagaaggaaggagaggagactgagactgctgctactgaagaggcaaagaagagcaaccacgtcaagagaaaaattgaaaagcgtcaacaggatcgcaaacttgacccacatgtggaggagcaatttggcagtggccgtttattagctgcaatctcctcccgtcctggccagtgtggccgtgccgatgggtatattttggagggcaaggagttggagttttacatgaagaaactccagaggaagaaagggaagggtgctggtgccgcttgaacttttgtgttgctcgtgtgaacgttctccctcccaaaatctcgccctatttttgtcattgttgttctccctgctatgggatgagtaagtttgagcttttctagtgttgggttgaactattaattgttacactagtgaattttttcgaggaggattatgttcatttctgttctcgttctcgttctcgttcagtgatagcattgatggaaacagaattaagatctc

SEQ ID NO: 6926 - DNA, 853 bp, Triphysaria pusilla
tattctcagttggagacaaatcggagcctccgccagcaatcatgggtatttctcgggattctatgcacaagaggcgttcaactggagggaagcagaagacatggaggaagaagcgaaagtacgagctcggaagacaaccggcaaacacgaagctgtcgagcaacaagactgtgcgcagagtgagagttcgtggaggtaacgtgaagtggcgtgcattgaggttggataccggaaacttttcgtggggtagtgaagctgtgacccgaaaaacccgtattctagacgttgtttacaatgcgtccaacaacgagttggttaggacccagactttggttaagggtgccgtcattcaagtcgacgctgcacctttcaagcaatggtatcttcagcattacggggtcgaaattggccgcaagaagaagactgctgctgcctctgccaagaaggacggagaggaaactgaggctgctgctgctgaagaggcgaagaagagcaaccatgtcaaaagaaaaatcgagaagcgtcaggaggagcgtaaaatagatgcgcatatcgaggaacaatttggcggtggccgtttgttagctgctatttcatcacgcccaggccagtgtggccgtgctgacggttacattttggagggcaaggagttggagttttacatgaagaaacttcagaggaagaagggaaagggtgctggtggtgtttaatttatgtcttcaaggacaaagcatatttttcgattcagtatttgttattttttctttatggcttgtacgaccagaacaatagtttggtattgaacgattttgatatgttactagtgcgacatcacatttacaattaattatcc

SEQ ID NO: 6927 - DNA, 914 bp, Panax ginseng
agcagctgtcatttgggttgtaggtggagaataccaccgtctgcaaacatagggtatttcccgggtatttcgagtgcacaaaaggcgtgccactggaggcaagaagaaggcttggaggaagaagcgaaagtatgagctcggaagacaacctgcaaacacaaagttgtctagcaacaagacagttcgtagggtaagggttcgaggtgggaacgtgaagtggcgtgccttgaggttggacacagggaactactcttggggtagtgaggctgtgacacgaaagactagaattctggatgtggtgtataatggcatcaaataatgaattggttaggacacagacattggtgaagagtgccattgttcaggttgatgctgcaccatttaagcaatggtatcttcagcactatggtgttgacattggtcgcaagaagaaatcctctgctgctgccaagaaagaaggagaggagggtgaagctgctactgaggaagcgaagaagagcaaccatttacaaagaaaaattgagaagcgtcaagaggatcgtaagattgatgcacatattgaagaacaatttggaggtggtcgtcttttagctgcaatttcctcacgacctggtcaatgcggtcgttctgatggatacattttggagggtaaggagttggagttctacatgaagaaactccagaggaagaaaggaaagggcgcagcagcttaaaatttcgtgacttgaatgtagtttgaattctgaattttttctctatattactttttttacttcttcaggcatgaaactgaagaactattaagctcatagttagtttcatttcttgttgtctcgagtgttgaagaagaatatttgaattttctttaatttttaacagtggtagtgttattggcttaattacagcgcttttat

SEQ ID NO: 6928 - DNA, 890 bp, Festuca arundinacea
ggcggcgcagctaaccacagcaggagtaggcgaggaggccgcagccatgggtatctcgcgggactccatgcacaagcgccgcgccactggcggcaagatgaaggcctggaggaagaagaggaagtatgagctcggccgccagcctgccaacaccaagctctcaagcaacaagactgtaaggagggttcgtgtccgtggaggcaatgtgaagtggagggccctccgtttggacacaggcaactactcctggggaagcgaggctgtgactcgcaagactcgcctccttgatgtggtttacaactcttcaaataatgagcttgttaggacacagactcttgtgaaaaatgccatcgtgcaagtggatgctgcccccttcaaacagtggtatctcactcattatggagtggatattggtaggaagaagaaggcccctgctgctgccaagaaggatgctacggaggagggtgatgctgctcctgtagaggaaaccaggaaaagcaacaatgtccagaggaagctggagaagcgccagcagggtcgcaccctagactctcacgtcgaagagcagtttagtagtgggagattgctagcctgcatttcttcccgccctgggcagtgtggacgagctgatggctacatccttgagggcaaggagttggagttctacatgagaaaacttcagaagaagaagggcaagggtgctgcagcatagagaatgcccatctcagaattcctcctttctccctggttattgttagctgttttggatcttttgttatgtttgtgtatttgtggactcatggatggttgtctaaactccaaacggagcttgtcaagcatgaaaagctgaatatggtttatttactgtaaaactatcagtttatatatgt

SEQ ID NO: 6929 - DNA, 881 bp, Festuca arundinacea
aaccaaagctgcggcggcgcgggcgtagaaggcgaagcagcggaggagccaagccatcgacgccaccatgggtatctcgcgtgactccatgcacaagcgccgggccaccggtgggaagatgaaggcatggcgaaagaagcgaaagtatgagctcggccgccagcctgctaacactaagctgtccagcaacaagacagtgaggagggtccgtgtccgtggtggtaatgtgaagtggagggctctccgtctggatactggtaacttctcatggggaagtgaggctgtgacccgcaagacccgtcttctggatgtggtttacaatgcgtcaaacaatgaacttgtgcgcacacagacactggtgaagaatgccattgtccaagttgatgctgctcccttcaaggggtggtatctgacacactatggagttgacattggtcgcaagaagaaaacccctgctgctgctaagaaggacgcagctgagggacaagagggagaggttgctccagctgccacagaggaggcaaagaagagtaacaacgtccagcggaagctggagaagcgtcagcagggacgcactctggatgcccacattgaggagcagttcagcagtggaaggctgttggcctgcatctcatcccgccctggccagtgtggcagagccgatgggtacattctggagggcaaagagctggaattctacaccaggaagctccagaagaagaagggcaagggtgccgcagcttagatcacaccttcctgtgtgctttatggcaggcctgcgtatttcatttcctggattttgatagttgttgcgtccatgttactatgttgcaaacgtgctgaacactattttctgcaagtgaatcgactctaggttggaa

SEQ ID NO: 6930 - DNA, 963 bp, Panax ginseng
gcagtggtatcaacgcagagtacatggggctcctccaaatctcctgccgagtttggtccgtttccgctgctggtatttgggttctttcaccttctaaaaccatgggtatttctcgtgattcgatgcacaagaggcgtgctactggaggcaagaagaaggcttggaggaagaagcgaaagtatgagcttggaagacaacctgcaaacacaaagttgtctagcaacaagacagttcggagggtaagggttcgtggtgggaatgtgaagtggcgtgccttgagattggatacagggaactactcttggggtagtgaagctgtgacccgtaagactcgaatcctggatgtggtctataatgcatcaaataatgaattggttaggacccagacattggtgaagagtgctattgttcaggttgatgcagcaccatttaagcaatggtatcttcagcactatggtgttgacattggtcgcaagaagaaatcctctgctgctgctgctgctgctgcttccgccgccaagaaagaaggagaggagggtgatgttcctatcgaggaggcgaagaagagtacacatgtcctgagaaaaattgaaaagcgtcaagaggatcgtaagattgacgcacatattgaagagcaatttgggggtggccgtctattagctgcaatttcatcacgacctggccaatgtggccgtgctgatggatatatcttggagggcaaggagctggagttctacgtgaagaaactccagaggaagaaaggaaagggtgctgcagcttaaaatggagttgcaattcagaacatttgtgttttctattttactttttcagagatggaaccaaagaactattcagctctcatagttagctttgtttcttgtcatgtctgagtgttgaaggagaattttagcatcatctttaattttcaacagtggtagtattatcgacttaaatttcagcttt

SEQ ID NO: 6931 - DNA, 907 bp, Zea mays
gtacccaatcagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgtcctggacagtgtggccgagctgatgggtacatccttgagggtaaagagcttgaattctacatgaagaagctacagaggaagaagggcaagagcgctgtagcttagagcattctcatggattgtcttgcaccgaaatgtgtgtcctgatgagtacacttttttggttagtcgtctcaagttcagagcgttatgccatattttcagacctgatttgtacactgttttctaaaagcgattgagctctagtccaatttgagcagggtatgattatttgtt

SEQ ID NO: 6932 - DNA, 915 bp, Zea mays
ttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacacttttttttggttagtcgtctcaagttcagagcgttatgccatgttttcagacctgattagtacactgttttctaaaagcgattgagctctagtccaatgtattgataatatctgctgttgtcc

SEQ ID NO: 6933 - DNA, 918 bp, Zea mays
accccaacgagaagagcggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttaatcgtctcaagttcagagcgttatgccatgttttcagacctgattagtacactgttttctaaaagcgattgagctctagtccaatgtattgataatatctgctgttgtcctattgcggtg

SEQ ID NO: 6934 - DNA, 897 bp, Zea mays
ctctcacttctgtacccaacagaagagcggcggcgcggacggacaaggagcaggcggaagaggagttgtgccaaggcacaatgggtatctcgcgtgactcgatgcacaagcgccgagccaccggtggaaagcagaaggcctggaggaagaagcgaaagtatgagcttggtcgccagccagccaacaccaagttgtcaagcaataagacagttaggagggtccgtgttcgtggaggtaatgtgaaatggagggctcttcgccttgatactggtaactactcatggggaagtgaagctgttacccgcaagacccgtatcctcgacgtggtctacaatgcgtcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagacctgattagtacactcttttctaaaagcgattgagctctagtccaatgta

SEQ ID NO: 6935 - DNA, 910 bp, Zea mays
acttctgtacccaaccagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagtcctgattagtacactgttttctaaaagcgattgagctctagtccaatgtattgataatttctgctgt

SEQ ID NO: 6936 - DNA, 892 bp, Cenchrus ciliaris
cagaagagcggcggcgcgggcggaccaggaataggcggagcaccagcggaggggaccaacccaccgccgccaccatgggtatctcgcgtgactcgatgcacaagcgccgggccaccggtgggaagcagaaggcctggaggaagaagcgaaagtacgagcttggccgccagccagctaacaccaagttatcaagcaacaagacggtgaggagggtccgcgtccgtggaggaaatgtgaagtggagggctctccgcctggatactggtaactactcttggggaagtgaggctgttacccgcaagacccgtatccttgatgtggtctacaatgcttcaaacaatgagcttgtgaggactcagaccctcgtgaagaacgccattgtgcaagttgatgctgccccattcaaacagtggtacctcacgcactatggactggacatcggtaggaagaagaaggcacctgctgccaagaaggatggtgctgagggacaagaggctgaggctgcagctgatgaaactaagaagagcaaccatgtcaagaggaagctggagaagcgcaaggagggacacaaacttgacccccacattgaggagcaatttggtagtggaaggctgttagcttgcattgcttcccgccctgggcagtgtggccgtgctgacgggtacatccttgagggtaaggagcttgagttctacatgaagaagcttcagaagaagaagggcaagggtgcagcagcttagagccatactcatgcatgtttggaaggggtgacctattaaatattctctggcttttttgttagttgtctcaagggcagagtatgtcgtgtttgcagacctgatgagcacaatattttctaaaaatgaatcaactctagccaagaattgagaat

SEQ ID NO: 6937 - DNA, 964 bp, Cenchrus ciliaris
cagaagagcggcggcgcgggcggactaggtaataggcggagcaccagcagaggggaccaacccaccgccgccaccatgggtatctcgcgtgactcgatgcacaagcgccgggccaccggtgggaagcagaaggcctggaggaagaagcgaaagtacgagcttggccgccagccagctaacaccaagttatcaagcaacaagacggtgaggagggtccgcgtccgtggaggaaatgtgaagtggagggctctccgcctggatactggtaactactcttggggaagtgaggctgttacccgcaagacccgtatccttgatgtggtctacaatgcttcaaacaatgagcttgtgaggactcagaccctcgtgaagaacgccattgtgcaagttgatgctgccccattcaaacagtggtacctcacgcactatggactggacatcggtaggaagaagaaggcacctgctgccaagaaggatggtgctgagggacaagaggctgaggctgcagctgacgaaactaagaagagcaaccatgtcaagaggaagcttgagaaacgcaaggagggacacaaacttgacccccacattgaggagcaatttggtagtggaaggctgttagcttgcattgcttcccgccctggtcagtgtggccgtgctgacgggtacatccttgagggtaaggagcttgagttctacatgaagaagcttcagaagaagaagggcaagggtgcagcagcttagagccatactcatgcatgtttggaaggggtgacctattaaatattttctggcttttttgttagttgtctcaagggcagagtatgtctgtggtttgcagacctgatgagcacaatattttttaaaaatgaatcaactctagccaagaattgagaattttcaccggactgtggttgtattctcgtaatggtaaggttatctgggttggtgtgggctcaccggtctt

SEQ ID NO: 6938 - DNA, 1013 bp, Cenchrus ciliaris
gcgagacccaaccagaggagcggcggcgcgggcggaccaggacgaggaggcggagcagcagcagcaggagccgggccaagccaccgccgccaccatgggtatctcgcgtgactcgatgcacaagcgccgggccaccggtgggaagcagaaggcctggaggaagaagcgaaagtatgagctcggccgccagcctgctaacaccaagctgtccagcaacaagacagtgaggagggtccgtgtccggggaggaaatgtgaagtggagggctctccgcttggatactggtaactactcatggggaagtgaggccgttacccgcaagacccgtatcctggatgttgtctacaatgcgtcaaacaatgagcttgttcgcacccagacccttgtgaagaacgctattgtgcaagttgatgctgccccattcaagcagtggtacctcactcactatggagtggacattggtaggaagaagaaggcccctgctgccaagaaggacactgctgagggtcaagagggtgaggctgctgcagatgaaacaaagaaaagtaaccatgtcaagaggaagcttgagaagcgcatggagggacgtaaacttgacctgcacattgaggagcaatttagcagtggaaggttgttggcgtgcattgcttctcgccctgggcagtgtggccgagctgatgggtacatccttgagggtaaagagcttgagttctacatgaagaagctccagaagaagaagggcaagggtgctgcagcttagatgcattatcttgctcgaagggcggcctatcttatccttttactctgggttttgttagtcctcaagtatgttatgtcatgttgcagacctgattgaacacctattttctaaaagtgaatcaactctagcttcaaagaactgagaattttcaccctgccatggttgtattctcgtgatatttaggttcactgtttcttgacagtttgtgttcagcagttttggttgatctctcagattgctttttgaatggtgt

SEQ ID NO: 6939 - DNA, 995 bp, Cenchrus ciliaris
gcgagacccaaccagaggagcggcggcgcgggcggaccaggacgaggaggcggagcagcagcagcaggagccgggccaagccaccgccgccaccatgggtatctcgcgtgactcgatgcacaagcgccgggccaccggtgggaagcagaaggcctggaggaagaagcgaaagtatgagctcggccgccagcctgctaacaccaagctgtccagcaacaagacagtgaggagggtccgtgtccggggaggaaatgtgaagtggagggctctccgcttggatactggtaactactcatggggaagtgaggccgttacccgcaagacccgtatcctggatgttgtctacaatgcgtcaaacaatgagcttgttcgcacccagacccttgtgaagaacgctattgtgcaagttgatgctgccccattcaagcagtggtacctcactcactatggagtggacattggtaggaagaagaaggcccctgctgccaagaaggacactgctgagggtcaagagggtgaggctgctgcagatgaaacaaagaaaagtaaccatgtcaagaggaagcttgagaagcgcatggagggacgtaaacttgacctgcacattgaggagcaatttagcagtggaaggttgttggcgtgcattgcttctcgccctgggcagtgtggccgagctgatgggtacatccttgagggtaaagagcttgagttctacatgaagaagctccagaagaagaagggcaagggtgctgcagcttagatgcattatcttgctcgaagggcggcctatcttatccttttactctgggttttgttagtcctcaagtatgttatgtcatgttgcagacctgattgaatacctattttctaaaagtgaatcaactctagcttcaaagaactgagaattttcaccctgccatggttgtattctcgtgatatttaggttcactgtttcttgacagtttgtgttcagcagttttggtttatctctcaga

SEQ ID NO: 6940 - DNA, 1078 bp, Setaria italica
tctcctcttccctgcgagacccaaccagcggagcggcggcgcgggcggaccaggaggaggaggaggcggagcggcagcagccgagccaagccaccgccgccaccatgggtatctcgcgtgactcgatgcacaagcgccgggctaccggtgggaaacagaaggcctggaggaagaagcgaaagtatgagcttggccgccagcctgctaacaccaaactgtccagcaacaagacagtgaggagggtacgtgtccgtggaggaaatgtgaagtggagggctctccgcctggatactggtaactactcatggggaagtgaggctgttacccgcaagacccgtatcctggatgttgtctacaatgcgtcaaacaatgagcttgttcgcacccagacccttgtgaagagtgctattgtgcaagttgatgctgccccattcaagcagtggtacctcactcactatggagtggacattggtaggaagaagaaggcccctgctgccaagaaggatgctgctgagggtcaagagggtgaggctgtagctgaggaaacaaagaagagtaaccatgtcacaaggaagcttgagaagcgcaaggtggggcgccaacttgacccacacattgaggagcaatttggcagtggaaggttgttggcgtgcattgcttctcgccctgggcagtgtggccgagctgatgggtacatccttgagggtaaagagctcgagttctacatgaagaagctccagaagaagaagggcaagggtgctgcagcttagatgcatcttcttgctcgaagggcggcttatcttatcctttactctgggttttgttagtccacaagtatgttatgtcgtgttgcagacctgatgaacacctattttctgaaagtgaatcaactctagcttcaaagaactgagaattttcaccctgtcgtggttgtattctcgtggtgtttaggttcactgtttattgacagtttgtgttcagcagttttggtttatctctcagatggctttctgaatggtgtatctcctgttcggtctttatttgttggttgcgaacgttggacgaaagcgtatccgcc

SEQ ID NO: 6941 - DNA, 1398 bp, Zea mays
atgcggcccaggcgccccaccttccctcctcctatatacacactcgatacctagggtttccttctctcacttctgtacccaacagaagagcggcggcgcggacggacaaggagcaggcggaagaggagttgtgccaaggcacaatgggtatctcgcgtgactcgatgcacaagcgccgagccaccggtggaaagcagaaggcctggaggaagaagcgaaagtatgagcttggtcgccagccagccaacaccaagttgtcaagcaataagacagttaggagggtccgtgttcgtggaggtaatgtgaaatggagggctcttcgccttgatactggtaactactcatggggaagtgaagctgttacccgcaagacccgtatcctcgacgtggtctacaatgcgtcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagacctgattagtacactcttttctaaaagcgattgagctctagtccaatgtattgataatatctgctgttgtcctattgcggtgatgtttatttgccctgttcgctagctgcaatagttcctatttgagcagggtatgattatttgttgactagttgagtgcccgtgcgttgcaacggcaacatataataccatgatgaattatgtacaaatgtgtgtttcattattatagtactatgtacgtgctttacacacaatcatatttgatacccataaaaaatatatgttctatacacatttagatctcgagatgtctcgttccctccaacgaaataagtccaagaaattttgtttgaggcttaaatgacctcaaaacaaatgtttacattctgacaaatctttttaagatgctagaacatattcgatctttaaaaagaaccataggttccaatctgaaaaatcagcttgccgacattgacttggctccacgg

SEQ ID NO: 6942 - DNA, 1114 bp, Zea mays
cactcagcccaccggcgcctatccccaaccctaggtcagcccatatatataaacccgatatttagggtttccttctctcacttgtgtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacacttttttttggttagtcgtctcaagttcagagcgttatgccatgttttcagacctgattagtacactgttttctaaaagcgattgagctctagtccaatgtattgataatatctgctgttgtcctattgcggtgatgatgatttgccctgttcgctagctgcaatagttcctatttgttgatgaatttgtttgaagcataaacgcagaacatgtcgtaaagaaaacctttctgtaatattag

SEQ ID NO: 6943 - DNA, 1160 bp, Zea mays
atgagacaacgatgcggcccaggcggcccacctcccctctcctatatacacactcgatacctagggtttccttctctcacttctgtacccaatcagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgtcctggacagtgtggccgagctgatgggtacatccttgagggtaaagagcttgaattctacatgaagaagctacagaggaagaagggcaagagcgctgtagcttagagcattctcatggattgtcttgcaccgaaatgtgtgtcctgatgagtacacttttttggttagtcgtctcaagttcagagcgttatgccatattttcagacctgatttgtacactgttttctaaaagcgattgagctctagtccaatttgagcagggtatgattatttgttgatgaatttgtttgaagcataagcacagaagcagggtatgattatttgttgatgaatttgtttgaagcataaacgcagaacatgtcgtaaagaaaacctttttccgtaatattagcttgtaagatcgtcatggcttcactgcatacataattttccctttttaggtgtc

SEQ ID NO: 6944 - DNA, 1137 bp, Zea mays
atttgccatgggtatttatttggtgggcactaggcctcactcagcccaccggcgcctatccccaaccctaggtcagcccatatatataaacccgatatatagggtctcacttgtgtaccccaacgagaagagcggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttaatcgtctcaagttcagagcgttatgccatgttttcagacctgattagtacactgttttctaaaagcgattgagctctagtccaatgtattgataatatctgctgttgtcctattgcggtgatgttgatttgccctgttcgctagctgcaatagttcctatttgttgatgaatttgtttgaagcataaacgcagaacatgtcgtaaagaaaacatttttctgta

SEQ ID NO: 6945 - DNA, 1373 bp, Zea mays
gagacaacgatgcggcccaggcgaccacctcacctcccctcccctatatacacactcgatacctagggtttccttctctcacttctgtacccaaccagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagtcctgattagtacactgttttctaaaagcgattgagctctagtccaatgtattgataatttctgctgttgtcctattgcggtgatgtttatttgccctgttcgctagctgcaatagttcctatttgagcactgagcagggtatgattatttgttgatgaatttgtttaaagcataaacacagaagcgggtatgattatttgttgatgaatttgtttgaagcataaacacagaacatatagtaaagaaaacctttttcactaagggcccgtttgtttccttggaaatgaaactcattccatgaataacattctagatattagattcctaaagaaagtaattccttagaatttgattcaattcaatttttttgtttgggtgctaatggaattcttttccatgaatcaaattcaatatcttgtttggatagttatatatgaaatttacatattt

SEQ ID NO: 6946 - DNA, 946 bp, Pennisetum glaucum
gcggcgcgggcggactaggaggaggcggagcaccagcgaggggaccaagccaccgccgccaccatgggtatctcgcgtgattcgatgcacaagcgccgggccaccggtgggaagcagaaggcgtggcgtaagaagcgaaagtatgagcttggccgccagccagctaacaccaagttgtcaagcaacaagacggtgaggagggtccgcgtccgcggaggtaatgtgaagtggagggccctccgcctggatactggtaactactcttggggaagtgaggctgttacccgcaagacccgtatcctggacgtggtctacaatgcttcaaacaatgagcttgtgaggacacagaccctcgtgaagagcgccattgtgcaagttgatgctgccccattcaaacagtggtacctcacgcactatggagtggacattggtaggaagaagaaggcacctgctgccaagaaggatggtgctgagggacaagaggttgaggctgctgctgatgaaaccaagaagagtaaccatgtcaagaggaagcttgagaagcgtaaggacgaacgcaaacttgacctgcacattgaggagcaatttggcagtggaaggctgttagcttgcattgcttcccgccctgggcagtgtggccgggctgacgggtacatccttgagggtaaagagcttgagttctacatgaagaagcttcagaagaagaagggcaagggtgcagcagcttagaggcattcttatgcatgtttggaaggggtgtcctattaaatatttactctggtctttttgttagttgtcaaacgggcagagcatctatgtcgtgtttgcagacctgatgaagacagtattttctaaaaacgaatcaactctagtgaagaactgagaattttcagctgttgtattcttctactgtttaggttatctgttttctatgtgctgcagcagt

SEQ ID NO: 6947 - DNA, 1495 bp, Mimulus guttatus
gccgggttgcaattccaccgccgtttcagtcgtgctgcattccgtcgccgattaatcggaactcttcgatcaagagcccgaaatcatgggtatctcacgagattcgatgcacaagagacgcgccaccggaggaaaaatgaaggcgtggaggaagaagcgaaagtatgagctcggaagacagccagcaaacacgaagctgtcgagcaacaagactgtgcgaagggtgagagttcgtggaggtaatgtgaagtggcgggccctgaggttggatacaggaaacttctcgtgggggagtgaagctgtaacccgtaagacacgtattctcgacgttgtttataatgcgtcaaataatgaattggttaggacccagactttggtgaaaggggctattattcaagtggatgctgcacctttcaagcagtggtatcttcagcattacggagttgaaatcggccgcaagaagaaggctgccgctaagaaggaaggagaggagactgaggctgctgcagccgaagaagtgaagaagagcaaacatgtgttgaggaaactcgaaaagcgtcaagaggagcgcacaattgaccaacatattgaggagcaattcgggggtggccgtttgctagctgcaatttcctctcgtcctggccagtgtggccgtgcagacgggtatattttggagggtaaggaattggagttctacatgaagaaactccagaagaagaaaggaaagagtgccggtgcttaaattttgccgatagaattttaattcgtagacggctcttgatctttgtattccttttctctgcaatgtaaggaacaaaatgagctttcgtaagttatattgaacttttcgattgtcatactactgatttctcgagacatgttaatttttcttcattggctaattgctcgacttttggcttaattactgttgtacgccggggtagctatccctagtgtcttatcacttgatgcttactagtaaaatttgcgaggatatgtaattagaagtgcgaagtgatagtataaatcagtcgaaattttgaaaattgaaatgattttttttatttacaaatcaaaaatttagaatcatcaacggatatgtacattcgctgaaataataaacaagacaaattaccgaacagtttgagctattaactccaaagttcgatcttgaaccaactagaaagaaccaaagcaaatgcataaggtttcacaaggagatacgagtaaaaacaaaacatgctgtcaagaacgaagcacctacttaatcactaaacaaatactacataatttaagccgggtttttgaaagttaccgatgaatgttgtgttgaagctgcatatattctttgcacgaagccctcccattatcgaactaaaataagaacaaattgttagtatccgtgttgaatcaccggaacacaacattattagtattattatttcccatatttctttcttaatcgttctctgacaaagtcattccgagcttggat

SEQ ID NO: 6948 - DNA, 942 bp, Avena sativa
agccaaggctctctcgtcctcctgcgagctcccaccaaaactgcggcggcgcgcgcatagaaggcgaagcagcagcggagccaatccaccgacgcaaccatgggtatctcgcgtgactccatgcacaagcgccgtgccactggtgggaagatgaaggcatggcgcaaaaagaggaagtatgagcttggccgtcagccagccaacactaagctgtccagcaacaagacagtgaggagggtccgtgtccgtggaggtaatgtcaagtggagggctctccgcctggatactggcaacttctcatggggaagtgaagctgtgacccgcaagacccgtctcctggatgtcgtttacaatgcgtcgaacaatgagctcgttcgaacgcagaccctcgtgaagaacgccattgtgcaagttgatgctgcccccttcaagggttggtatctgacgcactatggtgtggacatcggtcggaagaagaaagctcctgctgctgccaagaaggaagcttctgagggacaagagggtgaggttgctgcagttgccacagaggaggcaaagaagagcaacaacgtccagcgcaaacttgagaagcgtcaacagggccgttctctggactcccacattgaggagcagttcagtggtggaaggctgttggcctgcatctcctcccgccctgggcagtgcggcagagctgatgggtacatcctggagggcaaggagcttgagttctacatgaggaagctgcagaagaagaagggcaagggtgccgcagcttagattacagtctcctgtgtgctctatcgctggatgttatatttcattccctgagttttgatagttgttcggtctatgttatgatgtactgaatactatgttctgcaagtgagtcactatgtttgaacgactgagaatattttgcctgcttcagtaacctttgatatt

SEQ ID NO: 6949 - DNA, 1045 bp, Papaver somniferum
gctgaaggaaacagaacaactagttcttccgccgttcagccaagatgggtatctctcgagattctatgcacaagaggcgcgctacaggaggaaagaagaaggcatggaggaagaagcgaaagtacgagctcggtcgtcagcccgctaacaccaagctgtcaagcaacaagacagtgaggagagtacgtgttagaggaggtaatgtaaagtggagggcactccgattggatactggaaattactcatggggaagtgaaaccgttactcgtaagacccgtattcttgatgtcgtttacaatgcgtcgaacaatgagcttgtcaggacacagacattagtgaagagcgctattgttcaagttgatgctgctcctttcaagcaatggtaccttcagcactatggtcttgacatcggaaggaagaagaagactgctgctgccaagaaggaaaccactgaggagggagatgctgctgcagcagaagaagcaaagaagagtaaccatgtaatcaggaaaattgagaagcgtcaggtggatcacaaacttgaccctcatattgaagagcagtttagtggaggcagactattggcctgcatttcatctcgccctggacaatgtggtagagctgatgggtacatcttggaaggaaaggagcttgaattttacatgaagaagctacaaaagaagaagggcaagggtgctgctgcttaaacaacccgactattattgcgtgtgggaggtttttagcttttgtgatgatagtgcttcttaattatcaagacgtcctttttgtgtttcattctcaagtcgtaggataaagaggaaggattgacatcaaagattctcctaagttttgttattctgaattagtagagatgaaatgctgtttttattacttactatattttccaaacatgcgcgcgtttttcttcattagacataacagatctgggatctttgttttcaatttctatctacctggctggctggctggctgggataaccaaaaacggagtaaaaccattcccttcttgagaacctccaaaaaa

SEQ ID NO: 6950 - DNA, 1075 bp, Papaver somniferum
tgaatgttagggttttaaatgaaaaggattatattgttggtagagagagtgaaaggagctgaaggaaacagaaacaactagttcttccgccgttcagccaagatgggtatctctcgagattctatgcacaagaggcgcgctacaggaggaaagaagaaggcatggaggaagaagcgaaagtacgagctcggtcgtcagcccgctaacaccaagctgtcaagcaacaagacagtgaggagagtacgtgttagaggaggtaatgtaaagtggagggcactccgattggatactggaaattactcatggggaagtgaaaccgttactcgtaagacccgtattcttgatgtcgtttacaatgcatcgaacaatgagcttgtcaggacacaaacattagtgaagagcgctattgttcaagttgatgctgctcctttcaagcaatggtaccttcagcactatggtcttgacatcggaaggaagaagaagactgctgctgccaagaaggaaaccactgaggagggagatgctgctgcagcagaagaagcaaagaagagtaaccatgtaatcaggaaaattgagaagcgtcaggtggatcacaaacttgaccctcatattgaagagcagtttagtggaggcagactattggcctgcatttcatctcgccctggacaatgtggtagagctgatgggtacatcttggaaggaaaggagcttgaattttacatgaagaagctacaaaagaagaagggcaagggtgctgctgcttaaacaattcgactatcattgcttgtgggaggtttttagcttttacgatgatagtgcttaattatcaagatgattatcctttttgtgtttcattctcaagtcgtaggacaagattctcctaagttttgttattctgaattagtagagatgagaaacctttttattacttgctatatttttcaatcatgtgtgcgtttatcttcattagagacgaatctaggatctttgttctttgttttcaatttctatctacctggctgggataaccaaactgggtatattaatttaatacccttagttttgacacccaata

SEQ ID NO: 6951 - DNA, 1444 bp, Sorghum bicolor
ataaaccctaacccgcggccgccgcccctatataacttgacgcccatgatttttgatctcctcttcccgtcgagacccaaccagaccaggggcggcgctggctgacgaggaggcggagtagagcggccggactaactcgataccgccacagccaccatgggtatctcgcgtgactcgatgcacaagcgccgggccaccggtggaaagcagaaggcatggcgcaagaagcgaaagtatgagcttggccgccagcctgcaaacaccaaactgtctagcaataagacagtgaggagggtccgtgtccgtggaggcaatgtgaagtggagggctctccgcttggatacaggtaactactcatggggaagtgaggctcttacccgcaagacccgcatcctcgatgtggtctataatgcatcaaacaatgagcttgtgaggactcagactcttgtgaagagtgccattgtacaagttgatgctgctccattcaagcagtggtacctcactcactatggagtggacatcggtaggaagaaggtgcctgttgccaagaaggatgcagctgagggacaagagggtgaggctatagctgaggaaacaaagaagagcaaccacgtacaaaggaagcttgagaagcgccagcaggggcgtgcacttgacactcatattgaagagcaatttggcagtggaagattgttggcttgcatttcttcccgccctggacagtgtggccgagctgatggctacatccttgagggtaaagagctagagttctacatgaagaagctccagaggaagaaaggcaagggtgctgcatcttagagcattcatttagctagaacagcagaatatcttgtttttttcatataatttgtgcacctgatgaacactataagtgaatcaactcgctttcgaagaattaacgattttcacctgtggtggttgtaatttcgatatttaggtttgttgtttattgaagctttctgtctaaagcagttttagtttaacttgaagatggtttagaaatggaattacgagatcctatccaatccttattgctctttggttttcaccttatagctgctaacatttgactaaatttgtttgccatagtaagaactggtgttgcgtccgacaatatctgtcatgagacctaactagactgttttgaatcaacttgcttcaaagaattgaggattttcacatgtggtggttgtaattgtgatatttagatttgctgcttattgaagctttctgtctaaagcagttttagtttagcttcaagatggtggtttgaaacggaattacgagatcctatccaatctctattgctgtttggtttaaatcttattgctgcttgggactaaggctttattgttcgctacagtaagaactggtgatgcgtctgtcatgagatctaactatgactatttttttaggaacacta

SEQ ID NO: 6952 - DNA, 1696 bp, Sorghum bicolor
ctcttcccgtcgagacccaaccagaccaggggcggcgctggctgacgaggaggcggagtagagcggccggactaactcgataccgccacagccaccatgggtatctcgcgtgactcgatgcacaagcgccgggccaccggtggaaagcagaaggcatggcgcaagaagcgaaagtatgagcttggccgccagcctgcaaacaccaaactgtctagcaataagacagtgaggagggtccgtgtccgtggaggcaatgtgaagtggagggctctccgcttggatacaggtaactactcatggggaagtgaggctcttacccgcaagacccgcatcctcgatgtggtctataatgcatcaaacaatgagcttgtgaggactcagactcttgtgaagagtgccattgtacaagttgatgctgctccattcaagcagtggtacctcactcactatggagtggacatcggtaggaagaaggtgcctgttgccaagaaggatgcagctgagggacaagagggtgaggctatagctgaggaaacaaagaagagcaaccacgtacaaaggaagcttgagaagcgccagcaggggcgtgcacttgacactcatattgaagagcaatttggcagtggaagattgttggcttgcatttcttcccgccctggacagtgtggccgagctgatggctacatccttgagggtaaagagctagagttctacatgaagaagctccagaggaagaaaggcaagggtgctgcatcttagagcattcatttagctagaacagcagaatatcttgtttttttcatataatttgtgcacctgatgaacactataagtgaatcaactcgctttcgaagaattaacgattttcacctgtggtggttgtaatttcgatatttaggtttgttgtttattgaagctttctgtctaaagcagttttagtttaacttgaagatggtttagaaatggaattacgagatcctatccaatccttattgctctttggttttcaccttatagctgctaacatttgactaaatttgtttgccatagtaagaactggtgttgcgtccgacaatatctgtcatgagacctaactagactgttttgaatcaacttgcttcaaagaattgaggattttcacatgtggtggttgtaattgtgatatttagatttgctgcttattgaagctttctgtctaaagcagttttagtttagcttcaagatggtggtttgaaacggaattacgagatcctatccaatctctattgctgtttggtttaaatcttattgctgcttgggactaaggctttattgttcgctacagtaagaactggtgatgcgtctgtcatgagatctaactatgactatttttttaggaacactacaattttataggacttaatcccgaacctgaggatttacacagtgaggctaactttttttaactaataataatacaacctttgattggatttatcataaaatgtattgtcgaattactataaatttataagtataaaacaatatctcttctatcaatattatacaactaaaaagacctggcgtgtgctgctgctagggatcggccgcgttgcacactcggtcgcctcgccgtcatcgtggccactcgaccttccctctttcgcccccatcggttgcccgaacagatgaagcttactcactggtttcatacaag

SEQ ID NO: 6953 - DNA, 919 bp, Tragopogon dubius
ggaggaacgggcatagcgggaggagccgccggagagagcagaggtcagccgcgggttatcttcaaccaccgccaacatgggtatctcacgagattcgatgcacaagaggcgcgccacaggagggaagcagaagacctggaggaagaagcgaaagtacgagcttggtcgccagcctgctaacacgaagatctcaagcaacaagacggtaaggagagtccgagtgaggggaggcaatgtgaagtggagagctcttcgattggacactgggaattactcatggggaagtgaagcagttactcgcaaaacgcgtattctcgatgtggtttacaatgcttcaaacaacgagcttgtgagaactcaaactcttgtgaaaagtgccatcgttcaagttgatgcagctccattcaagcaatggtatcttcaacactatggtgttgacatcggtaggaagaagaaagttgctgctaccacgaagaaggatgcagaggaaggagaaggggttacagaggaggcaaaaaagagtaaccatgttaagagaaagattgagaagagacaggaagaacgtaagcttgatgcccatgttgaagaacagtttgggtctgggaggctgtatgcttgcatttcttctcgacctggtcaatgtggcagagccgatggatacattttggaagggaaggagctggaattctacatgaagaagcttcaaagaaagaagggcaaaggtgctgctgcttaataagtttctttaagtctttgagtctttttagtatgtgttggaatggaatcctatgttttgttctatttacctagccagaccaagttaatcggttttagttgcatgttctgtttacaatgttgatttgtggatttgtcttgttattggttgctagatgatctttgatgtcttttgcttggtacg

SEQ ID NO: 6954 - DNA, 966 bp, Cenchrus ciliaris
gggagatggagcaccagcgaggggaccaagccaccgccgccaccatgggtatctcgcgtgattcgatgcacaagcgccgggccaccggtgggaagcagaaggcgtggcgtaagaagcgaaagtatgagcttggccgccagccagctaacaccaagttgtcaagcaacaagacggtgaggagggtccgcgtccgcggaggtaatgtgaagtgagggccctccgcctggatactggtaactactcttggggaagtgaggctgttacccgcaagacccgtatcctggacgtggtctacaatgcttcaaacaatgagcttgtgaggacacagaccctcgtgaagagcgccattgtgcaagttgatgctgccccattcaaacagtggtacctcacgcactatggagtggacattggtaggaagaagaaggcacctgctgccaagaaggatggtgctgagggacaagaggttgaggctgctgctgatgaaaccaagaagagtaaccatgtcaagaggaagcttgagaagcgtaaggacgaacgcaaacttgacctgcacattgaggagcaatttggcagtggaaggctgttagcttgcattgcttcccgccctgggcagtgtggccgggctgacgggtacatccttgagggtaaagagcttgagttctacatgaagaagcttcagaagaagaagggcaagggtgcagcagcttagaggcattcttatgcatgtttggaaggggtgtcctattaaatatttactctggtctttttgttagttgtcaaacgggcagagcatctatgtcgtgtttgcagacctgatgaagacagtattttctaaaaacgaatcaactctagtgaagaactgagaattttcagctgttgtattcttctactgtttaggttatctgttttctatgtgctgcagcagtttctttgcttaccggggaaatggtagcacacgatatcttt

SEQ ID NO: 6955 - DNA, 811 bp, Centaurea maculosa
gggaagccagagagagtctggaggcggcataaaccctagaggaggagtaggaggaagaagaagaagaagaagaagaagaggatcgttcgccatctgcaaccatgggtatttctcgtgattccatgcacaagagacgtgcaactggaggcaagaagaaggcgtggaggaagaagcgaaagtatgagctcggaagacagcctgccaacacaaagatctccagcaacaagaccgttaggagggtgagggttcgtggtggtaacgtgaagtggcgtgcattgaggttggataccggtaacttctcgtggggtagtgaggccgtgacacgaaagacccgtatcttggatgttgtttacaatgcatcaaacaatgagttggtcaggactcagaccctggtgaagagtgccattgttcaggttgatgcagcaccatttaagcaatggtatcttcagcactatggtgttgacattggtcgcaagaagaaaggagctgctactgcccccaaaaaagagggagaggatgctgaaggtgcaaccgaggaggctaagaaaagtaatcatgttgtgaggaagttggaaaagcgacaagaggagcgcaaactggacgcacacgttgaagaacagttctctggtggtcgtctttatgcagcaatctcatcacgacctggccagtgtggtcgtgctgatggatacatattggaaggcaaagagcttgaattctacatgaagaagcttcaaaagagaaaggaaaaggtgctgcttaagtcttgttataggtttgtatcttcttttttgttatttaatttgaggaaggc

SEQ ID NO: 6956 - DNA, 987 bp, Panax ginseng
gccctatgaaactagggttttatgaggatataacaggaacactaattctcctctccaaatctcctgccgagtttggtccgtttccgctgctggtatttgggttctttcaccttctacaaccatgggtatttctcgtgattcgatgcacaagaggcgtgctactggaggcaagaagaaggcttggaggaagaagcgaaagtatgagcttggaagacaacctgcaaatacaaagttgtctagcaacaagacagttcggagggtaagggttcgtggtgggaatgtgaagtggcgtgccttgagattggatacagggaactactcttggggtagtgaagctgtgacccgtaagactcgaatcctggatgtggtctataatgcatcaaataatgaattggttaggacccagacattggtgaagagtgctattgttcaggttgatgcagcaccatttaagcaatggtatcttcagcactatggtgttgacattggtcgcaagaagaaatcctctgctgctgctgctgccaaaaaggagaggagggtgatgttcctatcgaggaggcgaagaagagtaaacatgtcctgagaaaaattgaaaagcgtcaagaggatcgtaagattgacgcacatattgaagagcaatttgggggtggccgtctattagctgcaatttcatcacgacctggccaatgtggccgtgctgatggatacatcttggagggcaaggagctggagttctacgtgaagaaactccagaggaagaaaggaaagggtgctgcagcttaaaatggagttgcaattcagaacatttgtgttttctattttactttttcagagatggaaccaaagaactattcagctctcatagttagctttgtttcttgtcatgtctgagtgttgaaggagaattttagcatcatctttaattttcaacagtggtagtattatcgacttaatttcagctttattattatatgcttggttttggca

SEQ ID NO: 6957 - DNA, 679 bp, Triphysaria pusilla
cgccgcatctgtttcttctctgcaaccatgggtatttctcgggattccatgcacaagaggcgtgcaactggaggaaagcagaagacatggagaaagaagcgaaagtatgggctcggaagacaaccagcaaacacaaagttgtcgagcaacaagactgtgcgcagggtgagagtccgtggaggtaatgtgaagtggcgtgcattgaggctggatactggtaacttttcatggggtagtgaagctgtgacccgaaagacccgtattctggatgtcgtttataatgcatccaacaatgagttggtcaggacccagactttggtgaagggtgctatcattcaagttgatgctgcacctttcaagcagtggtaccttcagcattatggagtgagattggtcgcaagaaaaagactgctgctgctgccaagaaggatggagaggagactgaggctgctgctgctgaagaggcaaagaagagcaaccatgtgaaaagaaaaattgagaagcgtcaggaggagcgtaaaatagatgcacacatcgaggaacagtttggcggtggtcgtctgttagctgctatctcctcccgcccaggccagtgtggccgtgctgacggttacattttggagggcaaggagttggagttttacatgaagaaacttcagaggaagaagggaaaaggtgc

SEQ ID NO: 6958 - DNA, 799 bp, Eschscholzia californica
cagcaggcaaagccctaatccaaatttctgaccaagacagagaaacttgaggggttcgatctgcaatcatgggtatttcacgagattctatgcacaagagacgtgccactggaggaaaaagaaggcttggaggaagaagcgaaagtacgagcttggaagacaaccagcaaacacgaagctatcgagcaacaagacagttcgaagggttagggttcgtggaggaaacgtgaaatggagagctcttagattagacactggaaattactcatggggaagtgaaactgtaactagaaagactcgtatacttgatgttgtctataatgcatcgaataacgagttggttcgaactcaaactctggtgaagagcgccattgttcaggttgatgctgcaccattcaagcaatggtatctccaacattacggtcttgatattggccgtaagaagaagaatacttctgctgctaagaaagatggagaggagggtgagactgcagttgaggaagcaaagaaaagcaaatcatgtagtgaggaaaattgaaaaagcgtcaacaagatcacaagcttgatccacatattgaagagcagtttagcggtggacgattgttggctgctatctcttcgcgccctggtcaatgtggtcgtgctgatgggtacattttggaaggtaaagaacttgagttctacatgaagaagttgcagaagaagaaaggcaaggctggtgctggagctgcttagtttgtctttcttttatatatttgataactctagatgctattattttaatcagattttgaggtta

SEQ ID NO: 6959 - DNA, 775 bp, Brassica napus
gcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaaccatgtgcagaggaagatcgagagccgtcaagaagggcgcactcttgattcccacattgaggaccagtttgcaagtggacggttgttggcatgcactctcctacgacggcccggaccaatggtggacgtgctgagtggatactatttcttaggaaggacaaagagtcttagtaattcctaccagaagaagtattcaagaagaaggaaggacgaagggtcgccgtacttaaactcgttgtctgtacttaaagtctttattttgtttttttcatagaaactattgttgttagttt

SEQ ID NO: 6960 - DNA, 902 bp, Cirsium arvense
cagtcgacttccagaggcagagaggacgcaggtggaagaaagccgcaagcatgggtatctctcgtgattcgatgcacaagagacgtgccactggaggaaagaagaaggcctggaggaagaagcgaaagtatgagctcggaagacagccagccaacactaaaatttccagcaacaagaccgttcgaagggtcagggttcgaggtggaaatgtgaagtggcgtgcgttgaggttggataccggtaacttctcttggggaagtgaggccgtcaccaggaagacccgtatcttggatgtggtttacaatgcatccaacaacgagttggtcaggacccagactctagtgaagagtgcaatcgttcaggttgatgctgcaccttttaaacaatggtatcttcaacactatggagttgacattggtcgcaagaagaaaccgtcagcaactgctacaaagaaagagggagaggaggcagaagctgctaccgaggaggcaaaaaagagcaaccatgtcgtgaggaaactggagaagcgtcaagaagagcgcaaacttgacggccatgttgaggagcaattttctggtggtcgtctttatgccgcaatttcttcacgccctggccagtgtggccgagctgatggatacatcttggagggaaaggagcttgagttctacatgaagaagctccagaagaagaaagggaagggtgctgcttagaagcattatgagtttgaatttatagatttttatttcctgtggaaggcatggaaccgaaattttgatgtgttttgtttgttaaaatgtgacttctatgaaatctttaagggattttaatgtaagctttaccctactttcatcaatactagtgttactgattcattttcaaaaaagaaaaaagtaccgactgcg

SEQ ID NO: 6961 - DNA, 1206 bp, Solanum melongena
cacccaatctttgaagctagggtttttagttatcctccatcactacgaggagaccagagtgaagaagtgaggtctgctcaagctctcagtaaccatgggtatctcaagagattctatgcacaagagacgtgcaactggtggaaagaagaaagcttggaggaagaagcgaaagtacgagcttggacgccagccagctaataccaagatctcaagtaacaagacagtcaggcgaattcgtgtgcgtggtggcaatgtgaagtggagggcactgagattggatacaggaaactattcttggggtagtgaggcagtcacacgcaagactcgtatccttgatgtggtttacaatgcctcgaacaatgaacttgtccgcacacaaacacttgtcaaaagtgcaatcgttcaagttgatgctgcaccatttaaacagtggtaccttcagcactatggtgttgacattggtaggaaaaagaaaggggcctctaagaaggaatctacaactgaggagggagaagctaccgaggaagctaagaagagcaaccacgtagtccggaaaattgagaaacgtcagaaggatcgtacacttgatagtcatctcgaagagcaatttggctctggcaggctatatgcctgcatctcatcccgtcctggtcaatgtggtcgagctgatgggtacattttggaagggaaagagttagaattctacatgaagaaacttcaaaagaagaaaggcaaggcatctggtgctgctgcttaagttgtgctttgtgctaaattgctcgcactcttcaccttcaatgccgcacccatgttggattctccgaaaatacactagtaccggagaattcggcatgcactcgctaacacttttgaagagtttgaacaacataggcaggctttgggagtgtccaaacttttttttttccttcctttttgtcaatcgagcttcaattttgagtgtgtatgttttttgcatttctttttgtcaagcgtgtatgttgtttttttcaactgtatcatgcccaaaagtatggtagggaataaattacaattttattgaatttatttagttgaaatattagaatgattagtttatgtggcttgtagaatggatctcaatgatagttatcattgatcatgctttagtgttaaatcataatataatatctactttatagtttatatacctaaggataatgtgtaagc

SEQ ID NO: 6962 - DNA, 807 bp, Flaveria ramosissima
atctctcgtgattcgatgcacaagagacgtgccactggtggcaagaagaaggcctggagaaagaagcgaaagtatgagcttggtcgtcaaccggcaaacactaaaatatccagcaacaagactgtcagaagggtcagagtccgaggtggtaatgtgaaatggcgtgcgttacgattagatacaggtaactactcttggggaagtgaggctgtgacccgcaagacccgtattttggatgtggtttacaatgcatcaaacaatgagttggtcagaactcaaaccctagtgaagagtgctattgttcaagttgatgctgcaccgtttaaacaatggtatctgcaacattatggtgttgatattggtcgcaagaagaaaggggcatcagctgctaccaagaaagagggagaggaagcagaaaccactactgaggaggcaaagaagagcaatcatgtggtgagaaagttagagaaacgccaagaggatcgtaaacttgaccctcatgttgaagagcagttttcaagcggtcgtctattggctgcaatttcatctcgtcccggtcaatgtggtcgtgctgacggatacattttggagggtaaggagcttgagttctacatgaagaagcttcagaagaagaaaggaaagggtgctgcttaaactttttaggtttattcagtttcaatcttttgattttatttccttttttactctgcaagttttgatgtgctttgtttgttaaaatgttacaactcttatgaatgctgcttgaggattattgttaaacttttattcttttatctaatactagtt

SEQ ID NO: 6963 - DNA, 920 bp, Papaver somniferum
cctactctgaagtttatcaggcaacgcagtcgagaggtttctctttccatctgcaaacatgggtatctctcgtgattctatgcacaaaagacgtgcaactggaggaaaaaaaaaggcttggaggaagaagcgaaagtacgagcttggaagacagcccgcaaataccaaactttcgagcaacaaaactgttcgaagagttagggttcgtggaggaaatgtgaaatggagagctcttagactcgatacaggaaattactcatggggaagtgagactgtaaccaggaaatctcgtattcttgatgtcgtttacaacgcatctaataacgagttggttaggactcagactttggttaagggtgctattgttcaagttgatgctgctccatttaagcaatggtatcttcaacattatggtcttgatattggacgtaagaagaaaattacctctgccaagaaagaaggagaggaggctgaggctgtagctgaggaagcaaagaagagcaaccatctcttgaggaaaattgagagtcgtcaacaagatcacaagcttgactcacatattgaagagcaattcagtggtggacgattattggcttgtatctcatctcgccctgggcagtgtggtcgtgctgatggatatattctggaaggcaaagagcttgagttctaccagaagaagctccagaagaagaagggcaaaggagctgcttagaggctgtctagctacttgtcatcctttttagctcttttcttcttcttaaatttatacatttggactattagtatgaagtgttctaatctagattgaagttttgtttctttaagccagtttttgtaatgtctttgatcgaacaaatgtcagtttaaacatcaaatttgctaagtcggatatcatctcagttttctgcaaaaaaaaaaaa

SEQ ID NO: 6964 - DNA, 876 bp, Carthamus tinctorius
cggggtttgccaaccttagtttatttcgggagccagagtccggaggcggcataaaccctagagcaggaggaaggaggaaggaggaggaatcgctcgccatctgcaaccatgggtatttctcgtgattccatgcacaagagacgtgcaactggaggcaagaagaaggcgtggaggaagaagcgaaagtatgagctcggaagacagcctgccaacacaaagatctccagcaacaagactgttaggagggttcgggttcgtggtggtaatgtgaagtggcgtgcattgaggttggataccggtaacttctcatgggggagtgaggccgtgacacgaaagacccgtatcttggatgtggtttacaatgcatccaacaatgagttggtcaggacccagaccctggtgaagagtgccatcgttcaggttgatgcagcaccatttaagcaatggtatcttcagcactatggtgttgacattggtcgcaagaagaaaggagctgctactgtcgccaaaaaagagggagaggaagctgaaggtgcaaccgaggaggctaagaaaagtaatcatgttgtgaggaagttggagaagcgacaagaggaacgcaaactggacgcacatgttgaagaacaattctctggtggtcgtctttatgcagcaatctcatcacgacctggtcagtgtggccgtgctgatggatacatattggaaggcaaagagcttgaattctacatgaagaagcttcaaaagaaaaaggggaaaggtgctgcttaaatcttgttatagatttgtattctctttttttatttatttattttgaggaaggcatgacttgggactttgtgttgagctttcttagtaacttcgactttaacgagtatg

SEQ ID NO: 6965 - DNA, 906 bp, Carthamus tinctorius
  misc_feature (780)..(780): n is a, c, g, or t
  misc_feature (785)..(785): n is a, c, g, or t
  misc_feature (815)..(815): n is a, c, g, or t
ttctctcaaccctagctttctctttctcagaggccgcaggtggaagaaggagcctttctgatctgcaaacatgggtatctctcgtgattcgatgcacaagagacgtgcaactggaggaaagaagaaggcgtggaggaagaagcgaaagtatgagctcggaagacagccagccaacactaaaatttccagcaacaagactgttcgaagggtcagggttcgaggtggaaatgtgaagtggcgtgcgttgaggttggataccggtaacttctcttggggaagtgaggccgtcaccaggaagacccgtatcctggatgtggtctacaatgcatcaaacaacgagttggtcaggacccagactctagtgaagagtgcaatcgttcaggttgatgctgcaccttttaaacaatggtatcttcaacactatggagttgacattggtcgcaagaagaaaccatcagcaactgctaccaagaaagagggagaggaggcagaggctgctaccgaggaggcaaagaaaagcaaccatgttgtgaggaaactggagaagcgtcaagaagagcgcaaacttgatgcccatgttgaggaacaattttctggtggtcgtctttatgcagcaatttcttcacgccctggccagtgtggccgagctgatggatacatcttggagggtaaggagcttgagttctacatgaagaagctccagaagaagaaaggaaagggtgctgcttagaagcattgtgtcgtatcgagtttgaatttatagatttttatttcctgtgnaaggnatggaaccgaaattttgatgtgttttcttngttaaaatgtgacttctatgaaatcttttaagggattaatgtaagctgctttaccctacttttatcaatactagtgttattgattcatttt

SEQ ID NO: 6966 - DNA, 876 bp, Centaurea maculosa
tttctgatctgcaaccatgggtatctctcgtgattcgatgcacaagagacgtgcaactggaggaaagaagaaggcgtggaggaagaagcgaaagtatgagctcggaagacagccagccaacactaaaatctccagcaacaagaccgttcgaagggtcagggttcgaggtggaaacgtgaagtggcgtgctttgaggttggataccggtaacttctcatggggaagtgaggccgtcaccaggaagacccgtatcctggacgtggtctacaatgcatccaacaacgagttggtcaggacccagactctagtgaagagtgcaatcgttcaggttgatgctgcacctttcaaacaatggtatcttcaacactatggagttgacatcggtcgcaagaagaaaccatcagccactgctacaaagaaagagggagaggaggcagaggctgctgccgaggaggcaaagaagagcaaccacgttgtgaggaaattggagaagcgtcaggaagagcgcaaacttgacgcccatgttgaggagcaattttctggtggtcgtctttatgccgcaatttcttcacgccctggccagtgtggacgagctgatggatacatcttggagggtaaggagcttgagttctacatgaagaagctccagaagaagaaagggaagggtgctgcttagaagcattatgtcgtatcgagtttgaatttatagatttttatttcctgtggaaggcatggaaccgaaattttgatgtgttttgtttgttaaaatgtgacttctatgaaaatcttttaagtaattttaatagtaagctgctttaccctactttcatcaatactagtgctattgattcaaaaaagaaaaaaataccgactgcg

SEQ ID NO: 6967 - DNA, 892 bp, Catharanthus roseus
gacctgagagcagacgcattagggcaaaatgggtatctcacgagactctatgcacaagaggcgtgccactggtggcaagaagaaggcttggaggaagaagcgaaagtatgagcttggtcgtcagccagcaaacacaaagctttccagcaacaaaacagtcaggagagtccgcgtccgaggaggcaatgtgaaatggagagccttgaggttggacacaggaaactactcatggggtagtgaggcagtgacacgtaagacccgtatccttgatgttgtctacaatgcctcaaacaacgagctggtgcgtacacaaactcttgtgaagagtgcaattgtccaagtggatgcagctccctttaagcagtggtacctccaacattatggtgttgacattggtaggaagaagaaggctgctgctgttaagaaggatgctactgaggagggagaagctacagttgaggaaaccaaaaagagcaaccatgttcaaagaaaacttgagaagcgacaacaaggacgtacacttgatgctcacatcgaagagcaatttggtgctggtcgacttcttgcttgcatctcttcccgccctggacagtgcggtagagcagatggttacatcctggagggcaaagagcttgagttctatatgaagaaactccagaggaagaaaggaaagggtgctggtgctgctgcttaaatccatttttctttatttgttgcagtctattagtagttctatttcatgcttccttttagccgagttgcctgaacattttcttggcagttgtaagcactgagaagttttgactattatacttttgcctagaattttacatttggaaagcccaagtttgacattaccttttgattaatgaattggcaacaatagttaatt

SEQ ID NO: 6968 - DNA, 962 bp, Solanum melongena
ccgctttccgcctttgagaacatctaaaccctaaggacctccgtcaccgactcaccggcgacaatgggtatctctcgtgattctatgcacaagagacgtgcaactggaggaaagaagaaggcttggaggaagaagagaaagtatgagcttggaagacagcctgcaaacacaaagctggtgccaaatgctaagaccgttagaagaattagagtccgaggaggtaatgtgaagtggcgtgctttgaggttggatactgggaattactcttggggcagcgaggctgttacaaggaagactcgtctgttggacgtggtgtataatgcctccaacaatgagttggttaggacacaaaccctggtgaagagtgcaattgttcaggtcgatgcagctccatttaaacagtggtatctccagcactatggagttgaaattggtcgcaagaagaagactgctgcttccaagaaggaaggagaggaggctgaggctgcacctgaggagaagaagagtaaccatgtccaaaggaagctggaaaagaggcaccaggatcgcaagattgacccacatgttgaggagcaatttgctagtgggcgtctattggctgcaatctcatcacgacctggccagtgtggtcgtgctgatggttacatcttggagggaaaggaacttgagttttacatgaagaagcttcagaagaagaaagggaagggtgccagtggtgctgcttagaattgcaggctccaatttttaaattagcagaacaaattagatttgttttcctccctatgcaacagccttctcttcattggaagggaatgattaacttcttgtatgagagttagattcaagtttgttttgcacatggttgactgggaattctgagaacctactttatgaaaaaaagagaattttgtggactgcaactgttttcttgatcagtgttaagatggattttggactgaagg

SEQ ID NO: 6969 - DNA, 1183 bp, Nicotiana tabacum
  misc_feature (942)..(942): n is a, c, g, or t
  misc_feature (947)..(947): n is a, c, g, or t
  misc_feature (958)..(959): n is a, c, g, or t
  misc_feature (963)..(963): n is a, c, g, or t
  misc_feature (984)..(985): n is a, c, g, or t
  misc_feature (991)..(991): n is a, c, g, or t
  misc_feature (993)..(993): n is a, c, g, or t
cgtattagagcataaccgtcggaaccctaggatccttcgtcgccggcaacaatgggtatctctcgggattcgatgcacaagagacgtgccactggaggcaagaagaaggcgtggaggaagaagagaaagtatgagcttggaagacagcctgcaaatacaaagctggtgactaatgctaagactgttaggaggataagggtccgaggaggcaatgtgaagtggcgtgctttgaggttggacactggaaacttctcttggggcagtgaggctgttactaggaagactcgtttattggatgtggtgtacaatgcctcaaacaatgagctggttaggacacaaactctagtgaagagtgcaattgttcaagttgatgcagctccatttaagcagtggtatctccagcactatggagttgatattggtcgcaagaagaagagtgctgccaagaaggaaggagaggaggctgagactgctcctgctgcagaggaaaaaaaaagtaaccatgtccagagaaagctgcaaaagcgtcaacaagatcgtaagattgacccacatgttgaagagcaatttgctagtggccgtctattggctgcaatctcgtcacgacctggccaatgtggccgtgccgatggttacatcttggagggtaaggaactggagttctacatgaagaaacttcagaaaaagaaagggaagggtgcaagtggcgctgcttaagagttataactgatttctgttatatcatccaaagcttcgaattatattgcctgtgttatttactattgatagaatggatattaagaaccaatttagctgctagagttagatcagcccatctctttgcaatgtgatgtcacataattttgaggacagaattcatcttactgttttcgtctaaggatgtcgtcaaggtagtcttatcattcagctttcaggttttanattgnttgaaattttnnatantatggttgcttgcgacagaanncttcananattaggtttttacactcttcataaggtgggtaaagttaaatccccgtgcagcgcacatgcattcatgagtttggcaatccaaagtgctatggagcttgaattgttgaagtgctgttgcatcataacatattataacaccaccaatttgagaaatgcaaattcggtaaattataatatatgacaattaaaa

SEQ ID NO: 6970 - DNA, 780 bp, Centaurea maculosa
gaagaggaggagccatcgtcatcatctgcaaccatgggtatatctcgtgattccatgcacaagagacgtgcgactggtggaaagaagaaggcatggagaaagaagcgaaagtatgagctgggaagacagccagccaacactaagatttctagcaacaagactgttcggagggtgagggtgcgaggtggtaatgtgaagtggcgtgcgttgaggttggatacaggtaacttctcgtgggggagtgaggctgtgacgcgaaaaacacgtatattggatgtggtttacaatgcatcgaataacgagttggtcaggacccagactttggtgaagagtgcaatcgttcaggtggatgctgcaccttttaagcaatggtatcttcagcactatggagttgacattggccgaaagaagaaaccaactgctgctgctgccgtaaaaaaggagggagaggaagccgaagtggctgctgaggagaccaagaagagcaaccatgttgtgaggaaattggagaagcgtcaagaggaacgtaagcttgatcaacatgttgaagagcaattctccggtggtcgtctttatgcagcaatttcatcacgccctggccagtgtggtcgtgctgacgggtacatattggagggtaaagaacttgagttctacatgaagaagcttcaaaagaagaaaggaaagagtggtggtgctgcttaaacactatcaagttttctttagattaagtatgcttctttttattgcactggaattttgtttgttttatgaatatgctaa

SEQ ID NO: 6971 - DNA, 811 bp, Centaurea maculosa
aaccatcgtcttctgcaaccatgggtatatctcgtgattccatgcacaagagacgtgcgactggtggaaagaagaaggcctggagaaagaagcgaaagtatgagttgggaagacagccagccaatactaagatttctagcaacaagactgttcggagggtgagggtgcgaggtggtaatgtgaagtggcgtgcgttgaggttggatacaggtaacttctcgtgggggagtgaggctgtgacgcgaaaaacacgtattttggatgtggtttacaatgcatcgaataatgagttggtcaggacccagactttggtgaagagtgcaatcgttcaggttgatgctgcacctttcaagcaatggtatcttcagcactatggagttgacataggccgaaagaagaaaccaactgctgctgctgccataaagaaggagggagaggaagctgaagtggctgctgaggagaccaagaagagcaaccatgttgtcaggaaattggagaagcgtcaagaggaacgtaagcttgatcaacatgttgaagaacaattctctggtggtcgtctttatgcagcaatttcatcacgccctggccaatgtggtcgtgctgacgggtacatattggagggtaaagaacttgagttctacatgaagaagcttcagaagaagaaggggaagagtggtggtgctgcttaaacactatgaagttttctttagattaattttgcttctttttattggtctggaattttgtttgttttatgaatatgctaaatggatcatgtaagcttttactcttaattcatccacatgctttc

SEQ ID NO: 6972 - DNA, 847 bp, Triphysaria pusilla
ccagcaatcatgggtatttctcgggattctatgcacaagaggcgttcaactggagggaagcagaagacgtggaggaagaagcgaaagtacgagctcggaagacaaccggcaaacacgaagctgtcgagcaacaagactgtgcgcagagtgagagttcgtggaggtaacgtgaagtggcgtgcattgaggttggataccggaaatttttcgtggggtagtgaagctgtgacccgaaaaacccgtattctagacgttgtttacaatgcgtccaacaacgagttggttaggacccagactttggttaagggtgccgtcattcaagtcgacgctgcacctttcaagcaatggtatcttcagcattacggggtcgaaatcggacgcaagaagaagactactgctgctgctgctaagaaggacggagaggaaaccgaggctgctgctgctgaagaggcgaagaagagcaaccatgtcaaaagaaaaatcgagaagcgtcaggaggagcgtaaaatagatgcgcatatcgaggaacaatttggcggtggccgtttgttagctgctatttcatcacgcccaggccagtgtggccgtgctgacggttacattttggagggcaaggagttggagttttacatgaagaaacttcagaggaagaagggaaagggtgctggtggtgtttaatttatgtcttcaaggacaaagcatatttttcgattcagtatttgttattttttctttatggcttgtacgaccagaacaatagtttggtattgaacgattttgatatgttactagtgcgacatcacatttacaattaattatccatcgtttgtctacaaaaaaaaaaaaa

SEQ ID NO: 6973 - DNA, 1054 bp, Amorphophallus konjac
cggccgggggccttccgacgccgcggcggcgcccttcttcctaagtcgctctcctctgagctcgctgtcggaccccaagcgctcgatccgtctcccccaagatgggtatctcccgggattccatgcacaagaggcgcgccaccggaggcaagaagaaggcctggaggaaaaagcgcaagtacgagctggggcgccagcctgccaacacaaagctttctagcaacaagacagtgaggagggtgcgagtgaggggagggaacgtcaagtggagggctttgagattggacactggtaactactcgtgggggagtgaggccgtcacccgcaagacgcgtattcttgatgtggtctacaatgcctccaacaatgagcttgtccgtacccagacacttgtgaaaagcgccatagtgcaggtcgatgcagccccgttcaagcagtggtacctccagcactatggtgtcgacattgggcgcaagaagaagcagcagccatcggcagcgtctgccaagaaggaaggcgaggagggtgacggggctgcagaggatacaaagaaaagcaaccacgttgtgaggaagatagagaagcgccagcagggtcgcaaactcgaaccacatattgaggaacagtttggtagtggcaggttgttggctgcaatttcatccaggcccgggcagtgtggacgtggtgatggctatatcttggagggaaaagagttggaattttacatgaagaagattcagaggaagaaagggaagggcgctggtgctgcctaaaaaaaaacacttttcccccaggaaacatgcaagtttctttcgatatatgtcggctctggtagatagaagttgagatcttgctcccattttcatggttttgttaaaactgcggatgatcaagctgctttcccaccaaacaccgggtatggacttggatgttttttttaattaaactacatgacattatttttatttaaattatttggtatgtattccaagtgaaatttaggatatggttctagttaagctgtcataatgcacaactccacttattttagtta

SEQ ID NO: 6974 - DNA, 857 bp, Arabidopsis thaliana
gccatttgttaaacctctaaagctcgtgagaaccaaaagcttgaatcaaacgcttttgaaatcatgggtatctctcgtgattcaattcacaagagacgtgccactggtggtaagcaaaaaatgtggaggaagaagcgaaagtatgagcttggaagacaaccagctaacactaagctgtcaagtaacaagacggtgaggaggatccgtgtgcgtggtgggaatgtaaagtggcgagctttgaggctcgatactggaaacttctcgtggggaagtgaagctgtgacccgcaagactaggatcttggatgtggcgtacaatgcatcaaacaatgagcttgttcgtacacaaactcttgtgaagagtgctattgttcaagttgatgctgctccattcaagcaagggtatctccaacactatggagttgatattggtcgcaagaagaaaggagaggccgttaccactgaggaagtgaagaagagcaatcatgttcaaaggaagctggagatgcgacaagaaggcagagcacttgactcgcaccttgaagagcagtttagcagtggaaggttacttgcatgtatcgcatcaagacccggacaatgtggtcgtgctgatgggtacatattagaaggtaaagagctcgaattctacatgaagaaacttcaaaagaagaagggcaagaatgctggtgctgcataagatacaaaactttcgattgggattttacttacgtttttgatcttgaaaatttgaaaagctttattcattcttttgttgagttagagtttgcattgagagatcttcatgtttatggattttgatcatttatagtcaaaatttctcaatttccattcaataaa

SEQ ID NO: 6975 - DNA, 1200 bp, Musa acuminata
gtttgggctgctgagaagatctctgaaaccgaggagtgcggcggcggacttcgggagagaagaagagggcgcagtgtttctcaccaccgccggccaacatgggtatctcgcgagactccatgcacaagaggcgggccaccggagggaagaagaaggcgtggcggaagaagagaaagtacgagttgggaagacagcctgccagtacgaagctttcgagcaacaagaccgtgaggaggattcgagttcgaggaggcaacgtgaagtggagggccctccgattggatcatggcaattactcatgggggagcgaggcagtgactcgcaaaacccgtatccttgatgtggtctacaatgcttcaaacaacgaacttgtgaggacacagacccttgtgaagagtgccattattcaggttgatgctgccccattcaagcagtggtaccttcagcactatggtgttgagattggtaggaagaagaaagccccttctgctaagaaggaagcaacagaggagggtgaagctgccacagaggaagaaaagaaaagtaaccatgtaaccaggaagctggagaagcgtcagcagggtcgaaaactggacccccacattgaggagcagtttggtagtggaagattgttggcttctatctcttcccgccctggtcagtgtggcagagcagatggatacatattggaaggaaaagagctggaattctacatgaagaagatccagaggaagaagggcaaaggtgcaggagcagcagcttaagtgacctcaatcatttccttttatcagttggtttgcatcagcttaatgaatcttggtggtttcttcttgaagtcaacgcttgactaatgttttgctcatttaagatatcggacagctttgtttgtaggctacaagatatttgaacattttgcattatgttatgtccccaaatggtcaatttttctacctagatctatcattaaataagaaattccttgattaaaacagtcaatgtgtgaagagcattaggtagctatgcttgatacttttttctcttttctcctagcttcgatgaacttgttgtaggcacatataaattctagtctggtggaatctctaaatcatatctcctgtggttgaagttacaatcattctatttcttgctcaaaaagaaggaaagaaggcaataataaaccattttaagaataagattttg

SEQ ID NO: 6976 - DNA, 1161 bp, Ricinus communis
aatagaagtataaatgctcgattcagctagggtttattagggagaggaggcgagggatatactgagaacggaggagtagccaccgccgctaagccaaaaatgggtatttcaagggactccatgcacaaaaggcgtgccactggtggcaaaaagaaagcctggagaaagaagagaaagtatgagcttggtcgtcaggctgcaaataccaagctttcaagcaataagactgtgaggaggattcgtgttagaggaggaaatgtgaagtggagagctttgagattggacacgggaaattattcttggggtagtgaggctgtcactcgcaagactcgtattcttgatgtggtttacaatgcctctaataatgagcttgttaggacacaaactctggttaagagtgctattgttcaggttgatgcagctccatttaagcaatggtatcttcagcactatggtgttgatattggcaggaagaagaagactgtagcaaagaaggaaactgaggaaggggaaggggaaggtgctgctgcagaggaatctaagaagagcaaccatgtgattaggaagcttgagaagcgccaaaaggatcgtaagcttgatgcccacattgaagagcagttttggggtggtagattactggcctgcatctcatcccgtcctggtcaatgtggcagagctgacgggtacatattggagggtaaggaacttgagttctatatgaagaagctccaaaggaagaagggcaagggtgctggagctgcataaatattagacttgtcaagtttttggtgtctactgttttgtttaatttacttttggttccttgagttttagaatctgttgagatacattattggttgctattaaagaaacgatcctcattccgcacgagggccatctcttaatttttttttttcttttgcagtttttaatatgtatggcgcggcaaggttttttctttcaatgtgctttctcaagaaattgacttgtttggttatttgaggttaatagttaatctagtcttatttgatgatttaaatactgaagaaatagagtattttcaatatattctttatatgccacaaactgtattataaatagttattctatttgtttttattttaataaatgtattataatttctcatgtatttaattaatt

SEQ ID NO: 6977 - DNA, 918 bp, Centaurea maculosa
  misc_feature (387)..(387): n is a, c, g, or t
  misc_feature (438)..(438): n is a, c, g, or t
  misc_feature (571)..(571): n is a, c, g, or t
  misc_feature (642)..(642): n is a, c, g, or t
  misc_feature (699)..(699): n is a, c, g, or t
  misc_feature (883)..(883): n is a, c, g, or t
gcgggggacgttattgtaacataacaaacataatgggcttcaatgtaaatgagagaacaccggttcacttattaagttctcactccgccaaaccctagttttcttccgtcatcggagccgccataaaccctagaagaggaggagccatcgtcatcatcgtcatctgcaaccatgggtatatctcgtgattccatgcacaagagacgtgcgactggtggaaagaagaaggcatggagaaagaagcgaaagtatgagttgggaagacagccagccaacactaagatttctagcaacaagactgttcggagggtgagggtgcgaggtggtaatgtgaagtggcgtgcgttgaggttggatacaggtaacttctcgtgggggagtgaggcngtgacgcgaaaaacacgtatattggatgtggtttacaatgcatcgaataangagttggtcaggacccagactttggtgaagagtgcaatcgttcaggttgatgctgcaccttttaagcaatggtatcttcagcactatggagttgacattggccgaaagaagaaaccaactgctgctgctgccntaaaaaaggagggagaggaagctgaagtggctgctgaggagaccaagaagagcaaccatgttgtgaggaanttggagaagcgtcaagaggaacgtaagcttgatcaacatgttgaagagcaattctcnggtggtcgtctttatgcagcaatttcatcacgccctggccagtgtggtcgtgctgacgggtacatattggagggtaaagaacttgagttctacatgaagaagcttcaaaagaagaaaggaaagagtggtggtgctgcttaaacactatcaagttttctttagattaagtatgcttctttttatngcactggaattttgtttgttttatgaatatgctaa

SEQ ID NO: 6978 - DNA, 868 bp, Cichorium intybus
cctagttccctttcaccatctggggaggccgagctcggaggcacatcttaaaccctagaggaggagcctccgtcatctgcaaatatgggtatctctcgtgattccatgcacaagagacgtgccactggtggcaagaagaaggcctggagaaagaagcgaaagtatgagctcggaaggcagcctgccaacaccaagatctccagcaacaaaaccgttcgtagggttcgagttcgaggtggtaacgtgaagtggcgcgccttgaggttggacacaggtaactactcatggggtagcgaggctgtgacccgaaagacgcgtatcttagatgtggtttacaatgcatccaacaacgagctggtcagaacccaaactttagtgaaaagcgcaatcgttcaggttgatgctgcacctttcaagcaatggtatcttcaacactacggagttgacataggccgtaagaagaaagcagccaaaaaagaaggagaggaagctgaaggtgctaccgaagagaccaagaagagcaaccatgttgtgaggaaaattgaaaagagacaagaagaacgcaaacttgatcaacatgttgaagagcagttttccagtggccgtcttttggcggcaatctcatcacgtcctggacagtgtggccgtgctgacgggtacatattggagggaaaagaacttgagttttacatgaagaaacttcagaagaagaaaggaaagagtgctggtactgcttaaacaatgtcagattatatcaatttctcttttttttttcttttcaaatttaaatgcattggacggaaattttgtttgttagttttgactttatgaatgctgaatggattctttaatgggtaaattgtttgac

SEQ ID NO: 6979 - DNA, 833 bp, Cirsium arvense
cgggggtcgatcggaggcgcgccataaacctagaggaagaggaggaaccatcgtcttctgcaaccatgggtatatctcgtgattccatgcacaagagacgtgcgactggtggaaagaagaaggcatggagaaagaagcgaaagtatgagttgggaagacagccagccaacactaagatttctagcaacaagactgttcggagggtgagggtgcgaggtggtaatgtgaagtggcgtgcgttgaggttggatacaggtaacttctcgtgggggagtgaggctgtgacgcgaaaaacacgtattttggatgtggtttacaatgcatcgaataatgagttggtcaggacccagactttggtgaagagtgcaatcgttcaggttgatgctgcacctttcaagcaatggtatcttcagcactatggagttgacattggccgaaagaagaaaccaactgctgctgctgccataaagaaggagggagaggaagctgaagtggctgctgaggagaccaagaagagcaaccatgttgtgaggaaattggagaagcgtcaagaggaacgtaagcttgatcaacatgttgaagaacaattctctggtggtcgtctttatgcagcaatttcatcacgccctggccaatgtggtcgtgctgacgggtacatattggagggtaaagaacttgagttctacatgaagaagcttcagaagaagaaggggaagagtggtggtgctgcttaaacactatgaagttttctttagattaattatgcttctttttattggtctggaattttgtttgtttatgaatatgctaaatggatcatgtaagtcttttac

SEQ ID NO: 6980 - DNA, 951 bp, Coffea canephora
agagcggagaggactttgcaggaagactcgttagagtaaaatctctcatttcttcaaggcagctgctctaatccaacatgggtatctcgcgggactctatgcacaagaggcgtgccactggtggcaagaaaaaagcttggaggaagaagcgcaagtatgagcttggtcgccagccagcaaacactaagctctcaagcaacaagacagtcaggagagtccgtgtccgtggaggcaatgtgaagtggagggccttgaggttggacacaggaaactattcttggggtagtgaggctgtcactcggaagacccgtattcttgatgtgatgtacaatgcctcaaacaatgagcttgtcaggacgcaaactctcgtgaagagtgcaattgttcaggttgatgcagccccctttaagcagtggtaccttcagcattatggtgttgacattggtaggaagaagaaggggcctgctaagaaggataccactgaggatggagaggctactgctgaggaaactaagaagagcaaccatgttgtcaggaaacttgagaagcgccagcaaggccgcacacttgatcctcacattgaggagcaatttgggggtggtagattgctggcctgcatatcttctcgcccaggtcaatgtggcagagcagatggttacatcttggagggtaaagagctcgagttctatatgaagaaaattcagaggaagaaaggcaaggcttctggtggtgctgcttaatcagaattctatgttcttttcttgggggtcttatcatagaattttaggtttttatgcttccttaagcttttgtcacctgtactttagcggcacaggaaaggttgctggaacattttcagctacttaattgctaaaattttgagtcttttcttctccctttatgaattaattatatggtcgttgttagacatttcagagtactagtctttga

SEQ ID NO: 6981 - DNA, 1156 bp, Taraxacum officinale
cggcggggacggggcatatagcgggaggagccgcctgagaaagccgaggtcagacgccggttatcttcaaccgccgccaacatgggtatctcacgagattcaatgcacaagaggcgcgccaccggagggaagcagaagacctggaggaagaagcgaaagtacgagcttggtcgtcagccagctaacacgaagatctcaagcaacaagacagtaaggagagttcgagttcgaggaggcaacgtgaagtggagagccctaagactcgacaccggaaattactcatggggaagtgaagcagtcactcgcaaaactcgtatcctcgatgtggtctacaacgcttcaaacaacgagcttgtgagaacacagacactcgtcaaaagtgctattgttcaagttgatgccgctccattcaagcaatggtaccttcaacattatggagttgacatcggcaggaagaagaaagctgctgcaactacaaagaaggacacagaggaaggagaaggtactacagaggaagcaaaaaagagcaaccatgtccagagaaagatagagaaacgtcaagaagaacgtaagcttgatgcccatgttgaagaacagtttagttctggtaggttgtatgcttgcatttcttcacgaccaggtcaatgtggcagagctgatggatacatattggaaggaaaggagcttgagttttatgtgaagaagcttcaaaggaagaaggggaaaagtgccggtgctgctttttaagagttttgagcccttctttcagtatgttagaatcgtttgggttgttttacttatgtagctagaccaatttaatcatggttttagttgactgttttgtgtgatcatggcataaagtttatataagatgttttgtggttttattatgtcaattcttcatctttagattcttaacaaacaagaagaacaaacaaaatcccagacattaagtgatgctgttttggacggaatcaactttgacatcaaaaatggggtcaggccaaatctggaaatgctttggcggccgccttggccgcgcacatcttgaaacaaaaagattttttgtctgcggccccaatttgccctatggagaggcccatctttataagggtctccccacaccaaaattcggggaccccaggctacaattctg

SEQ ID NO: 6982 - DNA, 817 bp, Gerbera hybrid cultivar
gcgcggcataaaccttagaggaggatcgtcgttcatctgcaaacatgggtatctctcgtgattcgatgcacaagagacgtgccactggtggcaagcaaaaggcatggagaaagaagcgaaagtatgagctcgggagacagcctgccaacaccaagatttcaagcaacaaaactgttcggagggtgagggttcgaggtggtaatgtgaagtggcgtgccttgaggttagatacagggaactactcatggggaagtgaggctgtgacacgaaagactcgtatcttggatgttgtttacaatgcatccaacaatgagttggtcaggacccaaacacttgtgaaaagtgcaatcgttcaggtagatgctgcaccctttaagcaatggtatcttcagcactatggagttgatattggtcgcaagaaaaaagcagttgctgcggctaaaaaagagggagaggaagtagaaggtgctactgaggaggcaaagaagagcaatcatgttgcgaggaaactgcagaagcgtcaagaggatcgcaaacttgacccacatgtcgaagaacagttctccagtggacgtcttttagcagcaatctcatcacgtcctggccaatgtggtcgtgctgacgggtacatattggaggggaaagagcttgagttctacatgaagaagcttcagaagaagaaaggaaagagtgctggtactgcttaaagaatttttattttattttaaggcatgactggatttttgttgaggttttatagctaggtttgattttgatgaacgacgaagggataatgcaaggtttactattattatta

SEQ ID NO: 6983 - DNA, 946 bp, Ipomoea nil
aggattgtgacagaaagagagtgagagagagagagagagagagagtgagtgagtgagtgaagctgaagagaatctctatagcaccaacgcagctatgggtatctcaagagattcgatgcacaagaggcgagccactggtggcaagaagaaggcatggaggaagaagagaaagtatgagcttgggcgtcagccagcaaatactaaactctcgagcaacaagactgttaggagagttcgagttaggggaggcaatgtgaagtggagagcactcaggctggatacaggaaactactcatggggcagtgaagctgttacccggaagacacgtattcttgatgtggtatataatgcctcaaacaatgaacttgtgaggacccaaactctggtgaaaagtgccattgttcaggtggatgctgctccattcaaacaatggtaccttcagcactatggtgttgatattggtaggaagaagaagtcggctgctgctaagaaggaaacgaatgaggaaggtgaaggcgcaactgcacctgaggaaaccaagaagagtaaccatgtggtaaggaagattgaaaaacgtcagaaagatcgcaagcttgattcccaccttgaagagcagtttgggtcgggcagattgatggcatgcattgcatcacgaccaggccagtgtggcagggctgatgggtatatcttggaaggaaaggaactggaattctacatgaagaagattcagaggaagaagggaaaaggttctggtgcaactgcctaatcatcatctgatcttataagatcctttgaagtcaatctagttttctattttgttgctcacctcccttgtgtaccaacattgacacttggttccttgtgctggatactatgtagttttggacaagttttgtatgcacttcgttttattggtcttctgaactggtttgttttaaaaaaaaaa

SEQ ID NO: 6984 - DNA, 909 bp, Elaeis guineensis
gggtagcaggcggcggcgaagttccaagcgcggaagagagagaggagaaagagaggtcttcctcgcctccgccaagatgggtatttcccgagactctatgcataagaggcgcgcaacgggagggaagaagaaggcctggaggaagaagagaaagtatgagttgggccggcagccggcaaatacaaagctttcgagcaacaagactgtcagaagggttcgtgttcgtggaggaaatgtgaagtggagggcccttcgtttggatactggcaattactcttgggggagtgaagctgtgacccgaaagactcgtatccttgatgtcgtgtacaatgcctccaataatgagcttgtgaggacacagaccctggtgaaaagtgccattatccaggttgatgctgcccccttcaagcaatggtacctccagcactatggtgttgagattggtaggaagaagaaggccccagctgctaccaagaaggaagcaacagaggggcaggagggcgaaggtgctaccgaagaaccaaagaagagcaaccacgtccttaggaagctggagaagcgtcagcagggtcgtaaacttgacccccacattgaggagcaatttggtagcgggagattgttagcttgtatctcatcccgccccggccagtgtggcagagctgacggatacatattggaagggaaggagctggagttctacatgaaaaagatccaaaggaagaagggcaagggtggtgccggagctgcttgagtggacttttgtttagttgtttggttcttcagttttattttgtttgaatttatgtagactgagaacaagtaatgggtcatttgaaatgttgacatgcatttgagctctgttagagatgagaacgatatactgttgctatattaatcattatatttccc

SEQ ID NO: 6985 - DNA, 867 bp, Carthamus tinctorius
cttggcggggccgtatcggaggcgcgccataaaccctagaggaggaaccatcgtcgtctgcaaccatgggtatatctcgtgattccatgcacaagagacgtgcgaccggtggaaagaagaaggcctggagaaagaagcgaaagtatgagctgggaagacagccagccaacactaagatttctagcaacaagactgttcggagggtgagggtgcgaggtggtaatgtgaagtggcgtgcgttgaggttggataccggtaacttctcgtgggggagtgaggctgtgacgcgaaagacacgtatattggatgtggtttacaatgcatcgaataatgagttggtgaggacccagactttagtgaagagtgcaattgttcaggttgatgctgcaccttttaagcaatggtatcttcagcactatggagttgacataggccgaaagaagaaaccaactgctgctgctgcgataaaaaaggagggagaggaagctgaagtggctgctgaggaggccaagaagagcaaccatgttgtgaggaaattggagaagcgtcaagaggaacgtaagcttgatcaacacgttgaagagcaattctctggtggtcgtctttatgcagcaatttcatcacgccctggccagtgtggtcgtgctgacgggtacatattggagggtaaagaacttgagttctacatgaagaagcttcagaagaagaaaggaaagagtggtggtgctgcttaaacactatcaagttttctttagattaattatgcttctttttattggactggaattttgtttgttttatgaatatgcaaaatggatcatgtaagcctttactcttaattcatccacatgctttcagttaaaaaaa

SEQ ID NO: 6986 - DNA, 836 bp, Helianthus annuus
  misc_feature (792)..(792): n is a, c, g, or t
gcgggggacggggcatatagcgggaggagccgcttgagaaagccgaggtcagacgccggttatcttcaaccgccgccaacatgggtatctcacgagattcaatgcacaagaggcgcgccaccggagggaagcagaagacctggaggaagaagcgaaagtacgagcttggtcgtcagccagctaacacgaagatctcaagcaacaagacagtaaggagagttcgagttcgaggaggcaacgtgaagtggagagccctaagactcgacaccggaaattactcatggggaagtgaagcagtcactcgcaaaactcgtatcctcgatgtggtgtacaacgcttcaaacaacgagcttgtgagaacacagacactcgtcaaaagtgctattgttcaagttgatgccgctccattcaagcaatggtaccttcaacattatggagttgacatcggcaggaagaagaaagctgctgcaactacaaagaaggacacagaggaaggagaaggtactacagaggaagcaaaaaagagcaaccatgtccagagaaagatagagaaacgtcaagaagaacgtaagcttgatgcccatgttgaagaacagttcagttctggtaggttgtatgcttgcatttcttcacgaccaggtcaatgtggcagagctgatggatacatattggaaggaaaggagcttgagttttatgtgaagaagcttcaaaggaagaaggggaaaagtgccggtgctgctttttaagagttttgagctcttcttttcagtatgttagaatcgtttgggttgntttacttatgtagctagaccaatttaatcatggttttagtttac

SEQ ID NO: 6987 - DNA, 1055 bp, Citrullus lanatus
taaacctaaccctcgccgcatcaaaacccctctcagtccccttgcaatctctctcccgacttccctcgatcgttcaaggaaccctagacttgactacacgccaagagctcttgtctcaccaagatgggaatctctcgtgattctatgcacaagaggcgtgccactggtggcaagaagaaggcttggaggaagaagcgaaagtatgagcttggaaggcaacctgccaacaccaagttatccagtgacaagtcaatcaggaggattcgagttcgtggtggtaatgtgaagtggcgtgcttttaggctggatactggaaattactcttggggtagtgaggctgtgactagaaagacccgtattcttgatgtggtctacaatgcatctaacaatgagcttgttcgtactcaaactttggtgaagagtgccatagttcaagttgatgcagcgccatttaaacagtggtatcttcaacattatggagtggatattggaaggaagaagaagacctcagcatctgctaagaaggaagaggaaggtgatgctgccactgaggaggtaaagaaaagtaaccacgtccagcgcaaaattgagaaacgtcagcaggaccgcaagcttgacccgcatattgaagaacaattcagcagcggtcgtttgatggcttgtatctcatcaaggccgggtcaatgtggccgagcagatgggtatatcttggagggcaaagagcttgaattctatatgaagaaactccaaagaaagaagggaaaaggagcgggcgctgcataaattttgttatcgagatgttttcggccattgtttcttgttcacttttcttcttatgaagacgacgagctctgttgcagctattttggaatttcgattttgctggtaatagttgtttaattatagtacgtttgaccttttaatgaataacattttgtttattagctcgagttcaagttcaattttttcttagtttatttatgtaagcgggttggtttggtgtttgatgttgaatttacagaagtaaaagtggattagaggcctaagctctcact

SEQ ID NO: 6988 - DNA, 994 bp, Festuca arundinacea
ttacggccgggggctcttccttcctgcgagaccaaaccaaagctgcggcggcgcgggcgtagaaggcggagcagccaccgacgccaccatgggtatctcccgtgactccatgcacaagcgccgggccaccggtgggaagatgaaggcgtggaggaagaagcgaaagtatgagctcggccgccagccagctaacactaagctgtccagcaacaagactgtgaggagggtccgtgtccgtggaggtaatgtgaagtggagggctctgcgcctggatactggcaacttctcatggggaagtgaggctgtcacccgcaagacccgtctcctggatgtggtttacaacgcgtcaaacaacgagctggtgcgcacccagactcttgtgaagaacgccattgtccaagttgatgctgctcccttcaaggggtggtatctgacacactatggagtggacattggtcgcaagaagaagaccactgctgctgcaaagaaggacgcagctgagggacaagagggtgaggtagctgcagctgccacagaggaggctaagaagagtaacaatgtccagcggaagctggagaagcgtcagcagggacgcactctggatgcccacattgaagagcagttcagcggtggaaggctgctggcctgcatctcttcccgccctggtcagtgtggcagggctgatgggtacatcctggagggcaaagagctggagttctacatgaggaagctccagaagaagaagggcaagggtgcctcagcttagatcactcctatgtgctttatggcaggctgcatgtttcattcctggttttgttagttgtctcgtccatgttgtcttcagacatgctgaactctattttatgcaagtgaatcgactctagcttggaacgactgagtatattttgccttcttccatatccataatattgtcaatctgttccaaaaaaaaaaaaaaaaaaaaaaaaaaaaaaaaagcttgtacacctgcccg

SEQ ID NO: 6989 - DNA, 961 bp, Panax ginseng
caagtcattttggcgacagaggaggcagccaccatctgtaaccatgggtatttctcgggattcgatgcacaagaggcgtgccactggaggcaagaagaaggcttggaggaagaagcgaaagtacgagctaggaagacaaccagcaagcacaaagttgtcaagcaacaagacagttaggagggtaagggttcgaggtgggaatgttaagtggcgtgcgttgaggttggatacagggaactactcttggggtagtgaggctgtgactcggaagactagaattttggatgtggtttataatgcatcaaataatgagttagttaggacccaaactttggtgaagagtgcaattgttcaggttgatgcagcaccatttaagcaatggtatcttcaacactatggtgtggacattggtcgcaagaagaaaacttctgcttctgctaagaaagaaggagaggatgctgacactcctaccgaggaggcaaagaagagcaaccatgtccttagaaaaattgagaagcgtcaagaagatcgcaagattgatgcacatatcgaagagcaatttggaggtggccgtctcttagctgcaatctcatcacgacctggccaatgtggtcgtgctgatggatacattttggagggcaaggagctggagttctacatgaagaaactccagagaaagaaaggaaagggtgccacagcttaaatatttttgaccttgatggagttttttaaatttagaattttattctctttgtgatgacatgaaactaaagagagattgagctcttacacttggctatgttttgtcaagtcttgatgtcagtaaatcaaatgcatgttaaaccctgtaaaacctgtagcattttgaaaattttaaaattcattattgattgcataaagaaacaaatactcaaattggtgatgcactggtatatttgaaattgaaaaaatgatttgatat

SEQ ID NO: 6990 - DNA, 1179 bp, Lolium multiflorum
cctgcgagaccaaaccaaagctgcggcggcgcgggcgtagaaggcggagcagccaccgacgccaccatgggtatctcccgtgactccatgcacaagcgccgggccaccggtgggaagatgaaggcgtggaggaagaagcgaaagtatgagctcggccgccagccagctaacactaagctgtccagcaacaagactgtgaggagggtccgtgtccgtggaggtaatgtgaagtggagggcactccgtctggatactggtaacttctcatggggaagtgaggctgtcacccgcaagacccgtctcctggacgtggtttacaacgcatcaaacaacgagctggtgcgcacccagactcttgtgaagaacgccattgtccaagttgatgctgctcccttcaaggggtggtatctgacacactatggagtggacattggtcgcaagaagaaaaccactgctgctgcaaagaaggacgcagctgagggacaagagggtgaggtagctgcagctgccacagaggaggcaaagaagagtaacaatgtccagcggaagctggagaagcgtcagcagggacgcactctggatgcccacattgaagagcagttcagcggtggaaggctgctggcctgcatctcttcccgccctgggcagtgtggcagggctgatgggtacatcctggagggcaaagagctggagttctacatgaggaagctccagaagaagaagggcaagggtgcctcagcttagatcacgcctatgtgctttatggcaggctgcatgtttcattcctggttttgttagttgtctcgtccatgttgtcttcagacatgctgaactctattttatgcaagtgaatcgactctagcttggaacgactgagtatattttgccttcttccatatccataatattgtcaatctgttccatttacacctgtcattttacatttgatttgcttggttctactggaccttggtatcttagctgcatttagttccctaagccctacattgaaattttgtccttcttattatgggggtctgggtcgcagatcagactagaactctggttgttagtttgtggactatcatgcctgtctgctgacctgtttgacgctgttcgctcagaatgtactgatcttcctgtgtcatctcaaatttcgtctttccggtaaaaaaaaaa

SEQ ID NO: 6991 - DNA, 854 bp, Artemisia annua
tatattttcatcagttgggaggcgcagcataataaacctttagccggagcagcagcagcagcaaacatgggtatctctcgtgattctatgcacaagagacgtgcaactggtggtaagaagaaggcctggaggaagaagcgaaagtacgagctcggtagacagtcagcaaacaccaagatttccagcaacaaaactgtgcgcagggttcgagttcgtggtggaaacgtcaagtggcgtgctttgaggttggataccggtaactactcgtggggaagcgaggctgtgacccgaaagacccgtattttggatgttgtgtacaatgcatccaacaatgagttggtcagaacccagacactagtcaaaagtgcaatcgtgcaagttgatgctgcaccattcaaacaatggtatttgcaacactatggtgttgaccttggccgcaagaagaaagcagttgcttcagctaccaagaaagagggagaggaagtagaaacggaggaggccaagaagagtaaccatgtcgtgaggaaactggaaaagcgtctggaggaacgcaagttagacccacatgttgaagaacaattctctggtggtcgtcttttggcagctatctcttctcgtcccggccagtgtggtcgtgctgatggatacatattggaaggaaaggagcttgagttctacatgaagaagctacagaagaagaaaggaaagggcgccgctgcttagaaagcgtatttgcttatactagatatgtaatcttttacttattttcaagaaaaaggcattactgagaaattttgtgttagttagctttgtcttctttgaatgttaaaaaggactagtggattggttttaag

SEQ ID NO: 6992 - DNA, 913 bp, Lolium multiflorum
gcgagaccaaaccaaagctgcggcggcgcgggcgtagaaggcggagcagccaccgacgccaccatgggtatctcccgtgactccatgcacaagcgccgggccaccggtgggaagatgaaggcgtggaggaagaagcgaaagtatgagctcggccgccagccagctaacactaagctgtccagcaacaagactgtgaggagggtccgtgtccgtggaggtaatgtgaagtggagggctctgcgcctggatactggtaacttctcgtggggaagtgaggctgtgacccgcaagacccgtctcctggatgtggtgtacaatgcgtcaaacaacgagctggttcgcacccagactcttgtgaagaacgccattgtccaagttgatgctgctcccttcaaggggtggtatctgacccactatggagtggacattggtcgcaagaagaagaccactgctgctgcaaagaaggacgcagctgagggacaagagggtgaggtagctgcagctgccacagaggaggcaaagaagagtaacaatgtccagcggaagctggagaagcgtcagcagggacgcactctggatgcccacattgaggagcagttcagcggtggaaggctgctggcctgcatctcttcccgccctgggcagtgtggcagggctgatgggtacatcctggagggcaaggagctggagttctacatgaggaagctccagaagaagaagggcaagggtgcctctgcttagatcactcctatgtgttatgtggcaggctgcatattttccctgggttttgttagttgtctcgtctatgtcgtgtctgccgacgcactgaactctattttatgcaagtgaatctactctagcttggaacaacttagcatgttttgcctgctactgtaaccatgatattcgtcaa

SEQ ID NO: 6993 - DNA, 939 bp, Physcomitrella patens
cgggtctggctggtcccgaccgggactcgggtacccaaggaaaccaagcgcgcggaggtcgagtggagtggcgagaagagtttccagggcaaatccttgttgcatacgatagtttgcttcttgcgttgctggtagctggtggcgcagcggacatcaccatgggtatctctagggattccactcacaagagacgggctacgggagggaagaagaagtcatggcgcaagaagcgcaagtacgagcttgggaggcaaggtgccatgaccaagttgtccagcaataagaccgttaggcgtatccgtgtgcgtggtggaaactccaagttccgggcgctgcgtttggatactggcaattattcctggggttcggaggctgttacccgcaaaaccagagtattggacgtggtttataatgcttcgaacaacgaattagttcgtactcagactttggtgaagaatgctattgttcaggtagacgctgctccgttccgtacctggtacagccagcactacggcgtcgaaattggcaagaagaagaagtccgctgctaagaaggactctgaggatgctgaagccacagaggaagagaagaagagtaaccacgttcagaagaaattagctaagagggtggagggccacaaacttgattctcatttggaggatcagtttgctagtggcaggttgcttgcttgcatcgcctctcgacctggacagtgcggtcgcgccgatgggtacatcttggagggcaaagagctcgaattttatcagaagaagattcagaagaagaagggcaagggtgccgccgcttagagtgagctgcctcggttagtcacttggtaggatcacaatgacgtattaagcaatagcgaggttataccatgcggaagttatttgaattctattcactgaggttttcttgtaatgaaaaaagtaacacaga

SEQ ID NO: 6994 - DNA, 1293 bp, Physcomitrella patens
cgggactcgggtacccaaggaaaccaagcgcgcggaggtcgagtggagtggcgagaagagtttccagggcaaatccttgttgcatacgatagtttgcttcttgcgttgctggtagctggtggcgcagcggacatcaccatgggtatctctagggattccactcacaagagacgggctacgggagggaagaagaagtcatggcgcaagaagcgcaagtacgagcttgggaggcaaggtgccatgaccaagttgtccagcaataagaccgttaggcgtatccgtgtgcgtggtggaaactccaagttccgggcgctgcgtttggatactggcaattattcctggggttcggaggctgttacccgcaaaaccagagtattggacgtggtttataatgcttcgaacaacgaattagttcgtactcagactttggtgaagaatgctattgttcaggtagacgctgctccgttccgtacctggtacagccagcactacggcgtcgaaattggcaagaagaagaagtccgctgctaagaaggactctgaggatgctgaagccacagaggaagagaagaagagtaaccacgttcagaagaaattagctaagagggtggagggccacaaacttgattctcatttggaggatcagtttgctagtggcaggttgcttgcttgcatcgcctctcgacctggacagtgcggtcgcgccgatgggtacatcttggagggcaaagagctcgaattttatcagaagaagattcagaagaagaagggcaagggtgccgccgcttagagtgagctgcctcggttagtcacttggtaggatcacaatgacgtattaagcaatagcgaggttataccatgcggaagttatttgaattctattcactgaggttttcttgtaatgaaaaaagtaacacagattctatttgtattttttgttcagtgcagtccttgaaattatcttaaatgggaagttggatcgggtagacttgagcttcgttctatcctagaatccgttttcgttaaacagctctagtgttcagagcatgaccgagtgttttagccttctaaaggatgctattagcctatgcccttacgcgcatgcagtcaagttatcccggatgttcccagcgggtgcaggtttccactcaaaatttccctcctccatgaccagtctctggccgcgagacatcatagccatatgcaaaggaatctgggttttgatgatttgcgttgagattcaagagccaatgtaacagaggtctggaaatcgatcatgagatgacatgtctga

SEQ ID NO: 6995 - DNA, 766 bp, Centaurea maculosa
catgggtatctctcgtgattcgatgcacaagagacgtgcaactggaggaaagaagaaggcgtggaggaagaagcgaaagtatgagctcggaagacagccagccaacaccaaaatttccagcaacaagaccgttcgaagggtcagggttcgaggtggaaatgtgaagtggcgtgctttgaggttggataccggtaacttctcttggggaagtgaggccgtcaccaggaagacccgtattctggatgtcgtctacaatgcatccaacaacgagttggtcaggacccagactctagtgaagagtgcaatcgttcaggttgatgctgcaccctttaaacaatggtatcttcaacactatggagttgacattggtcgcaagaagaaaccatcagcaactgctacaaagaaagagggagaggaggcagaggctgctgccgaggaggcaaagaagagcaaccacattgtgaggaaattggagaagcgtcaggaagagcgcaaacttgacgcccatgttgaggagcaattttctggtggtcgtctttatgctgcaatttcttcacgccctggccagtgtggccgagctgatggatacatcttggagggtaaggagcttgagttctacatgaagaagctccagaagaagaaagggaagggtgctgcttagaagcattatgtcgtatcgagtttgaatttatagatttttatttcctgtggaaggcatggaaccgaaattttgatgtgttttgtttgttaaaatgtgacttctatg

SEQ ID NO: 6996 - DNA, 676 bp, Acacia harpophylla
gccctctgctgccgcgtgaaaccctcctactctagttcttctgtgtttcagcagccatgggtatctctcgcgattccatgcacaaaaggcgtgccactggaggcaagaagaaggcttggaggaagaagagaaagtatgagcttgggaggcaaccagcaaacactaagctgtcaagcaacaagacagtgaggaggattagggttcgaggtgggaatgtcaagtggcgtgctttgaggcttgatactggaaattactcttggggcagtgaagccgtgacccggaaaaccagaattctcgatgtggtgtacaatgcatctaataatgagctggttcgtactcagacattggtcaagagtgccatcgttcaggtagatgcagcacctttcaagcagtggtatctccaacattacggtgttgacgttggtcgcaagaagaagactgcaacttctgccaagaaggaaggagaggatggtgaagctgcaaccgaggaagtgaaaaagagcaaacatgttttgagaaagcttgagaagcgtcagcagaatcgaacactggattctcatattgaagaacaatttggaggaggtcgtctattggcttgcatctcgtctcgtcctggtcaatgtggtcgtgctgatgggtatattttggagggtaaagaattggaattctacatgaa

SEQ ID NO: 6997 - DNA, 738 bp, Guizotia abyssinica
tatgcacgggaattccgccattactgacggaggagctcggaggcgcagaataaaccctacaggaggatcgtccgccatctgcaaccatgggtatctctcgtgattccatgcacaagagacgtgcgactggtggcaagaagaaggcatggaggaagaagcgaaagtacgagctcggaagacagccagccaacaccaagatctccagcaataagactgttaggagggttagggttcgtggtggtaatgtcaagtggcgggctctaaggttggacacaggcaactactcttggggaagtgaagctgtgacccgaaagacccgtattttggatgtggtttacaacgcatccaacaatgagttggtcagaacccagacacttgtcaagagtgctattgtccaggtggacgctgcacctttcaagcagtggtatttgcaacactatggtgttgacattggtcgcaagaagaaaacagctccttctgcaaccaagaaagagggagaggaagcagaaggtgcaacagaggaagccaaaaagagtaaccatgttgtgaggaaactggaaaaacgtcaagaggagaggaaattggacccccacgttgaagaacagttttccagtggccgtcttctagctgccatctcatcacgccctggccaatgtggtcgtgctgatggatacatattggaaggaaaagagcttgaattctacatgaagaagctccagaagaagaaaggaagggtac

SEQ ID NO: 6998 - DNA, 888 bp, Ipomoea nil
aagttggcagattcgacggccgcgagagagagagagagagattgaaggaggagacgccttagctctctgcaaaaatgggtatctctcgtgactcaatgcacaagaggcgtgccactggtggcaagcagaaggcatggaggaagaagcgaaagtatgagcttggtcgtcaacctgcaaatactaaactatcaagcaacaaaacagtaagaagaattcgtgtgcgaggaggcaatgtgaaatggagggctctgagattggacacaggaaattattcttggggtagtgaagctgttactaggaagacacgtgtcctggatgttgtctacaatgcctcgaataatgagcttgttcgacacaaactctggtgaagagtgcaattgttcaggtcgatgcagcccctttcaagcagtggtacctccagcactacggtgttgacattggtaggaagaagaaggggcctgtcaagaaggaagctgctgaggaaggagaaaccgcggctgctgaggagactaagaagagtaatcatgttgttaggaaactagagaaacgacagaaggatcgtaaactcgatgctcaccttgaagagcaatttggtgctggtaggctgatggcctgcatctcttcccgacctggccaatgcgggagggctgatggttacattttggagggcaaagaactcgagttctacatgaaaaagatccaaagaaagaagggcaagggtggagctggtgctgcttaattccacctcactaaattttcaccaactttattttcttctcaaaactttttgtaatttgccatgaacttttattagttgataactctatgaagttttactgggctttgctttatacctctgtccaattctatgaatacatagaaaaagat

SEQ ID NO: 6999 - DNA, 1071 bp, Pennisetum glaucum
ctaggaagaggcggagcaccagcgaggggaccaagccaccgccgccaccatgggtatctcgcgtgactcgatgcacaagcgccgggccaccggtggtaagcagaaggcctggcggaagaagcggaagtatgagctgggccgccagcctgctaacaccaagctgtccagcaacaagacagtgaggagggtacgtgtccggggaggaaatgtcaagtggagagctctccgcctggatactggtaactactcatggggaagtgaggctgttacccgccagacccgtatcctggatgttgtctacaatgcgtcaaacaatgagcttgttcgcacccagacccttgtgaagagcgctattgttcaagttgatgctgccccattcaaacagtggtacctcactcactatggagtggacattggtaggaagaagaaggcacctgctgccaagaaggatggtgctgagggacaagaggttgaggctgctgctgatgaaaccaagaagagtaaccatgtcaagaggaagcttgagaagcgtaaggacgaacgcaaacttgacctgcacattgaggagcaatttggcagtggaaggctgttagcttgcattgcttccgcctgggcagtgtggccgggctgacgggtacatccttgagggtaaagagcttgagttctacatgaagaagcttcagaagaagaagggcaagggtgcagcagcttagaggcattcgtatgcatgtttggaaggggtgtcctattaaatatttactctggtctttttgttagttgtcaaacgggcagagcatctatgtcgtgtttgcagacctgatgaagacagtatttctaaaaacgaatcaactctagtgaagaactgagaattttcagctgttgtattcttctactgtttaggttatctgttttctatgtgctgcagcagtttctttgcttaccggggaaatggtagcacacgatatctttcgtgctcacagcctcaccactgtcttctttgctgcatcaaattataatgctgctagttacaggcgacagcagtttctttgcttactggggaaatggtagcac

SEQ ID NO: 7000 - DNA, 935 bp, Nicotiana benthamiana
actacgtagagagtataccagtgtgaggactgaggtcggcttaagctctcagcaaacatgggtatctcaagagattctatgcacaagagacgtgccactggtggaaagaagaaatcttggaggaagaagcgaaagtatgagcttggacgccaaccagctaatactaagatctcaggcaacaagacagttagacgaattcgtgttcgtggtggtaatgtgaagtggagggcactgagattggatactggaaattattcatggggtagtgaggcaaccacacgtaagactcgtatccttgatgtggtttacaatgcctcgaacaatgaacttgtccgcacacaaacactggtcaagagtgcaattgttcaagttgatgctgcaccgtttaaacagtggtacctccagcattatggtgttgacattggtaggaaaaagaagggagctgctaagaaagaaactactgaggagggagaagctgctgctcctgcagaggaagctaagaagagcaaccatgtagcccggaaacttgagaaacgtcagaaggatcgtaaacttgatcctcacctcgaagagcaatttggttctggtaggctatatgcctgcatctcatctcgccctggtcaatgtggcagagctgacgggtacattttggaagggaaagagttggaattctatatgaagaaacttcaaaagaagaaaggcaaggctggatctggtgctgctgcttaagaggaactttcggatttccagatcagttttttgttttttttaagatggtgtttttactcataggctgttccttcttatcatatatggacactataagttgagacatggactttactgttacagcaatcttaagtttgaaattttactgctaattgactagatgtacgttgatgtaattttatttgcatgaattagatgtcttggtt

SEQ ID NO: 7001 - DNA, 974 bp, Nicotiana benthamiana
cctacaaagtgaaagagaagtgtagtctgcctcttcgcggctaagctctcagcaaccatgggtatctcacgagattctatgcacaagaggcgtgccactggtggcaagaagaaagcttggaggaagaagcgaaagtatgaacttggccgccagcctgctaatactaagatctcggctaacaagacagtccgacgaattcgtgtgcgtggtggcaatgtgaagtggagggcactgagattggataccggaaattactcatggggtagtgaggcagtcacacgcaagactcgtatccttgatgtggtttacaatgcctcaaacaatgaacttgttcgcacacaaactctggtcaagagtgctattgttcaagttgatgctgcgccatttaaacaatggtacctccagcattatggtgttgacattggtaggaagaagaagggccctgctaagaaggaaactactgaagaaggagaaggtgctgctgccgctgcagaggaaactaagaagagcaaccatgttctcaggaagattgagacacgccagaaggatcgtaaacttgatcctcatattgaagagcaatttggtggtggtaggctgttggcctgtatctcttctcgccctggtcaatgtggcagagcagatgggtacattttggagggaaaagagcttgagttctacatgaagaaactacagaagaagaaaggcaaggctggagctggtggtactgcttaactgttgcaaccagaattttcagactagtttcattttcttctcttttgctgtaattccaattttggggatatgtgattttgtatgcagtaccttttatattttatcttgtactctaccagagtttagtatgatgtcttaagacattgttaatcattatcagttttccatcactggttccagtttctcttgaaagttgtgtgatttaaagagttgatgatatttacagccagttttgtgtgata

SEQ ID NO: 7002 - DNA, 967 bp, Elaeis guineensis
gagtcgtcagggggaaggtgggagagagcaagcggcggggaagtcccgaagagagagaaagagagagaagccttccttgcctccgccaaaatgggtatctcgcgagactctatgcacaaaaggcgcgcgacgggagggaagaagaaggcctggaggaagaagagaaagtatgagttgggccgccagcctgcaaacactaagctgtccagcaacaagacagttaggagggttcgtgttcgtggaggtaatgtgaagtggagggccctccgtttggatactggcaattactcttgggggagtgaggctgtgactcgcaagactcgtatccttgatgttgtgtacaatgcctcaaacaatgagcttgtgaggacacagaccctggtgaagagtgctattatccaggttgatgctgcccccttcaagcaatggtacctccagcactacggtgttgagattggtaggaagaagaaggccccagctgcctccaagaaggaagcaacagaggagggagaaggtgctacagaggaggcaaagaagagcaaccatgtcctcaggaagctggagaagcgccagcaatgtcgtacacttgacccccacattgaagagcaatttggtagtgggagattgttggcttgtatctcatcccgccctggccagtgtggcagagctgatgggtacatattggaaggcaaggaactggaattttacatgaagaagatccaaaggaagaagggcaagggaggttctggagctgctgcttgagtcgaatctgtttagttgcttggttcttccgttttatgcacttgtttgagttccatagactgaggacaggtgatgagtcatttgaaattttgacatgcattgtagatgttagagatgagaactgtttattgtttctagcgatcattatatttcccattgcgttcgatagcagacatatattgattggacctcaaaacacaaattt

SEQ ID NO: 7003 - DNA, 1091 bp, Sarracenia psittacina
aggttagtagtttgttggtaggcgtgagaaatacgagctgagagagagagagagagagagagagagagcttcgccgcttctccgccacacacgaaagatgggtatctcacgagactcgatgcacaagaggcgtgcaactggaggaaagaaaaaggcatggaggaagaagagaaagtatgagcttggtcgccagcctgcaaataccaagctatcgagcaacaaaacggtgaggagagttcgtgtgagaggaggcaatgtgaagtggggggcccttagattggacactgggaattactcttggggtagtgaagctgtcacccgtaaaacacgtatccttgatgtggtttacaacgcttccaacaatgagcttgtcagaacccaaactctggtgaaaagtgcaattgttcaggtggatgctgcacctttcaagcagtgataccttcagcactatggtgttgacgttggtaggaagaagaaggcagctactaagaaggaaactccagaggaaggagaaggggcagctgcagcagtagaggaaacaaagaagagcaaccatgtcctcaggaagattgagaaacatcagcaagatcggaaacttgatcctcacattgaagagcagtttggcagtgggaggttgatggcgtgcatctcttcccgaccaggtcaatgtgggagggcagatggatacatcttggaaggaaaggaactggaattctatatgaagaagctccagaggaagaaaggcaaaggtgccggtgctgccgcataatcgctgcactacctgtcgtactttttccttcaggttgtgctctgttcaattcctttcttgcttactaagacaaatggcttgttaagactgaatttgggaactctaaaaagacttcaggtttctagctttgagatgagatgtcttttttccctttttaccctgctctgttaggcaagtcttttttgaactaaaatattataagttataatggtctgttcgctctgcaggatcttagtgtaacgtttcattggccgcctggtctatgaatccatataccaaattattatggggctgataaggaattcaattaatgaccaataaa

SEQ ID NO: 7004 - DNA, 951 bp, Nicotiana tabacum
  misc_feature (405)..(405): n is a, c, g, or t
  misc_feature (408)..(408): n is a, c, g, or t
ggccattacggccgggggttacctacaaagtgaaagagaagtggtgtagtctgcctcttcgcggctaagctctcagcaaccatgggtatctcacgagattctatgcacaagaggcgtgccactggtggcaagaagaaagcttggaggaagaagcgaaagtatgaacttggccgccagcctgctaatactaagatctcgactaacaagacagtccgacgaattcgtgtgcgtggtggcaatgtgaaatggagggcgctaagattggatacaggaaattactcatggggtagtgaggcagtcacacgcaagactcgtatccttgatgtggtctacaatgcctcaaacaatgaacttgttcgcacacaaactctggtcaagagtgctattgttcaagttgatgctgcnccntttaaacaatggtacctccagcattatggtgttgacattggtaggaagaagaaggggcctgctaagaaggaaactactgaggaaggagaaggtgctgctgccgctgcagaggaaactaagaagagcaaccatgttctcaggaagattgagacacgccagaaggatcgtaaacttgatcctcatattgaagagcaatttggcggtggtaggctgttggcctgtatctcttcccgccctggtcaatgtggcagagcagatgggtacattttggagggaaaagagcttgagttctacatgaagaaactacagaagaagaaaggcaaggctggagctggtggtgctgcttaactgttgcaaccagaattttcagactagtttcattgttctcttttgctgtaattccaattttggggatatgtgattttgtatgcagtatcttttatattttatcttgtactctaccagagtttagtatgatgtcttaagactttgttaatcattatcagctttccttcactggttccgctttctcttgaaagttgt

SEQ ID NO: 7005 - DNA, 1182 bp, Nicotiana benthamiana
gatctcattttttgttgagccctccgtattagagcatagccgtcggaaccctaggatccttcgtcgccggcaacaatgggtatctctcgggattcgatgcacaagagacgtgccactggaggcaagaagaaggcgtggaggaagaagagaaagtatgagcttggaagacagcctgcaaatacaaagctggtgcctaatgctaagactgttaggaggataagggtccgaggaggcaatgtgaagtggcgcgctttgaggttggacactgggaacttctcttggggcagtgaggctgttactaggaagactcgtttattggatgtggtgtacaatgcctcaaacaatgagctggttaggacacaaactctagtgaagagtgcaattgttcaagttgatgcagctccatttaagcagtggtatctccagcactatggagttgatattggtcgcaagaagaagagtgctgtcaagaaggaaggagaggaggctgagactgctcctgctgcggaggaaaagaaaagcaaccatgtgcagagaaagctgcaaaagcgtcaacaagatcgtaagattgacccacatgttgaagagcaatttgctagtggccgtctattggctgcaatctcgtcacgacctggccaatgtggtcgtgctgatggttacatcttggagggtaaggaactggagttctacatgaagaaacttcagaaaaagaaagggaagggtgcaagtggcgctgcttaagagttatagctgatttctgttatatcatccaaagcgtcaaatcatatgcctctgtgttatttactattttacagaatgggtattaagaacctctttagctgctagagttagatcagcccacctttttggaatgttataattttgaggacagattggtcctactgttttcttctaaagatgtcattaaggtagtctcagcattcagctttcaggttttacattgcttgaaattttatatactattattgcttgctgacagaaaccttcaaatattagtgttcacactgtcttcgtaagttgcgcaaagtcccccctcagcacacaagcatttatgaagtttggtaatccaaaatgctatggagcttgaatcgttgaagtactgatgatgcattgggacatatataacaccaccaattgagaaaatgtaaactcgtgaattat

SEQ ID NO: 7006 - DNA, 897 bp, Capsicum annuum
tacacctaaaccctaacgttcctccgtcgccggcgacaatgggtatctctcgtgattctatgcacaagagacgtgctactggaggaaaacagaaggcttggaggaagaagagaaagtatgagcttggcagacagccagcaaacacaaagctggtgccaaatgctaagactgttagaagaataagagtccgaggaggtaatgtgaagtggcgtgcattgaggttggatactgggaattactcttggggtggcgaggctgttacaaggaaaactcgtctattggatgtggtgtataatgcctccaacaatgagttggttaggacacaatccttggtgaagagtgcaattgttcaggttgatgcagctccatttaaacaatggtatctccagcactatggagttgagattggccgcaagaagaaggctgctgcttccaagaaggaaggagaggaggctgaggctgtaccagaggagaagaagagtaaccacgtccaaagaaagctggaaaagaggcaacaggatcgcaagattgacccacacgttgaggagcaatttgctagtgggcgtttattggcggcaatctcatcacgacctggccagtgtggtcgtgctgatggttacatcttggagggtaaggaactcgagttttacatgaagaaacttcagaagaagaaagggaagggcgccggtggtgctgcctaaagttgcacgctccaagttttaaattatctgaagttcagaacaaattagatttgatttttgttccctattgaacagtctcacttcatttgaaaggggatgatagacttcttgtatctgagtatcaagtttgttttgcatatggttaactgacagttttgagaaccactacttagtgaaaaaagaaagtgcctcgtgc

SEQ ID NO: 7007 - DNA, 1020 bp, Solanum lycopersicum
agggtttgaatttataagctgataaaacccaactcttgcagagccgtcgtccgtctttgagaaaatcgaaaccctaaggacctccgtcaccggcgacaatgggtatctctcgtgattctatgcacaagagacgtgccactggaggaaagcagaagacttggaggaagaagagaaagtatgagcttggcagacagccagcaaacacaaagctggtgccaaatgctaagactgttagaaggataagagtccgaggaggtaatgtgaagtggcgtgctttgaggttggatactgggaatttctcttggggtagcgaggctgttacaaggaagactcgtctgttggatgtggtgtataacgcctctaacaatgagttggttaggacacaaaccctggtgaagagtgcaattattcaggttgacgcagctccatttaagcagtggtatctccagcactatggagttgaaatcggtcgcaagaagaagactgctgcttcttccaaaaaggaaggagaggaggctgaggctgtagcagaggagaaaaagagtaaccatgtccaaagaaagctggaaaagaggcaacaggatcgcaagattgacccacatgtcgaggagcaatttgctagtgggcgtctattggctgcaatctcatcgcgacctggccagtgtggtcgtgctgatggttacatattggaaggaaaggaacttgaattttacatgaagaaacttcagaagaagaaagggaagggtgccggtgctgctgcttagagttgcaggctccaatttttaaattatcagaacaaattagattttggtttttcttccctattcaacagtctcacttcatttaaagggaatgataaacttcttgtatcagagttagattcaagtttgttttgcatatgcttaactgagaattttgagaaccacctactttatgaaaaaaaagaattttgagaacagccttaaaagttgcatcattaactgttttcttaatcagtgttgagatggatcttctgctgaa

SEQ ID NO: 7008 - DNA, 938 bp, Solanum lycopersicum
caactcttgcagagccgtcgtccgtctttgagaaaatcgaaaccctaaggacctccgtcaccggcgacaatgggtatctctcgtgattctatgcacaagagacgtgccactggaggaaagcagaagacttggaggaagaagagaaagtatgagcttggcagacagcccgcaaacacaaagctggtgccaaatgctaagactgttagaaggataagagtccgaggaggtaatgtgaagtggcgtgctttgaggttggatactgggaatttctcttggggtagcgaggctgttacaaggaagactcgtctgttggatgtggtgtataacgcctctaacaatgagttggttaggacacaaaccctggtgaagagtgcaattattcaggttgacgcagctccatttaagcagtggtatctccagcactatggagttgaaatcggtcgcaagaagaagactgctgcttcttccaaaaaggaaggagaggaggctgaggctgtagcagaggagaaaaagagtaaccatgtccaaagaaagctggaaaagaggcaacaggatcgcaagattgacccacatgtcgaggagcaatttgctagtgggcgtctattggctgcaatctcatcgcgacctggccagtgtggtcgtgctgatggttacatattggaaggaaaggaacttgaattttacatgaagaaacttcagaagaagaaagggaagggtgccggtgctgctgcttagagttgcaggctccaatttttaaattatcagaacaaattagattttggtttttcttccctattcaacagtctcacttcatttaaagggaatgataaacttcttgtatcagagttagattcaagtttgttttgcatatgcttaactgagaattttgagaaccacctactttatgaaaaaaaagaattttgagaacagccttaaaa

SEQ ID NO: 7009 - DNA, 1076 bp, Musa acuminata
atgggtgagccaaagtccagacctgattactacgttgatcgacgggtctggttcgaccaggccaagtccgattccggtttagtccgaccgtcgagacagtggagggtgtgcgagagagaggagcgacgagggcggcggcagaagtaccggggagagagaggaagctgcttgccgcgaccggacaatatgggtatctcgcgggactccatgcacaagaggcgggccaccggagggaagaagaaggcgtggcggaagaagagaaagtatgagttgggaaggcaaccagctaataccaaactttcgagcaacaagactgtgaggagggttcgagttcgaggaggcaacgtgaagtggagggccctccgcttggatcatgggaactactcatgggggagtgaggcagtgacacgcaagacccgtatccttgatgtggtctacaacgcttcaaacaacgagcttgtgaggacacagacccttgtgaagagtgccatcattcaggttgatgctgccccattcaagcagtggtatctccagcactatggtgttgagattggcaggaagaagaaagcccctgctgttaagaaggaagcaactgagggacaggaggctgaacctgctacagaggaagcaaataagagtaatcatgtcaccaggaagctggagaagcgtcagcagggtcgcaaactcgatgcccacatcgaggagcaatttagcagtggaaggttgttggcttgtatctcctcccgccctggtcagtgtggccgagcagatggatacgtattggaaggaaaagagctggaattctacatgaagaagatccagaggaagaagggcaaaggagcaggaggtgcagcttaagtaatgcttcggtcatttcttcagttagttccgaatgagaacctgtgcaattgctttgcatcagcttaaggaaccttgttagtttcatcttcaagtgaaccttatttaatgctcgctcattcaaggcttcttaatacttttgtagctaccataaattatctttgtttccatcatgtttaatccgtgtggacaatttgttcttggtatgtcttcttccc

SEQ ID NO: 7010 - DNA, 963 bp, Fagus grandifolia
ctggaccttggctgtcactcagttacgcaagaggcgctcggtgcagcaggtaagcccaagtaacagaggcgctcaagaaccagaacaagagcttcaactgcaatcatgggtatctcacgtgactctatgcacaagaggcgtgccactggaggaaagaagaaggcctggagaaagaagagaaagtatgagcttggccgtcagcctgcaaacactaagctctcaagcaacaagactgtgaggagagtccgtgtgagaggaggcaatgtgaaatggagagccctcagattggatactggaaactactcatggggtagtgaagctgtcacccgcaaaacacgtatcctggatgttgtttacaatgcttcgaacaatgagcttgtcagaacacaaactctggtgaaaagtgctattgttcaggtggatgctgccccattcaagcagtggtaccatcagcactatggtgttgacattggtaggaagaagaagacagttgctaagaaggataccccagaggaaggaggaaagcctgaagcagaagcagctacagaggaaacaaagaagagtaaccatgtcctcaggaagattgagaagcgtcagcaaggtcgttcacttgatgcccatatcgaagagcagtttgggggtggtaggttgttggcatgcatctcatctcgaccaggacaatgtggtagagctgatggatacatcttggaaggaaaagagctggagttctatatgaagaagctccagaggaagaaggggaagggtgcaggtgcagctgcttaagcagtttattagtcaatagttttggtctttttgctacttgttttagctacacctttttgttctgcctagatggaccaatgtttatcgttactgatggaactatgaggattctgtatggcatgtttagttgtttcaaattagatgctttgaccagtttgtgattgacaagtcatttttgag

SEQ ID NO: 7011 - DNA, 938 bp, Eschscholzia californica
gtttcagaggcgctgaggagaaggaagaaggtagttagtgttcaagccgttcagccaagatgggtatctctcgagattctatgcataagaggcgggcaactggaggaaagaagaaagcttggaggaagaagcgaaagtacgagcttggtcgtcagcctgcaaacaccaagctctcgagcaacaaaactgtgaggagagtccgtgttaggggtggaaatgtaaaatggagagccctcagattggatactgggaattactcttggggtagtgagacagtcactcgcaagacccgtattcttgatgttgtttataatgcatcaaacaatgagcttgtcaggacacagacattggtgaagagcgctattgttcaagttgatgctgcccctttcaagcaatggtatctccagcactatggagttgagattgggaggaagaagaagtccaccaccaagaaggaaactgctgagggtcaagagggtgatgccgcagctgtggaagaaacaaaaaagagtaaccatgttatgaggaaaatcgagaagcgtcagcaggatcacaaacttgacgcacacattgaagagcagttcagtggaggcaggctattagcttgcatttcatctcgccctgggcaatgtggcagagctgatggatacatcttggaaggtaaggagcttgagttttacatgaagaaactccagaagaagaagggcaagggtagtgctggagctgcttaaacaacaagcaaattcatatcctctaggttttaaaattatgcttcttgttggttatcaagatgccttttaggctatttatcttctagggttaggtggatagtgtatggactagattttggtgcaagataatcaaaattttgctttttattcatcatcagatatgggaacagcggtattacttgtttaagtcattcactaagattgttt

SEQ ID NO: 7012 - DNA, 905 bp, Ipomoea batatas
tagccgagctgcacccctaacgctgcagtgccgagaaaggagaagaagctcttctcttcgcagacatgggtatctctcgtgattcgatgcacaagaggcgtgccactggtggcaagcagaaagcttggaggaagaagcgaaagtatgagctcggtcggcagtctgcaaatactaagctctcaagcaacaaaacagtcaggcggatccgtgttcggggtggcaatgtaaaatggagagccctgagattggatacagggaattattcttggggcagtgaggcagttactaggaaaacgcgtatccttgatgtggtttacaatgcttcaaacaatgagcttgttcgaacacaaactttggtgaagagtgcaattgtgcaggtggatgcggccccctttaagcagtggtacctgcagcactatggtgttgatattggtaggaagaagaagggacctgccaagaaggaaactgctgaggaaggaaatgaaggtgctgctgttgaggagactaagaaaagtaatcacgttcaaaggaaacttgagaagcgccagaaggatcgtaaacttgattctcaccttgaggagcaatttggttctggtaggctgatggcctgcatttcctcccggccaggtcaatgtggcagagctgatgggtacattttggagggaaaagagctcgagttttacatgaagaaaattcagaggaagaagggcaagggagctggtgctgctgcttaattattgctttcaaaattttcaagaaacttattttcatcttctagtttcttttacattactatggcccacaatgctttgtgaacatctgttttatttgactgagtattaaattattgctatcttgataatattttgctttgcctgttgaaaattgcttcagttatttttttg

SEQ ID NO: 7013 - DNA, 857 bp, Ipomoea batatas
caccgcagctatgggtatctcaagagattcgatgcacaagaggcgagccactggtggcaagaagaaggcatggaggaagaagagaaagtatgagcttgggcgtcaaccagcaagcactaaactctcgagcaacaagactgttaggagagttcgagtgaggggaggcaatgtgaagtggagagcactcaggctggatacaggaaactactcatggggcagtgaagctgttacacggaagacacgtattcttgatgtggtatataatgcctcaaacaatgaacttgtcaggacccaaactctggtgaaaagtgccattgttcaggtggatgctgctccattcaaacaatggtaccttcagcactatggcgttgatattggtaggaagaagaagtcggctgctgctaagaaggaaacaaatgaggaaggtgaaggcgcaactgcacctgaggaaaccaagaagagtaaccatgtgctaaggaagattgaaaaacgtcagaaagatcgcaagcttgactcccaccttgaagagcagtttagttcgggcagattaatggcatgcattgcatcacgaccaggccagtgtggcagggctgatgggtatatcttggaaggaaaggaactggaattctacatgaagaagattcagaggaagaagggaaaaggttctggtgcagctgcctaatcatcatctgatctgataagatcctttgaagtcaatctagttggtctagttttctatttggttgctcacctcccttgtgtaccaacattgacacttggttccttgtgctggatactatgtagttttggacaagttttgtatgcacttcgttttattggtcttgtgaactggtttg

SEQ ID NO: 7014 - DNA, 843 bp, Ipomoea nil
tgggtatctctagggattcaatgcacaagaggcgtgccactggtggcaagaagaaggcgtggaggaagaagcgaaagtatgagcttggacgtcagcctgcaaatactaagctgtctagcaacaaaacagtgagacgaattcgtgtacgagggggcaatgtgaagtggagggcactgaggttggatacaggaaattattcatggggtagtgaggcagttactaggaaaacacgtatccttgatgtggtttacaatgcctcaaacaatgaacttgttcgaacacaaactctggtgaagagtgcaattgttcaggttgatgcagctccctttaagcagtggtaccttcagcactatggtgttgacattggcaggaagaagaaggcggctgccaagaaggaaactgctgaggaaaccgagggtgtagctgctgaggagacaaagaagagcaaccatgtccaaaggaaacttgagaagcggcagaaggaacgtaaacttgactctcaccttgaggagcagtttggctctggtaggttgatggcctgcatctcatccagacctggtcaatgtggcagagccgatggatatattttggaaggaaaagagctcgagttctatatgaagaaaatccaaagaaagaagggcaagggtagcggtgctgctgcttaattttgcagtcaagatttttgatcaagttaaatcttttagtttgctgtactttacctaaaaaatatgagaatttgatttgggaacttctttctctccttatatttatagttggtgatgacatttaactcttctttattgtactgaattttggtcaaccttgctggttagactttgttgc

SEQ ID NO: 7015 - DNA, 921 bp, Triphysaria pusilla
tcagtcgctgcctttgctcgtattctcagttggagacaaatcggagcctccgccagcaatcatggggatttctcgggattccatgcacaagaggcgtgcaactggaggcaagcagaagacctggaggaagaagcgaaagtatgagctcggaagacaaccagcaaacacaaagctgtcgagcaacaagactgttcgcagggtgagagttcgtggaggtaatgtgaagtggcgtgcattgaggttggataccggtaacttttcctggggtagtgaagctgtgacccgaaagacccgtattctggatgttgtttacaatgcgtccaacaacgagttggttaggactcagactttggttaagggtgctgtcattcaagttgatgctgcgccgttcaagcaatggtatcttcaacattatggagttgaaattggccgcaagaagaagactgctgctgccaagaaggacgcagaggaaactgaggctgctgctgttgctgaagaggcgaagaagagcaaccatgtgaaaagaaaaattgagaagcgtcaggaggagcgtaaaatagatgcacacatcgaggaacagtttggcggtggccgtctgttagctgctatctcctcccgcccaggccagtgtggccgtgctgacggttacattttggagggcaaggagttggagttttacatgaagaaacttcagaggaagaagggaaaaggtgctagcggtgtttaatctatgtcgtgagcacaaaccatattttccaattcagtattgttatcatttctttttggcctgtatgacaagaacaatagtttggtatcgaactattttggtcggttaatggtgtgacgtcacatatacaatcaattatccttttaattttgaatcctttgtttgaatactacttttggtcgttttggttccac

SEQ ID NO: 7016 - DNA, 796 bp, Triphysaria pusilla
aaatcggagcctccgccagcaatcatggggatttctcgggattccatgcacaagaggcgtgcaactggaggcaagcagaagacctggaggaagaagcgaaagtatgagcttggaagacaaccggcaaacacaaagttgtcgagcaacaagactgtgcgcagggtgagagttcgtggaggtaatgtgaagtggcgtgcattgaggttggataccggtaacttttcctggggtagtgaagctgtgacccgaaagacccgtattctggatgttgtttacaatgcgtccaacaacgagttggttaggactcagactttggttaagggtgctgtcattcaagttgatgctgcgccgttcaagcaatggtatcttcaacattatggagttgaaattggccgcaagaagaagactgctgctgctgccaagaaggacgtagaggaaactgaggctgctgctgaagaggcaaagaagagcaaccatgtgaaaagaaaaattgagaagcgtcaggaggagcgtaaaatagatgcacacatcgaggaacagtttggcggtggtcgtctgttagctgctatctcctcccgcccaggccagtgtggccgtgctgacggttacattttggagggcaaggagttggagttttacatgaagaaacttcagaggaagaagggaaaaggtgctagcggtgtttaatttatgttgttgagccaaaccattttttccgatttagtattcttatcttttctttttggcctgaatgacaagaacaatagtttggtatcgaactattttggtcggttaa

SEQ ID NO: 7017 - DNA, 944 bp, Cucurbita pepo
agtcccctacaatctcttcccttctatctcccgagttctctcgttcgctcaaggaactctaaacttggcttcacgccaagagctctcatctcagcaacatgggtatttctcgtgattctatgcacaagaggcgtgccactggaggcaagaagaaggcttggaggaagaagagaaagtatgagctcggaaggcaacctgccaacaccaagatatccagtgacaagtcaatcaggaggattagagttcgtgggggtaatgtgaagtggcgtgcttttaggcttgatactggaaactactcttggggtagtgaggccgtgactaggaagtcacgtattcttgatgtggtctataatgcatccaacaatgagcttgttcgtactcaaaccttggtgaagagtgccatagttcaagttgatgctgcaccatttaagcaatggtatcttcaacactatggggtggatattggaaggaagaagaagacctcagcacctgccaagaaggaagaggaaggtgaggctgctgctgctgcggaggagttgaagaagagtaaccacgttcagcgcaagttggagaaacgtcaacaggatcgtaagctcgacccacatattgaggagcaattcagcagtggtcgtttgatggcttgtatctcatcaagaccaggtcaatgtggccgagcagatgggtatatcttggaggggaaagaactcgagttctacatgaagaagctccagaggaagaaggggaaaggtgctggtgctgcataagttttgtcgttgagatatgttgtggccgtgtttcattttctatgattctatctgcctttttgtcttctgaagatatgatgatttgcagctaagaggatagaattatttatgaacttcaattttgctggtattagttgtttaattacaatactttatttgagtctgtttcgtgattataac

SEQ ID NO: 7018 - DNA, 828 bp, Zingiber officinale
  misc_feature (99)..(99): n is a, c, g, or t
  misc_feature (129)..(129): n is a, c, g, or t
ctctactcctctgccaggatgggtatctcacgggactccatgcacaagaggcgcgctaccggaggtaaaaagaaggcctggaggaagaagagaaagtangagttgggaaggcaacctgcaaacacaaanctttccagcaacaagactgtgagaagggtaagagtccgaggaggcaatgtaaaatggagggctctcaggttggatactgggaattattcatggggaagtgaggccgtaacacgcaagacccgtatccttgatgtggtctataatgcttcaaacaacgagcttgtgaggacacaaacccttgttaagagtgcgattgtccaggtggatgcagcccccttcaaggcgtggtatctccagcattatggagttgaacttggaaagaagaagaagtctgcctcagctaccaagaaagagacaactgaggggcaagagggtgaacctactgcagaagtaaagaagagcagccatgtactgaggaagttggaaaagaggcagcaggatcggaaacttgattctcacattgaggatcaatttggtaccggaaggctgttggccgccatctcctctcgccctggccagtgtggtagagctgatggctacatattagaaggaaaggagctcgagttctacatgaagaagatacagaagaaaaagggcaagggagcaggagctgcatgagtaattagcgttcggttctttgttttctctagctgatttcaaatagctctagttgagtcctcaatcctttgagattgagatttatttgcttgtgaaagttttgaacattggacggtcatggcgactttgataacattaatc

SEQ ID NO: 7019 - DNA, 1117 bp, Lactuca sativa
atgaaatctaacaaggacaatgggttttaatgtaaataatcaaatcacgcctttaagttcttcactccgccaaaccctagttttcttccgtcatctagggaggccgagctcggaggcgcgtcataaaccctagaggaggatcctccgtcaactgcaaatatgggtatctctcgtgattccatgcacaagagacgtgccactggtggcaagaagaaggcatggagaaagaagcgaaagtatgagctcggaaggcagcctgccaacaccaagatttccagcaacaaaaccgttcgtagggtgagggttcgaggtggcaatgtgaagtggcgtgccttaaggttagacacaggtaactactcatggggtagtgaggctgtgacacgaaagacccgtatcttagatgtcgtctacaatgcatccaacaacgaattggtcagaacccaaacattagtgaagagtgcaatcgttcaggttgatgctgcacctttcaaacaatggtatcttcaacactatggagtcgacattggtcgcaagaagaaaacccctgcatctggtaacaagaaagagggagaggaagctgaaggtgctactgaggaaaccaaaaagagcaaccatgtcgtgaggaaaattgaaaagcgtcaagaggaacgcaaacttgaacaacatgttgaagaacagttctcaagtggtcgtcttttagcagcaatttcatcacgccctggccagtgtggtcgtgctgatgggtacatattggagggaaaagaacttgagttctacatgaagaagcttcagaaaaagaaaggaaagagtggtgctactgcttaaacaatgtcagtttatgatcaagttttctttaggttatcatgtcttcttttatatatcatttaatagatttggactcaaattttgtttgacttaatgaatgacttaatggatcatgtaagttctactactgttaattcattgacatggttccatctgtatgcaccaattttgtgaattagcaacaaacttcacttttgctaccaatatagtcaatgtatttttttttacctataataacagtgtagctacattttttttacatgtagtaatgtgtttacatttctttgctgat

SEQ ID NO: 7020 - DNA, 1048 bp, Triphysaria pusilla
gactcctcagccttgggcctaaaaagtggcctttatgataattcgatttcatctagggttttaaacaaattctgctgagtaccttcatttctcagtcgctgccgttgctcatattctcagttggagacaaatcggagcctccgccagcaatcatggggatttctcgggattccatgcacaagaggcgtgcaactggaggcaagcagaagacctggaggaagaagcgaaagtatgagcttggaagacaaccggcaaacacaaagttgtcgagcaacaagactgtgcgcagggtgagagttcgtggaggtaatgtgaagtggcgtgcattgaggttggataccggtaacttttcctggggtagtgaagctgtgacccgaaagacccgtattctggatgttgtttacaatgcgtccaacaacgagttggttaggactcagactttggttaagggtgctgtcattcaagttgatgctgcgccgttcaagcaatggtatcttcaacattatggagttgaaattggccgcaagaagaagactgctgctgccaagaaggacgcagaggaaactgaggctgctgctgttgctgaagaggcgaagaagagcaaccatgtgaaaagaaaaattgagaagcgtcaggaggagcgtaaaatagatgcacacatcgaggaacagtttggcggtggccgtctgttagctgctatctcctcccgcccaggccagtgtggccgtgctgacggttacattttggagggcaaggagttggagttttacatgaagaaacttcagaggaagaagggaaaaggtgctagcggtgtttaatctatgtcgtgagcacaaaccatattttccaattcagtattgttatcatttctttttggcctgtatgacaagaacaatagtttggtatcgaactattttggtcggttaatggtgtgacatcacatatacaatcaattatccttttaattttgaatcctttgttcgaatgatacatttcaagttctcttattaaaagagaaatattaaaggacaaaaaaaaaaaaaaaaaa

SEQ ID NO: 7021 - DNA, 966 bp, Musa acuminata
gatttgtgaccttctactcgtcgctaacgcaggtatctcttccatggtgctcttcttcttctgcttgcgctcgcaggtatctcacgggactccatgcacaagaggcgcgccactggaggcaagaagaaggcctggaggaagaagagaaagtatgagttgggaaggcagccagcaaacacaaaactttcaagcaacaagacagtgaggagggttcgagttcgaggaggcaatgtaaagtggagggcccttcggttggattctgggaactattcatggggaagtgaagctgtgactcgcaagacccgtgtcctcgatgtggtctataatgcttcaaacaacgagcttgtgagaacacagacccttgtgaagagtgccattgtgcaggttgatgctgctcccttcaaacagtggtacttccagcattatggcatcgagattggtaggaagaagaaggctccaacggcttccaagaaagaggcagcagaggagggtgaagctgccgtggaggaaggcaagaagagcaatcacgtcaccaggaagcttgagaagagacagcagggatgtaaacttgatcctcacatcgaggagcaatttggggcaggaaggttgttggcttgtatatcttcccgccctgggcaatgtggaagagctgatggatacatattagaaggaagggagcttgagttctacatgaaaaagatccagcggaagaagggaaagggcacaggggctgctgcttaagagtttatgccacttctgtctggtgttccatgggtattttctcaacgatatagatgtgtttctcgtttgtttcaggttttgattttaaatttagacggatgcttgcttattgaaaattttgacatacaagctatgagagacgataacatttactttattcaatagcctatttcttctttgaggtgaatgaattgaacttttgacgatgttaatgatgtatacaaa

SEQ ID NO: 7022 - DNA, 958 bp, Panax ginseng
tttcacgttcaagtctccttgcctccattctgctgcaagtcattttggcgacagaggaggcagccaccatctgtaaccatgggtatttctcgggattcgatgcacaagaggcgtgccactggaggcaagaagaaggcttggaggaagaagcgaaagtacgagctaggaagacaaccagcaagcacaaagttgtcaagcaacaagacagttaggaggttaagggttcgaggtgggaatgttaagtggcgtgcgttgaggttggatacagggaactactcttggggtagtgaggctgtgactcggaagactagaattttggatgtggtttataatgcatcaaataatgagttagttaggacccaaactttggtgaagagtgcaattgttcaggttgatgcagcaccatttaagcaatggtatcttcaacactatggtgtggacattggtcgcaagaagaaaacttctgcttctgctaagaaagaaggagaggatgctgacactcctaccgaggaggcaaagaagagcaaccatatcctgagaaaaattgagaagcgtcaagaagatcgcaagattgatgcacatatagaagagcaatttggaggtggccgtctcttagctgcaatctcatcacgacctggccaatgtggtcgtgctgatggatacattttggagggcaaggagctggagttctacatgaagaaactccagaggaagaaaggaaagggtgccacagcttaaatatttttgaccttaatgaagttttttaaatttagaattttattctctttgtgatgacatgaaactaaagagagattgagctcttacacttggctatgttttttaagtctttatatcagtttgtcttgtgatttgaatttaaaggtcagtaaatcaaatgcatgttaaaccctgtaaaacctgtagcattttgaaattttttaaattcattattgattgc

SEQ ID NO: 7023 - DNA, 940 bp, Vitis vinifera
ccaccaaaccctagcctcactgccaaggattagggtctccgggaagaagagaaaccctagaattccccccctctgcaacaatgggtatttctcgagattccatgcacaagaggcgtgccactggaggcaagaagaaggcgtggaggaagaagagaaagtacgagcttgggagacaacctgctagcacaaaactatccagcaacaaaacagttcggagagttagagtgagaggtgggaatgtgaaatggcgtgcactgaggcttgacactgggaactactcttggggcagtgaggctgtgaccaggaaaactcgaatcttggatgtggtttacaatgcatcaaacaatgagttagttcgtacccaaacattggtgaagagtgccattattcaggttgatgcagcaccatttaagcagtggtatctccaacactatggccttgacattggtcgcaagaagaaagcctcagccactgccaagaaagaaggagaggaaggtgatggtcctgctgaggagacaaagaagagcaaccatgtggtgagaaaattagagaagcgtcaacaggagcacaaacttgacccacatatcgaagagcaatttggtagtggccggttgttggctgcaatctcatcccgtcctggtcagtgtggccgtgctgatggatacatcttggaaggcaaggagcttgagttctacatgaagaagatccagaggaagaaggggaagggctcagctgcttaaaattttgtcacctgagtttcgtatttggaatcagagttttcatttctcttcatatctttttaccctctttaggcaatggactccagttgagatcgaccagtaacttgaactatttcttgttttaccaatggatgtttaaattagaatattttattggtgttttgttttgatcaatgatcatactactggtattgaacatt

SEQ ID NO: 7024 - DNA, 971 bp, Zea mays
ccatgatttcgctctcttcttcccgtcgagacccaaccataccagcggcgccgcaggctgacgaggaggcggagtagagtggccggactacctcgacacctccactgcaaccatgggtatctcacgtgattcgatgcacaagcgccgtgccaccggtggaaagcagaaggcgtggcgcaagaagcgaaagtatgagcttggccgtcagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtggacatcggtaggaagaagaaggtgcctgttgctaagaaggatgcgactgagggacaagagggtgaggctatagctgaggaaacaaagaagagtaaccatgtgcagaggaagattgagaagcgacagcaggaccgtgcactcgacactcatattgaagagcaatttggcagtgggagattgttggcctgcatttctgcccgtcctgggcagtgtggccgagctgatggctacatccttgagggtaaagagctcgagttctacatgaagaagctccagaggaagaagggcaagggtgttgcatcttagagcattcttttagctagaactgcaaaatatcttctacttgggggttttgttgttagtctttatgcatatcatttgcggacctgatgaacacttcataagtgaatcaactctcgattccaagaattgataattttcacatgcggtggttgtaattgtgatatttaggtttgctatttattgaaacttcttgtct

SEQ ID NO: 7025 - DNA, 1041 bp, Lolium multiflorum
gcgagaccaaaccaaagctgcggcggcgcgggcgtagaaggcggagcagccaccgacgccaccatgggtatctcccgtgactccatgcacaagcgccgggccaccggtgggaagatgaaggcgtggaggaagaagcgaaagtatgagctcggccgccagccagctaacactaagctgtccagcaacaagactgtgaggagggtccgtgtccgtggaggtaatgtgaagtggagggctctccgcctggatactggtaacttctcgtggggaagtgaggctgtgacccgcaagacccgtctcctggatgtggtttacaacgcatcaaacaacgagctggttcgcacccagactcttgtgaagaacgccattgtccaagttgatgctgctcccttcaaggggtggtatctgacacactacggagtggacattggtcgcaagaagaagacaactgctgctgcaaagaaggacgcagctgagggacaagagggtgaggtagctgcaactgccacagaggaggcaaagaagagcaacaatgtccagcggaagctggagaagcgtcagcagggacgcactctggatgcccacattgaagagcagttcagcggtggaaggctgctggcctgcatctcttcccgccctgggcagtgtggcagggctgatgggtacatcctggagggcaaggagctggagttctacatgaggaagctccagaagaagaagggcaagggtgcctctgcttagatcactcctatgtgttatgtggcaggctgcatattttccctgggttttgttagttgtctcgtctatgttgtgtctgccgacgcactaaactctattttatgcaagtgaatctactctagcttggaacaacttagcatgttttgcctgctactgtaaccatgatattcgtcagtctgttgtgttccatttacatctgtcatttacaactttattttaccttgggtttgcggggtgctactgaatcttgctagcatagataggtttattgttcttggctctacattgaaatctggtctcctt

SEQ ID NO: 7026 - DNA, 794 bp, Arnica chamissonis
aagtcggaggctcgccatcaaccctagagcagtatcctccttaatctgcaaacatgggtatctctcgtgattcaatgcacaagcgacgtgccactggtggcaagaagaaggcttggagaaagaagcgaaagtatgagcttggaaggcagcctgccaacactaagatttccagcaacaagactgtaagaagggtgagagttagaggtggtaatgtgaaatggcgggctttgaggttggataccggtaactactcgtggggtagtgaggctgtgacccgaaagacccgtattttagatgttgtttacaatgcatcaaacaatgagttggtcaggacccaaactttagtcaaaagcgcaattgttcaagttgatgctgcaccttttaagcaatggtatcttcaacactatggtgttgatataggccgcaagaagaaaaccgcatccaaaaaggaggcagaggaagctgaaggtgctacggaggagactaagaagagtaaccatgttgtgaggaagcttgaaaaacgtcaagaggagcgaaaacttgaccaacatgttgaagagcaattttcgagtggtcgtcttttagctgcgatctcatcacgccccggccagtgtggtcgtgctgacgggtacatattggagggcaaagaacttgagttctacatgaagaaacttcagaagaagaaaggaaagagtgctgctgcctaagtaatatcagcttatcaagttttctttagattatgctttcttttgattgttagttttgacatttatctgactaagttaatcatgtaa

SEQ ID NO: 7027 - DNA, 882 bp, Artemisia annua
ggaggcgtgaccctaaaccctaaaacaagaccctcttgaatcagccaaaatgggtatatcacgtgactctatgcataagagacgtgccactggtggcaagaagaaggcatggaggaagaagcgaaagtatgagctaggaaggcaggcagccaacactaagatttcctccaacaagactgtacgaagggtgagggttcgaggtggtaatgtgaaatggcgtgcattgaggttggatacaggtaactactcatggggtagtgaggctgtgacccgaaagacccgtattttggatgtggtttacaattcatcaaacaacgagttggtcaggactcagacgttggtgaaaagtgccattgttcaagttgatgctgcaccgtttaagcaatggtatcttcaacactatggtgttgaccttggtcgcaagaagaaagccgctgccaagaaagagggagaggaagctgaaggtgccacagaggagaccaagaagagcaaccatgttgtgaggaaaatagagaagcgtcaagaggaacgcaaacttgaccaacatgttgaagaacaattctccggtggtcgtcttttagctgcaatctcatcacgccctggccaatgtggtcgtgctgacgggtacatattggagggcaaagaacttgagttctacatgaagaagctccagaagaagaaaggaaagagtgccgctgcttaaaaagatatcactttattatattttctttaggttatgctttcttttctttgtcattaaaatgcgcgggacttgaattttgcttgttaggtttgacatgatgactaaatggatcatgtaacatctgctgttgattcatctacattgttccaacttccaatttaatgtgtgcctacagtgct

SEQ ID NO: 7028 - DNA, 696 bp, Bruguiera gymnorhiza
  misc_feature (28)..(28): n is a, c, g, or t
ggcggagatttgggactcgtgaggcagngaaaacctttgaaccctgtctctgcaaaaatggggatttctcgtgattctatgcacaagagacgtgccactggtggcaagaagaaggcttggagaaagaagcgcaagtatgagcttggaaggcagcctgcaagtacaaaactgtctagtaacaagacagtgaggaggattagggttagaggagggaatttgaagtggcgtgctctgaggcttgatactgggaactactcatgggggagtgaggctgtgaccaggaagaccagaattcttgatgtggtttacaatgcatctaacaatgagctggtccgtactcaaaccttggtgaaaagtgccatcattcaagttgatgcatcacctttcaagcagtggtatctccagcactatggagttgacattggtcgcaagaagaaaactgcagtagctaccaagaaggagggagaggaaggtgaagcagcaactgaggaggtgaagaagagtaaccatgtgttgaggaagctggaaaagagacagcaaaatcgccagcttgatccacatattgaggagcagtttggcggcgggcgtttactagcttgtatttcatcacgccctggtcaatgtggccgtgctgatggatatatcttggagggtaaagagctggagttctacatgaagaagatacaaaggaagaag

SEQ ID NO: 7029 - DNA, 1262 bp, Vitis vinifera
cctaaccaaatgggcatgacctctagtccattaggtaaaacaaagaagagcaagggcataaaaataatttcagatattagggttttgttcaaaaccaagcacaccccacttcgttccttcctccaccaaaccctagcctcactgccaaggattagggtctccgggaagaagagaaaccctagaattccccccctctgcaacaatgggtatttctcgagattccatgcacaagaggcgtgccactggaggcaagaagaaggcgtggaggaagaagagaaagtacgagcttgggagacaacctgctagcacaaaactatccagcaacaaaacagttcggagagttagagtgagaggtgggaatgtgaaatggcgtgcactgaggcttgacactgggaactactcttggggcagtgaggctgtgaccaggaaaactcgaatcttggatgtggtttacaatgcatcaaacaatgagttagttcgtacccaaacattggtgaagagtgccattattcaggttgatgcagcaccatttaagcagtggtatctccaacactatggccttgacattggtcgcaagaagaaagcctcagccactgccaagaaagaaggagaggaaggtgatggtcctgctgaggagacaaagaagagcaaccatgtggtgagaaaattagagaagcgtcaacaggagcacaaacttgacccacatatcgaagagcaatttggtagtggccggttgttggctgcaatctcatcccgtcctggtcagtgtggccgtgctgatggatacatcttggaaggcaaggagcttgagttctacatgaagaagatccagaggaagaaggggaagggctcagctgcttaaaattttgtcacctgagtttcgtatttggaatcagagttttcatttctcttcatatctttttaccctctttaggcaatggactccagttgagatcgaccagtaacttgaactatttcttgttttaccaatggatgtttaaattagaatattttattggtgttttgttttgatcaatgatcatactactggtattgaacatttcatttccgttagttatttgctgctgttgcttgccctgggagattaaaatttacccattatttattgatcacttatccatggcttgctcgctgttgtgggaaattgttataccaaacaggaaagttccataggttatttaagctgttccatatcctaaggttagtcaagtatttcccgtatcagttttggaaagctaacc

SEQ ID NO: 7030 - DNA, 1093 bp, Zea mays
ctagcccgcctccgccgccctataatccgacgccggacgccccatgatttcgctctcttcttcccgtcgagacccaaccataccagcggcgccgcaggctgacgaggaggcggagtagagtggccggactacctcgacacctccactgcaaccatgggtatctcacgtgattcgatgcacaagcgccgggccaccggtggaaagcagaaggcgtggcgcaagaagcgaaagtatgagcttggccgccagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtggacatcggtaggaagaagaaggtgcctgttgctaagaaggatgcgactgagggacaagagggtgaggctatagctgaggaaacaaagaagagtaaccatgtgcagaggaagattgagaagcgacagcaggaccgtgcactcgacactcatattgaagagcaatttggcagtgggagattgttggcctgcatttctgcccgtcctgggcagtgtggccgagctgatggctacatccttgagggtaaagagctcgagttctacatgaagaagctccagaggaagaagggcaagggtgttgcatcttagagcattcttttagctagaactgcaaaatatcttctacttgggggttttgttgttagtctttatgcatatcatttgcggacctgatgaacacttcataagtgaatcaactctcgattccaagaattgataattttcacatgcggtggttgtaattgtgatatttaggtttgctatttattgaaacttcttgtctaaagcagttttagtttaccttgaagatgattgttagaaacgagatcctatccaatctatattgctgtttggttttcacttt

SEQ ID NO: 7031 - DNA, 855 bp, Salvia sclarea
ctcttccgtcattgcttaacgtcggaaccctagaacccccaatcgtcaatcatgggtatctcacgggattcaatgcacaagagacgtgcaactggaggaaagaagaaggcatggaggaagaagcgaaagtatgagctcggaagacaaccggctaacacaaagttgtcgagcaacaagacagtgcgcagggtgagagttcgaggaggtaatgtgaagtggcgtgccttgaggttggatacaggaaactattcttggggtagtgaagctgtaaccagaaagacccgtattttggatgtggtttacaatgcatcaaacaatgaactggttagaacacagactttggtgaaaggtgccattgttcaagttgatgctgcaccattcaagcagtggtacctgcagcactatggagttgaaattggccgcaagaagaaggctgctgccaagaaggaaggagaggagacaactgaggctgctactgaagaagtaaagaagagcaaccatgttcaaagaaaactagaaaagcgtcagcaggatcgaaagatcgacacacatattgaagaacaatttggtggtggtcgtctgttggcagccatttcctctcgtcctggccagtgcggccgctgcgatgggtatattttggagggcaaggaatcggagttctacatgaagaaacttcagaggaagaaaggaaagggtgccagcgcttaaattttgccttgagttcattcaaagatgcattttggtgcaaacatttaattgtcttttcatcgcctttctatgtaatgtgccgaaccagaagaggttttatagagttgctttgaacttgaaattgttatacactgttgatttcgtgat

SEQ ID NO: 7032 - DNA, 899 bp, Senecio madagascariensis
aaagacaagtaggtaatacaacgcagagtacgcgggggggaggcgcgagataaaccctagtccaagatccaccggaatctgcaatcatgggtatttctcgtgattctatgcacaagcgtcgtgctactggtggaaagaagaaggcctggagaaagaagcgaaagtacgagctcggaaggcagccagccaacactaagatttccagcaacaagactgttcgtagagttcgggttcgtggtggaaatgtgaaatggcgtgccttgaggttggatactggtaacttttcgtggggtagtgaggctgttacccgaaagacgcgtattttggatgttgtttacaatgcatcaaacaatgagttggtgagaactcaaactttggttaagagtgctatcgttcaggttgatgttgcacctttcaagcaatggtatcttcaacactatggagttgacattgggcgcaagaagaaaaccgctgctaaaaaagagggagaggaagctgaagctaccgaggagaccaaaaagagcaacaatgtggtgaggaaacttgctaaacgtcaagaggaacggacacttgacgaacatgttgaagaacagttctcaagtggtcgacttttggcagcaatctcatcgcgccctggtcaatgcggtcgggctgatggttacatattggaaggaaaagaactcgagttttacatgaagaaacttcagaagaagaagggaaagagcgctgcttaaatgatatcagcttatgaagttttcttcagattatgccgtgttttgtttctcatttaaatgcatgagattttgaattttgtttgttagttttgatattgttactaaatggatcatgtaatctcttactgttgattcaaccatatggttatgattatgtattcattg

SEQ ID NO: 7033 - DNA, 1204 bp, Panax ginseng
cttgcctccgttctgctgcaagtcattttggcgacagaggaggcaaccaccacctgtaaccatgggtatttctcgggattcgatgcacaagaggcgtgccactggaggcaagaagaaggcttggaggaagaagcgaaaatacgagctaggaagacaaccagcaaacacaaagttgtcaagcaacaagacagttaggagggtaagggttcgaggtgggaatgttaagtggcgtgcgttgaggttggatacagggaactactcttggggtagtgaggctgtgactcggaagactagaattttggatgtggtttataatgcatcaaataatgagttagttaggacccagactttggtgaagagtgcaattgttcaggttgatgctgcaccatttaagcaatggtatcttcaacactatagtgtggacattggtcgcaagaagaaaacttctgcttctgctaagaagaaggagaggatggtgacactcctaccgaggaggcaaagaagagcaaccatgtcctgagaaaaattgagaagcgtcgagaagatcgcaagattgatgcacatatagaagagcaatttggaggtggccgtctcttagctgcaatctcatcacgacctggccaatgtggtcgtgctgatggatacattttggagggcaaggagctggagttctacatgaagaaactccagaggaagaaaggaaagggtgccacagcttaaatatttttgaccttaatgaagttttttaaaatttagaattttattctctttgtgatgacatgaaactaaagagagattgagctcttacacttggctatgtttttttaagcctttatatcagtttgtcttgtgatttgaatttaaaggtcagtaaatcaaatgcatgttaaaccctgtaaaacctgtagcattttgaaatttttaatttcattattgattgcaataaagaaacaaatattacaaaattaaaggtaaaaaaaaaaaaaacaaaaaaaaaaaaaacaaaaaaaaaaaaaacaaaaaaaaaaaaacaaaaaaaaaaaaaacaaaaaaaaaaaacaaaaaaaaaaaacaaaaaaaaaacaaaaaaaaacaaaaaaacaaaaacaagaagaagaagaagaagaacgagagagagagacacacacacacacacacacacacaccacacaacaccccccccccccccccccccccccccccc

SEQ ID NO: 7034 - DNA, 868 bp, Panax ginseng
cgtgattcgatgcacaagaggcgtgctactggaggcaagaagaaggcttggaggaagaagcgaaagtatgagcttggaagacaacctgcaaacacaaagttgtctagcaacaagacagttcggagggtaagggttcgtggtgggaatgtgaagtggcgtgccttgagattggatacagggaactactcttggggtagtgaagctgtgacccgtaagactcgaatcctggatgtggtctataatgcatcaaataatgaattggttaggacccagacattggtgaagagtgctattgttcaggttgatgcagcaccatttaagcaatggtatcttcagcactatggtgttgacattggtcgcaagaagaaatcctctgctgctgctgccaagaaagaaggagaggagggtgatgttcctatcgaggaggcgaagaagagtaaacatgtcctgagaaaaattagaaaagcgtcaagaggatcgtaagattgacgcacatattgaagagcaatttgggggtggccgtctattagctgcaatttcatcacgacctggccaatgtggtcgtgctgatggatacatcttggagggcaaggagctggagttctacgtgaagaaactccagaggaagaaaggaaagggtgctgcagcttaaaattttgtgacctgaatggagttgcaattcagaacatttctgttttctgttttactttttcagagatggaaccaaagaactattcagctctcatagttggctttgtttcttgtcacgtctctgagtgttaaaggagaattttagcatcatctttaattttcaacagtggtagtattattgacttaatttcagttttattattatatgcttggtttt

SEQ ID NO: 7035 - DNA, 846 bp, Arachis hypogaea
ctatgcacaagaggcgcgccactggtggcaagaagaaggtttggaggaagaagagaaagtatgagcttggaaggcaaccagcaaacacaaagctctccagcaacaaaactgttaggaggatcagggttcgaggtgggaatgtaaaatggcgtgctttgaggcttgacactgggaactactcttggggtagtgaagctgtgactcgcaaaacgaggattctcgatgtggtgtataatgcctccaacaatgaacttgttcgaactcagactttggtcaagagtgccatcgttcaggttgatgctgcacctttcaaacagtggtatctccagcattatggtgtcgacattggtcgcaagaagaagggtgcaacttctggcaagaaagaaggggaggatgctgaaactgcaaccgaagaagtgaagaagagtaaccatgtcttgagaaagttggagaagcgtaaacaaacccgggtgcttgattcccacattgaagaacaatttggaagtggtcgcctcttggctagtatctcatcccgccccggtcaatgtggtcgtgctgatggatatatattggagggcaaagagcttgagttctacatgaagaagcttcagaaaaagagggcaagggtgctgcttaagatgttgtatttcctccattttagttttctttgaattatcttgttgaaactattacatcttagacaatcaaggtgatcattttgctagaatgtctactttctatgggttgttttggtagtgatgttgggttgtaaacaaaacccggaactttgaactgtttaatgatattgatagtgagtcctaatttaaaattaaaaaaaaaaaaaaa

SEQ ID NO: 7036 - DNA, 915 bp, Persea americana
ctcaatctcagtctcatagagggagagggagagggagagggacaggatcttcgcctcgctgattagtaaatatgggtatctcccgagattcgatgcacaagaggcgtgccacaggtggaaagaagaaagcttggaggaagaaaagaaagtatgagcttggtcggcagccagcaaatacaaagctctctagcaacaagacagtgagaagagtccgtgttaggggagggaatgtgaaatggcgtgccctccgattggacactgggaattactcttggggtagtgaggctgttacccgtaagacccgtatacttgatgtggtctacaatgcctcaaacaatgagcttgttaggacacagacactggtgaaaagtgccattgttcaggttgatgctgctccattcaagcagtggtacctgcagcattatggtattgacatcggcaggaagaaaaaggctccggcttccaagaaagaagcagtggagggacaagagggtgatgctgctgcctctgagcaagcgaagaagagcaaccatgttattaggaagcttgagaagcgtcaacagggccataaacttgatccccatattgaggagcagtttagcggtggcaggttgttggccgccatatcttctcgccctggtcaatgtggcagagctgatggatacattctagaaggaaaagagctagagttctacatgaagaagatccagaggaagaagggcaagagtggtgctggtgcagctgcttaaatcaatctgctctaggttttttgttctttacttagattcagattttattatgtagtgtttgctgtctagggaatcatggttcagtggatcccaactggctgacatagatgtctgaaattttgttatgcattttagtgtgagagttacatatactgtttgctgcttt

SEQ ID NO: 7037 - DNA, 714 bp, Vaccinium corymbosum
cgaagaggtcgcctctcgactgatcagcaaacatgggtatctctcgggactccatgcacaagaggcgtgccactggtggcaagaagaaggcttggaggaagaagcgaaagtatgaactcggtcgtcaacctgcaaacactaagctctcaagcaacaagacagttaggagagtccgtgtgcgtggtggcaatgtgaaatggagggccctcagattggacactgggaattattcatggggtagcgaggctgtgactcgtaagacccgtatgcttgatgtggtttataatgcatcaaacaatgaacttgttaggacacaaactctggtgaagggtgcaatcattcaggtggatgcagccccatttaagcagtggtatcttcagcattatggtgtcgatattgggaggaagaagaaagggccaattaagaaggaagctgctgaggagggagaaggtgtggctgctgaggaagctaaaaagagcaatcatgtcgtcaggaaaattgagaagcgccagcagggtcgtaaactcgatcctcatattgaggagcagtttggtggcggtaggctgttggcctgcatctcttcccgcccaggtcaatgtggcagagctgatggatacattctggagggtaaagagctcgagttttacatgaagaagctccagaggaagaaaggcaagggtgcagcaggtgccgctgcttaaatgagagatggcc

SEQ ID NO: 7038 - DNA, 1366 bp, Mimulus guttatus
gttgctggcagtaccgccgtctttacacctctgatcggagcttagaaatcctccgccggcaatcatgggtatttctagggattccatgcacaagaggcgtgaaactggaggaaagaagaaagcctggaggaagaagcgaaagtacgagctcggaagacagccagcgaacacgaagctgtcgagtaacaagacggtgcgtagagtgagggtgcgtggtggtaatgtgaagtggcgtgcgttgaggctcgatactggaaatttctcttggggaagtgaggctgtgaccaggaagacccgtattctcgatgtggtttacaatgcatcgaacaatgagttggttaggacaaagactttggtgaagagtgctattattcaggttgatgctgcgcctttcaagcagtggtatcttcagcattatggagttgacatctctcgcaagaagaaggctgctgtcaagaaggaaggagaggaggctgaggctgctgccaccgaagaggcaaagaagagcaaccatgtgcataggaaaatcgagaagcgccaagaagagcgtaaaatcaacacacatattgaggaacaattttgcagtggtcgtttgttagctctgccatttctccatgcccaggccagtgcggtcgcgctgacggttatattctggacgggaaggagttggagttttacatgaagaaaatctagaagaagaaaggaaagggtgcaactgcataagctgctgtcttgtgctcttgtgctgattatggaagttttccgaaccaaatccttaatttcatattttatgtttatctttcgagagagcagaacaatagtttggttgatctttgttaacctgaacctatgtgcggaaatacttcatgaaggcgaagatgatgaaaatgaagaagatgatcataacggggtaacggggaacagatgaatgaggacgagggggagaagaatgaggacgagagagatagacaggcacttgttgtctacgttctccatggttaagaggattggacacataggtgaccgcggggtgaagagaaaagagcttgattttgtcactccgggatccactacactggcgcaacggagagatcgacgtggacagggacgtggtaggggacgcgttagtcctttatcagttgagaaattgcagatgtcatggacgattcactttcacagtataaagggcaactcggttacacaaggcgggttgagattcaagatcggaaaagagcggtcattgatgaatttattatgcgaggtgacttgtacgacaaggatcccgagaatcaaaagaggaagagaaaagatataaaataaaatatcaacgcaggccaaacgatatacaaggtaatcctatttcctc

SEQ ID NO: 7039 - DNA, 1150 bp, Solanum lycopersicum
atttttcttttgaatgttgggccaaacgaacggagtattatggcaaggcaacgaatgagaaaagaatagtaaggcccaagattgaaaggcagcagtcatagtaaaagtagggttttggtgtgttcgtgcttcctacaaagtgaaagagaagtggtgtcgtctgcctcttcgcggctaagctttcagcaaccatgggtatctcacgagactctatgcacaagaggcgtgccactggtggcaagaagaaagcgtggaggaagaagcgaaagtatgaacttggccgccagcctgctaatactaagctctcaaataacaagacagtcagacgaatccgtgtgcgtggtggtaatgtaaagtggagggcactgagattggatacaggaaattactcatggggtagtgaggcagtcacacgtaaaactcgtatccttgatgtggtttacaatgcctcaaacaatgaacttgttcgtacacaaacactggtcaagagtgcaattattcaagttgatgctgcaccatttaaacaatggtacctccagcattatggtgctgacattggtaggaagaagaaggggcccgctaagaaggatactactgaggaaggagaagctgctgctgccgaggaaactaagaagagcaaccatgttcagaggaaaattgagaatcgccaaaaggaccgtacacttgatcctcaccttgaagagcaatttggtggtggtaggcttttggcctgcatctcttcacgccctggtcaatgtggcagatgtgatgggtacattttggagggaaaagagcttgagttctacatgaagaaactacagaagaagaaaggcaaaagtggagctggtgctgctgcttaactggtgcaatcagactagtttcatatggttctctattgttgtaattccaattttggggatatgtgattttgtattcagtaccttttattttctctcttgtactcttgccaaattttagtatgatctccttgactactactctttagcattatcagtttttccatggtcagtcccactttctcttgaaggttttgtgaattaagtgggaatgatattcatggtcagttttgtctggtggagtggtttcctgcattgctatttaatagagcagtgtgattaaatgttgccat

SEQ ID NO: 7040 - DNA, 1273 bp, Citrullus lanatus
tccctagcaatgcacaacaatgactacttatgccatagaactgagagtaaatgggatctggaaagtgtaaggcccttgaagacggattctagaagaaaatagatgggtttcagctgaaaatataaaggcctcagctctattgggaaatctgctttaattgtcagacttgaactcctcatcttagatagattttcctgctttttactttacacgtttgcttttgaaggtgtaggttttaggttccggtggcagtttgctaatactctcacttgtttcctaacaggaattttagaccttctccgcccgcaagagccctcccctctccaagatgggtatgttagatatattcatattgtttcatttgtgacttcgtttttctttttgttaatcttggaggactttgtttataggtatttcacgtgactctatgcacaagagacgtgcgacaggaggaaagaagaaagcttggaggaagaagagaaagtatgaacttggaaggcaacctgccaacactaagttgtccagtgacaagtcaatcaggaggatcagagtccgtggtggtaatgttaagtggcgtgcttttaggcttgatactggaaactactcttggggcagtgaggctgtgaccagaaagacccgtattcttgatgtggtgtacaatgcatctaacaatgagcttgttcgtactcaaaccttggtgaagagtgccatcgttcaggttgatgcagcaccattcaaacagtggtatcttcagcattatggagtggatattggacggaagaagaagacctcagcatctgccaagaaggaagaggaaggtgatgctcccagtgaggaggtgaagaagagtaaccatgtccaacgcaagctggagaaacgtcagcaggatcgtaaacttgaccctcatattgaagaacaattcagcagtggtcgtttgatggcttgtatctcatcaagaccgggtcaatgtggccgagcagatggatacatcttggagggtaaagagcttgagttctatatgaagaaacttcaaaggaagaagggaaaaggagctggtgctgcataaattgtcaccaagatgttttctccgtgcgtttaccatttcattgcccttttcttcttatgaatacgattagttattgcagctgagattaaagagtaatttaggaacttcagttttgatggtgttagcttgttcaattacaatacttcagttcttttcaagtttttcttgaacttttgatcttacaaatcgtttaacaatcacttgatt

SEQ ID NO: 7041 - DNA, 910 bp, Zostera marina
agggtcgtccgtcgccgcggagaagaataatttctatcgccgagcagccttcaatatgggtatctcccgtgattcaatgcacaaacgccgtgccactggtgggaagaagaaggcgtggagaaagaagcgaaagtacgagcttggacgacaggcagccaacacgaagttatccagcaacaagacagtgaggagagtccgtgttcgtggtggaaatgtgaagtggagagccttgcggttggatacgggaaatttctcatggggtagcgaagcagtaaccaggaaaacacgtcttttagatgttgtgtacaatgcttcaaacaatgagcttgtgagaacgcaaactcttgtgaagaatgccattgttcaggttgatgctgctcctttcaagcagtggtatcttcaacactatggtgtagatgttggtaggaagaagaaggttactgctgttaaaaaggacactgagggagtagaagcagtagtagaggaagcaaaaaagtaaccatttggcaaggaagattgagaagcgccaagaagatagaaagcttgactcacacattgaggaacaattcggtggtgggagattgcttgcctgcatttcttcgagacctggtcaatgtggccgttgtgatggctatatcttggagggtaaagagcttgaattttatcagaagaaattacaaaagaagaagggcaaaggtgctactgcctaagctgtttgattattttcccttgcatttcatgtgtttttgagttgactctggatgagtttctcttttttatttaagacttgtgtttttgcagtattttgtttcaaattatgaatcaaggattttgtttcctaattaatttacagttattgtagaaaaggcttcgaaaaatcagaagttatttatctcttataaaaattatt

SEQ ID NO: 7042 - DNA, 950 bp, Aquilegia formosa
aagagagagagagagaggtaaggaggtagtctcaatcatttgaagaagaagaggtagagaggcgtctacctcgcagattcagcaaacatgggtatctctcgtgattctatgcacaaaaggcgtgcaactggtggaaagaagaaagcatggaggaagaagaggaagtatgaactcggtcgccaacctgcaaatacaaagctctctagcaacaaaacagttagaaggatacgtgtcagaggaggcaatgtgaaatggagagctctcagattggatacaggaaactactcatggggtagtgaagcggtcacccgaaagactcgtgttcttgatgtggtatacaatgcctcaaacaatgagcttgttagaactcagaccttggtgaagagtgctattgttcaggttgatgctgccccatttaggcaatggtacagtcagcactatggcgttgatattggaaggaagaagaaatctactgccaagaaggaagctacagaggaaggagatgctcctgcagaagagacaaagaagagtaaccacgtgcttaggaaaattggcgaccgtcagaaggatcacaaacttgacgctcacatagaagaacagtttggagggggcagattgttggcctgcatctcttctcgtcctggtcaatgtggtagagctgatgggtatattttggagggcaaggagctggaattttatacgaaaaagcttcagcgaaagaagggcaagggtgctggtgctacagcctaagcaaaacattttgtttttattctttttgtaatcttgtttttggatatgagctacttgtgagatttagatctcagtttttgtttctctacctagtatttattatggttgaaactagcgttgacatctatccattagaggacttgaactctgtttaatccacatgatgctattctggtttttatttatttagtaatattcac

SEQ ID NO: 7043 - DNA, 1012 bp, Vaccinium corymbosum
actctcagttgccgactccagaaaccctagagatcctctctctcatctgcaaccatgggtatctcacgggattcaatgcacaagaggcgtgcaaccggaggcaagaagaaggcgtggaggaagaagcgaaagtacgagctcggaagacaacctgctaacacaaagttgtgcaaggacgcaaagactgtaaagacagttcgcagaataagagttcgtggtggaaatgtgaagtggcgtgcactaaggctggatactggaaactactcttggggcagtgaggctgtgacacggaagactcgaattttggatgtggtttataatgcatcaaataacgagttggttcgaacccagtcgttggtgaaaagtgcaattgttcaggttgatgctgcaccgtttaagcagtggtaccttcagcactatggagtcgacattggtcgcaagaagaaatcttcttctgccaagaaagaaggagaggaggctgatgcggcacctgctgaggaggtcaagaagagcaaccatgttgtgagaaaagtggagaagcgtcaacaggatcgcaagatcgatccccatgttgaggagcaatttggcggtggtcgtttgttagctgcaatttcatccagacctggccagtgtggtcgtgctgatgggtacatattagagggaaaagagctggaattctacatgaagaagattcagaagaagaagggaaagggtgctgctgcttgatgcgcttttcggttttgttacctgaacttaatcctagaattaagaggctacttatttcccaattagttcttttttctttaattcgcaaggcatgggatggttggttgagttcagagttagcttcaaaattttggttctcattttgttgaatgttaaatgattattatcatactttggttttcgcctgcgagaattgatcaagtagcttatatttttacttcgttaattaccaaatcaatcggggtgaatgaaactgttggtgatgactgttatgtcttttaagtac

SEQ ID NO: 7044 - DNA, 1054 bp, Vaccinium corymbosum
aaccctccatctctatactctcagctgccgactccagaaaccctagagatcctctctctcatctgcaaccatgggtatctcacgggattcaatgcacaagaggcgtgcgactggaggcaagaagaaggcgtggaggaagaagcgaaagtacgagctcggaagacaacctgctaacacaaagttgtgtaaggacgcaaagactgtgaagactgttcgcagaataagagttcgtggtgggaatgtgaagtggcgtgcactaaggctggatactggaaactactcttggggcagtgaggctgtgacgcggaagactcgaattttggatgtggtttataatgcatcaaataatgagttggttcgaacccagtcgttggtgaaaagtgcaattgttcaggttgatgctgctccgtttaagcagtggtaccttcagcactatggagtcgacattggtcgcaagaagaaatcttcttctgccaagaaagaaggagaggaggctgatgcggcacctgctgaggaggtcaagaagagcaaccatgttgtgagaaaagttgagaagcgtcaacaggatcgcaaaatcgatccccatgttgaggagcagtttggcggtggtcgtttgttggctgcaatttcatccagacctggccagtgtggtcgtgctgatgggtacatattagagggaaaagagctggaattctacatgaagaagattcagaagaagaagggaaagggtgctgctgcttgatgcgctttcggttttgttacccgaacttaatcgtagaattaagaggctacttatttcccaattagttcttttttctttaattcgcaaggcatgggatggttggttgagttcggagttagctttcaaaattttgattctcattttgttgaatgttaaatgattattatcatactttggttttcgcctgcgagaattaatcaagtagtagcttatatgtttacttcgttaattaccaaatcaagcggggtgaaactgttggggatgactgttatgtcttctaagtcattcaaggaaaacctttaaattcctttt

SEQ ID NO: 7045 - DNA, 1029 bp, Platanus occidentalis
gagaggaagagggagaggtgctgagtagagttcttcgaccttagccgctctacaaagatgggtatctctcgagattctatgcacaagaggcgcgccactggagggaagaagaaggcttggaggaagaagagaaagtacgagcttggccgtcagcctgccaacactaagctttcaagcaacaagacggtgaggagagtccgtgtgaggggaggaaatgtgaaatggagggctctcagattggacaccgggaattactcgtggggaagtgaggctgtaactcgtaagacccgtctccttgatgtggtttacaatgcctcgaacaatgagcttgtcaggactcagaccctggtgaagagtgcaattgttcaggttgatgctgccccgttcaagcaatggtatcttcagcactatggtgttgatattggtaggaagaagaaggcggttgctgccaagaaagaaacgacagaggagggagaaggtactactgcagaggaaaagaagaagagcaatcatgttgctaggaaaattgagaaacgtttgcagggtcataagctcgatccacatattgaagagcagtttggcggtggcaggttgttggcatgcatctcatcccgccctggtcaatgtggcagagctgatggatacatcttggaaggaaaggagctcgagttctatacgagaaagctccagaggaagaagggcaagggtgctgctggtactgcttaactgtgttgtttttttctacaggtgttttgcttctaccctccctggagttagtttgtctctgttttgttgtttttctctgcctaggaggataatgtgttcgaattgatcacacagctggtacaatgtttttaaatgttgactgcatttttagttattatagatgagaatatttagttaatgtgtcgtcatattttgaatctaatgtattagcaagtttgttattttcatccgtgccatcttttatttcctttcatcaggaacatatctatattgaaaagtatacttttgcaagtgtttgataat

SEQ ID NO: 7046 - DNA, 989 bp, Solanum tuberosum
gtgtggttctcgctccctacaaagtgaaagagaagtgctgtagtcttcctcttcgcggctaagctttcagcaaccatgggtatctcacgagactctatgcacaagaggcgtgccactggtggcaagaagaaagcgtggaggaagaagcgaaagtatgaacttggccgccagcctgctaatacaaagctctcaaataacaagacagtcagacgaattcgtgtgcgtggtggtaatgtaaagtggagggcactgagattggatacaggaaattactcatggggtagtgaggcagtcacacgtaaaactcgtatccttgatgtggtttataatgcctcaaacaatgaacttgttcgtacacaaacactggtcaagagtgcaattattcaagttgatgctgcaccatttaaacaatggtacctccagcattatggtgctgacattggtaggaagaagaaggggcccgctaagaaggaaactacggaggaaggagaaggtgctgctgctgccgccgaggaaactaagaagagcaaccatgttcagaggaaaattgagaatcgtcaaaaggaccgtacacttgatcctcaccttgaagagcaatttggtggtggtaggcttttggcctgcatctcttcccgccctggtcaatgtggcagatgtgatgggtacattttggagggaaaagagcttgagttctacatgaagaaactacagaagaagaaaggcaagagtggagctggtgctgctgcttaactggtgctaccagaatcttcagactagtttcatattgttgtaattccaattttggggatatgtgattctgtatgcagtaccttttattttctttcttgtactcttaccaaagactacttttctttatcattatcagcttttccatggtctgtcccagtttctcttgaaggttttttggattaagtgggaatgagattcatgatcagttttgtctgaaaaaaaaaaaaaaaaaactcgag

SEQ ID NO: 7047 - DNA, 979 bp, Solanum phureja
gggttttggtgtgtggttctcgctccctacaaagtgaaagagaagtgctgtagtctgcctctttgcggctaagctttcagcaaccatgggtatctcacgagactctatgcacaagaggcgtgccactggtggcaagaagaaagcgtggaggaagaagcgaaagtatgaacttggccgccagcctgctaatacaaagctctcaaataacaagacagtcagacgaattcgtgtgcgtggtggtaatgtaaagtggagggcactgagattggatacaggaaattactcatggggtagtgaggcagtcacacgtaaaactcgtatccttgatgtggtttataatgcctcaaacaatgaacttgttcgtacacaaacactggtcaagagtgcaattattcaagttgatgctgcaccatttaaacaatggtacctccagcattatggtgctgacattggtaggaagaagaagggtcccgctaagaaggaaactactgaggaaggaggaggtgctgctgctgctgccgaggaaactaagaagagcaaccatgttcagaggaaaattgagaatcgtcaaaaggaccgtacacttgatcctcaccttgaagagcaatttggtggtggtaggcttttggcctgcatctcttcccgccctggtcaatgtggcagatgtgatgggtacattttggagggaaaagagcttgagttctacacgaagaaactacagaagaagaaaggcaagagtggagctggtgctgctgcttaactggtgctaccagaatcttcagactagtttcatattgttgtaattccaattttggggatatgtgattctgtatgcagtaccttttattttctttcttgtactcttaccaaagactacttttctttataattatcagcttttccatggtctgtcccagtttctcttgaaggttttttggattaagtgggaatgagattcatgatcagttttgtctgataa

SEQ ID NO: 7048 - DNA, 989 bp, Solanum phureja
ccagctcttgtagcgccgtcgtccgtctttgagaaaatctaaaccctaaggacctccgtcaccggcgacaatgggtatctctcgtgattctatgcacaagagacgtgccactggaggaaagaagaaggcttggaggaagaagagaaagtatgagcttggcagacagccagcaaacacaaagctggtgccaaatgctaagactgttagaaggataagagtccgcggaggtaatgtgaagtggcgtgctttgagattggatactgggaatttctcttggggtagcgaggctgttacaaggaagactcgtctgttggatgtggtatataacgcctctaacaatgagttggttaggacacaaaccctggtgaagagtgcaattattcaggttgacgcagctccatttaaacagtggtatctccagcactatggagttgagattggtcgcaaaaagaagactgctgcttccaagaaggaaggagaggaggctgaggctgtagcagaggagaagaagagtaaccatgtccaaagaaagctggaaaagaggcaacaggatcgcaagattgacccacatgttgaggagcaatttgctagtgggcgtctattggctgcaatctcatcacgacctggccagtgtggtcgtgctgatggttacatcttggaaggaaaggaacttgagttttacatgaagaaacttcagaagaagaaagggaaggctgccggtgctgctgcttagagctgcaggctccaatttttaaattatcagaaccaattagattttggtttttcttccctattcaacaacagtctcacttcattgaaagggaatgataaacttcttgtatcagagttagattcaagtttgttttgcatatggttaactgagaattttgagaacaacctactttatggaaaaaaagaattttgagaacagccttaattgcatcattaactgttttcttaatcagtgttaagatggaccttctgctgaa

SEQ ID NO: 7049 - DNA, 941 bp, Nicotiana tabacum
gcgctcgttcgaagtagaagagagttgtgagggtgtgtatcttagctgcttagctctcagcaaccatgggtatatcacgagattctatgcacaaaagacgtgccactggtggcaagaagaaagcttggaggaagaagcgaaagtacgagcttggccgtcaacctgctaatactaagatctcaggtaacaagacagttagacgaattcgtgttcgtggtggcaatgtgaaatggagggcactgagattggatacaggaaactattcatggggtagtgaggcaaccacccgtaagactcgtatccttgatgtggtctacaatgcctcgaacaatgaacttgttcgcacgcagactctagtcaagagtgcaatcgttcaggttgatgcagcaccttttaaacagtggtacctccagcactacggtgttgacattggtaggaagaagaagggggctgctaagaaagaaactgtcgaggagggagagggtgctgctgctgctgcagaggaaactaagaagagcaaccatgtagcccggaaacttgagaagcgccagaaggatcgcaaacttgacgctcaccttgaagaacaatttggtgctggtagactcttggcttgcatctcatctcggcccggtcagtgtggcagagctgatgggtatatcttggaaggcaaagaacttgagttctatattaagaaattacagaagaagaagggcaagactggagctggtggagctgcttaattgatgctcttagatttttgagactaatttatatgtttttcctttttacccgttaatcaacttggtttgtgaggatatttttctatatgcagtattctttaatcttaccatgagttgacgttgatgcctggacttcatctgttattgttggcgttgattagttgtttcagtttcttctgaaaatcttttgccacattttta

SEQ ID NO: 7050 - DNA, 910 bp, Nicotiana tabacum
ctacaagtgtagtagagagtagaccagcgtgtgaggagtgaagtcggcttaagcattcagcaaacatgggtatctcaagagattctatgcacaagagacgtgccactggtggaaagaagaaagcttggaggaagaagcgaaagtatgagcttggccgccagccagctaatactaagatctcaggcaacaagacagtcaggcgaattcgtgtgcgtggtggtaatgtgaagtggagggcactgagattggacactggaaactattcatggggtagtgaggcaaccacacgcaagactcgtatccttgatgtggtttacaatgcctcgaacaatgaacttgtccgcacacaaacactggtcaagagtgcaattgttcaagttgatgctgcaccatttaaacagtggtatctccagcattatggtgttgacattggtaggaagaagaagggggctgctaagaaggaaactactgaggaaggagaagctgctgcacctgctgaggaagccaagaagagcaaccatgtagcccggaaacttgagaaacgtcagaaggatcgtaaacttgatcctcatctcgaagagcaatttagtgctggtaggctatatgcctgtatctcatcccgccccggtcaatgtggcagagcagacgggtacattttggaagggaaagagttggagttctatatgaagaaacttcaaaagaagaaaggcaaggctggatctggtgctgctgcttaagaggagctttcagaatttccagactagcttaattttttttttttttgggttaatcgatcagctttatttcagaggttggctttttttctcatactcttgtgcgacactaaaagttgagacatggactttgctgttacctcaatctttagtttgaaattttacttccaattgac

SEQ ID NO: 7051 - DNA, 880 bp, Nicotiana tabacum
gcgctcgttcgaagtagaagagagttgtgagggagtgtctcttggctgcttttagctctcagcaaccatgggtatctcacgagattctatgcacaaaagacgtgccactggtggcaagaagaaagcttggaggaagaagcgaaagtacgagcttggccgtcaacctgcgaatactaagatctcaagtaacaagacagtcagacgaattcgtgttcgtggtggcaatgtgaaatggagagcactgagattggatacaggaaactattcatggggtagtgaagcaaccacccgtaagactcgtatccttgatgtggtctacaatgcctccaacaatgaacttgttcgcacacaaactctagttaagagtgcaatcgttcaggttgatgcagcaccttttaaacagtggtacctccagcactacggtgttgacattggtaggaagaagaagggggctgctaagaaagaaactgccgaggagggagaaggtgctgctgctgctgcagaggaaactaagaagagcaaccatgtagcccgaaaacttgagaagcgccagaaggatcgccaacttgatgctcaccttgaagaacaatttggtgctggtaggctcttggcctgcatctcatctcggcccggtcagtgtggcagagctgatgggtatatcttggagggcaaagaacttgagttctatatgaagaagctacagaagaagaagggcaaggctggagctggtggagctgcttaattgaagctcttagatttttgagactaatttatatgtttttcatttttacctgttaatcaacaacttggttttgtgaggatatttttctatatgcagtattctttaatcttaccatgagttgacgttgatgcctggact

SEQ ID NO: 7052 - DNA, 883 bp, Valeriana officinalis
ctcattctcgttctaatctgcaatcatgggtatctctcgtgattccatgcacaagaggcgtgccactggaggcaagaagaaagcatggaggaagaagcgaaagtatgagttgggaagacagccagcaaacacaaagttggttacaggaactgcaaacaagacagtgaggagggttagggttcgaggaggcaatgtgaagtggagagccttgagattagatacaggaaatttctcatggggaagcgaagctgtcacaagaaaaactcgtctgttagacgtcgtttacaacgcgtctaataatgagcttgtcaggactcaaaccctagttaagggtgctattgttcaagttgatgcagcaccgtttaagcaatggtatcttcaacattatggtgtcgatatcggccgtaagaaaaaaaccgtcgcagctgccaagaaagaagctgaggatggtgaatctgctgctgttgaggaggcaaagaaaagtaaccatgtggtgaggaaaatcgaagagcgtcaaaaagatcgcaaacttgatcagcatgttgaggagcagtttagtggtggtcgtcttttagcttgcatttcttctcgtcctggacagtgcggtcgtgctgacggatatattttggaaggaaaagagttggaattctacatgaagaagcttcagaagaagaaagggaagagtgctggtgcagcttaaatctcttttagtacttttacaaggcatgaatatgaattttgaagttagattgagatgtctcatagttttgttttaatcgtttcacattgtcttttggaaaattttgatgttcatggaaaatgttacttcaggtcttgattttattttcaaatgaattagcttcgttgtttactcagaaaaaaa

SEQ ID NO: 7053 - DNA, 1007 bp, Juglans hindsii x Juglans regia
cgctgtggcctgctgatgagccgaagaagccagaggcgctgaagaagaacaagagcttgtactcttcgatctccctctccaatccgcaaccatgggtatctcgcgtgactctatgcacaaaaggcgtgccaccggaggcaagaagaaggcatggaggaagaagagaaagtatgagcttggccgccagcctgctaatactaagctttcaagcaacaagacggttaggcgaattcgtgtgagaggaggtaatgtgaagtggagagccctcagattggatactgggaactactcatggggtagtgaagctgtcacccgcaaaacacgtatactggatgttgtttacaatgcttcaaacaatgagcttgtgaggacacaaactctagtgaaaagtgctattgttcaggtggatgctgccccattcaagcagtggtaccttcagcactatggagttgacattggtaggaagaagaaggcagctgctaagaaggaaaccccagaggaagtagaagcagctacagaggaagcaaagaagagtaaccatgtccttaggaagcttgagaagcgccagcaaggtcgtaaacttgatctccatattgaagagcagtttgggagtggtagattgttggcttgcatctcttctcgaccaggacaatgcggtagagctgatggatacatcttggaaggaaaagaactggaggtctacatgaagaagctacagagaaagaaagggaagggtgctggtgctggtgccgcttgagcagtttgtcgttatgcggagtattgtctttttttcttttattgttttagttgcacttttttggcctgcctagatgaagattttgcttggcatgtctagttgtttcaaagtaaatgctttgagcacgttttgatccacaagtcagtttataagctaaaataacacttgtttggtgctggcttcaatatccgtcattagtttgtggtattattaattttttgaaaaagtagctgtcatttgttcttcatgc

SEQ ID NO: 7054 - DNA, 929 bp, Citrullus lanatus
attttgtggataggtatctctcgagattctatgcacaagagacgtgcaactggagggaagaagaaggcttggaggaagaagagaaagtatgagctcggaaggcaacctgccaacactaagttatctagcgataagtcaatcaggaggatacgagttcgtgggggtaatgtgaagtggcgagcttttaggcttgatactggaaactactcatggggtagtgaggctgtgactaggaaaacccgtattcttgatgtggtttacaatgcatcaaacaacgagcttgttcgtactcaaactttggtgaagagtgccattgttcaggttgatgccgcaccattcaagcagtggtatcttcagcactacggagtggatattggaaggaagaagaagtctgcagcatctgctaagaaggacgaggaagctgatgctgctgctaccgaggaggtgaagaagagtaaccatgttcagcgcaagctggagaaacgtcaagagggtcgtaagctagacccacatattgaagagcaattcagcagtggtcgtttgatggcttgtatttcatcaaggccaggccaatgtggtcgagcagatggatatatcttggagggcaaagaacttgaattctacatgaagaagctccagagaaagaagggaaagggtgcaggtgctgcttaatttttgtcgttaagatattttctggccgtgtttccttttctatgattctatctgcccttttttttttttttttgtctaatgaagaccataagttgttgcagctaagatgaaacaattatttatgaactccaattttgctggtattggttgtttaatcacattactttctttagtcctttttgtgatcacaaccgcttgtttattagcttaaaattttctcaagtgccccgacctgtttctgggcgatcttgatttaa

SEQ ID NO: 7055 - DNA, 1132 bp, Amsonia hubrichtii
agaaagcttgacgcggaggagaagctcgtctctcggaaaaaatgggtatctcacgagactctatgcacaaaaggcgtgccactgggggcaagaagaaagcttggaggaagaagcgcaagtatgagcttggtcgtcagccagcaaacacaaagctatccagcaacaaaactgttaggagaatccgtgtcagaggaggtaatgtgaaatggagagccttgaggttggacacaggaaactactcatggggtagcgaggctgtcacacgtaagacccgtattcttgatgtcgtctacaatgcctcaaacaatgagctggtgcgtactcagactcttgtgaagagtgcgatcgtccaggtagatgctgccccatttaagcagtggtacctccaacactatggtgttgacattggtaggaagaagaagggaactattaagaaggatgctaccgaggagggagaagctactgttgaggaaactaagaagagcaatcatgttcagaggaaacttgaaaaacgtcagcaaggtcgcacccttgatcctcacattgaagagcaatttggtgctggtcgactgcttgcatgcatctcttcccgcccaggacagtgtggcagagcagatggttacatactggagggcaaagagcttgagttctatatgaagaaactccaaaggaagaaaggaaaggctgctggtggtgctgcttaaatccaattcctttattactctgttgcagtctcattaatagttctggaattttcatgcttcctttgagcctcttggctggcattattgataatttgatgtggaagcagaaaagtgcctgaacatttcttgtcgtcaggcactgagaatttttgacgattatacttttgcctagaatttcgttttcgtcagccctgattcaaatttacctctcatgcaatgaatcagcaacgagtttttatacttccattacactcttttattgcaactagtatcctttgcattattgttacatttttaatgacttggaagaaccatcatagcatctgtcggaccatctttttgtgttgcaagcttgccacttatctttctctaggcatttttgatgtgcgagacacgagtgagttaggataacatgtatgatgtgtgta

SEQ ID NO: 7056 - DNA, 1039 bp, Cephalotaxus harringtonia
agaggattcagctcgacggaggtgcaagggatctgcaggcgctgcaccccattcggcagtcatgggtatctcacgagattcgatgcacaagagacgtgcgacgggaggaaagaagaagcagtggagaaagaagcgaaagtatgagttgggaaggcagcctgctatgacaaaactttcaagcaacaagacagttagaagggtacgagtgagaggaggaaatgtgaaatggagagctctgaggctcgatactggcaattactcgtggggatcggaggcagtcactaggaagacccgaatattggatgtggtttacaatgcttctaacaacgagcttgtgagaacacaaaccttggttaagagtgccattgttcaggttgatgctgcgcctttccgtatatggtatcatcagcattatggtctggaaattggcaggaagaagaaggctcctgctgctggtgtttctaagaaagaaactgaggagggagaagctgctgctgcagcagaagaagagaagaagaaaagtgcacatgtgatgagaaagattgagaaacgtcttgaaggtcacaaacttgacccacatatggaagagcagtttgctggcggtaaattgatggcatgcatctcctctcgacctgggcagtgtgggcgtgctgatgggtacatccttgagggtaaggagcttgaattttacatgaaaaagttacagaggaagaagggaaagggtggtgctggtgctgcttaagcaatcaattttggtttctggaggcatttgtgcaacttagaaacatcttgatttggctgttttttaacagtatttttcctagtaaagtcaaacgtgatttagtggcagactgagggtaaccatttctggtaatgaccagggatgaatatttttgtgttaagtcatttttaacaacttggtgtatactactgcaaatttgatagatgactggttgcttttatttccagcatttagaaataaaatgtcaacagtcaagaaccatgttgtttaaatttctgtgttattagaatacattgg

SEQ ID NO: 7057 - DNA, 908 bp, Eschscholzia californica
accaagagagagaaacttgaggggttcgatctgcaatcatgggtatttcacgagattctatgcacaagagacgtgcaactggaggaaaaaagaaggcgtggaggaagaagcgaaagtacgagcttggaagacaaccagcaaacacgaagctatcgagcaacaagacagttcgaagggttagggttcgtggaggaaacgtgaaatggagagctcttagattagacactggaaattactcatggggaagtgaaactgtaactagaaagactcgtatacttgatgttgtctataatgcatcgaataacgagttggttcgaactcaaactttggtgaagagcgccattgttcaggttgatgctgcaccattcaagcaatggtatctccaacattatggtcttgatattggccgtaagaagaagaatacttctgctgctaagaaagatggagaggagggtgagactgcagttgaggaagcaaagaaaagcaatcatgtagtgaggaaaattgaaaagcgtcaacaagatcacaagcttgatccacatattgaagagcagtttagcggtggacgattgttggctgctatctcttcgcgccctggtcaatgtggtcgtgctgatgggtacattttggaaggtaaagaacttgagttctacatgaagaagttgcagaagaagaaaggtaaggccggtgctggagctgcttagtttgtctttcttttatatatttgataactatagatgctattattttaatcagattttgaggttatgtttcttattgtagtgtattggcctctttcttaaagccaaattacatggttgagaattttttgattggctagtgtttctttcacatcttatacattattatcatatttcatgtctattctagaaactttttattctgta

SEQ ID NO: 7058 - DNA, 915 bp, Eschscholzia californica
ccaaatttcagaccaagagagagaaacttgagggttcgatctgcaatcatgggtatttcacgagattctatgcacaagagacgtgcaactggaggaaaaaagaaggcttggaggaagaagcgaaagtacgagcttggaagacaaccagcaaacacgaagctatcgagcaacaagacagttcgaagggttagggttcgtggaggaaacgtgaaatggagagctcttagattagacactggaaattactcatggggaagtgaaactgtaactagaaagactcgtatacttgatgttgtctataatgcatcgaataacgagttggttcgaactcaaactctggtgaagagcgccattgttcaggttgatgctgcaccattcaagcaatggtatctccaacattacggtcttgatattggccgtaagaagaagaatacttctgctgctaagaaagatggagaggagggtgagactgcagttgaggaagcaaagaaaagcaatcatgtagtgaggaaaattgaaaagcgtcaacaagatcacaagcttgatccacatattgaagagcagtttagcggtggacgattgttggctgctatctcatcgcgccctggtcaatgtggtcgtgctgatggatacattttggaaggtaaagaacttgagttctacatgaagaagttgcagaagaagaaaggcaaggctggtgctggagctgcttagtttgtttttcttttatatatttgatgactctagatgctattatttttaatcagattttgagtttgtttcttattgtagtgtattcgcctctttcttaaagccaaattacatggttgagaattttttgattggctagtgtttctttcacatcgtatacattattatcatatttcatgtctattctagaaactttttattctg

SEQ ID NO: 7059 - DNA, 840 bp, Humulus lupulus
ctgagactcgcagcccttggaacagagtagaatccttactgcgccaaaatgggtatttctcgggattccatgcacaagaggcgtgccactggaggcaagaagaaggcttggaggaagaagagaaagtacgagctcggaagacagcctgcaaacaccaagttgtcaagcaacaaaacagtaaggagaattagggttcgaggtgggaatgtgaagtggagagctttgaggctcgatactggtaacttttcctggggtagtgaggctgtgaccaggaagactcgtcttcttgatgtggtctacaatgcatctaacaacgagttggtccgtactcaaaccttggtcaaaggtgccattattcaggttgatgctgctcctttcaaacaatggtatctgcaacactatggagttgatattggacgtaagaagaagaccgttgtctctgccaagaaagaagaggatggtgaagctgccgctgaggaggtgaagaagagcaaccatgtggttagaaagctggagaagcgccagcaagaacgagttcttgacgctcatattgaagagcaattcagcggtggtcgtcttctggcgtgtatatcatcacgacctggccagtgtggtcgttctgatggatatattttggagggcaaagagcttgaattctacatgaagaagctccagcgtaagaaggggaagggagctggtgccgctgcctaaaattttgttacttggtcactttagattccagtttttgtttcttttttaaatgttcttcaatggacgaggcaattaactttttatccattgagggtgaattattttaattgaaacaattttttcttgtgt

SEQ ID NO: 7060 - DNA, 1025 bp, Olea europaea
tattcacaaatatttctgttgagcggctttcagttgtaccgccgtttctccctctgcaatcaatagaggactcaccggaaccttagtaaccaccgcctgcaatcatgggtatttcacgggactcgatgcacaagagaagagccactggaggcaagaagaagtcttggagaaagaagagaaagtatgagcttggaagacaaccagcaaatactaagttgtcaagtaacaaaacagtaagaagggtgagggttcgtggaggtaatgtgaagtggcgtgccttgaggttggacactggaaattactcttggggtagtgaagctgtgaccaggaagactcgtatacttgatgtggtttataatgcatcaaacaatgagttggttaggacccagactttggtgaagagtgcaattgttcaagtggatgctgcaccattcaagcagtggcatcttcagcactatggtgttgacattggtcgcaagaagaagacagctgccaagaaagaagaagatactgatgctgttgctactgaagagacgaagaagagcaaccatgtcctgagaaaaattgaaaagcgtcaacaggatcgcaagcttgacccccatgttgaggagcaatttggtagtggccgtttattagcttcaatctcttcacgccctggacagtgtgggcgtgctgatggatatattttggagggcaaagaattggagttttacatgaagaaactccagaagaagaagggaaagggtaccagtggtgctgcctaatctcaaatttttgccaccagaaatgtcatcttattatactattcactttttccattccaaatttctctagttttcgagaattagactgaacttttcaattgtcatgctaaatcaatttttgtgaagtgttgtgttaaatcttttcttttgggaattgcattcttcttatttctcattaatttgcagatcgattttatttgtttccttttacatgtaagcctccaatggtagctctctaagaatcaaagcatggctgaagcc

SEQ ID NO: 7061 - DNA, 806 bp, Primula obconica
agccatgggtatttcaagggattcgatgcacaagaggcgcgccactggtggcaagaagaaagcatggaggaagaagcgaaagtatgagctcgggagacagcctgccaacacaaagttggataacaacaagactgtgagaaggataagggttcgaggtgggaatgtcaagtggagagcactgaggttggacactggcaatttctcttgggggagtgagagcacaacccgcaagacccgtgtcttagatgtggtttacaatgcatctaataatgagttggttaggacccagactttggtaaagggtgctatcattcaagttgatgctgcaccgtttaagcaatattatcttcagcactatggagtcgaggttggtcgaaagaagaaagctgctgctactaagaaaggagaggagggagaagcagcagcagctactgaagaggagaagaagagtaaccatgtcaagagaaagatagagagtcgtcagcaagatcgcagccttgagcagcacattgaggatcaatttgctggtggccgtttgttagctgctatctcatcccgacctggccagtgtggtcgttgtgatggatacatattggagggaaaagagctggagttctacatgaagaagctccaaaggaagaagggcaagggtgctggtgctgcagcttgaggctacttttctcggacttcttaatttgttttgatcaattttaatgggagtgtcgtgtccggacgtttctttgttagtttgaatacttgttccaaattttggtaaattgttgtttgactatttgctatttgaaggc

SEQ ID NO: 7062 - DNA, 974 bp, Rosa hybrid cultivar
ttagccgaagagaagcggagagctttcgtttcctggtctcgccgtcgctctctctctctctctcagcaaccatgggtatctcacgtgactcgatgcacaagaggcgtgccactggaggcaagaagaaggcttggaggaagaagagaaagtatgagctcggtcgtcagcctgcaaacactaagctttcaagcaacaagactgtgaggcgaatccgtgtccgaggaggtaatgtgaagtggagggctctcaggttggacaccggcaacttttcatggggtagtgaagctgttactcgtaaaacacgtcttctggatgtggtttacaatgcctcaaacaatgaacttgttagaacacaaacccttgtcaaaggtgcaattgtccaagttgatgcagccccttttaggcaatggtaccttcagcactacaatgttgaggttgggaaaaagaaaaagattgctgctgctaagaaggatacttcagaggaggcagaagcagctcctgtggaggaggcaaagaagagtaatcatctaaccagaaagattgagaagcgtgtgcaagttcgtacactggactcccacattgaagagcagtttgggggtggtagattgttggcctgcatatcttcccgtcctggacaatgtggaagagctgatgggtacatcttggaaggtaaggagcttgagttctacatgaagaagctccagaggaagaaggggaagggtgctgccgccactgcctaagcagttcattcaccaggctttatctttttgaccattttgtgaaacctatcgctagctgggtcctttgttatttatatgttattgtgctagacatctagtcatagtaatttattgctcaatttagtgtagagtttggattttaatagaagtctgttcggacttcttcctgtcactccaaacttccttaaacaatgtagaagtattatgctcaagtcaattggagttttcagagtc

SEQ ID NO: 7063 - DNA, 1083 bp, Cucumis melo
aaaacccctttgagtccccttccattttctctctcgaccttctctccatcgttcaaggaaccctagactcgtctttactccgagagctctcgtcatatcaagatgggtatttcccgtgattctatgcacaaaaggcgtgaaactggaggcaagaagaaggcttggaggaagaagagaaagtatgagcttggaaggcaacctgccaacaccaagttatccagtgacaagtcaatcaggaggattagagttcgagggggtaatgtgaagtggcgtgcgtttaggctggatactggaaactactcttggggtagtgaggccgtgactagaaagacccgtattcttgatgtggtctacaatgcatctaacaatgagcttgttcgtactcaaaccttagtgaagagtgccatagttcaagttgatgcagcaccatttaagcagtggtatcttcagcattatggagtggatattggcaggaagaagaagacctctgcatctgctaagaaggaagaggaaggcgatgctggcactgaggaggtaaaaaagagtaaccatgtccagcgcaaaatagagaaacgtcagcaggaccgtaagctcgacccacatattgaagaacaattcagcagtggtcgtttaatggcttgtatctcatcaaggcccggtcaatgcggccgagcagatggatatatcttggagggcaaagagctcgaattctatatgaagaagctccaaagaaagaagggaaaaggagctggtgctgcttaaattttgttatggcttcagccagtatttctgttttcactctttttcttatgaagacaacgagttgttgcagctattttggaactttgattttgctggtaatagtttaattatagtacttttgacatttttcatgttaacagttcgcttattagcttgagtttaagttcaaaattcttagtcaatttatgtaagcgggttggtttggttgtttgatctagaatttatagaagtacaaatggattatagagtgatttaaactcccattgcttctcttaaaccaatttcgctgaagttcccactttataatttttgttatgtctg

SEQ ID NO: 7064 - DNA, 1062 bp, Orobanche aegyptiaca
ttgcttatgtaatttaacatatctagggtttcaagctgactgcataaagccctgtcggcctcacttgcgtttctctttctttgctgctgttattgtgccgccgtcgtctctttctgccttggatcggagatcaatcggaactttataaccagccgcctgcaatcatgggtatttcccgggattccatgcacaagaggcgtgcgactggagggaaaaagaaggtttggaggaagaagagaaagtatgagctcggtagacaaccggcaaacacaaagttgtcaagtaacaagactgtgcgcagggtgagagtccgcggaggtaatgtgaagtggcgtgcattaaggcttgatacaggaaactactcttggggaagtgaagctgtgacccgaaagactcgtattctggatgtcgtctataatgcatccaataatgagttggttaggacccagactttggtgaagggcgctataattcaagtcgacgctgcacctttcaagcagtggtatcttcagcattatggagtcgagattggtcgcaagaagaaaactgctgctaagaaggaaggcgaggactctgaggctcctgatgaagcggtagagaagagcaaccatctccaaagaaaactagaaaagcgtcaacaggatcgtaaaattgaccctcatattgaggaacaatttggtgggggccgtttgttagcagcaatctcctcacgcccaggccagtgtgggcgtgctgatggttatatattggagggcaaagagttggaattttacatgaagaaacttcagaggaagaaaggaaaaggtgcaggaggtgcttaatctgcctagaggttgagaatgttactttgttcttcttttaaagcttattattgcaatccgtgaacactagtttgcttgaacttttgatgatttcagttgtcagttatgcgatatcttgatgacaaattatcctttgtgtactgtatttttgacgtggaagttctgttggatggaaagtttagttttggttcttccttgcaatattgcctatgtttttcttttatcttcgatgttaaagata

SEQ ID NO: 7065 - DNA, 1117 bp, Orobanche aegyptiaca
aagtggcaaagtgcgataaagccttctctcacttatttctgtagctggctgctagcactctcggccggagtttgatcggagccctagaaatcatccgccggcaataatgggtatttctcgggattccatgcacaagagacgtgccactggaggaaagaagaaggtctggagaaaaaagagaaagtatgagctcggaagacaacccgcaaacacaaagttgtcgagtaataaaactgttcgcagggtgagagtccgtggaggtaacgtgaagtggcgtgcattaaggcttgatacagggaactactcttggggaagtgaagctgtaacccgaaagactcgtattctggatgtcgtctataatgcatccaataatgagttggttaggacccagactttggtgaaaggtgctattattcaagttgacgctgcacctttcaagcagtggtatcttcagcattatggagtcgatattggtcgcaagaagaaaactgctgctaagaaggaaggcgaggacactgaggctgctgctgctgaagcgttggagaagagcaaccatctccaaagaaaactagaaaagcgtcaacaagatcgtaaaattgactcacatattgaggaacaatttggtgggggccgtttgttagctgcaatctcctcacgcccaggccagtgtgggcgtgctgatggttatattttggagggcaaggagttagaattttacatgaagaaacttcagaggaagaaaggaaaaggtgccggggccgcttaatttacatagtgcacttcggaactttccatttctctactgtttacttctcttatgtgatatttcgtctgcaatcaattatccttcggattttttttttttcctttggctgattcattccgttaatcttttggatttgggttttgctatggcaatgcttctcattttaattactgtggactagaattaggtctgggtatatgagcgatttcccaataaccctctctcagaatatcgcccctgagcttattgaagtattttccaacctctccaagtgtgaggattattgttggaacaagtcatgtaccggcatgaatttggatttgtgcgctctataaataccgattataagtt

SEQ ID NO: 7066 - DNA, 852 bp, Salvia sclarea
ctactagaccttggctgtcactcagacatttgtgatctgcctacggcgccctgctgcattctctcggcgatttatcggaggcagcgcatccaccgccaatcatgggtatttctcgggattctatgcacaagaggcgtgccactggaggcaagaagaaggcctggaggaaaaagcgaaagtatgagctgggaagacagccagcaaacacgaagttgtccagtaacaagacagttcgcagggtcagagttcgtggaggcaatgtgaagtggcgtgcgttgaggctcgatacaggaaactactcttgggggagtgaggccgtcacccgaaagactcgtattctggatgtcgtctataatgcatccaacaacgagctggttaggacccagactttggtgaagggtgctattgttcaagtggatgctgcacccttcaagcagtggtatcttcagcactatggagttgaaatcggtcgcaagaagaagactgctgcaaagaaggaaggcgaggaggctgaggctactgtgactgaagaggtgaagaagagtaaccatgtccagagaaaactagaaaagcgtcagcaggaccggaaaatcgaccaacatattgaggaacaatttggcggtggccgtctgttagctgcaatctcctctcgcccaggacagtgtggacgatgtgatggttatattttagagggcaaggagttggagttttacatgacgaaacttcagaaaaagattggaaaaggtgcaagcggcgcataattgtctgatgcaacccaaaattttgaagcctgatattttcttatgcttccaccttttgtattgaacatctaagttgtcggtgacatgattt

SEQ ID NO: 7067 - DNA, 1090 bp, Castanea mollissima
cgctgttgttgttgttgttgttgttgttgttgtagcagaataggtaccgagcccaaagaagaagaagtcgttctcatcctctgcaaccaaccatgggtatctcacgtgactctatgcacaagaggcgtgccactggaggcaagaagaaggcctggaggaagaagagaaagtatgagcttggtcgtcagcctgcaaatactaagctctcaagcaacaagactgtaaggcgaattcgcgtgagaggaggcaatgtcaaatggagagccctcagattggatactggaaactactcatggggtagtgaagctgtcacccgcaaaacacgtattctggatgttgtttataatgcttcgaacaatgagcttgtcagaacacaaactctggtgaagggtgctattgttcaggttgatgctgccccattcaagcagtggtaccttcagcattatggagttgacattggtaggaagaagaagacaacagctaagaaggaaaccccagaggaaggcgaaggaaatacagaggaaagggaaaaggaaacaaaaaagagtaaccatgtcgccaggaagcttgagaagcgtcagcaaggtcgtacacttgatgcacatatcgaagagcagtttgggggcggtaggctgttggcatgcatctcttctcgaccaggacaatgtggtagatctgatggatacattttggaaggaaaagaacttgagttctatatgaagaaaatccaaaggaagaaggggaagggtgccgcagcttaagtagtttattagtcatagctttggtcttcttgcaacttgtttttgttacacctgcctagatgggccaaagtttatcattattgatggaactctgaagattgtgtggcatgttcagtttcaaattagatgctttaactagtttgtgattgacaagtcagacttgagctaaaatagcacttgttgggtgctggcctctttatggaccattctcttgtagtagaatttctttattgttatagctgtgctcttttaatggtattgccagttcctgtaatagttatattgcatctttttccctatagtaaaatttagaaccctgacctctaaaa

SEQ ID NO: 7068 - DNA, 934 bp, Nicotiana benthamiana
ttgcagagccctccattttttgtgcgttgcatttcggaaaacctaaaccctagggccctccatcgcctgtaacaatgggtatctctcgtgattctatgcacaagagacgggccactggaggcaagaagaaggcttggaggaagaagagaaagtacgagcttggcagacagccagcaaatacaaagttggttcctaacgctaagactgttagaagaataagagtccgaggaggtaatgtgaagtggcgtgctttgaggttggatactgggaattactcttggggaagtgaggctattacaaggaagactcgtctattggatgtggtgtataatgcctctaacaatgagttggttaggactcaaaccctggtgaagggtgcgattgttcaggttgatgcagctccatttaaacagtggtatctccagcactatggagttgatattggtcgcaagaagaagactgctgcttccaagaaggaaggagaggaggctgaggctgttccagaggagaagaagagtaaccatgtccaaagaaagctgcaaaagcggcaacaggatcgcaagattgacccacatattgaggagcaattttctagtgggcgtctattggctgcaatctcatcacgacctggtcagtgtggtcgtgccgatggatacatcttggagggtaaggaacttgagttttacgtgaagaaactccagagaaagaaaggaaagggtgccagtggtgctgcttagaactgcgcctccattttttcacattagaatggtcgctataacctcttcagtagtcttagtgctactcttcattggaagggaatgataacttcttgtaacagagttagattcaagtttcttttgcatatggttatgtaaaagttttgagaactgcctacctttgtcaaaagaagaaatttgagaacagccttatcact

SEQ ID NO: 7069 - DNA, 929 bp, Nicotiana tabacum
  misc_feature (42)..(42): n is a, c, g, or t
  misc_feature (116)..(116): n is a, c, g, or t
  misc_feature (126)..(126): n is a, c, g, or t
gcttgcagagccctccatttttttgtgcgttgcatttggganaacctaaaccctagggccctccatcgccggcaacaatgggtatctctcgtgattctatgcacaagagacgggcnactggaggcnagaagaaggcttggaggaagaagagaaagtacgagcttggcagacagccagcaaatacaaagttggttcctaatgctaagactgttagaagaataagagtccgaggaggtaatgtgaagtggcgtgcattgaggttggatactgggaattactcttggggaagtgaggctattacaaggaagactcgtttattggatgtggtgtataatgcctctaacaatgagttggttagaacgcaaaccctggtgaagagtgcgattgttcaggttgatgcagctccatttaaacaatggtatctccagcactatggagttgatattggtcgcaagaagaagactgctgcttccaagaaggaaggagaggaggctgaggctgttccagaggagaagaagagtaaccatgtccaaagaaagctgcaaaagcgacaacaggatcgcaagattgacccacatattgaggagcaatttgctggtgggcgtctattggctgcaatctcatcacgacctggccagtgtggtcgtgccgatggatacatcttggagggtaaggaacttgagttttacatgaagaaactccagagaaagaaaggaaagggtgccagtggtgctgcttagaattgcacctccatttttttcacattatgataagttcaggacaaattagattggtcgttattccgtattcagtagtcttcattggaagggaacgataacttcttgtaacagagatagattcaagtttcttttgcatatggttaatctaaaagttttgagaactgcctactttatcaaaagaagaaattt

SEQ ID NO: 7070 - DNA, 823 bp, Ocimum basilicum
actctctggttgcttttgtcccgccgttgcgcttcgtcggaaccctaggatccaccggctgcaaccatgggtatctcacgggattcgatgcacaagagacgtgcaactggaggaaagaagaaggcctggaggaagaagagaaagtatgagctgggaaggcaaccagctaacacaaagctatctgccaacaagacagtgcgtagggtgagagtgcgaggtggtaatgttaagtggcgtgcgttgagattggatactggaaattattcctggggaagtgaagctgtaacacgaaagactcgtattcttgatgtggtttacaatgcatcgaacaacgaattagttagaacacagacattggtgaaaggtgccattgttcaagtggatgctgctcccttcaagcagtggtatcttcagcactatggagttgacattggccgcaagaagaagactgttgccaagaaggaaggagaggaggctgatactgctcctactgaagaggcaaagaagagcaatcatgtccaaagaaaactagaaaagcggagggaggatcgcaagatcgacccgcatattgaagaacaatttggcggcggtcgtctattggcggcgatagcctctcgacctggacaatgtgggcgttgtgatgggtatattttggaaggcaaggaattggaattctacatgaagaaacttcagaaaaagaaaggaaagggtgccagtggtgcttaaattttgacttagttcatcaacttttccgattagagcacacatttaatttgccttctacctcacttctatgtagtgtgtggaacaggaagagctttct

SEQ ID NO: 7071 - DNA, 969 bp, Malus domestica
tatatgtgataatatgcaggtatctcacgtgactcgatgcacaagcgccgtgctactggaggcaagaagaaggcatggaggaagaagagaaagtatgagctcggccgtcagcctgcaaatactaagctctccagcaacaagactgtaaggagaatccgtgtgcgaggaggcaatgtcaaatggagagctctcaggttggatactgggaacttctcgtggggcagcgaagccgttactcgcaaaacccgtctcctggatgttgtatacaatgcctcaaacaatgagcttgttagaacacaaactctggtgaaaggcgccattgtccaggtggatgcagctccatttaagcaatggtacctccagcattatggagttgaaattggcagaaggaagaagtctgctgttgctaagaaggataccccagaggaaggagaaggaactacagaggaagcaaagaagagtaatcatgttgccaggaaacttgagaaacgtcagcaaggtcgcactctagacccccatattgaagagcagtttggaggtgggagattgctggcttgcatatcttcccgtccaggccaatgtggcagatgtgatgggtacatcttggagggtaaggaacttgagttttacatgaagaagctccagaggaagaagggaaagggtgctggcgctgctgcataaacagtttgtcgacgaggctctttcttttttggctttcgatgagatccgttttagctggaacctttttcatttgtctaggacatatgctggttgcctgtgtgctaatgcaaatctttcgagttttgcttggcatatccggtatttcaagattttgacaattgttttttgaccaatcactagtcatttgatatctttgtggtgcgagtcgaagtaaactggtgtagtgaatgttgagtttggtggatttggatacaattcaatctggagttttatgaactctaaatcttg

SEQ ID NO: 7072 - DNA, 1021 bp, Cucurbita pepo
ggtcgctcaaggaaccctagacagctctcacgacaagagctctcatcttgccaagatgggtatttctcgtgattctatgcacaagaggcgtgccacaggaggcaagaagaaagcctggaggaagaagagaaagtatgagctcggcaggcaacctgccaacaccaagatatccagtgataaatcaatccggaggattagagttcgtgggggaaatgtgaagtggcgagctttaggcttgatactggaaactactcttggggtagtgaggctgtgactagaaagtcccgtattcttgatgtggtctacaatgcatctaataatgagcttgttcgtactcaaactttggtgaagagtgccatcgttcaagttgatgcagcaccatttaaacagtggtatcttcagcattatggagtggatattggacgtaagaagaagaccacaacatcttctaagaaggaagaggaagctgatgctgccactgaggaggtaaagaagagtaaccacgtgcagcgcaaaatagagaaacgtcagcaggaccgtaaccttgagccacacatcgaagaacaattcaacagtggtcgtttgatggcgtgtatctcatcaagacctggtcaatgtggccgagcagatggatatattttggaaggcaaggagcttgaattctacatgaagaagctccaaaggaagaagggtaaaggagctggtgcttcatagattttgttgtcgagttcttttcggctcgagtttcttgttcctaattcttcgtaggacgccaatgattgcagctgagatgaaactgctattttggaacttcagttttgctggtaatagtttaattacaatacttagtgattttcatgttaacaacagtttgtttattagctttaaaagctttaaagtttaattgtttacaatactcctatgcatgacgcttttcaattaattcatcacagtatttttttagtcggtttcaattgtaatgcatggacttggaaattccgcataaagaaagaatttatga

SEQ ID NO: 7073 - DNA, 838 bp, Cynara scolymus
  misc_feature (46)..(48): n is a, c, g, or t
  misc_feature (592)..(592): n is a, c, g, or t
  misc_feature (648)..(648): n is a, c, g, or t
  misc_feature (685)..(685): n is a, c, g, or t
  misc_feature (761)..(761): n is a, c, g, or t
  misc_feature (767)..(768): n is a, c, g, or t
  misc_feature (806)..(806): n is a, c, g, or t
  misc_feature (812)..(813): n is a, c, g, or t
  misc_feature (818)..(818): n is a, c, g, or t
  misc_feature (823)..(824): n is a, c, g, or t
  misc_feature (833)..(834): n is a, c, g, or t
gcgtctctgggaggtcgagctcagaggcgcgccataaaccctagannnggaacaaccgtcatctgcgaacatgggtatctctcgtgattccatgcacaagagacgtgccactggtggcaagaagaaggcgtggagaaagaagcgaaagtatgagctcggaaggcagcctgccaacacgaagatttctagcaacaagactgttcggagggtgagggttcgaggtggtaatgtgaagtggcgtgccttgaggttggatacaggtaactactcgtgggggagtgaggctgtgacccgaaaaacacgtatattggatgtggtttacaatgcatcgaataatgagttggtcaggacccagactttagtgaagagtgcaatcgttcaggttgatgctgcaccttttaagcaatggtaccttcaacactatggacttgacataggccgcaagaagaagccagctgctgctgccaccaaaaaggagggagaggaagctgaagtggctactgaagagaccaagaagagcaaccatgttgtgaggaaattggagaagcgtcaagaggaacgtaagcttgatcaacacgttgaagagcaattntccagtggtcgtcttctagcagcaatttcatcacgccctggccagtgtggtcgtgntgacgggtacatattggagggaaaagaacttgagttntacatgaagaagcttcagaagaagaaggaaagagtggtggtgctgcttaaaaatatcaggtttctttaattagctncttttnntggacttgaatttgttgtttatgatgctaatgatcagnagcttnnttttnattanncacagcttnnatag

SEQ ID NO: 7074 - DNA, 765 bp, Cynara scolymus
  misc_feature (34)..(34): n is a, c, g, or t
  misc_feature (740)..(741): n is a, c, g, or t
gtgttttggtggcgcaccataaaccctagaggantatcctccgtcatctgcaaacatgggtatatctcgggattccatgcacaagagacgcgccactggtggcaagaagaaggcctggagaaagaagcgaaagtatgagcttggaaggcagcctgccaacaccaagatatccagcaacaagactgttcgaagggtgagggttcgaggtggtaatgtgaagtggcgtgcgttaaggttggatacaggaaattactcctggggaagtgaggctgtgacaaggaagacacgtatcttggatgtggtttataatgcatcaaataatgagttggttaggacccaaactttagtgaagagtgctattgttcaggttgatgctgcgccgtttaagcagtggtatcttcagcattatggagttgatattggtaggaagaagaaagctaccactgctgccaaaaaagagggagaggaagtagagggtgctactgaggagaccaaaaagagcaatcacgttgcaaggaaactagagaagcgtcaagaagaacgcaaacttgatccacatgtcgaagaacagttctctggtggtcgtctcttagcagcaatctcatcacgtcctggccagtgtggtcgtgctgacggatacatcttggagggaaagagctcgagttctacatgaagaagctgcagaagaagaaaggaagagtgctggtgccgcttaaaccatatgtcatcctgattttcanntatgatcgtatgttttctttctac

SEQ ID NO: 7075 - DNA, 940 bp, Solanum melongena
acaaaatgaaagagaagtaacgtagtctgcctcttcgcagctaagctttcagcaaccatgggtatctcacgagactctatgcacaagaggcgtgccactggtggcaagaagaaagcgtggaggaagaagcgcaaatatgaacttggccgccagcctgctaataccaagctctcaagtaacaagacagtcagacggattcgtgtgcgtggtggcaatgtaaagtggagggctctgagattggatacaggaaattactcatggggtagtgaagcagtcacacgtaagactcgtatccttgatgtggtctataatgcctcaaacaatgaacttgttcgaacacaaacactggtcaagagtgcaattattcaagttgatgctgcaccgtttaaacaatggtacctccagcattatggtgttgacattggtaggaagaagaaggggcccaccaagagggaagctactgaggaaggagaaggtgttgcggctgctgctgaggaaactaagaagagccacaatgttcagaggaaacttgagaatcgccaaaaggatcgtacacttgatcctcaccttgaagaacaatttggtggtggtaggcttttggcctgcatctcttcccgcccgggtcaatgtggcagatgtgatgggtacattttggagggaaaagagcttgagttctatatgaagaaactacagaagaagaagggcaagagtggagctggtgctgcttcttaactggtgctacaagaatcttcagactagttacatattgttgtaattccaattttggagatatgtgattctgtaaggggtaccttttatttctttttttgtactctttttaactgattttgtatgatctcccggactacttttcttaatcattatcagcttttccatggtaggccacagttaccttaacagtagcaaaattaaacttcac

SEQ ID NO: 7076 - DNA, 1025 bp, Linum usitatissimum
cctaagggtaagattggagagaaggtggggagagcagtttcagtttgcccgtcgctcagccaacatgggtatttccagggactctctgcacaagaggcgcgccaccggaggcaagaagaaggtctggaggaagaagcgaaagtatgagctcggacgtcagccagccaacaccaagctctcgagcaacaagacagtgaggagggtgcgtgtcagaggtggcaatgtgaagtggagggctctgaggttggataccggtagcttctcttggggaagtgaggctgtatctatgaaatgccgtcttcttgatgtggtgtacaatgcctccaacaatgagcttgtgaggactcagactttggtcaagagtgccatcgtccaagttgatgctgccccattcaggcagtactaccttaaccactatggtgttgaggttggtaggaagaagaaggctgtggctaagactgctgaggagggagatgctgctaccgctcctgcagctgaagaaaccaagaagagcaagcatgtcctgaggaagattgaatcccgccagaaggatcgccagcttgacccccacatcgaggagcagttcagtggtggtaggctgttggcttgcatttcatcccgacctggtcaatgcggtagagctgatggatacatattggaaggtaaggagctggagttttacatgaagaaactccagaggaagaagggcaagggtgctggtgctgcttagatacacatcttcgagatctcggaaaccttccctagtgttcgttttgtccttctgaagctttttaaaagtaatgaagtgaaatactctttctattactagcgaagtagaagaattgtctctcgttttcccttggtgtgttttgacatatcataattccagagattttgccttgtttcttaagttggttgcaatttcaatgccttttgattgaagctttatacgcctgaatgctgtcctagttttctaaccatattgtgttagattgacctctcctatgataatgttatctggtttg

SEQ ID NO: 7077 - DNA, 974 bp, Fraxinus spp
tttttctttctactgctgctgctgggggattcatcggaaccttagaaactaccgcgagcaacaatgggtatttcacgggattccatgcacaagaggcgtgccaccggaggaaagaagaaggcttggaggaagaagagaaagtacgagcttggtagacaaccagcaagcacgaagttgtcaagtaacaagacagtgcgtagggtgagggttcgaggaggtaatgtgaaatggcgtgccttgaggttggatacagggaactactcttggggtagtgaggctgtgacccggaagactcgtattcttgatgtggtttataatgcttcgaataatgagttggtcaggacccagactttggtgaagagcgcaattgttcaggtggatgctgcaccttttaagcagtggtatcttcagcactatggagttgacattggtcgcaagaagaaggctgccaacaagaaagaaggagaggaggccgagggtgctgtagaagagacaagaaaaagcaaccatgtccagaggaaactagcaaaagcgtcaacaggatcggaagcttgacccacatgttgaggagcaattcggcagtggccgtcttttagctgcaatctcttcacgccctggccagtgtggtcgtgctgatggatatattttggagggcaaagagttggagttttacatgaagaagcttcaaaggaagaaaggaaagggtgccagcggggcttcctaaatttctctccaactcaaagaatgttaccgtcgaaatctccttatctcactttttctgtatgacagaagtgtgcttgacctttttccagtttagttgaaattttgaactgtcattacaatactgctgctgttatgctaatgctacttcccatccctggtgacaatggtcaacatatggctgattataaataactttagtaggtaagttcattctacagggaattgactagtgtataatgtaggtagtataa

SEQ ID NO: 7078 - DNA, 1053 bp, Taxus baccata
aagcagtggtatcaacgcagagttacttttttttttagttcgatttgtttgtgagggagaggactgagctcggcggaggcgcaaggaatctacaggcgggcaatcatgggtatctcacgagattcgatgcacaagaggcgtgcaacgggaggaaagaagaagcagtggaggaagaagcgaaagtatgagctaggaaggcagcctgccatgacaaagctttcgagcaacaagacagttagaagggttcgtgtaagaggtggaaatgtaaaatggagagctctgaggctggataccggtaactactcgtggggttcggaggccgtgactagaaaaacccgtatattggatgtggtttacaatgcatccaataacgagcttgtgagaacacaaaccctggttaagagtgccattgttcaggtagatgccgctcctttccgtatatggtatcagcagcactacggccaagaaattggtaggaaaaagaaggctcctacttctaccaagaaagaaaccgaggagggagaagcagctgccacagaagaagaaaagaagaaaagcgctcatgtgttgagaaagattgaaaagcgcaatgaaggtcacaaacttgacgcacatatggaagaacaatttgccagtggcaaattgatggcttgtctatcgtctcgccctggacagtgtggacgtgctgatggatacattcttgagggtaaagagcttgagttctatgtgaaaaagttacagaggaagaagggaaagggtggtgctggtgctgcttaggcaatcaatttttgtttcttgagacatctgtgcaacacagaaacattttgattaggctgtttttaaacaatatttttcctggtgaagtcaaaagtggtttagagtaactactactggtaaatgactaaatatgaatttagaacaacatggtgtataatactgcaaatttgatagatgactggctacttttatttctagtattgagaaataaaatgtctcagtcaagagccatgctgttttttaagttttttgttattagtttacagggaagcatct

SEQ ID NO: 7079 - DNA, 959 bp, Vinca minor
atcagacgcagccttacgcgcaggagaaactcttctctcaccgaaaatgggtatctcacgagattctatgcacaagaggcgtgccactggtggcaagaagaaagcttggaggaagaagcgaaagtatgagcttggccgtcagccagcaaacacaaagctttccagcaacaagacagtcaggagaatccgtgtccgaggaggcaatgttaaatggagggcattgaggttggacactggtaactactcatggggtagtgaggctgtcacacgtaagacacgtattcttgacgtcgtctacaatgcctcaaacaatgagctggtgcgtactcaaactctcgtgaagagtgcgattgtccaggtggatgcagccccattcaagcattgtaccttcaacactacggtgttgacattggtaggaagaagaagaccgttgttaagaaggatgctgctgaggagggagaagttgctattgaagaaactaagaagagcaaccatgtacaaaggaaaattgaaaagcgtcagcaaggtcgtgcacttgatgctcatattgaggagcaatttggcgctggtcgattacttgcatgcatctcttcccgcccaggacagtgtggcagatcggatggttatattctggagggcaaagagcttgagttctacatgaagaaactccaaaggaagaaaggaaaggctgctggtggtgctgcttaagtccaattttctttattgttctgttgcagtcttaatagttctagatttttcatgcttccttttagcccgtttggcttatgcaacttataatttgatgtggattatgtgagcttcaaattgcactttacctttcatggcatgaatgggcaacaaaaatcaactgttttgacgatttattttccttcccaacaatttaccacttgttactcttggcataattttcggctgcccaagtcttgagtcgtgcaggt

SEQ ID NO: 7080 - DNA, 689 bp, Ocimum basilicum
cggcacgacggtaaagtgtagcgcgaaggagacgaattggattcggagcccttccaccagcaaccatgggtatttctcgggattccatgcacaagagacgtgccactggaggcaagaagaaggcctggaggaagaagagaaagtatgagctgggtagacaaccggcaaacacgaagttgtcgagcaacaagactgttcgcaggatcagagttcgtggaggcaacgtgaagtggcgtgctttgaggcttgatactggaaactactcatgggggagtgaagcagtgacacgaaagactcgtattttggatgtcgtttataacgcatccaacaacgagctagttagaacccagaccctggtgaagggtgctattgttcaagtggatgctgcacctttcaagcagtggtatcttcagcactatggtgttgagattggccgtaagaagaaggctgctgcaaagaaggaaggagaggaggctgatgctactgccactgaagaggtaaagaagagtaaccatgtccagagaaaacaagaaaaacgtcagcaggatcgcaagattgactcacatatcgaggagcaattcggtggtggccgtttgttagctgcgatatcttctcgcccaggacagtgtgggcgatgcgacggttacattttggagggcaaggagttggaattctacatgaagaaaatt

SEQ ID NO: 7081 - DNA, 805 bp, Centaurea maculosa
cgagaggccgcaggtggaagaagaagagccttttctgatctgcaaccatgggtatctctcgtgattcgatgcacaagagacgtgcaactggaggaaagaagaaggcgtggaggaaggagcgaaagtatgagctcggaagacggccagccatcacaaagatttccagcaacaagaccgttcgaagggtcagggttcgaggtggaaacgtgaagtggcgtgctttgaggttggataccggtaacttctcttggggaagtgaggcagtcaccaggaagacccgtattctggatgtcgtctacaatgcatccaacaacgagttggtcaggacccagactcttgtgaagagtgcgatcgttcaggttgatgctgcaccctttaaacaatggtatcttcaacactatggagttgacattggtcgcaagaagaaaccatcagcgactgctaccaagaaagagggagaggaggcagaggctgctgccgaggaggcaaagaagagcaaccatgttgtgaggaaattggagaagcgtcaggaagagcgcaaacttgacgcccatgttgaggagcaattttctggtggtcgtctttatgccgcaatttcttcacgccccggccagtgtggccgagctgatggatacatcttggagggtaaggagcttgagttctacatgaagaagctccagaagaagaaagggaagggtgctgcttagaagcattatgtcgtttcgagtttgaatttatagatttttatttcctgtggaaggcatggaaccgaaattttgatgtgttttgtttgttaaaatgtgac

SEQ ID NO: 7082 - DNA, 828 bp, Actinidia deliciosa
  misc_feature (407)..(407): n is a, c, g, or t
  misc_feature (799)..(799): n is a, c, g, or t
ctagcacctgcaggctcgcgggaccagagaaaccctagaattctccatcatctacagccatgggcatttctcgggattcaatgcacaagaggcgtgccactggagggaagcagaaggcgtggaggaagaagcgaaagtatgagcttggaagacaacctgctaatacgaagttgtcaaatgccaagacagttcgtagaataagagttcgcggtgggaacgtgaagtggcgtgcattgaggttggatactgggaacttctcttgggggagtgaggctgtgacccgcaagactcgaattttggatgtggtttataatgcttcaaacaatgagttggttcgaacccagacattggtgaaaggggcaatcattcaggttgatgtggctccatttaagcaatggtatcttcancactatggagttgacattggtcgtaagaagaaaactgctgtttctgccaaaaaagaaggggaggaggctgatgcagcggctactgaagaggcaaaaaagagcaacaatgtcttgaggaagctacagaagcgtcaacaggatcgcaagctcgatccccatgttgaagagcaatttggcagtggccgtctcttagctgcaatttcatcccgacctggacagtgtggtcgttgtgatggttacatattggagggcaaagagctggagttctacatgaagaagatccagagaaaaaaaggaaagggagctgcttgaagggtttttgtttttcaattcctttttcaacctgaacttgttcttagaattcagaatttgcttggcatgatacactaaanatccgttgagtttccagtaaaaaaaaaaa

SEQ ID NO: 7083 - DNA, 934 bp, Nicotiana tabacum
cgtagagagtagaccagtgtgaggactgaggtcggcttaagctctcagcaacatgggtatctcaagagattctatgcacaagagacgtgccactggtggaaagaagaaagcttggaggaagaagcgaaagtatgagcttggccgccaaccagctaatactaagatctcaggcaacaagacagtcaggcgaattcgtgtgcgtggtggaaatgtgaagtggagggcactgagattggatactggaaattattcatggggtagtgaggcaaccacacgtaagactcgtatccttgatgtggtttacaatgcctcgaacaatgaacttgtccgcacacaaacactagtcaagagtgcaattgttcaagttgatgctgcaccatttaaacagtggtacctccagcactatggtgttgacattggtaggaagaagaagggagcttctaagaaggaaactactgaggagggagaagctgctgctcctgttgaggaagctaagaagagcaaccatgtagcccggaaacttgagaaacgtcagaaggatcgtaaacttgatcctcacctcgaagagcaatttggttctggtaggctatatgcctgcatctcatctcgccctggtcaatgtggcagagctgacgggtacattttggaagggaaagagttggaattctatatgaagaaacttcaaaagaagaaaggcaaggctggatctggtgctgctgcttaagaggaactttcggattttccagatcagtttttttgttttttttcaagagggagtttttactcataagctgttttttcttatcttatgtgacacgacaagtttagacatggactttactgttacagcaatctttagattgaaatttcactgccaattgactagatttaattttattgcatgaattagatgtcttggttagcggccgcatga

SEQ ID NO: 7084 - DNA, 1025 bp, Solanum lycopersicum
gttcgtgcttcctacaaagtgaaagaggagtggtgtcgtctgcctcttcgcggctaagctttcagcaaccatgggtatctcacgagactctatgcacaagaggcgtgccactggtggcaagaagaaatcgtggaggaagaagcgaaagtatgaacttggccgccagcctgctaatactaagctctcaaataacaagacagtcagacgaatccgtgtgcgtggtggtaatgtaaagtggagggcactgagattggatacaggaaattactcatggggtagtgaggcagtcacacgtaaaactcgtatccttgatgtggtttacaatgcctcaaacaatgaacttgttcgtacacaaacactggtcaagagtgcaattattcaagttgatgctgcaccatttaaacaatggtacctccagcattatggtgctgacattggtaggaagaagaagggggccgctaagaaggatactactgaggaaggagaagctgctgctcccgaggaaactaagaagagcaaccatgttcagaggaaaattgagaatcgccaaaaggaccgtacacttgatcctcaccttgaagagcaatttggcggtggtaggcttttggcctgcatctcttcacgccctggtcaatgtggcagatgtgatgggtacattttggagggaaaagagcttgagttctacatgaagaaactacagaagaagaaaggcaaaagtggagctggtgctgctgcttaactggtgcaatcagactagtttcatatggttctctattgttgtaattccaattttggggatatgtgattttgtattcagtaccttttattttctctcttgtactcttgccaaattttagtatgatctcattgactactactctttagcattatcagtttttccatggtcagtcccactttctcttgaaggttttgtgaattaagtgggaatgatattcatggtcagttttgtctggtggagtggtttcctgcattgctatttaatagagcagtgtgattaaatgttg

SEQ ID NO: 7085 - DNA, 981 bp, Fagus grandifolia
ctggaccttggctgtcactcagttgagcgacaattaggaatataacttttagagagagagagagagagagagagagagagagggaaagagagagtgaggtcacttcgtcgctgagacaagatgggtatttcaagggattccatgcacaagagacgtgccactggtggcaagaagaaagcttggagaaagaagcgaaagtatgagcttggtcgccagccagcaaatactaagctctcaagcaacaagacagttaggagaattcgtgtgagaggtggaaatgtgaagtggagggccctgagattggatacagggaattattcatggggtagtgaggctgtaactcgcaaaacccgtatccttgatgtggtttacaatgcctcaaacaacgaacttgttaggacacaaactcttgtgaagagtgccattgttcaagtggatgcagctccatttaagcaatggtaccttcaacactatggtgttgacattggtaggaagaaaaaggcgaccactaagaaggaaactgcagaggagggggaagctgctgcagaggaaactaagaagagcaaccatgttcagaggaagattgagaaacgccagaaagatcgtaaccttgatccccatattgaagagcagtttggtggtggtaggttgttggcctgcatctcttcgcgtcctggtcaatgtggcagatctgatgggtgcatattggaagggaaagagctggaattttatatgaagaaactccagcggaagaaaggaaagggtagtgctggtgctggtgcttaattgtactgtgttagtgttttgatgttgcctatattgaatatttattttttaggccatggctaccatcgatgaggcttgtgtaatacatttttgccgttacctgattggtggctagctacacattttgagtttaattcttttattatctgactattttttcctacttgatcgtttgtggttgctttcaggtggtca

SEQ ID NO: 7086 - DNA, 900 bp, Petunia hybrida
agaggtcctccatcacctgcaactatgggtatctcacgtgattctatgcacaaaaggcgtgccactggaggcaagcagaagacctggaggaagaagcgaaagtatgagcttggcagacaaccagcaaatacaaagctggtacctaatgagaagactgttaggagaataagagtccgaggaggtaatgtgaagtggcgtgctttgaggttggatactggaaattactcttggggaagtgaggctgtttcacggaagactcgtctcttggatgtggtgtataatgcctcgaacaatgagttggttaggacacaaaccctggtgaagggcgcaattgttcaggttgatgcagctccatttaaacagtggtatcttcatcactatggagtagatgttggtcgcaagaagaagactgctgcttccaagaaggaaggggaggaggctgaggctgttccggaggagaagaagagtaaccatgtccaaagaaagctggcaaatcgccaacaggaccgcaagattgacccacatattgaggagcaatttgctagtggccgtctattggctgcaatctcatcacgacctggccagtgtggccgtgctgatggttacatcttggagggcaaggaacttgagttttacatgaagaaactccagagaaagaaaggaaagggtgccagtggcactgcttagagttgcagcttgtttttaatttcatactatcagtagtgctactcttcatttgaaggggtgataacttcttgtatcagatttgactgatgtttcttttgcatttggttatctaagaattttgggagcaaccttatcctacatgatgtttattttcaccaacaatggattcatttgatagtgccgtggcaactcatattttacagttagcttagt

SEQ ID NO: 7087 - DNA, 956 bp, Solanum tuberosum
gcgtccgtctttgagaacatcgaaaccctaaggacctccgtcaccggcgacaatgggtatctctcgtgattctatgcacaagagacgtgccactggaggaaagaagaaggcttggaggaagaagagaaagtatgagcttggcagacagccagcaaacacaaagctggtgccaaatgctaagactgttagaaggataagagtccgcggaggtaatgtgaagtggcgtgctttgagattggatactgggaatttctcttggggtagcgaggctgttacaaggaagactcgtctattggatgtggtgtataacgcctctaacaatgagttggttaggacacaaaccctggtgaagagtgcaattattcaggttgatgcagctccatttaaacagtggtatctccagcactatggagttgaaattggtcgcaagaagaagactgctgcttccaagaaggaaggagaggaggctgaggctgtagcagaggagaagaagagtaaccatgtccaaagaaagctggaaaagaggcaacaggatcgcaagattgacccacatgttgaggagcaatttgcaagtgggcgtctattggctgcaatctcatcacgacctggccagtgtggtcgtgctgatggttacatcttggaaggaaaggaacttgagttttacatgaagaaacttcagaagaagaaagggaagggtgccggtgctgctgcttagagttgcaggctccaatttttaaattatcagaacaagttagattggtttttcttccctattcaagtcgcacttcattgaaagggaatgataaacttcttgtatcagagttagattcaagtttgttttgcatatggttaactgagaattttgagaacaacctactttatggaaaaaaagaattttgagaacagccttaattgcatcattaactgtttttttaatcagtgttaagatggacctt

SEQ ID NO: 7088 - DNA, 956 bp, Nicotiana tabacum
gcttgcaagagccctccattttttgttcgtcgcatttgggaaaacctaaaccctagggccctccatcgccggcaacaatgggtatctctcgtgattctatgcacaagagacgggccactggaggcaagaagaaggcttggaggaagaagagaaagtacgagcttggcagacagccagcaaatacaaagttggttcctaatgctaagactgttagaagaataagagtccgaggaggtaatgtgaagtggcgtgctttgaggttggatactgggaattactcttggggaagtgaggctattacaaggaagactcgtctattggatgtggtgtataatgcttctaacaatgagttggttaggacgcaaaccctggtgaagagtgcaattgttcaggttgatgcagctccatttaaacagtggtatctccagcactatggagttgatattggtcgcaagaagaagactgctgcttccaagaaggaaggagaggaggctgaggctgttccagaggagaagaagagtaaccatgtccaaagaaagctgcaaaagcggcaacaggatcgcaagattgacccacatattgaggaacaatttgctagtgggcgtctattggctgcaatctcatcacgacctggccagtgtggtcgtgccgatggttacatcttggagggtaaggaacttgagttttacatgaagaaactccagagaaagaaaggaaagggtgccagtggtgctgcttagagttgcacctccattttttcatattatgataagttcagaacaaattagattggtcgttattccctattcattggaagggaatgataacttcttgtatcagatttagattcaagtttcttttgcgtatggctatctaaaatttttgaaaactgcctactttatcaaaagaagaaatttaagaacagccttatcactaaaaaaaaagcggccgacaac

SEQ ID NO: 7089 - DNA, 903 bp, Ipomoea nil
gagggttttaacgtcttgccaagctgcacccctaacgctgcagtgccgaggaaggagaagaagctcttctcttcgcagacatgggtatctctcgtgattcgatgcacaagaggcgtgccactggtggcaagcagaaagcttggaggaagaagcgaaagtatgagctcggtcggcagtctgcaaatactaagctctcaagcaacaaaacagtcaggcggatccgtgttcgtggtggcaatgtaaaatggagagccctgagattggatacagggaattattcttggggcagtgaggctgttactaggaaaacgcgtatccttgatgtggtttacaatgcttcaaacaatgagcttgttcgaacacaaactttggtgaagagtgcaattgtgcaggtggatgctgccccctttaagcagtggtacctgcagcactatgctgtcgatattggtaggaagaagaagggacctgccaagaaggagactgctgaggaaggaaatgaaggtgctgctgttgaggaggctaagaaaagtaatcacgttcaaaggaaacttgagaagcgccagaaggatcgtaaactcgatcctcaccttgaggagcaatttggttctggtaggctgatggcctgcatttcctcccggccaggtcaatgtggcagagctgatgggtatattttggagggaaaagagctcgagttctacatgaagaaaattcagaggaagaagggcaagggagctggtgctgctgcataattgctttcaaaattttcaagaagcttattttcatcttctagtttcatttacattactatggcccacaatgctttgtgaacatctgttttatttgactgagtctattaaattattgctctcatgacataatattttgctttgccctgttgaaagt

SEQ ID NO: 7090 - DNA, 975 bp, Olea europaea
gttctgcttttgctgggggattcaccggaaccctgaaaactaccgccggtaaccatgggtatttcacgggattccatgcacaagaggcgtgccactggaggaaagaagaaagcgtggaggaagaagagaaagtatgagcttggtagacagccagcaaacacaaagttgtcaagtaacaagacagtgcgtagggtgagggttcgaggtggtaatgtgaaatggcgcgccttgaggttggacacagggaactattcttggggtagtgaggctgtgactaggaagactcgtattctcgatgtggtttataatgcttcgaacaatgagctggtcaggacccaaactttggtgaagagcgcaattgttcaggtggatgctgcacctttcaagcagtggtatcttcagcactatggagttgacattggtcgcaagaagaaagctgcagccaagaaggaaggagaggaggccgagggtgctgtagaagagacgaagaaaagcaaccatgttgagaggaaactgcagaagcgtcaacaggatcgcaagcttgacccacatgttgaggagcaatttggcagtggacgtcttttagctgcaatctcttcacgcccaggccagtgtggtcgtgctgatggatatattttggagggcaaagagttggagttttacatgaagaaacttcaaaggaaaaaaggaaagggtgccagcggggcttcctaaatttgtctcgaactaagaaaaatctctcaaaatcgtttttatctctcacgctttctttaagacagaagtttgctcgatctttctcctgtttagttgaaattttgaactgtcgtgtaatgaattttctagaaatattattcttctatttctctgggtaatagcattacagtgctgttgtggtgataattttgctctaattgcaatggtgcttcttaagtgtgaacatgcttcccttagcttgaaataaaaattgaaattttt

SEQ ID NO: 7091 - DNA, 951 bp, Capsicum annuum
agagattctatgcacaagagacgtgccactggtggaaagaagaaagcttggaggaagaagcgaaagtacgagcttggacgccagccagctaataccaagatttcaagtaacaagacagtcaggcgaattcgtgtgcgtggtggcaatgtgaagtggagggcactgagattggatacaggaaactattcatggggtagtgaagcagtcacccgcaaaactcgtatccttgatgtggtctacaatgcctcgaacaatgagcttgtccgcacacaaactcttgtcaagagtgcaatcgtccaagttgatgcagcaccatttaaacagtggtacttacagcactacggtgtcgacattggtaggaaaaagaaggggactgctaagaaggaaactactgaggatggagaagctgctgctccagctgaggaagctaagaagagcaaccatgtagtccggaaacttgagaaacgccagaaggatcgtaaacttgatattcatctcgaagaacagtttggctctggtaggctatatgcctgcatctcatcccgccctggtcaatgtggccgagctgacgggtacattttggaagggaaagagttggaattctatatgaagaaacttcaaaagaagaaaggcaaggcatctggtgctgctgcttaagtggtgctttcggaatgccctgactagtcttctccctgtctttttcggctttgttttattaagtttcaatggagagagtgtttttgtacgccgcttttatattttatgcacccccacaaattccaaatgatgcctggatttaattgttattagcaattcttagtttacaattttactgccagttttgctagttgtgacttgaatttgcctgaattggacaccttggttttgcaagcagaggctctataattgtctgacaacatatctgatgtaattctataacctactaccctt

SEQ ID NO: 7092 - DNA, 910 bp, Phalaenopsis aphrodite
gaggcggtctggtggccttaggattgcagaggcaagcgtcgtcatttctttcggtttgtcacaatgggtatctctcgagattccttgcataagaggcgcgctacgggcggcaagaagaaggcctggaggaagaagagaaagtacgagctgggtcggcagccagccaacaccaaactttccagcaacaagacggtgaggagggttcgagttcgaggaggcaacgtcaagtggagggctctccgcttggatacaggaaattactcatgggggagcgaagctatcacccgcaaaactagaatcctcgatgtggtttataatgcctcgaacaatgagctcgtgaggacgcaaactctagtgaagagtgctatcgtgcaggttgatgctacccctttcaagcagtggtacctacagcactatggtgttgagcttgggaggaagaagaaggccgccgctgcaaccaagaaggatgcgactgagggacaagagggcgaagctgcgcaggacgaggtaaagaagagcagccacatccaaaggaagctggagaaaaggcaggagacccgcaagcttgatgcccacattgaggagcagtttggcggtgggcgtcttcttgcctctatctcatctcgccctggccagtgtggccgtgctgacggttacattctggaagggaaggagctggagttctatatgaaaaagattcaaaggaagaaaggcaagggtgccggtgcggctgcatgagaacttctaggtttatctttactagggttttagcttattctgcaaatgctatttgggtccacaagttcggaagttataactgacagtatgtattattttcctttttattcctcgtgtttcttttcgacttctgctgaatcggtaatgccaaaggatatctctttttatttgt

SEQ ID NO: 7093 - DNA, 845 bp, Festuca arundinacea
gcggcggcgcgggcgtagaaggcgaagcagcagcggaggcaagctaccgacgccaccatgggtatctcgcgtgactccatgcacaagcgccgggccaccggtgggaagatgaaggcgtggaggaagaagcgaaagtatgagcttggccgccagccagctaacactaagctgtccagcaacaagactgtgaggagggtccgtgtccgtggaggtaacgtgaagtggagggctctccgcctggatactggtaacttctcatggggaagtgaggctgtgacccgcaagacccgtctcctggatgtggtttacaactcgtcaaacaacgagctggtacgtacccagactcttgtgaagaatgccattgtccaagttgatgctgctcccttcaaggggtggtatctgacacactatggagtggacatcggtcgcaagaagaaaacccctgctgctgcaaagaaggacgcagctgagggacaagagggtgaggtaactacagctgccacagaagaggcaaagaagagtaacaatgtccagcggaagctggagaagcgtcagcagggacgcactctggatgcccacattgaagagcagttcagcggtggaaggctgctggcctgcatctcttcccgccctgggcagtgtggcagggctgatgggtacatcctggagggcaaagagctggagttctacatgaggaagctccagaagaagaagggcaagggtgcctctgcttagatcactcctatgtgctttgtggcaggctgcatattttccctgggttttgttagttgtctcgtctatgttgtgtcttccgacgcactgaactctattttatgcaagtgaat

SEQ ID NO: 7094 - DNA, 1160 bp, Lupinus angustifolius
tgggaatgaaataaatcacaaccctaccaatggttttcttcctctcgtccctgaaagggtgaactcaccagccacagctagcagcggctccacgttactactttgctacttcgaaaatgggtatctctcgtgattccatgcataagaggcgcgcaactggaggcaagaaaaaagcttggaggaagaaaagaaagtacgagcttgggagacaaccagcaaacacaaaactttcaagcaataaaacagttaggaggattagggtccgaggtgggaatgtcaaatggcgtgctttgaggcttgatactggtaatttctcttgggggagtgaagctgtgactcgcaaaacaagacttcttgatgtggtgtataatgcatccaacaatgagttggttcgtactcaaacattggtcaagggggctattgttcaagttgatgcagcacctttcaagcagtggtatctccaacattatggtattgaaattggtcgcaagaagaagagtacaacttcggccaagaaggaaggcgaggttgctgaaaccacaactgaggaggcgaagaagagtaaccatgtcttgagaaagttggaaaagcgtacacagaaccgggttctcgatcctcatattgaagaacaattcggaggtggtcgccttttagcttctatctcatctcgacctggccaatgtggtcgtgctgatggatatatattagagggaaaagagctggagttctacattaagaagcttcagagaaagaagggcaagggagctgctgcttaaggatattgtcaatcttcctacaccttgtatcagagcttcatgttgaagctattatattatattatatctaagacacaatcagaaaatcagttttgccaggaaaagtactttttttggtggaatgggtatttgggcgttaacatagcccagtacttttaattgttttacttaatagtgagtcttgtttaaatagactaccaccgccattataacttttcatatgctggtattattctgaatgtgatgtgtatctgtttattattctgttgcttgcctgtgatgtgggttgattcttttcatgtgtatcatgatttgtatcgaccagttattggagatggaaatgaaaagaatcctcgccaaatcaatattaagaagaaatgatgt

SEQ ID NO: 7095 - DNA, 851 bp, Chelidonium majus
gaaactcatcgaagaagaaaccctaagtttctctctgtatctgcgaaaatgggtatatcacgtgattccatgcacaagaggcgtgccactggaggcaaaaagaaggcctggaggaagaagcgaaagtatgagctcggaagacaaccagctaacactaagttatcaagcaacaaaacagttagaagggttagggttcgaggagggaacgtgaaatggcgtgcattgagacttgatactggaaatttttcttggggaagtgaagctgtaacccgaaagacccgtattcttgatgtggtttacaatgcttctaacaatgaattggttcgtacccagactttggttaagggtgcgattgttcaggttgatgtggctccgttcaagcagtattgtcttcagcattatggacttgacattggacgaaagaagaagggtgctgttgctgctgttgtagccaagaaagatggcgaggaaggtgaggctgctactgaggaggccaaaaagagtaaccatgtagttagaaagcttgaaaagcgtcagcaagatcacaagcttgatgcacacatcgaggaacaattcagcggcggtcgtttattggctgctatctcatctcgtcctggtcaatgtggtcgagcggatggatatatcttagagggaaaagagttggagttctacatgaagaaacttcagaagaagaagggcaagggtgctgctgcttaaatgccaattatctccttggttttgaaaaccgatacattttttgctttcttttttgttgtttcagtataacatgctttccatccttatatcagttaagtgttcttaagttcagttttgactgtagtttaactatt

SEQ ID NO: 7096 - DNA, 1024 bp, Cucumis sativus
cccctctcagccccctccattctctctctcgaccttctctcgatcgttcaaggaatcctagactcgtctttactccgagagcccacgtcttaccaagatgggtatttcccgtgattctatgcacaaaaggcgtgaaactggaggcaagaagaaggcttggaggaagaagcgaaagtatgagcttggaaggcaacctgccaacaccaagttatccagtgacaagtcaatcaggaggattagagttcgagggggtaatgtgaagtggcgtgcgtttaggctggatactggaaattattcttggggtagtgaggccgtgactagaaagacccgtcttcttgatgtggtctacaatgcatctaacaatgagcttgttcgtactcaaaccttagtgaagagtgccatagttcaagttgatgcagcaccatttaagcagtggtatcttcagcattatggagtggatattggccggaagaagaagacctctgcatctgttaagaaggaagaggaaggcgatgctggcactgaggaggtaaagaagagtaaccatgtccagcgcaaaatagagaaacgtcagcaggaccgcaagcttgacccacatattgaagaacaattcagcagtggtcgtttgatggcttgtatctcatcaaggcctggtcaatgtggccgagcagatggatatatcttggagggcaaagagctcgaattctatatgaagaagctccaaagaaagaagggaaaaggagctggtgctgcttaaattttggttatggtttcagccagtattttcctgttcactccttttcttatgaagacaacgagctgttgcagctattttggaactttgattttgctggtaatagtttaattatagtacctttgaccttttttcatggtaacaacagtttgcttaattagcttgagtttaagttcaaaattttctagtcaatttatgtaagcgggttggtttggttgtttgatctagaatttatagaagtacaaatggattatagagtgatttaaactc

SEQ ID NO: 7097 - DNA, 1141 bp, Linum usitatissimum
agatcgagagaggttgagagagcagtctcactttgccgccgctccgccaacatgggtatttctagggactctctgcacaagaggcgcgccaccggaggcaagaagaaggtctggaggaagaagcgaaagtatgagctcggacgtcagccagccaacaccaagctctcgagcaacaagacagtgaggagggtgcgtgtcagaggtggcaatgtgaagtggagggcgctgaggttggataccggtagcttctcttggggaagtgaggctgtatctatgaaatgccgtcttcttgatgtggtgtacaatgcctccaacaatgagcttgtcaggactcagactttggtcaagagtgccatcgtccaagttgatgctgccccgttcaggcagtactaccttaaccactatggtgttgaggttggtaggaagaagaaggctgtggccaagactgctgaggaaggagatgctgccgctgctgctcctgcagctgaggaagcgaagaagagcaagcatgtcctgaggaagattgaatcccgccagaaggatcgccagcttgacccccacattgaggagcagttcagtggtggaaggctgttggcttgcatttcatcccgaccaggtcaatgcggtagagctgatgggtacatattggaaggtaaggagctggagttttacatgaagaaactccagaggaagaagggcaagggtgctggtgctgcttagatacactctttcgagatcttacgttccttttgttggatgtctttctgatgctttttaaagtaatgaagtgaaatactcttttctattactagccaagtagaagaattgtctctcgttttccctggtgtgttttgacttaacataagtccagagattttgccttgttttttaagctggttgcattttcaattccttttgattgaagctttatatcctcgaatgtgcctacctacatttattccgtagtgttctagccattgtttttatggttgattgatcagcctggtaatcggtgtatgtggttcgatctctgtttgatcggatagtttagttgaactacattttgcaatcattgtatgtgtcagattgatgtgttggtgtcgttgaactttcgtacatgaatgatgttcaatgtttctgc

SEQ ID NO: 7098 - DNA, 858 bp, Zingiber officinale
  misc_feature (841)..(841): n is a, c, g, or t
  misc_feature (853)..(853): n is a, c, g, or t
gcaccagtgcgataatcaccaccgggccgccaagatgggtatctcacgtgactcgatgcacaagaggcgcgccaccggaggcaagaagaaggcttggaggaagaagagaaagtatgagctgggaaggcagcctgcgaacacaaagctctctagcaacaagacggtgagacgagtgcgagttcgaggaggcaatgtgaagtggagagcactcagactggatactgggaattactcatggggaagtgaagctgtgacacgcaagacccgtatccttgatgtcgtctacaatgcctcaaacaatgagcttgtgaggactcaaaccctcgtaaagagcgcaattgttcaggttgatgccgcccccttcaaggcatggtatctccagcattacgggatcgaacttggaaagaaaaagaagaacccagcggtcgcaaaaaaagaggcaaccgagggccaagagggagaagctaccacagaagtagttaagaagagcagccacgtactgaggaagctagagaagaggcagcaggatcggaaactagatccccacattgaggaacagtttggtactggaaggctcttggccagcatatcctcgcgccctggccagtgtggcagagctgacggctacatattagaagggaaggagctcgagttctaccagaagaagatccagcggaagaagggcaagggagcaggagcttcctaattatctttctgcagttcatttcgaaatgccgttgttaccttgtttcattgagaagaatgtaatgctttgaacattaagatgtgtctcttttagaatttttagcaccagacactataaacaaatattaatttggcntaatttgatccncgtgc

SEQ ID NO: 7099 - DNA, 980 bp, Momordica charantia
ccatattgccttctgctgtgcactcccgccgccgcccgccgaacgttttcacccaccgatcggctgccgccctaagaagttctcctctagcaggagctctcgtctcgtcaagatgggtatttctcgtgattctatgcacaagaggcgtgccactggaggcaagaagaaggcgtggaggaagaagagaaagtatgagctcggaaggcaacctgccaacaccaagttatccagtgacaagtcaatcaggaggattagggttcgtggaggcaatgtgaagtggcgtgcttttaggcttgatactggaaactactcgtggggtagtgaggctgtgactaggaagacccgtattcttgatgtggtgtacaatgcatctaacaatgagcttgttcgtactcaaactttggtgaagagtgccatcattcaggttgatgcagctccattcaaacagtggtatcttcagcattatggagtggatattggacggaagaagaagacctcagcatctgctaagaaggaagaggaaggtgatgctccctctgaggaggcaaagaagagcaaccatgtccagcgcaagctggagaaacgtcagcaggaacgtaaacttgatgcacatattgaagaacaattcagcagtggtcgtttgatggcttgcatctcatcaagacctggtcaatgtggcagagcagatggatatatcttggagggcaaagagcttgaattctatatgaagaaactccaaaggaagaagggaaagggagctggtgctgcataaactttgtcgttaagatgttttctgcccgtgtttctagttccatctgccttttcttcttatgaagacgataagctattgcaactaagatgaaaaagttatttaggaacttcaattttgctggtattagttgttgaattacaatactgtagtctttttcaacattaccatgaatttctgaacttgccagttatttagcaattacttgatt

SEQ ID NO: 7100 - DNA, 1340 bp, Populus trichocarpa
tttggaaaagaaaagaaaaggaggggtatgtacaatgacaagactaccccgtattgacagacaactagggttttacgaatagcagagctggtaagtcgaaggagaggcgcttaggagcagatacataaaatcagtggtctccgcaagaccgcaaccgcaactgcaaccatgggtatctcacgtgactctatgcacaagaggcgtgccactggaggcaagaagaaggcctggagaaagaagagaaagtatgagctaggccgtcagcctgcaagcactaagctctcaagcaacaagactgtcagaagaattcgtgtgcgaggaggcaatgtgaagtggagggccctcagattggatactgggaactactcgtggggcagtgaagctgtcactcgcaaaacccgtattcttgatgtggtttacaatgcctcaaacaatgagcttgtccgaacccagactcttgtcaaaagtgctattgttcaggtggatgctgcccctttcaagcaatggtaccttcagcattatggggttgacattggtaggaagaagaaggctgtggtgaagaaggaaacccctgagcaggaaggagaagcaactacagaagaaacaaagaagagcaaccatgtcatcaggaagcttgagaagcgtcaacaggttcgtaagctagatcctcacattgaagagcagtttggaagtggtaggctgttggcttccatctcttctcgacctggtcaatgtggcagagctgatggatacatcttggaaggaaaagaacttgaattttatatgaagaagatccagaggaagaagggaaagggtgctggtgctgcttaagcaattcaataactggactcctctgcttgttttcgagtttagttgctttacttttcattctattatgcgtaggacaaaaattttgtatttcagcactgattttggagtttaaagactaaatatctatatttagccttctccagtgaatcacgttttggcttgcttggaactcataaatcaattttcgaatgaaattaaaacttctaattttttgactcagccaccaatattatggtcacagacagttactgaaattgcttcctttgaacatcagatgtgttaagtttgtcaacattaggagttgggaaattgtaggcaacggccaacttgaagaatgatttcagctggaaaattaatgttatgttcttctcagatgttaccataagatttgccttggtagttctaggttttggcaaacttcaggttcaagtgcgtctatactgatgacagtttcagatattgctctggcgtgtagattgtctccaggaattccctgatgccttgtttgt

SEQ ID NO: 7101 - DNA, 900 bp, Tripterygium wilfordii
cggaggagagggaaggagtcttcactcaagcagctcagcgaagatgggtatttccagagattccatgcacaagaggcgcagcaccggtggaaagaagaaagcctggaggaagaagcgaaagtatgagcttggtcgccagtctgcaaatactaagctctcaagcaacaagactgtcaggagagttcctgtaagaggaggcaatgtgaagtggagggccctgaggttggacactgggaattattcttggggcagtgaagctgttacccgcaagactcgtattcttgatgtggtttacaatgcctcaaacaatgaacttgtcaggacacaaactcttgtcaagagtgcaattgtccaagtggatgcggctccattcaggcaatggtaccttcagcactatggtgttgacattggtcggaagaaaaaggtggcagcaaagaaagaaacaacagaggagggggaaactgtggccgaggaaactaagaagagcaaccatgtcatcaggaagcttgaaaagcgtcaaaaggatcgtaaacttgatgcccacattgaagagcaatttggtgctggtagattgatggcctgtatttcatcccgtccaggtcaatgtggcagagctgatgggtacatattggaaggtaaggaactggagttctatatgaagaagattcagagaaagaaaggcaagggtagtgctggggctggtgctgccgcttaagttattttatcttgcggtaatccactatcagaaataggttgcggtgcaggtttttttactgtatgttaatgagatgtaatgcatgttggggatttcctcattttgttccggtggttttaatttttctaaatgaagcagtgctctattcatgacaatctggctatatggaatgaacattaggtggt

SEQ ID NO: 7102 - DNA, 755 bp, Cleome gynandra
aagcagaagcaatggaagaaagaagcgaaagtacgagatgggaagggttgccgcaaacaccaagctttcgagcaacaaaactgttcggagggttagggttcgtggaggaaatgtcaagtggcgtgctttgaggcttgacactggaaactactcttggggaagcgaggccgttacccgcaagaccaggatacttgatgtcgtgtacaatgcatcaaacaatgagcttgtccgtaccaagactctggtgaagagtgctattgttcaagtcgatgctgcgcccttcaagcaatggtatctccagcactatggtgttgaggtcggccgcaagaagaagactgcgactacatctgggaagaaagaaggagaggaaggtgaagactctgctgctgctcctgaggaggcaaagaagagcaaccatgtcctgagaaagcttgagaagcgacaacagaaccgcactcttgatgcacacattgaggaccaatttgcaagtggtcgattgcttgcttgtatctcatcaaggcctggccaatgtggtcgtgctgacggatacattttggagggtaaagagctggagttctacatgaagaagatccagaaaaagaaggggaagggtaccgcttaaggatatgtttggattcttggtcgctacatccttagttttgttggtgtctctatactttctggttagtacacgacaagagatatttaatgtatctttggattaacctatgttgacctttttctatgaactaaat

SEQ ID NO: 7103 - DNA, 990 bp, Tropaeolum majus
gtttcaaaccctagcttttctctgtggagattcgtgaactattgacggagaaacctttgaattctctttgcaaatatggggatttctcgggattctatgcacaagcgccgtgctactggagggaagaagaaggcttggaggaagaagcgaaagtatgagcttggaagacagcctgcaaataccaaattgtcaagcaacaagacagttagaaggattcgggttcgtggtggaaatgtcaagtggagggctctcaggctcgatacaggaaacttttcatggggaagtgaagctgtgactcgtaaaactagacttctggatgttgtgtacaatgcatctaacaatgaacttgtgcgtacccaaacccttgtgaaaagtgccattgttcaggttgatgctgcaccattcaaacaatggtatctccagcactatggtgttgaaattggtcgcaagaagaagacagctgtttcagccaagaaggaaggagaggaagttgaagctgctacagaggaggccaagaagagtaaccatgttacaagaaagctagagaagcgtcaacaaacccgcgagcttgactcacatatcgaagagcaatttggaggtggtcgtttgttggcttgtattgcatcacgacctggtcagtgtggtcgcgctgatggatacattttggaaggcaaagagctagagttctacatgaagaagttacagaaaagaaggggaaaggagctgcctaagattttgttaccttaacttttttactccatcttaaagtatttagtatttactttttagacttggaagttagcttgggatgagttaaaacagaaatgctattttttgactttttataagagtattgaacttacttatgtgacctttctactgctttgttgtctacttatcaatttttgttgcttgatttgtgggcagtcatgaggaaaataagttttccttgaacgtttctactcagaggtccgtttagtttgtgtgaaa

SEQ ID NO: 7104 - DNA, 914 bp, Nicotiana benthamiana
tgtgagggagtgtctcttagctgcttttagctctcagcaaccatgggtatctcacgagattctatgcacaaaagacgtgccactggtggcaagaagaaagcttggaggaagaagcgaaagtacgagcttggccgtcaacctgccaatactaagatctcaagtaacaagacagtcagacgaattcgtgttcgtggtggcaatgtgaaatggagagcactgagattggatacaggaaactattcatggggtagtgaagcaaccacccgtaagactcgtatccttgatgtggtctacaatgcctcaaacaatgaacttgttcgcacacaaactctggtgaagagcgcaatcgttcaggttgatgcagcaccttttaaacagtggtacctccagcactacggtgttgacattggtaggaagaagaagggggctgctaagaaagaaactgccgaggagggagaaggtgctgctgctgcagaggaaactaagaagagcaaccatgtagcccgaaaacttgagaaacgccagaaggatcgcaaacttgatgctcaccttgaagaacaatttggtgcgggtaggctgttggcctgcatctcatctcggcccggtcagcgtggcagagctgatgggtatatcttggagggcaaagaacttgagttctatatgaagaagctacagaagaagaagggcaaggctggagctggtggagctgcttaattgaagctcttagatttttgagactaatttatatgtttttcctttttacctgttaatcaacttggtttgtgaggatatttttctatatgcagtattctttaatcttaccatgagttgacgttgatgcttggacttcatctgttattgttgtcgctgattagttgtttcagtttcttctgaaaatttttgccatattttta

SEQ ID NO: 7105 - DNA, 976 bp, Nicotiana benthamiana
agggttttagtgcgctcgttcgaagtagaagagagttgtgagggagtttatctttgctgcttagctctcagcaactatgggtatctcacgagattctatgcacaaaagacgtgccactggtggcaagaagaaagcttggaggaagaagcgaaagtacgagcttggccgtcaacctgggaatactaagatctcaagtaacaagacagtcagacgaattcgtgttcgtggtggcaatgtgaaatggagagcactgagattggatacaggaaactattcatggggtagtgaggcaaccacccgtaagactcgtatccttgatgtggtatacaatgcttcaaacaatgaacttgttcgtacacaaactctagtgaagagcgcaatcgttcaggttgatgcagcaccctttaaacagtggtacctccagcactacggtgttgacattggtaggaagaagaagggggctgctaagaaagaaactgtcgaggagggagaaggtgctgctgctgtagcagaagaaactaagaagagtaaccatgtcgccagaaaacttgagaagcgccagaaggatcgcgaacttgatgctcaccttgaagaacaatttggtgctggtagactcttggcctgcatctcatctcggcccggtcagtgtggcagagctgatgggtatatcttggagggcaaagaacttgagttctatatgaagaagctacagaagaagaagggcaaggctggagctggtggagctgcttaattgaagctcttagatttttgagactaatttatgtctttcctttttacctgttaatcaacttggtttgtgaggatatttttctatatgcagtattctttagtcttaccatgagttgacgttgatgcctggacttcatttattattgttggtgttgattagttgttcagtttcttatgaaatttgctgtattttaactataaatcatagaaattgtgttttccagca

SEQ ID NO: 7106 - DNA, 1016 bp, Carica papaya
ggtgcgagggggaggagtgagtatcgttgccgctagcaaagatgggcatttctcgagattctatgcacaagaggcgcgccactggtggcaagaagaaagcatggaggaagaagagaaagtatgaacttggtcgtcagcctgcaaatacaaagctctcaagtaacaaaactgtaagaagaattcgtgtaagaggaggcaacgtgaagtggagagccttgaggctggatacaggcaactactcctggggtagtgaggctgtcactcgcaagactcgtatccttgatgtggtttataatgcatcaaacaatgagctagtcaggacccaaactctggtgaagagtgcaatcattcaggttgatgcagcaccattcaagcagtggtatctccagcactatggtattgacattggtaggaagaagaaagcagcagtatctaagaaggaaagcactgaggagggagaagctcctgcagctgaggaaactaagaaaagcagccatgttcttaagaagcttgagaagcgccaaaaggatcgcaaacttgatccccacattgaagagcagtttggagctggtaggttgttggcgtgcatttcatcccgacctggtcaatgtggcagagctgatgggtatatattggagggtaaggagctggaattctatatgaagaaactccagaggaagaagggcaagggtggtgctggagctgctgcttaggtgcattattccgatcgatcttcagtttccagtgttgttttattttaggtttgtgtttgaccagaaccattgatgttagatactcttgagtacttgactggtcattgatagattgatcttttggtattgtggtggcttgcttttgtttttgttggaaatttttgtttattctgttatttaagctatgtctactttagggaaattgcctatacaccagtgcatgaatcttatggtcctaaagtttttgtttatttgggttcttcattatatgattacagtgacaaccaagttactgtgttcatc

SEQ ID NO: 7107 - DNA, 685 bp, Solanum phureja
atactttgtcgccggcaaccatgggtatctctcgtgatttgatgcacaagagacatgccactggaggcaagaagaaggcatggaggaagaagcgaaagtatgagatgggaagacagtttgcaaatacaaagctggtgcctaatgctaagactgttaggaggatcagggtccgaggaggcaatgtgaagtggcgtgctttgaggttggacactggaaattactcttggggtagtgaagttgttactaggaagacccgtttattggatgtggtctacaacgcctcaaacaatgagttggttagaacacaaactctagtgaagagtgctattgtgcaagttgatgcagctccatttaagcagtggtatctccagcattacggtgttgaaattggttgcaagaagaagagtgttgccaagaaggaaggagaggaggctgctgaggctgctgcagaggagaagaaaagtaaccatgtccaaagaaagctggaaaagcgtcaacaggatcgtaagatcgacccacatgttgaagagcaatttgctagtggtcgtctattggcggcaatctcatcacgacctggccaatgtggccgtgctgatggttacatcttggagggtaaggaactggagttttatatgaagaagctacagaaaaagaaagggaagggtgcaagtggtgctactgctta

SEQ ID NO: 7108 - DNA, 776 bp, Persea americana
gggagagcgagggagttttgttaatcctgttcgtcccgccgctcaacgagacaacatggggatctctcgagattcgatgcacaagcggcgcgccactggcggaaagaagaaggcttggaggaaaaagagaaagtacgagctgggccggcagcctgcaaacacgaagctctcaggcaacaagacagtgaggagagtccgtgttaggggaggaaacgtgaaatggcgtgcccttcgtttggacactggaaattactcgtggggaagtgaggctgttacccgcaagacacgtatccttgatgtggtttacaatgcttctaacaatgagcttgttaggacccagaccctagtgaagggtgccattattcaggttgatgctgccccgttcaagcagtggtacctgcagcactatggtattgacattggtaggaagaagaaggctcctgtcgccaagaaagaagcagcggagggacaggatggcgaggctcctgtagaggaagctaagaagagcaatcatgtcgttaggaagctggaaaagcgtcaggagggtcaaaagcttgatgctcatattgaggagcagtttagcagtggcaggctgttggctgccattgcctctcgtcctggtcaatgcggcagagctgatggatatattttagaagggaaggagctcgaattctacatgaagaagattcagaggaagaaaggcaagggtggcgctggtgctgctgcttaaaatggatcttctcggggccttttttgttcttagagattctggaact

SEQ ID NO: 7109 - DNA, 2816 bp, Chelidonium majus
gagtgagagggaggggctgaagctgcaatcatgggtatttcacgtgattctatgcacaagagacgtgccactggaggcaaaaagaaggcatggaggaagaagcgaaagtacgagctcggtagacaacccgcaaacacaaagctctcgagcaacaagacagttcgtagggttagggttcgaggaggaaacgttaaatggagagctttgagactcgatactggaaatttctcatggggaagcgagactgtgacccgaaagacccgtattctcgatgtggtttacaacgcgtcgaacaacgagttggttcgaactcagactctggttaaaggtgctattattcaggttgatgccgcaccattcaagcaatggtatctccagcattatggtcaagacattgggcgtaagaagaagggtgctgccaagaaagaaggagaggaggagaagcctgcagccgaggaggcaaaaaaaagtaatcacgtcttgaggaagattgagaaacgtcaagaagagcacaagcttgacgcgcatattgaagagcagtttagcggtggtcgattattggctgcaatctcatcacgacctggacagtgtggtcgtgcagatgggtacattttggaaggaaaagagctggagttctacatgaagaagctccagaagaagaagggcaaggctggtgcaggagctgcctagatgttttaaagctcaaaattcatcccttgtcttcttttagcaattgtcttttatacattttgaccattagatgaggtgtttcaattagattgaagttttgttttcttatcagattttttttatgtcattgttcatttcgatggggagatgatttagacttgtttagttggattaaattcccctaatttctgttcttaatgttatcaattcgtgcagtcaaaaaaaaaaaaaaaaatgttacgtttcagatcacaggcaaagctcattttaccaacctttctcttcatagcatcaaccttcttcttctctcatggagtttctcaggcacctagccttcaaacgttacttccccaagatatggttaatgggaaggtaaatggacaactgaatcaagtattactcagcaccgacggaaatgatactaatttatacaattcaacccttgtattagctgcaaagagaactcacaggaaggatcctcttaacagtttcaagcggtatacaggtggatggaatattagtgaagaacattattgggcttctgtaggttttactgctgttcctttgttcgtaattgctggagtctggtttgtgatatttgggttgtccttgttcctcgtatgtacctgtcatttctgttgtcggaaagagccgtatggttattctagaatagcatatgctctttcccttatcttgctgatcctcttcaccattacagcaattgttggatgtgttgttttatacactggacaggggaaatttcatgggattacaacagatactttgggatacgttgtgaagcaaggaaatttaactgtggagaaccttaataatgtgtcaaattatcttgcttcagctaagaagatcacagtggataaggtttttctaccttccgatatgcagactaaaattgacgagattcaaactaagattaatacttctgcgaacactcttgctaaacgtacggatgagaaccaggaccagataaaagatttattggataatacgagattggctcttatcataattgctgctgtaatgctcttcttggcatttcttggattcatattttctatttttgggatgacgtttcttgtgtcaatcttggtagtcatcggatggattcttgtcgcgggcacatttatcttgtgtggagtatttctccttcttcacaatgttgttgcggacacatgtgtatcaatggatgagtgggttgcgcacccgactgcttatacagctctcgatgatattctgccctgtgtggataataaaacagccgctgagaccttgacgcgaaccaaagaagctacaaaacaacttgttggtgtggtgaaccaagtcatcaccaatgtctctaacattaacttctcacccaactttgctcctctgtatttcaatcaatctggtccattgattcctgtcctctgcgacccgtttactgctgacttgtctgataggcaatgctcaactggtgaagtggatttggataacgcaacacaggtgtggcagagttacgtctgccaggtttcatctacagggatttgtactacagtgggccgtataacccctgatttctacacacagatgtctgcagcagtgaatgtcagctatgggctttatcattacggtccattcttagtcaaccttgaagattgcacatttgtgagagagacatttacagaaatcagtagggattattgtcctggattgcgccgatatagtcagtggacctacattggattggttatggtttcgggtgctgtgatgctctccttaatcttctgggtaatctatgcgagagagcgacgacaccgtgtttacaccaaacaattcttggtttcaggtcaaggtgcgtttgaagagcataaaaattcatagaggatctttagttttcgttccttctcttaagttggactgtgcgtttttttcatagagtttgatggtttaagttgatgtacatctttgcagttggtttacatgagttactacactgtatatattatgtcagatttccaatcgttggtttgatcagcgttcaaaagcttttgaacggaaattactctgtaatatgattctatactgggttttgtcgaattatctcatgcttttatttattaaggttttcg

SEQ ID NO: 7110 - DNA, 850 bp, Eschscholzia californica
agggtttcaatctgcaatcatgggtatttcacgagattctatgcacaagagacgtgccactggaggcaagaagaaggcttggagaaagaagcgaaagtacgagcttggaagacaaccagcaaacacaaagctttcaagcaacaaaacagttcgaagggttagggttcgtggaggaaacgttaaatggagagctcttagattagatactggaaattactcatggggaagtgaaactgttactagaaaatctcgtatccttgatgttgtttataacgcatcgaacaacgagttggttcgaactcaaactctagttaagagtgctattgttcaggttgatgctgctccattcaagcaatggtatcttcagcattatggtcttgatattggacgtaagaagaagtccacttctgctaagaaagaagctgaggagggtgaagctgttgaggaagcaaagaaaagcaaccatgttgtaaggaaaattgagaagcgtcaagtagaccacaagcttgacccacatattgaggagcagtttagtggtggacgattattagctgctatctcatctcggcctggtcagtgtggccgtgctgatgggtatattttggaaggtaaggagctggagttctacatgaagaaactccagaagaagaagggcaaggctggtgcaggagctgcttgattttgatctttcttcctagaagttcttttctctgttcttctctccagcttttatgcgctttaagttggatgctatgttcggattactttgaagttttgtttttttcattggattttgtagcttctttgctggattatggttaataccatcttgaaaagaatttgtttagat

SEQ ID NO: 7111 - DNA, 716 bp, Ipomoea batatas
gcatatagctcttctagctgccacgctttcgccatgggtatctctagggattcaatgcacaagaggcgtgccactggtggcaagaagaaggcatggaggaagaagcgaaagtatgagcttggacgtcagcctgcaagcactaaactgtctagcaacaaaacagtgagacgagttcgtgtacgaggaggcaatgtgaagtggagggcactgaggttggatacaggaaactattcatggggtagtgaggcagttactaggaaaacacgtatccttgatgtggtttacaatgcctcgaacaatgaacttgttcgaacacaaactctggtgaagagtgcgattgttcaggttgatgcggctccctttaagcagtggtaccttcagcactatggtgttgacattggcaggaagaagaagggagctgccaagaaagaaacttctgaggaaaccgagggtgcagctgctgaggaggcaaagaagagcaaccatgtccaaaggaaacttgagaagcggcagaaggatcgtaaacttgactctcaccttgaggagcagttcggctctggtaggttgatggcctgcatctcatcaagacctggtcaatgtgacagagccgatggatatattttggaaggaaaagagctcgagttctatatgaagacaatccaaagaaagaaaggcaagggtagcggtgctgctgcttattttgcagtcaagatttt

SEQ ID NO: 7112 - DNA, 1214 bp, Quercus alba
cgggggaagcgacaggaaattacgagactaacttcgtatgtcgaccacagtgcatttctagggtttccacataaaagccgataatcatccttaaacacacaacaggaggtgctgttgttgttgttgtagcataataggtaccgagcccaaagaagaagtcgttctcatcctctgcaaccaaccatgggtatctcacgtgactctatgcacaagaggcgtgccactggaggcaagaagaaggcctggaggaagaagagaaagtatgagcttggtcgtcagcctgcaaatactaagctctcaagtaacaagaccgtaaggcgaatccgtgtgagaggaggcaatgtcaaatggagagccctcagattggatactggaaactactcatggggtagtgaagctgtcacccgcaaaacgcgtatcctggatgttgtttataatgcttcgaacaatgagcttgtcagaacacaaactctggtgaagagtgctattgttcaggttgatgctgccccgttcaagcagtggtaccttcagcattatggagttgacattggtaggaagaagaagacagctgctaagaaggaaaccccagaggaaggcgaaggaaatacggaggaaagggaaaaggaaacaaaaaagagtaaccatgtcgccaggaagcttgagaagcgtcagcaaggtcgtacacttgatgcacatattgaagagcagtttgggggcggtaggctgttggcgtgcatctcttctcgaccgggacaatgtgatacattttggaaggaaaagaacttgagttctatatgaagaagatccaaaggaagaaggggaagggtgccgctgcttaagtagtttattagtcatagttttggtctttttgcaacttgtttttgttacacctgcctagatgggccaatgtttatcattattgattgaactctgaggattgtgtagcatgtttagttgtttcaaattagatgctttgtgattgacaagtcagacttgagctaaaatagcacttgttgggtgctggcctctttatccatcactctcttgtagtagaatttctttttattgttatagctgtgctcttttcatggtattgccagttcctgtaatagttatattgcaactttttccctatagtaaaatttagaaccctgacctctatataccaaaaaaaaaaaagttaaattatgcgatctagaactaggacacgcgag

SEQ ID NO: 7113 - DNA, 856 bp, Physcomitrella patens
tctctttccgtttcgaagcgcgactccacctcgccggagctcttgcgagcacacaccgcaaccatgggtatctctcgggattcgactcacaagagacgggcgactggaggaaagaagaaatcatggcgcaagaagcgcaagtacgagttgggaaggcaaggtgccatgaccaagttgtctagcaacaagactgtcaggcgcatccgtgtgcgtggcggtaactctaagttccgggcgttgcgtttggacacaggaaatttctcttggggttccgaggctgtcacccggaagaccagagtcctggatgtggtctacaatgcctccaacaatgagctggtccgtacccagactttggtgaagaatgccatcatccaagttgatgctgctcctttccgcacctggtacagccagcactacggtgttgaaattggcaagaagaagaaggcggcagccaagaaggatactgaggacgccgaaaccacagaggaagagaagaagagcgcccacgtgcagaggaagctggctaagagattggagggccagaagctggactcccacttggaagatcagtttgccagcggcaggctgctcgcctgcattgcctcccgccctggccagtgcggccgtgctgacgggtacatcttggaaggtaaggagcttgagttttaccagaagaagatccagaagaaaaagggcaagggtgccgccgcctaggcttttggtagtcatttgataggactattctggtgtgccttgtcgaggctatgcgaaacctattgattcaggttttttcataatggaaaatttctcgcaatcagaatctgcattgtgacattacctgaggatcttcaacaca

SEQ ID NO: 7114 - DNA, 847 bp, Physcomitrella patens
tccgtttcgaagcgcgactccacctcgccggagctcttgcgagcacacaccgcaaccatgggtatctctcgggattcgactcacaagagacgggcgactggaggaaagaagaaatcatggcgcaagaagcgcaagtacgagttgggaaggcaaggtgccatgaccaagttgtctagcaacaagactgtcaggcgcatccgtgtgcgtggcggtaactctaagttccgggcgttgcgtttggacacaggaaatttctcttggggttccgaggctgtcacccggaagaccagagtcctggatgtggtctacaatgcctccaacaatgagctggtccgtacccagactttggtgaagaatgccatcatccaagttgatgctgctcctttccgcacctggtacagccagcactacggtgttgaaattggcaagaagaagaaggcggcagccaagaaggatactgaggacgccgaaaccacagaggaagagaagaagagcgcccacgtgcagaggaagctggctaagagattggagggccagaagctggactcccacttggaagatcagtttgccagcggcaggctgctcgcctgcattgcctcccgccctggccagtgcggccgtgctgacgggtacatcttggaaggtaaggagcttgagttttaccagaagaagatccagaagaaaaagggcaagggtgccgccgcctaggcttttggtagtcatttgataggactattctggtgtgccttgtcgaggctatgcgaaacctattgattcaggttttttcataatggaaaatttctcgcaatcagaatctgcattgtgacattacctgaggatcttcaac

SEQ ID NO: 7115 - DNA, 970 bp, Platanus occidentalis
tcggtagaggcttagagctgcagaggacaagccctcaacccctcgctctgcaacaatgggtatttctcgggattccatgcacaagagacgtgccacaggaggcaagaagaaggcctggagaaagaagcgaaagtacgagcttgggcgacaacctgcgaacacgaagctatcgagcaacaagacagttcggagagttagggttcgaggagggaacgtgaagtggcgtgcgctgaggctcgatacagggaattactcatgggggagcaaggcagtgacccggaagactcgtatcctcgatgtggtctacaatgcgtcgaacaacgagctggtgcgtacccagactttggtgaagagtgcgatcgttcaggtcgatgcagcacccttcaagcaatggtacctccagcattacggcctcgatatagggcgtaagaagaagagttccgcgaccgccaagaaagaaggagaggaaggtgaggctgctgaggaggcaaagaaaagcaaccatgtcctgagaaaacttgagaagcgtcaacaagagcataagcttgatactcctattgaagagcagtttggtggtggccgattactggctgcaatctcatcacggcctggtcagtgtggtcgagctgatggatatatcctggagggcaaagagctggagttctacatgaagaagctccagaggaagaagggaaaggctgcaggaggtgctgcttaaaattttcatttcattactctttttttccatgtcatgttttgcaggctatattgactctaaatgagcttagatgtgcttcagttagttttgaactttttctcgtcattgaatggtttggcagaattgcccattcttttcatgatcaaatatttttgaacttctttgctattaactgtctagtagttgtatgtcttgtgtccttcctttgctggttcattttcatggccttgaactctctacaaattaagattc

SEQ ID NO: 7116 - DNA, 1150 bp, Sarracenia psittacina
gcttctcctctagcaaattatccatctctcaactctcagagaaccctaagatcctcagtgatccgcaaccatgggtatatctcgggattccatgcacaagaggcgtgccactggaggaaagaagaaggcttggaggaagaagagaaagtatgagcttggaagacaacctgctaacacaaagttgtcgagcaacaagacagttcggcgagttagagttcgtggtgggaatgtgaagtggcgtgcattgaggttggatacagggaactactcttgggggagtgaggctgtgacacggaagactcgaattttggatgtggtttataatgcttccaataatgagttagttcgaacccaaacgttggtgaaaggtgcaattgttcaggttgatgctgctccatttaagcaatggtatcttcagcactatggagttgacattggtcggaagaagaaaactagtgcttctgccaagaaagaaggagaggtggagggcgatgcagctattgaagagacaaagaaaagcagccatgtcttgagaaaactgaaggatcgccaagaggatcggaagcttgacccacatgttgaagagcaatttggcggtggacgtttgttagctgcaattgcatctcgacctggccagtgtggtcgtgctgatgggtatatattggagggcaaagagctggagttttacatgaagaagctccagaggaagaaaggaaaaagtgctggaggtgctgcttgatggtgctttgctttttgttttgtttgttttttaaacaagctgaactccatttgaattcagaaatgtccaatttcctatttttccattgtttttcgaggcatagaaccgaagactggtcgagttgacagttagcttgaaacattttattttgctgtctggtattgatcgattatatctaaattacttcatgtgggaatgggtttaaatttttccataataatttagtactttaatttgttgtgcttggagatcatatgctatatgattcatcagccttgcttgatcgatatggtgcattgttatgggtacgatcttgctgtaagtctgactgcctctagatttcaatattttgaaatttcacaccatagaattttagtctaaatttgtttagtatacaaatagtattcaatt

SEQ ID NO: 7117 - DNA, 685 bp, Centaurea maculosa
catctgcaaccatgggtatttctcgtgattccatgcacaagagacgtgcaactggaggctagaagaaggcgtggaggaagaagcgaaagtatgagctcggaagacagcctgacaacacaaagacctccattaacaagaccgttaggagggtgagagtccgtggtggtaatgtgaagtggcgtgcgttgaggttggataccggtaacttctcgtgggggagtgaggctgtgacacgaaagacccgtatcttggatgttgtttacaatgcatcatacaatgagttggtcaggacccagaccctggtgaagagtgccattgttcaggttgatgcagccccatttaagcaatggtatcttcagcactatggtgttgacattggtcgcaagaagaaaggagccgctactgtcaccaaaaaagagggagaggatgctgaaggtgcaactgaggaggccaagaaaagtaatcatgttgtgaggaagttggaaaagcgacaagaggaacgtaaactggacgcacacgttgaagaacaattctccggtggtcgtctttatgcagcaatctcatcacgacctggccagtgtggtcgtgctgacggatacatattggaaggcaaagagcttgaattctacatgaagaagcttcaaaagaagaaaggaaaaggtgctgcttaagtcttgttataggt

SEQ ID NO: 7118 - DNA, 1041 bp, Carpinus betulus
cgtaccttcgatctctctcagactctgcaaccatgggtatctcccgtgactcgatgcacaagaggcgtgcgactggaggcaagaagaaggcctggaggaagaagagaaagtatgagcttggccgtcaggctgcaaatactaagctctcaagtaacaagaccgtgaggcgaatccgtgtcagaggaggtaatgtgaaatggagagccctcagattggatactgggaactactcatggggtagtgaagctatcacccacaaaacacgtatcctggatgttgtttacaatgcttcaaacaatgagcttgtcagaacgcaaactctggtgaaaggtgccattgttcaggtggatgttgctccattcaaacagtggtaccatcagcactatggagtggacattggtaggaagaagaaggcagctgctaagaaggacgctcctgaggaaggagaaggaactgcaacagaggaaacaaagaagagtaaccatgttgtcaggaagcttgagaagcgccagcaaggccgtacacttgatccccatattgaagagcagtttgggagcggtagactgttggcttgcatttcttctcgaccaggccaatgcggtagagctgatggatacatcttggaaggaaaagaacttgagttctacatgaagaagctccagaggaagaagggcaaggctactggtgctgctgcttaagtagtttattagttgcgcagtctctggtcttttcatgacatgttttagtttgcaccctttttctgcctagatgaactgatgtttgtccttactattgcaactctcaagattttgctgggcaatgtctagttgtttcaatttgactattttgtgatctacaagtaagttttgagctaaaattgcacttgatgggtgctggtttctttattgttcattagctattagttctatttgatattgttatagcttgtgtctcctgctgctgcggttcatgctatttaagaatttgcttttgtgatgttgctttcttcctgtaataattatagtgcttattccctgttag

SEQ ID NO: 7119 - DNA, 989 bp, Nicotiana benthamiana
aaggtcacattgctcagctgcttgcagagccctccatttttatgtgcgttgcatttgggaaaacctaaaccctagggccctccatcgccggcaacaatgggtatctctcgtgattctatgcacaagagacgggccactggaggcaagaagaaggcttggaggaagaagagaaagtacgagcttggcagacagccagcaaatacaaagttggttcctaacgctaagactgttagaagaataagagtccgaggaggtaatgtgaagtggcgtgctttgaggttggatactgggaattactcttggggaagtgaggctattacaaggaagactcgtctattggatgtggtgtataatgcctctaacaatgagttggttaggacgcaaaccctggtgaagagtgcgattgttcaggttgatgcagctccttttaaactgtggtatctccagcactatggagttgatattggtcgcaagaagaagactgctgcttccaagaaggaaggagaggaggctgaggctgttccagaggagaagaagagtaaccatgtccaaagaaagctgcaaaagcggcaacaggatcgcaagattgacccacatattgaggagcaatttgctagtgggcgactattggctgcaatctcatcacgacctggccagtgtggtcgtgccgatggttacatcttggagggtaaggaacttgagttttacatgaagaaactccagagaaagaaaggaaagggtgccagtggtgctacttagagttgcacctccattttttcacattacgataaatctagaacaaatgagattggtcgttattacctattcattgggagggaatgataacttcttgtaacacagtgagattcaagtttcttttgcatatggttatctaaatgttttgagaactgcctactttatcaaaagaagaaatttgagaacagccttatcactcgacgactgtttttctaatagcatcatttaactgt

SEQ ID NO: 7120 - DNA, 936 bp, Musa acuminata
cctctccttatgctcgcaggtatctcgcgggactccatgcacaagaggcgcgctactgggggcaagaagaaggcatggaggaagaagagaaagtatgaattgggaaggcagccggcgaacacaaaactctccagcaacaaaacagtgaggagggttcgagtgcgaggaggcaatgtgaagtggagggccctccggttggacactgggaattactcatgggggagtgaggctgtgactcgcaagacccgtatccttgatgtggtctacaatgcttcgaacaacgaacttgtgaggacgcagacccttgtgaagagtgccatcgtgcaggttgatgctacccccttcaagcattggtacctccagcattacggtgtcgagattggtaggaaaaagaaggcccctgcagccgccaagaaggaggcaacagaggtaccggagggtgaagctgcagcagaggaagcaaagaagagcaaccatgtaaccaggaagctggagaagcgacagcagggccgtacacttgatccccacatcgaggagcaatttggtgctggaaggttgttagcttgtatttcttcacgccctggccagtgcgggagagctgatggatacatactggaaggaaaggagcttgagttctacatgaagaagatccagcgaaagaagggcaagggtgcaggagctgcagcttaaggggaagccaattatttctggtacactgcagtaagtttcagaatgatatagttgtgcacttgcctgtttcaggttagggttttgtattccaagggatgtttgcatatggaaattttgacaaacatcggcttttcaagatgttgagatttaattgtcacatttgacaaatttctaatcaattgttctgggtacaaatttttgtgacattattagaagcttaattttaaagctcttgtctctttaccg

SEQ ID NO: 7121 - DNA, 1093 bp, Vitis vinifera
ttttacttcgttctcatcgtcaaaaacccagaagcagagtcgctcgggaggtgagggagagttgttggctgccggtctcttcttcgcagctctgtaaacatgggtatctcacgagactccatgcataagaggcgggcaactggaggcaagaagaaggcctggaggaagaagcgaaagtatgagcttggtcgtcaacctgccaataccaagctatcaagcaacaagacagtgaggcgagttcgcgtgaggggaggcaatgtgaagtggagggccctcaggttggacactgggaactattcatggggtagtgaagctgtcacccgcaaaacgcgtatcttagatgtggtttataatgcctcgaacaatgaactggtcagaacacaaaccttggtgaaaagtgcaattgttcaggtggatgcagccccattcaagcaatggtaccttcagcattatggcgtagacattggtaggaagaagaagactactgctaagaaggaaactacagaggagggagaaggtggtgccacagaggaaacaaagaagagtaaccatgttctccgcaagcttgagaagcgccaacaagatcatagacttgatcctcacattgaagagcagtttggcagtggtagattgttggctagcatctcttcccgaccaggtcaatgtggcagagctgatggatacatcttggaaggaaaggaactggagttctatatgaagaagattcaaaggaagaaaggcaagggcagtgctggtgccgcctaattaaatgtgcaagctggtttcttgttctttcttattcctcaaatggttgtcattttttggttatggtaatatcataactgataaaaattttgagaattttgcatgtcagactaaatggttttgactttttctcttcgggtagtttggttcttggttttgtttcccataccaatgtttagcagaacatgaaatgtatttggaaagcatgtcttcttatacaggtgttgtttgctgttgcttaggcacaactgtaactttgaaaaccatccctctaaaatggaggtcttttggaagtgatattgagagaattagaaacgcctcatatgac

SEQ ID NO: 7122 - DNA, 997 bp, Vitis vinifera
cagagtcgctcgggaggtgagggagagttgttggctgccggtctcttcttcgcagctctgtaaacatgggtatctcacgagactccatgcataagaggcgggcaactggaggcaagaagaaggcctggaggaagaagcgaaagtatgagcttggtcgtcaacctgccaataccaagctatcaagcaacaagacagtgaggcgagttcgcgtgaggggaggcaatgtgaagtggagggccctcaggttggacactgggaactattcatggggtagtgaagctgtcacccgcaaaacgcgtatcttagatgtggtttataatgcctcgaacaatgaactggtcagaacacaaaccttggtgaaaagtgcaattgttcaggtggatgcagccccattcaagcaatggtaccttcagcattatggcgtagacattggtaggaagaagaagactactgctaagaaggaaactacagaggagggagaaggtggtgccacagaggaaacaaagaagagtaaccatgttctccgcaagcttgagaagcgccaacaagatcatagacttgatcctcacattgaagagcagtttggcagtggtagattgttggctagcatctcttcccgaccaggtcaatgtggcagagctgatggatacatcttggaaggaaaggaactggagttctatatgaagaagattcaaaggaagaaaggcaagggcagtgctggtgccgcctaattaaatgtgcaagctggtttcttgttctttcttattcctcaaatggttgtcattttttggttatggtaatatcataactgataaaaattttgagaattttgcatgtcagactaaatggttttgactttttctcttcgggtagtttggttcttggttttgtttcccataccaatgtttagcagaacatgaaatgtatttggaaagcatgtcttcttatacaggtgttgtttgttgttgcttaggcacaactgtaactttgaaaacca

SEQ ID NO: 7123 - DNA, 954 bp, Olea europaea
ggttaaaaagtttgtaaaacccttagtttcttcttacgtccgttcgtcacttcctccattttctctttcttctgcttctgcttctgctgggggattcctcggaaacctagaaagtacagccggcaaccatgggtatttcacgggattccatgcacaagaggcgtgccactggaggaaagaagaaggcttggaggaagaagagaaagtacgagcttggtagacagccagcaaacacaaagttgtcaagtaacaagacagtacgtagggtgagggttcgaggaggtaatgtgaaatggcgtgctttgaggttggacacagggaactactcttggggtagtgaggctgtgacccggaagactcgtattctcgatgtggtttataatgcttctaataatgagttggtgaggacccagactttggtgaagagcgcaattgttcaggtggatgctgcaccttttaagcagtggtatcttcagcactatggagttgacattggtcgcaagaagaaggctgccgtcaagaaagaaggagaggagaccgagggtgctgtagaagagacaaagaaaagcaaccatgtccagaggaaactgcagaagcgtcaacaggatcgcaagcttgacccacatgttgaggagcaattcggcggtggccgtcttttagctgcaatctcttcacgccctggccagtgtggtcgtgctgatggatatattttggagggcaaagagttggagttttacatgaagaaacttcaaaggaagaaaggaaagggtgctagcggggcttcataaatttctctcgtaactcaaagaatgtttccttcaaaatctcctctttcacttcctgtaagacacaagttagcttgatctttttcatatttagttgaaattttgagctgttatgtaatgaattttctaccaataacatatttttcttccgtttctcattacaatacag

SEQ ID NO: 7124 - DNA, 1185 bp, Sciadopitys verticillata
gaggaagccgctgtttgagctcgcaaggaatctgcaggcgttacagtccagtctgcaatcatgggtatctcacgagattcgatgcacaagagacgtgcgacgggtggaaagaagaagcaatggaggaagaagcgaaagtacgaattaggaaggcagcctgccatgactaagctgtcaagcaacaagacagttagaagggtacgtgtgagaggaggcaacgtgaagtggagggctctgagactggatactggtaactactcgtggggatcggaagctgtgagcaggaagactcgtatattggatgtggtgtacaatgcatctaataatgagcttgtgagaacccaaacattggttaagagcgccattgttcaggttgatgctgctcctttccgtatctggtatcagcagcactacggtcaggatattggcaggaagaagaaggctgttgctgcgaagaaagagactgaagagggagaagctgctgcagaagaagaaaagaagaaaagtaatcatgttttgaggaagattgagaaacgacaggagggtcacaaacttgatgcccatctagaagagcagtttgctggtggtaaaatgttggcttgcatctcctctcgtcctgggcagtgcgggcgctgtgatggatacatccttgagggaaaggagcttgagttctacatgaaaaagttacagagaaagaagggaaagggtggtgctggagctgcttaagcagccaattttggcttcttaaggcattcaaaaatctctttattagactatttataacagtgttgttccaattgaatgccaaaagaacttcagggggactgagggtaactatttctggtaatttaccaaggttaagtttgttcttgttagttatttccactccttggtgtacattactctgagtttggtagatgaccggtcacagtcaagaaccatgctattttaaatttttctgatattccttttagaataccgtggcagcatcttgagttaattttctcatagcggagaaccaatgtagggtttaattgaaattttttcttatattaacttagtaccttttttaatcttgctatcattatctgaattttatgtctattctaaaatttacttatgcacatttgttaaaactttgtatagatggtcctgtataaggtgggcatatgtttctgtaagtca

SEQ ID NO: 7125 - DNA, 1165 bp, Brassica juncea
aacgacagaagtacgcgggggtcgccgaaccaaactttttcggacacaaactagagaagtcttcgaatcagagagattctttccctttagatccggaagtttcttagtgagagaagatgacagtgatcgacattctgaccagagttgacacgatctgcaagaagtacgacaagtacgatgtcgacaaacagcgtgagtccaatatctccggcgacgatgctttcgctcgtctctacggagctttcgagactcaaatcgagacagctctcgagaaagctgagattgttaccaaggagaagaacagagcttctgctgttgcgatgaacgctgagatccgtcgcaccaaggctagattgtctgaagaagttcccaagttgcagagacttgctctcaagcgggtgaagggccttacaacggaagagcttgctgcgaggaacgatttggtacttgcgcttccggctaggattgaagctatacctgatgggacagcgggtggtcctaaaagcactagtgcttgggctccttctacaacttctcgtcctgatattaagtttgattcagatgggcgttttgatgatgattactttcaagagtcacatgaatccagccagttcaggcaggagtttgagatgcgcaaaattaaacaggaccaaggtctggacatgatctccgaaggtttagatgctttgaagaacatggcgtctgatatgaacgaggagctggataggcaagttcctctgatggatgaaatcgactcaaaggtggacagagcaacctcagatcttaagaacaccaatgttagactcaaagatactgtgaaccagctgaggtcaagcaggaacttctgcatcgatattgttttgttgtgtattgttctgggtatcgctgcatacttgtacaatgtactgaagtaacgagatgaacaggaaagggcccatcactactctctcttgccatctgctattaaagtttcttacccgagtcaatgtctgtgtgcttgtttctggtggtatgtgtgtgatctttcaacgagagtttcttctaagtgtcaagactgttcaagttgtttcttctatcgacttgtttccatgttgttcatgtccattacatgatgaatatatatataaccttgttaaatttaccaaatttatgtaattctattcat

SEQ ID NO: 7126 - DNA, 1315 bp, Brassica rapa
aaataaacaaaagtaagaggggtgattcataaatattcctccaggctgttaagtttttctctttcgtcgccgaaccaaactcttcggacacaaactagaaggaagtcttcgaatcagagagattctctatcctttagatccggaagttgcttggcgagagaagatgacagtgatcgacattctaaccagagttgacacgatctgcaagaagtacgacaagtacgacgtcgacaaacagcgtgagtccaacatctccggcgatgatgcttttgctcgtctctacggagctttcgagactcaaatcgagacagctctcgagaaagctgagattgttaccaaggagaagaacagagcttctgctgttgcgatgaacgctgagatccgcaggaccaaggctagattgtcggaggaagttcccaagttgcagagacttgctctcaagcgggtgaagggccttacgacggaagagcttgctgcgagaaacgatttggtacttgcgcttccggcgaggattgaagctatacctgatgggacagcgggtggtcctaaaagcactagtgcttgggctccttctacaacgtctcgtcctgatattaaatttgattcagatgggcgttttgatgatgattactttcaagagtcacatgaatccagccagttcagacaggagtttgagatgcggaaaattaaacaggaccaaggtctggacatgatctccgaaggtttagatgctttgaagaacatggcgtctgacatgaacgaggagctggaccggcaagttcctctgatggatgaaatcgactcaaaggtggacagagcaacctcggatcttaagaacaccaatgttagactcaaagatactgtgaaccagctgaggtcaagcaggaacttctgcatcgatattgttttgttgtgtattgttctgggtatcgctgcatacttgtacaatgtactgaagtaatgagatgaacaagaaaggacccatcactactctctcttgccatctgctattaaagtttcctacccgagtcaatgtctgtgtgcttgtttctggtggtatttgtgtgatctttcaacgggagtttcttcttagtgtcaagactgttcaagttgtttcttctgtcgagttgtttccatgttgttcatgtccattacatgatgaatatatataaccttgttaaatttaccaaatttatgtaattccattcattcgttgtccctgtcaatgtgccgtcaagctagccgtttgctagtcaagctagtcgtttgctatgtgctatatctgcttgtgtatgagaatgtcaagaagacccac

SEQ ID NO: 7127 - DNA, 1161 bp, Raphanus sativus
gggaaccaattttttcggacacaaactagagaagtcttcttcgaatcagagagattctatcccttaattagagatccggaagttccttggtgagagaagatgacagtgatcgacattctgaccagagttgacacgatctgcaagaagtacgacaagtacgacgtcgacaaacagcgcgagtccaacatctccggcgatgacgctttcgctcgtctctacggagctttcgagacccaaatcgagacagctctcgagaaagctgagattgttaccaaggagaagaacagagcttctgctgttgcgatgaacgctgagatccgtcgcacaaaggctagattgtctgaggaagttcccaagctgcagagacttgctctcaagcgggtaaagggccttacaacggaagagcttgctgcgagaaacgatttggtgcttgcgcttccggcgaggatcgaagctatacctgatgggacagcgggtggtcctaaaagcactactagtgcttgggctccttctacaacctctcgtcctgatatcaagtttgattcagatgggcgttttgatgatgattactttcaagagtcgcatgaatccagccagttcaaacaggagtttgagatgcgcaaaattaagcaggaccaaggtctggacatgatctccgaaggtctagatgctttgaagaacatggcgtctgatatgaacgaggagctggatcggcaagttcctctgatggatgaaatcgactcaaaggtggacagagcaacctcggatcttaagaacaccaatgttagactcaaagatactgtgaaccagctgagatcaagcaggaacttctgcatcgatattgttctgttgtgtatcgttctgggtatcgctgcatacttgtacaatgtactgaagtgatgagatgaacaggaaagggacccatcactactctctattgccattatctattaaagtttcttacccgactcagtgtgtgcttgtttctgtctgtattcgtgtgatctttctacaagagtttcttctgaagtgttaagactgctcaagttgtttcttatattgagttttttccatgttgttcatgtccattacatgatgaatatatatatatactccttcccgaatttaccaaattttatgtaattatattcatttatgggc

SEQ ID NO: 7128 - DNA, 1067 bp, Brassica napus
tcgaatcagagattctctatcctttagatccggaagtttcttggcgagagaagatgacagtgatcgacattctaaccagagttgacacgatctgcaagaagtacgacaagtacgacgtcgacaagcagcgtgagtccaacatctccggcgacgatgctttcgctcgcctctacggagctttcgagactcaaatcgagacagctctcgagaaagctgagattgttaccaaggagaagaacagagcttcagctgttgcgatgaacgctgagatccgcaggaccaaggctagattggccgaggaagttcccaagttgcagagacttgctgtcaagagggttaagggccttacgactgaagagcttgctgcgagaaacgatttggtacttgcgcttccggcgaggattgaagctatacctgatgggacagcgggtggtactaaaagcactagtagtgcttgggctccctctgcaacctctcgtcctgatatcaagtttgattcagatgggcgttttgatgatgactactttcaagagtcgcatgaatccagccagttccgacaggagtttgagatgcggaaaattaaacaggaccaaggtctggacatgatctccgaagggttagatgctttgaagaacatggcatctgatatgaacgaggagctggaccgtcaagttcctttgatggatgaaatcgactcaaaggtggacagagcaacctcggatcttaagaacaccaatgttagactcaaagatactgtgaaccagctgaggtcaagcaggaacttctgcatcgatattgtgttgctgtgtattgttctgggtatcgctgcatacttgtacaatgtactcaagtaacgagatgaacaagaaaggacccatcactactctctcttgccatatatgctattaaagtttcttacccgagtcaatgtctgtgcttgtttctggtggtatttgtgtgatctttcaacgagagtttcttccaagtgtcaagactgttcaagttgtttcttctattgagttgtttccatgttgttcatgtccattacatgatgaatatatataacc

SEQ ID NO: 7129 - DNA, 1132 bp, Eutrema parvulum
gggcacgaacagaaagagattcaaattttcacaaactaaaatcttcttcctcttcgaatcagagattctctcctttagatccggaagtttctggcagcagaatcggaagaaaatgactgtgatcgacattctaactagagttgactcgatctgtaagaagtacgataagtacgatgtcgacaaacagcgagaggctaatatctccggcgatgatgcctttgctcgcctctatggagcttttgagacccaaatcgagaccgctctcgagaaagctgaacttgttacgaaggagaagaatagggcttctgctgttgcaatgaatgctgagatccgccggaccaaagctcgattgtccgaggaagttcctaagctgcagagacttgctgtcaagcgggttaaaggccttacaaccgaagagcttgcggcgagaaatgatttggtgcttgcacttccggccaggattgaagccattcctgatgggacagcaggtggtcctaaaagcactagtgcttgggctccctcaacaacatctcgtcctgatatcaaatttgattcagatgggcgttttgatgatgattactttcaagaatcacatgagtccagtcaattcaggcaggagtatgagatgcggaaaatgaagcaggaacaaggtctggacatgatctctgaaggtttagatgctttgaagaacatggcgtctgatatgaacgaggaactggataggcaagttcctctgatggatgaaatcgacacaaaggtggacagagcaacctcagatcttaagaacaccaatgttagacttaaagatactgtgaaccagctgaggtcaagtcggaacttctgcatcgatattgttttgttgtgtattgttctgggtatcgctgcatacttgtacaatgtcctgaagtaatgagatgaacaccaaaggacccatcatcgctctctctttgccctctgctattaccgtgttttacccgagtcagtgtgtgtgtatgtgcgcttgtttcttgctgtatctctgtgatcttctactagaattccttttaagtatcaaaactactgaagttgtttctccctgcaattgagttatttccatgttgttcgtctccatacatgatgaatgtatatctta

SEQ ID NO: 7130 - DNA, 1207 bp, Eutrema halophilum
aggctgtaaattttctttcaggccctttcgttcgtcgccgaaccacttctccagcattcgggcacaaacagaaagagattcaaatttcacaaactaaaagtcttcttcttcctcttcgaatcggagattctctcctttagatccggaagtttctgttagcagaatcggaagaagatgactgtgatcgacattctgactagagttgactcgatctgtaagaagtacgacaagtacgatgtcgacaaacagcgggaggccaatatctccggtgatgatgcgtttgctcgcctctatggcgcttttgagacccaaatcgagactgctctcgagaaagctgaacttgttacaaaggagaagaatagggcttctgctgttgcaatgaatgctgagatccgccggaccaaagctcgattgtccgaggaagttcctaagctgcagagacttgctgtcaagcgggttaaaggccttacaaccgaagagcttgcggcgagaaatgatttggtgcttgcacttccggccaggattgaagccattcctgatgggacagcaggtggtcctaaaagcactagtgcttgggctccctcaacaacatctcgtcctgatatcaaatttgattcagatgggcgttttgatgatgattactttcaagaatcacatgagtccagtcaattcaggcaggagtatgagatgcggaaaatgaagcaggaacaaggtctggacatgatctctgaaggtttagatgctttgaagaacatggcgtctgatatgaacgaggaactggataggcaagttcctctgatggatgaaatcgacacaaaggtggacagagcaacctcggatctaaagaacaccaatgttagacttaaagataccgtcaaccagctgagatcaagccggaacttctgcatcgatattgttttgctgtgtattgtcctgggtatcgctgcctacttgtacaacgtactgaagtgatgagatgaacaccaaaggacccatcagtactctctctctctcgctattgctctctgctattactgcgttttacccgagtcagtgtgtgtgcttgtttgttgctgtatttgtgtgatcagtttactgagagtttcttcgaactgttgatctttcttcctgcattgagttattttcatgttgttcgtgtccattcatggtgaatatatcttatattaaaattacaaaatttatgtct

SEQ ID NO: 7131 - DNA, 1149 bp, Eutrema halophilum
gggcacaaacagaaagagattcaaatttcacaaactaaaagtcttcttcttcctcttcgaatcggagattctctcctttagatccggaagtttctgttagcagaatcggaagaagatgactgtgatcgacattctgactagagttgactcgatctgtaagaagtacgacaagtacgatgtcgacaaacagcgggaggccaatatctccggtgatgatgcgtttgctcgcctctatggcgcttttgagacccaaatcgagactgctctcgagaaagctgaacttgttacaaaggagaagaatagggcttctgctgttgcaatgaatgctgagatccgccggaccaaagctcgattgtccgaggaagttcctaagctgcagagacttgctgtcaagcgggttaaaggccttacaaccgaagagcttgcggcgagaaatgatttggtgcttgcacttccggccgggattgaagccattcctgatgggacagcaggtggtcctaaaagcactagtgcttgggctccctcaacaacatctcgtcctgatatcaaatttgattcagatgggcgttttgatgatgattactttcaagaatcacatgagtccagtcaattcaggcaggagtatgagatgcggaaaatgaagcaggaacaaggtctggacatgatctctgaaggtttagatgctttgaagaacatggcgtctgatatgaacgaggaactggataggcaagttcctctgatggatgaaatcgacacaaaggtggacagagcaacctcggatctaaagaacaccaatgttagacttaaagataccgtcaaccagctgagatcaagccggaacttctgcatcgatattgttttgctgtgtattgtcctgggtatcgctgcctacttgtacaacgtactgaagtgatgagatgaacaccaaaggacccatcagtactctctctctctcgctattgctctctgctattactgcgttttacccgagtcagtgtgtgtgcttgtttgttgctgtatttgtgtgatcagtttactgagagtttcttcgaactgttgatctttcttcctgcattgagttattttcatgttgttcgtgtccattcatggtgaatatatcttatattaaaattacaaaatttatgtctc

SEQ ID NO: 7132 - DNA, 2921 bp, Brassica rapa
tattcctccaggctgttaatgcaattttcttgccggctcttttgtccccgccgaaccacttcttctccagcattcatcaggacacaaacaagggaaagagattcaaaaatttcacaaaacgaatcagagattattatatcctttagatccggaagaagaagaagatgacggtgatcgacattctgactagagttgactcgatctgtaagaagtacgacaagtacgatgtcgacaaacagcgtgaagccaatgtctccggtgatgatgcctttgctcgtctctatggagctttcgagactcaaatcgagacagctctcgagaaagctgagcttgttaccaaggagaagaacagagcttctgctgttgcaatgaacgctgagatccgcaggacaaaggcgagattgtctgaggaagttcccaagttgcagagacttgctgttaaacgggttaaaggccttacaaccgaagagcttgctgctagaaacgatttggtgcttgcgcttccggccaggattgaagccatacctgatggcacagcgggtggtcctaaagccaccagtgcttgggctccctcaacagcatctcgtcctgatatcaaatttgattcagatgggcgttttgatgatgattactttcaagaatcacatgagtccagccaattcagacaggagtatgagatgcggaaaatcaagcaggaacaaggtctggacatgatctcggaaggtttagatgctttgaagaatatggcgtctgatatgaacgaggagctggataggcaagttcctctgatggatgaaatcgactccaaggtggacagagcaacctcggatcttaaaaacaccaatgttagacttaaagatactgtgaaccagctgaggtcaagccggaacttttgcatcgatattgttttgttgtgtattgttcttggtatcgctgcatacttatacaatgtactgaagtaatgagatgaacatgaaaggaccccatcagtactctctctttcccctctgctattaccgtttcttaccctgagtcagtgtgtgtgtgagtgcttgtttcttgctgtatttgtgtgattcgacgagagtttcttccgagtgtcaagactattgaagttgtttcttattatccttctgttatgttgtttatgtccatacatggtgcatacatatcttattaagtttaccaaatttatgtaattatattcactcatgcccttgtcaatgtctggtcaagcttattgtttggtctgttctcagaataaataaccaaactgcatcaacataatccaattctaatatcgaagaatcgtgattgtgaattgaaatgactttgaaaatttctatattataaattggcaatcaggacattttattgtttaacatgttacacatggatcaaacatgcatatagatgtgtccattctatccatgctcaacccgtgtttggctactcttgttcagctgttcctcctccttgctcagtatcattcccactcccactattaccatgaacttgtatctccaaaagcctctcaacaggctgcctacaaatcgggcatcgattcgtctgaaacctcaacaccttagcacatccactgcacatacactacaccacaaaacacctttccacctcagtccacaagagaaacacagttcatcaaaaacattgaatcttacttaccatatgtcgacaaggaagaacagtcgtgtccgacggctcagacaaacaaataacacactctttcccctgatcatccccatcctcatccccatcatcgtccccaccaaccgtattcccaatcccataaatctcctgcaactcatacctagtcccgttgacccacagtatctgcttcaccactcttatcttaacctctcctttctccttctcgtaaaccgcttgagtaatctgcgcgttcttagacagactctcttcacctgaactaactgcttccgccttaaccgctaaaggataaacatcagtctctaacgctgccgccttaaacagctcggagtcttcgaataacgacaaatctataccggacccgggaggctgtttgaacttctgaccaagccctttctcgaagtccatcgtgatcggtggtaaagtgtcttcctttgtcgctgtgaggacgcattgttcggtttctttagcgaagaatatgactgtgattctgtttttaagacaacaccaatctaaaggttcagtttttttcttttaatatagataaaggttgggtttttatttaccttccgggtacagttgcatcaaacgtgaaggagacgaggacccgggtcgggttatccgggtcgggttcgagctttaaagactccttttttagattaacgtcgttacgaatggtgacggctttctgatgctcgacgcagggaagctgcggaggcatcatgggtccgtgataaggatgctgctgcggaggaggaggatagtggatgtgatggtgctggtcgtaaggccccggaggaggaggagggtagtagcctggatactggtagttagggtttgggtacggtgtagcggcggcgaagacgatgcgattgggtggtggcggtggaggaagagaaggaggaggtggcggtggtggagaaggagaaggaagggtgttgctccgccgttgttgtctgcggcgtctaccgtcgccgcctccgctgctgctgatgttgcccatgaggagaatgatcagaaaaggtgagatttttatggatcgaatcgaagaaagtttgtgttttgatgggtggatcggtggttaaaaggaaaagcagagagagagagagagagagagagagaatataaattgggggagaaaagtgggtaaaggagatgatgatggggtccgttggccaagaaactccacccatgaacctactttgaacacctttccatggtgtttttatgttacc

SEQ ID NO: 7133 - DNA, 1209 bp, Brassica napus
ggaggctgttatgcaattctcttgccgactcttttgtccgccgaagcacttcttctccagcattcatcaggacacaaacaagggaaagagatacaaaaatttcacaaaacgaatcagagattattatacctgctagatccggaagaagaagaagatgacagtgatcgacattctgactagagttgactcgatctgtaagaagtacgacaagtacgatgtcgacaaacagcgtgaggccaatgtctccggtgatgacgctttcgctcgtctctatggagctttcgatactcaaatcgagacagctctcgagaaagctgagcttgttaccaaggagaagaacagagcttctgctgttgcaatgaacgctgagatccgcaggaccaaggctagattgtctgaggaagttcccaagttgcagagacttgctgttaagcgggttaagggccttacaaccgaagagcttgctgctagaaacgatttggtgcttgcgcttccggccaggattgaagccatacctgatggaacagcgggtggtcctaaagccaccagtgcttgggctccctcaacagcatctcgtcctgatatcaaatttgattcagatgggcgttttgatgatgattactttcaagaatcacatgaatctagccaattcagacaggagtttgagatgcggaaaatcaagcaggaacaaggtctggacatgatctctgaaggtttagatgctttgaagaatatggcgtctgatatgaacgaggagctggatcgccaagttcctctgatggatgaaatcgactccaaggtggacagagcaacctcggatcttaagaacaccaatgttagacttaaagatactgtgaaccagctgaggtcaagccggaacttttgcatcgatattgttttgttgtgtattgttcttggtatcgctgcatacttatacaatgtactgaagtaatgagatgaacatgaacggaccctctcttgccctctgctattaccgcttcttacccgagtctgtgtgtgtgagtgcttgtttcttgctgtatttgtgtgatcgatctttaagtgtcaagactattgaagttgttttcttcctgcaactgagttatttccatgttgttcaagtccatacatggtgaatacatatcttattaagttaccaaatttatagttaattattattcattcatcgtcctgtcaatcgccccgtac

SEQ ID NO: 7134 - DNA, 1292 bp, Arabidopsis thaliana
acggaaattagtttacaggctgtaatttttctttcaggctctctctctttcgtcgccgaaccagttccagaaaggctgtagcgattcaaaatttcacaaattaaagtcttcttcctctccgaatcagagattgtctccttcttagctcagatctgggagcttcttgtgatagatttggaagaagatgactgtgatcgatattctgactagagttgactcgatctgtaagaagtacgacaagtacgatgtcgacaaacagcgggaggccaatatctccggcgatgatgcctttgctcgtctctatggagctttcgaaacccaaatcgagaccgctctcgagaaagctgaacttgttacgaaggagaaaaacagggctgctgctgttgcaatgaatgctgagatccgccggaccaaggcacgattgtcagaggaagttcccaagttgcaaagacttgctgtcaagcgggttaagggccttacaaccgaagagcttgctgcgagaaatgatttggtgctcgctcttccagccaggattgaagccatacctgatgggacagcaggtggccctaaaagcactagtgcttggactccctcctcaacaacatctcgtcctgatatcaaatttgattcagatgggcgttttgacgatgattactttcaagaatcaaatgaatctagccaattcaggcaggagtatgagatgcggaaaataaaacaggaacaaggtcttgacatgatctccgaagggttagatgctttgaagaacatggcttctgatatgaacgaggaactggatagacaagttccactgatggatgaaatcgacacaaaggtggacagagcaacctccgatcttaagaacaccaatgttagacttaaagataccgtgaaccagctgagatctagccggaacttctgtatcgatattgttttgttgtgtattgttctgggtatcgctgcatacttatacaatgtactgaagtaatgagatgaaccctacgaaaggacccattagtacttatcacccgagtcaatatccagtgtgtgcttgtgtcttactcttcttctctgatatttctacgagagtttcttcttaatgtcaagaatattcaagtcttatcttcctgcatcgacttttctccatgttgttcgtgtgcatagattcatctgtcaaaatgtgcgtcaaactaattgattgctgtgtctgcggcagtgtgctattattttccagccaaaatatgattttttatttattttaaaagcaagccaaattttaatttcaaagatcagtg

SEQ ID NO: 7135 - DNA, 1198 bp, Arabidopsis thaliana
gccgaaccagttccagaaaggctgtagcgattcaaaatttcacaaattaaagtcttcttcctctccgaatcagagattgtctccttcttagctcagatctgggagcttcttgtgatagatttggaagaagatgactgtgatcgatattctgactagagttgactcgatctgtaagaagtacgacaagtacgatgtcgacaaacagcgggaggccaatatctccggcgatgatgcctttgctcgtctctatggagctttcgaaacccaaatcgagaccgctctcgagaaagctgaacttgttacgaaggagaaaaacagggctgctgctgttgcaatgaatgctgagatccgccggaccaaggcacgattgtcagaggaagttcccaagttgcaaagacttgctgtcaagcgggttaagggccttacaaccgaagagcttgctgcgagaaatgatttggtgctcgctcttccagccaggattgaagccatacctgatgggacagcaggtggccctaaaagcactagtgcttggactccctcctcaacaacatctcgtcctgatatcaaatttgattcagatgggcgttttgacgatgattactttcaagaatcaaatgaatctagccaattcaggcaggagtatgagatgcggaaaataaaacaggaacaaggtcttgacatgatctccgaagggttagatgctttgaagaacatggcttctgatatgaacgaggaactggatagacaagttccactgatggatgaaatcgacacaaaggtggacagagcaacctccgatcttaagaacaccaatgttagacttaaagataccgtgaaccagctgagatctagccggaacttctgtatcgatattgttttgttgtgtattgttctgggtatcgctgcatacttatacaatgtactgaagtaatgagatgaaccctacgaaaggacccattagtacttatcacccgagtcaatatccagtgtgtgcttgtgtcttactcttcttctctgatatttctacgagagtttcttcttaatgtcaagaatattcaagtcttatcttcctgcatcgacttttctccatgttgttcgtgtgcatagattcatctgtcaaaatgtgcgtcaaactaattgattgctgtgtctgcggcagtgtgctattattttccagccaaaatatgattttttattt

SEQ ID NO: 7136 - DNA, 1170 bp, Brassica oleracea
  misc_feature (153)..(153): n is a, c, g, or t
  misc_feature (156)..(156): n is a, c, g, or t
  misc_feature (166)..(166): n is a, c, g, or t
  misc_feature (373)..(373): n is a, c, g, or t
  misc_feature (375)..(375): n is a, c, g, or t
  misc_feature (562)..(562): n is a, c, g, or t
  misc_feature (570)..(570): n is a, c, g, or t
  misc_feature (600)..(600): n is a, c, g, or t
ggccgactcttttgtccgccgaagcacttcttctccagcattcatcaggacacaaacaagggaaagagatacaaaaatttcacaaaacgaatcagagattattataccctctagatccagaagaagaagaagatgaccgtgatcgacattctnacnagagttgacncgatctgtaagaagtacgacaagtacgatgtcgacaaacagcgtgaggccaatgtctccggtgatgacgctttcgctcgtctctatggagctttcgatactcaaatcgagacagctctcgagaaagctgagcttgttaccaaggagaagaacagagcttctgctgttgcaatgaacgctgagatccgcaggaccaaggctagattgncngaggaagttcccaagttgcagagacttgctgtcaagaggtttaagggccttacgactgaagagcttgctgcaagaaacgatttggtacttgcgcttccggcgaggattgaagctatacctgatgggacagcgggtggtactaaaagcactactagtgcttgggctccttctacaacctctcgtcctnatatcaantttgattcagatgggcgttttgatgatgantactttcaagagtcgcatgaatccagccagttccgacaggagtttgagatgcggaaaattaaacaggaccaaggtctggacatgatctccgaagggttagatgctttgaagaacatggcatctgatatgaacgaggagctggaccgtcaagttcctttgatggatgaaatcgactcaaaggtggacagagcaacctcggatcttaagaacaccaatgttagactcaaagatactgtgaaccagctgaggtcaagcaggaacttctgcatcgatattgtgttgctgtgtattgttctgggtatcgctgcatacttgtacaatgtactcaagtaacgagatgaacaagaaaggacccatcactactctctcttgccatatatgctattaaagtttcttacccgagtcaatgtctgtgtgcttgtttctggtggtatttgtgtgatctttcaacgagagtttcttccaggtgtcaagactgtccaagttgtttcttctattgagttgtttccatgttgttcatgtccactacatgatgaatatatataaccttattaaatttaccaaatatat

SEQ ID NO: 7137 - DNA, 1259 bp, Arabidopsis lyrata
aaatttgtttttccaggctgtaattttcttacaggctctttcgtcgacgaaccacttccagaagcgattcaaatttcacaaaataaagtcttcttcctcttcgaatcagagattttctccttctttagctcagatctgggagcttctggtgatagatttggaagaagatgactgtgatcgatattctgactagagttgactcgatctgtaagaagtacgacaagtacgatgtcgacaaacagcgggaggccaatatctccggcgatgatgcctttgctcgtctctatggagctttcgaaacccaaatcgagaccgctctcgagaaagctgaacttgttaccaaggagaaaaatagggctgctgctgttgcaatgaatgctgagatccggcggaccaaggctcgattgtcagaggaagttcccaagttgcagagacttgctgtcaagcgggttaagggccttacaaccgaagagcttgctgcgagaaatgatttggtgctcgctcttccagccaggattgaagccatacctgatgggacagcaggtggccctaaaaacactagtggttggactccctcctcaacaacatctcgtcctgatatcaaatttgattcagatgggcgttttgatgatgattactttcaagaatcacatgaatctagccaattcagacaggagtatgagatgcggaaaataaaacaggaacaaggtcttgacatgatctccgaagggttagatgctttgaagaacatggcgtctgatatgaacgaggaactggatagacaagttccactgatggatgaaatcgacacaaaggtggacagagcaacctcggatcttaagaacaccaatgtcagacttaaagataccgtgaaccagctgagatcaagccggaacttctgtatcgatattgttttgttgtgtattgttctgggtatcgctgcatacttatacaatgtactgaagtaatgagatgaacacggcgaaaggacccagtagtacttatcacccgagtcagtgtccagtgtgtgcttgtgtcttacttttcttctctgatatttctgcgagagtttcttcttaatgtcaagaatattgaagtatgttcttcctgtatcgacttttctccatgttgttcgtttgcatatattcatctttgtcaaagtgtgcatcaaactaattgtttgctgtgtctgctgcagtgtgatattattttccaggtaaaatatgatttttaatttttaaaaatcaagccaaaattta

SEQ ID NO: 7138 - DNA, 1242 bp, Eutrema parvulum
gaatatttttccaggctgtagattttctctcgggctctttcgtcgccgaactactttctacagcattcgggcacgaacagaaagagattcaaattttcacaaactaaagtcttcttcctcttcgaatcagagattctctcctttagatccggaagtttctggcagtagaattggaagaaaatgactgtgatcgacattctaactagagttgactcgatctgtaagaagtacgataagtacgatgtcgacaaacagcgagaggctaatatctccggcgatgatgcctttgctcgcctctatggagcttttgagacccaaatcgagaccgctctcgagaaagctgaacttgttacgaaggagaagaatagggcttctgctgttgcaatgaacgctgagatccgccggaccaaggctcgattgtcggaggaagttcccaagttgcagagacttgctgtcaagcgggttaagggccttacaaccgaagagcttgctgcgagaaatgatttggtgcttgcgcttccagccaggattgaagccatacctgatgggacagcgggtggtcctaaaagcactagtgcttggactcccgcaacagcatctcgtcccgatatcaaatttgattcagatgggcgttttgatgatgattactttcaagaatcaaatgaatccagccaattcagacaggagtatgagatgcggaaaatgaagcaggaacaaggtctggacatgatctccgaaggtttagatgctttgaagaacatggcatctgatatgaacgaggaactggataggcaagttcctctgatggatgaaatcgacacaaaggtggacagagcaacctcagatcttaagaacaccaatgttagacttaaagatactgtgaaccagctgaggtcaagtcggaacttctgcatcgatattgttttgttgtgtattgttctgggtatcgctgcatacttgtacaatgtcctgaagtaatgagatgaacaccaaaggacccatcatcgctctctctttgccctctgctattaccgtgttttacccgagtcagtgtgtgtgtatgtgcgcttgtttcttgctgtatctctgtgatcttctactagaattccttttaagtatcaaaactactgaagttgtttctccctgcaattgagttatttccatgttgttcgtctccatacatgatgaatgtatatcttaccaaattttatgtgattctattaatacgtgtccctgcctcat

SEQ ID NO: 7139 - DNA, 1181 bp, Raphanus sativus
  misc_feature (106)..(106): n is a, c, g, or t
ggaattctcttgccggctgttttgtccgccgaacattcacccggccacgcagagattcaaaatttcacaaaacggaagtcttcgaatcagagatttatactctttngatccggaagaagaagaagatgacggtgatcgacattctgactagagttgactcgatctgtaagaagtacgacaagtacgatgtcgacaaacagcgtgacgccaatgtctctggtgatgatgctttcgctcgtctctatggcgctttcgaagaacaaatcgagactgctctcgagaaagctgaacttgttaccaaggagaagaacagggcttctgctgttgcgatgaacgctgaaatacgcaggactaaggctaggttgtctgaggaagttccaaagttgcagagacttgctgttaagcgggtcaagggccttacaaccgaagagcttgctgctagaaatgatttggtccttgcgcttccggccaggattgacgccatacctgatggaacagctggtggtcctaaagccaccagtgcttgggctccctcaacagcatctcgtcctgatatcaaatttgactcagatgggcgttttgatgatgattactttcaagaatcacatgaatccagccaattcagacaggagtatgagatgcggagaatcaagcaggagcaaggtctggacatgatctccgaaggtttagatgctttgaagaatatggcgtctgatatgaacgaggagctggataggcaagttcctctgatggatgaaatcgactccaaggtggacagagcaacctcggatcttaagaacaccaatgttagacttaaagatactgtgaaccagttgaggtcaagccggaacttctgcatcgatattgttttgttgtgtattgtgttgggtatcgctgcatacttatacaatgtactgaagtaatgagatgaagacgaaaggaactctctttcttgcccctctgctattaccgtttcttaccctgagtcagtgtgtgtgtgtatgcacttgtttcttgctgtatttgtgtgaataacattgaaggatgatcctaatagtgaatgaatcaagatgactttgaaatttctatattataaaattgggaatcaggacattttattgttaaacatgttacacatggatcaaacatgcatatatatataatatcaatggtccattcta

SEQ ID NO: 7140 - DNA, 1173 bp, Arabidopsis lyrata
agcgattcaaatttcacaaaataaagtcttcttcctcttcgaatcagagattttctccttctttagctcagatctgggagcttctggtgatagatttggaagaagatgactgtgatcgatattctgactagagttgactcgatctgtaagaagtacgacaagtacgatgtcgacaaacagcgggaggccaatatctccggcgatgatgcctttgctcgtctctatggagctttcgaaacccaaatcgagaccgctctcgagaaagctgaacttgttaccaaggagaaaaatagggctgctgctgttgcaatgaatgctgagatccggcggaccaaggctcgattgtcagaggaagttcccaagttgcagagacttgctgtcaagcgggttaagggccttacaaccgaagagcttgctgcgagaaatgatttggtgctcgctcttccagccaggattgaagccatacctgatgggacagcaggtggccctaaaaacactagtggttggactccctcctcaacaacatctcgtcctgatatcaaatttgattcagatgggcgttttgatgatgattactttcaagaatcacatgaatctagccaattcagacaggagtatgagatgcggaaaataaaacaggcaaggttagatgctttgaagaacatggcgtctgatatgaacgaggaactggatagacaagttccactgatggatgaaatcgacacaaaggtggacagagcaacctcggatcttaagaacaccaatgtcagacttaaagataccgtgaaccagctgagatcaagccggaacttctgtatcgatattgttttgttgtgtattgttctgggtatcgctgcatacttatacaatgtactgaagtaatgagatgaacacggcgaaaggacccagtagtacttatcacccgagtcagtgtccagtgtgtgcttgtgtcttacttttcttctctgatatttctgcgagagtttcttcttaatgtcaagaatattgaagtatgttcttcctgtatcgacttttctccatgttgttcgtttgcatatattcatctttgtcaaagtgtgcatcaaactaattgtttgctgtgtctgctgcagtgtgatattattttccaggtaaaatatgatttttaatttttaaaaatcaagccaaaattta

SEQ ID NO: 7141 - DNA, 950 bp, Raphanus sativus
  misc_feature (90)..(90): n is a, c, g, or t
  misc_feature (135)..(135): n is a, c, g, or t
tcgctcgtctctacggagcttccgagactcaaatcgagacagctctcgagaaagctgagatgtaccaaggagaagaacagagcttctgcngttgcgatgaacgctgagatccgtcgcacaaaggctagattgtcngaggaagttcccaagctgcagagacttgctctcaagcgggtaaagggccttacaacggaagagcttgctgcgagaaacgatttggtgcttgcgcttccggcgaggatcgaagctatacctgatgggacagcgggtggtcctaaaagcactactagtgcttgggctccttctacaacctctcgtcctgatatcaagtttgattcagatgggcgttttgatgatgattactttcaagagtcgcatgaatccagccagttcaaacaggagtttgagatgcgcaaaattaagcaggaccaaggtctggacatgatctccgaaggtctagatgctttgaagaacatggcatctgatatgaacgaggagctggaccgtcaagttcctctgatggatgaaatagactcaaaggtggacagagcaacctcggatcttaagaacaccaatgttagactcaaagatactgtgaaccagctgaggtcaagcaggaacttctgcatcgatattgttctgttgtgtattgttctgggtatcgctgcatacttgtacaatgtactgaagtgatgagatgaacaggaagggacccatcactactctctcttgccatctgctattaaagtttcttacccgagtcagtttgtgtgtgtgtgtttgtgtgcctgtttctggcggtatttgtgtgatcttttgacgagagtttcttctaagtgtcaagactgttcaagttgtttcttctattgagttatttccatgttgttcatgtccattacatgatgaatatatatattctccttcccgaatttaccaaattttatgtaatt

SEQ ID NO: 7142 - DNA, 694 bp, Brassica napus
gtgatcgacattctgactagagttgactcgatctgtaagaagtacgacaagtacgatgtcgacaaacagcgtgaagccaatgtctccggtgatgatgcctttgctcgtctctatggagctttcgagactcaaatcgagacagctctcgagaaagctgagcttgttacaaaggagaagaacagagcttctgctgttgcaatgaacgctgagatccgcaggaccaaggcgagattgtctgaggaagttcccaagttgcagagacttgctgttaaacgggttaaaggccttacaaccgaagagcttgctgctagaaacgatttggtgcttgcgcttccggccaggattgaagccatacctgatggcacagcgggtggtcctaaagccaccagtgcttgggctccctcaacagcatctcgtcctgatatcaaatttgattcagatgggcgttttgatgatgattactttcaagaatcacatgagtccagccaattcagacaggagtatgagatgcggaaaatcaagcaggaacaaggtctggacatgatctcggaaggtttagatgctttgaagaatatggcgtctgatatgaacgaggagctggataggcaagttcctctgatggatgaaatcgactccaaggtgacagagcaacctcggatcttaaaaacaccaatgttagacttaaagatactgt

SEQ ID NO: 7143 - DNA, 1192 bp, Theobroma cacao
tttgaatctggagttggttcccacaccaacatcaacgggggaaacaaacagaaacaaagaaaatcgtactttttattttctctcccaattttctttccttccaaacagctacattgactgatctgtaaactcaaaacagatcaggaataaaaatgagtgtgatcgatatattgacaagagtagatgtgatctgcaagaggtacgacaaatacgacgtcgaaaagcagcgagaccaaaatgtctccggcgacgatgcctttgctcgcttatacgccgccgttgaagccgacattgaatctgctcttcagaaaggggagcttgcttcgaaggagaaaagtaaggcatctgctgttgcagtgaatgctgagattcgtcgaaccaaggctcgattgcttgaggaagtccctaagctgcagagattggctgttaagaaggttaaagggatttcaacagaagagctggctgctcgtaacgatctggtccttgcattgccagacaggattcaagctatacccgatggaacttctgctcctaaacaaaccggaggctggatgtcttcagcaccttcagcttctcgtaatgaaattaagtttgattcagatggaagatttgataatgaatactttcaagaatctgagcagtcaagccaattcaggcaggagtatgaaatgcggagaatgaaacaggaccaaggtttggatatgatttcagaaggtttggatactttaaagaacatggctcatgatatgaatgaggaattggataggcaagttcctttgatggatgaaattgacaccaaggtggacaaggctgctgctgaccttaagaataccaatgttagacttaaagatactgtcaatcagttgaggtccagccgaaatttctgtattgatatcgtcttgttgtgcatagttctgggaattgctgcctatttatacaatgttctgaagaagtgaagtgataaaaggatgcattgatgcgtttcacttttatgctgtcggccttttttggttttgtctttcatttggaggacttgctctcgtgcttgatcttgtatttgatttgtttcttatgtgggagtcattgttcacacagttaaaatgtgagtttatctttctatacaaaattcaagaacttcaatctttgtatatgatgtaagttgcagagatttgatcacattagtttgaggtgt

SEQ ID NO: 7144 - DNA, 1061 bp, Vitis vinifera
cggacgaactctaaagcctctctccagtaattcttttcctttccccacgttcttagagcggttcgcaagaaacagaagatgaccgtgatcgacattctcaccagagtcgacgcgatctgcaagaaatacgacaagtacgacatcgacaagcagaaggatctcaatgtctccggcgatgatgccttcgctcgtctttacgccgtcgttgaagccgacatcgaggccgctcttcagaaagcggatactgcatctaacgagaaaaatagagcgtctgcggttgctttgaacgccgagattcgtcggaccaaggctcgattgctggaggaggtccctaagttgcagagactggctataaagaaggttaaagggctttcaacagaagaacttgctgctcgtaatgatttggtccttgcattgccggataggatccaagcaataccagatggggctgcaactgcacccaaacaaactggaggttgggcagcttcagcttctcgtacagaaatcaaatttgattcagatggacgatttgacagtgaatacttccaacaaactgaagagtctagtcagttcaggcaagagtatgaaatgcggaaaatgaaccaagaccaaggtttggatgtgatagcagaaggtttggacacattgaaaaacatggcccatgatatgaatgaggaattggatcggcaagttcctttgatggatgagatcgacaccaaggtggacaaagcaacagctgacctcaagaatactaatgttagacttaaggacactgttaaccagctgaggtccagtcgaaatttctgcattgatattattttgttgtgtataattctgggaattgctgcctatctatataatgtattgaagaagtgaactgatgcaaaggcctacttatatcagttcatatggtgtttcgtttgtgtgtttagctttgtttgaggacttggtatgctgcttgattctggattagatttttttcttttttttttttccttgtcatgtttgaaggttttttgtttacacttggaaattgtacttctctcggatgcaaatttggg

SEQ ID NO: 7145 - DNA, 1767 bp, Arabidopsis thaliana
gaattgaaaataaaaaacgaagaatcaaaacaaatcttagagaaaacaaaaatccaatttttgctgtgaagatggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataagtaaaccacaaaaccagtcgacatttctatgaggaataagaattatatcttcgtctcgttccagattgctagaacagatgaagttggtgtttggagaatcaattcaaagctttggatcacaaagtcagagataagctctgctacaaagcttgagtaattgcagtattgtaagatttataaagttgcgatagtgttgattcttcatgtaaatgtgtggtgtctattaaaatcaagcctctgtttcttctttgcattcatttttgagaatatagagctaagaaactgatgattctccatg

SEQ ID NO: 7146 - DNA, 1718 bp, Arabidopsis thaliana
gaaaataaaaaacgaagaatcaaaacaaatcttagagaaaacaaaaatccaatttttgctgtgaagatggcaatgtctgtaaatgtttcttcttcttcgtcttctgggatcataaactctcgtttcggtgtttcattggagccaaaagtttcgcaaattggttcgttgaggttattggatcgtgttcatgttgctcctgtgtctctgaatctatctgggaagcgatcatcatctgttaaacctttaaacgctgaaccaaagacaaaggattcaatgattcctcttgcggcaacaatggtagcagaaattgcagaggaagttgaagtggttgagattgaggattttgaagagcttgctaagaagttagagaatgcttcacctcttgagattatggacaaagctcttgagaaatacgggaacgatatcgccattgcatttagtggtgcagaagatgttgctcttattgagtacgctcatttgactgggaggccatttagagtatttagtttggatacagggaggttgaatcctgagacgtatcggtttttcgatgcggtggagaagcactatgggattaggattgagtatatgtttcctgattctgttgaggttcaaggtttggttaggagcaagggattgttctctttttatgaggatggtcatcaggagtgttgccgtgttcgaaaggtgagacctttgaggcgtgctctcaagggtttaaaggcttggattactggtcagaggaaagatcaatctccggggacaaggtctgagattccggttgttcaggttgatccggtgtttgaaggtttggatggtggagttggtagtttggtgaagtggaatccggttgcgaatgttgaagggaatgatgtttggaacttcttgaggactatggatgttccggttaacacattgcatgcggcagggtatatatcgattggatgtgagccttgcacgaaagcggttttaccgggtcagcacgagagagaagggagatggtggtgggaagatgctaaagccaaggaatgtggacttcacaaagggaatgtcaaagaaaactccgatgatgctaaagtgaacggggaatcgaaatccgctgttgcagatatctttaagagtgagaatcttgtgactttgagcaggcaggggattgagaatttgatgaagttggagaaccgtaaagagccttggatcgtcgtgctttatgctccgtggtgccccttttgtcaagccatggaagcatcgtatgatgaactggcggataaattggctggaagtgggattaaggttgccaaattcagagcagatggtgaccagaaggagtttgctaagcaggaattgcagctcggtagcttccctaccattctggttttccctaagaactcatcgagaccgatcaagtatccgtctgagaagagagatgttgagtctttgacttcgttcttgaatcttgtccgataagtaaaccacaaaaccagtcgacatttctatgaggaataagaattatatcttcgtctcgttccagattgctagaacagatgaagttggtgtttggagaatcaattcaaagctttggatcacaaagtcagagataagctctgctacaaagcttgagtaattgcagtattgtaagatttataaagttgcgatagtgttgattcttcatgtaaatgtgtggtgtctattaaaatcaagcctctgtttcttctttgcat

SEQ ID NO: 7147 - DNA, 1701 bp, Cleome gynandra
ctgcgaaatggcattggcagtcactgcttcttcttcttcctcctcttccgttattcccagctctggtttcccgcgtttgggttttcattcggatatcaaagtgacgcaaatcggttctttgaggttggtggatagttttaatgttgttgctccatcatccctgactttgtctgggagaaattccttggtgaaacccctgaacgctgagccaaaaacactgaaggctgtcgttcctcttgcggcagcaaccactgttgcccctgaggtggaggaaaatgtggaagtggagaactttgaagaactggctacgaggctagagaatgcttcgcctcttgaaattatggacaaggctcttgagaagttcggagaggatattgctatcgcctttagtggtgctgaagacgttgccctactggagtatgctcgattaactgggagaccctttagggttttcagcttggacactgggagactgaaccctgaaacatacagatttttcgatgcagtggagaagcattacggcattcgaattgagtacatgtttcccgatgcggtcgaggtccaagccttggttaggaacaaaggtttgttctctttctatgaagatggtcaccaagaatgttgccgtgtgagaaaggtcagacctttgaggcgagctctgaagggcttgcgtgcctggatcacaggccaaaggaaggatcagtctccaggcacaaggtcagagattcccattgttcaggtcgatccagttttcgaaggtatggatggtggggttggtagtttggtgaagtggaaccctgtggccaatgtccaagggaatgatatttggaatttcttgaggactatggatgtccctgtaaacaccctgcacgcagaagggtatgtctcaatcggatgtgagccatgtacaagggctgttttgccagggcaacacgagagagaaggaaggtggtggtgggaggatgccaaggctaaggagtgtggacttcacaaagggaatatcaaggaaaacaccaatggaaatggaaatggcaatggaagtgcaaatgtaaacgggcaatccacagttgcagacattttcaacagtgagaatttggtgaccttgagcagaccgggaatacataatttgctgaaactggagaaccgtaaggaaccatggattgtcgtgctctatgcaccgtggtgccctttttgccaggcaatggaagcatcatacattgaattggcaaataagttgtcacaaagcggcgttaaggttgccaagttcagagcagatggcgaccagaaggaatacgcaaagcaggagctgcagctcgggagcttccccacgatactcgtcttcccaaagaactctgcacgacccatcaagtatccatctgaaaagagagacgtggattcacttatgtcctttgtgaatcttgtaaggtaaaatagcagaacccgacaacattgagaagcagatgaagaaacccttcatctttgttaccagagacttgggaactactgaatagccctatcatagatgtggtaatggaaaaaaaaatgttacagctttatgacagagtgagtagttggggccattggaaaactgtagagctgagtctcctctgtatatttgtggcttatagttaaaagttaagtttgtgctttgccgtggaatgataaagttcaatggtaattattgttatctaccaaaaaaaa

SEQ ID NO: 7148 - DNA, 1183 bp, Gossypium raimondii
caaccgaataatgggtaacacattattttcatttgaccaatcaaaagttcaaaaatatcacaccaatcaccacacattattagctcaaccaacagtgtttctcatctccataagaaggccaagatgagcattttggtattgttggttttttatattattagctgaaaatggagaattgttacccttttagcttgcttgaacctccaaattgtgatggttgcaatgctgctgctataagcaatgagcctcctttcgtagttccatggccagtcgaacctcttttctcagcttctagctcggttcgttgccacgggtttacttcgccagcgatacctgataaagctacggtggcttccaagagccatagtgaagccgagaagcgtcggagggatcggattaactcgcagcttacagctttgaggaaattgattcccaagtctaacaagatggacaaggcagccttattaggaagtgcaatagagcaagtcaaggatctaaaacgaaaagcaacagaaatcggcaaagcttttgctataccgtccgaaaccgatgaagtatctgtcgattacaatgttcccgaagacaagacattcatcagggtttcgatttgttgcgatgatcggccggaagtgttttcggaactcatccgagtcctcaaagggctaaggcttagcattgtggaagctgaaatttcaagtgttggtggaagaaccaaaagcaatttgatcctttgcaatgagagtgataatagagaaggtgtttcaagcaatctaaaacaatctttgaatgtagttgtgaacaagattaatgctttatcatcggatgaatcgaaatcgaattatcggataaggagtaagagacaaaggttgttcttgtcttcttagtttactccgtaataaacaaggtgaatatttaatacattgtcagtgtaggtgtttttatccgtgagcaaaaacagattgccttgtatttagtaaaataaaaaataatggagggcttacaaataaataataactttattcaaacccaaaatctaaaaatctaaaaccccaaacttgaaaaaaatccaaaacccaatatatatacaccatcaatgcaagttcttattggtttcttcctcaattataacttgatttcgaaaataaaacttgatctgaattaaataaattttttgaagataaaa

SEQ ID NO: 7149 - DNA, 1150 bp, Gossypium raimondii
gaccaatcaaaagttcaaaaatatcacaccaatcaccacacattattagctcaaccaacagtgtttctcatctccataagaaggccaagatgagcattttggtattgttggttttttatattattagctgaaaatggagaattgttacccttttagcttgcttgaacctccaaattgtgatggttgcaatgctgctgctataagcaatgagcctcctttcgtagttccatggccagtcgaacctcttttctcagcttctagctcggttcgttgccacgggtttacttcgccagcgatacctgataaagctacggtggcttccaagagccatagtgaagccgagaagcgtcggagggatcggattaactcgcagcttacagctttgaggaaattgattcccaagtctaacaagatggacaaggcagccttattaggaagtgcaatagagcaagtcaaggatctaaaacgaaaagcaacagaaatcggcaaagcttttgctataccgtccgaaaccgatgaagtatctgtcgattacaatgttcccgaagacaagacattcatcagggtttcgatttgttgcgatgatcggccggaagtgttttcggaactcatccgagtcctcaaagggctaaggcttagcattgtggaagctgaaatttcaagtgttggtggaagaaccaaaagcaatttgatcctttgcaatgagagtgataatagagaaggtgtttcaagcaatctaaaacaatctttgaatgtagttgtgaacaagattaatgctttatcatcggatgaatcgaaatcgaattatcggataaggagtaagagacaaaggttgttcttgtcttcttagtttactccgtaataaacaaggtgaatatttaatacattgtcagtgtaggtgtttttatccgtgagcaaaaacagatcgccttgtatttagtaaaataaaaaataatggagggcttacaaataaataataactttattcaaacccaaaatctaaaaatataaaaccccaaacttgaaaaaaatccaaaacccaatatatatacaccatcaatgcaagttcttattggtttcttcctcaattataacttgatttcgaaaataaaacttgatctgaattaaataaattttttgaagataaaaa

SEQ ID NO: 7150 - DNA, 932 bp, Gossypium hirsutum
gttaaaaaatatcacaccagtcaccacacattatttagctcaaccaacagtgtttctcatctccataagaaggccaagatgaagcatttttggtattgttggttttttatattgttagctgaaaatggagaattgttatcctcttagctttcttgaacctccaaattgtgatggtttcaatgctgctgctataagcaatgagcctcctttcatagttccatggccaatcgaacctcttttctcagcttctagctcagttcgttgccacgggtttacttccccagcgatacctgataaagctacggtggcttccaagagccatagtgaagccgagaagcgtcggagggatcggattaactcgcagcttacagctttgaggaaattgattcccaagtctaataagatggacaaggcagccttattaggaagtgcaatagagcaagtcaaggatctaaaacgaaaagcaacggaaatcggcaaagcttttgctataccgtccgaaaccgatgaagtatctgtcgattacaatgttcccgaagacaagacattcatcagggtttcgatttgttgcgatgatcggccggaagtgttttcggagctcatccgagtcctcaaagggctaaggcttagcattgtggaagctgaaatttcaagcgttggtggaagaaccaaaagcaatttgatcctttgcaatgagagtgataatagagagggtgtttcaagcactctaaaacaatctttgaatatagttgtgaacaagattaatgctttatcatcggatgaatcaaaatcgagttgtcggataaggagtaagagacaaaggttgttcttgtcttcttagtttactccgtaataaacaaggtgaatatttaatacattgtcagtgtaggtgtttttatccgtgagcaaaaacagaccgtcttgtatttagt

SEQ ID NO: 7151 - DNA, 1312 bp, Gossypium raimondii
tggaaaatttgaaggaatttccaatttcagatctggaaatcaacccaaattggaattgggtgttttggataagatcgactgtgtacaaacacactacccttattttaatatattttgtcagcgaaactgaaagaataaatataaatttatttatttattaaagttccatttggtgaattgtctgtagcgcaatcctaggtgtctgaaaatatgtgtattaaacagtttggactttggagtgtggcgttgcagaatctcgtagttggtttatcttttcactcactctgttggctaaactgcttttctagggttcatttatctttcgcctccctctcttttcttttttcaatcccctccttctttcaggtaaaatgcaacgggcagttcgagctttttcggtgcacggaaatactgtgaaaaatgcgatcttgcatcgcattcgggttgtcaatccggttatacgacccgttatgttttccagatcacttacatctgctagtatggaagaacatggcttcgagagcaccactatttcagacgttttgaaagccaaaggcaaaggtgcagatggatcctggctttggtgcactacggatgactctgtgtacgatgctgtgaaatcgatgactcaacacaatgttggtgctctggtggttgttaaacctggagagcagaaatcaattgcgggtatcatcacagagagagattatcttaggaagataatagtacatggaagatcatccaagtcaactaaagttggggacatcatgactgaagagaacaagctcatcacggtcacacctgagaccaaagttctgcaagcaatgcaattgatgacagataaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatgatggaatatagtgtatgtttcacttgttggacttaagcaagcaagcaaggggagagcttgcaaatatgctatgttttcgtggtttttctgtgaagatgcaagtgatgttggaataattaccatgtggactaagtgtttgacaataatcattctcattttgcttccttcctatttgactaggaaagtggcaaaagcaaccttgatcagtttgatttctgtttttctaattattgaacgcattaactcggcgagtcacgattgagccctttgcataggtatcaactaaaaaataaactaattaaaatctg

SEQ ID NO: 7152 - DNA, 992 bp, Gossypium raimondii
gcggaatctcgtagttgggtttatcttttcactcactctgttggctaaactgcttttctagggttcatttatctttcgcctccccctcttttcttttttcaatcccctccttctttcaggtaaaatgcaacgggcagttcgagctttttcggtgcacggaaatactttgaaaaatgcgatcttgcatcgcattcgggtggtcaatccggttatgcgacccgttatgttttccagatcacttacatctgctagtatggaagaacatggcttcgagagcaccactatttcagacgttttgaaagccaaaggcaaaggtgcagatggatcctggctttggtgcactacggatgactctgtgtacgatgctgtgaaatcgatgactcaacacaatgttggtgctctggtggttgttaaacctggagagcagaaatcaattgcgggtatcatcacagagagagattatcttaggaagataatagtacatggaagatcatccaagtcaactaaagttggggacatcatgactgaagagaacaagctcatcacggtcacacctgagaccaaagttctgcaagcaatgcaattgatgacagaaaaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatggaatattgtgtatgtttcacttgttggacttaagcaagcaagcaaggggagagcttgcaaatatgctatgttttcgtggtttttctgtgaagatgcaagtgatgttggaataattaccatgtggactaagtgtttgacaataatcattctcattttgcttccttcctatttgactaggaaagtggcaaaagcaaccttgatcagtttgatttctgtttttctaattcttgaacgc

SEQ ID NO: 7153 - DNA, 1022 bp, Gossypium hirsutum
ttgcagaatctcgtagttggtttatcttttcactcactctgttggctaaaccgcttttctagggttcatttatctttcgcctccccctctttctttttcaatcccctccttctttcaggtagaatgcaacgggcagttcgagctttttcggtgcacggaaatactttgaaaaatgcgatcttgcatcgcattcgggtggtcaatccggttatgcgacccgttatgttttccagatcacttacatctgctagtatggaagaacatggcttcgagagcaccactatttcagacgttttgaaagccaaaggcaaaggtgcagatggatcctggctttggtgcactacggatgactctgtgtacgatgctgtgaaatcgatgactcaacacaatgttggtgctctggtggttgttaaacctggagagcagaaatcaattgcgggtatcatcacagagagagattatcttaggaagataatagtacatggaagatcatccaagtcaactaaagttggggacatcatgactgaagagaacaagctcatcacggtgacacctgagaccaaagttctgcaagcaatgcaattgatgacagaaaaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatgatgatggaatattgtgtatgtttcacttgttggacttaagcaagcaagcaaggggagagcttgcaaatatgctatgttttcgtggtttttctgtgaatatgcaagtgatgttggaataattaccatgtggactaagtgtttgacaataatcattctcatgttgcttccttcctatttgactaggaaagtggcaaaggcaaccttgatcagtttgatttctgtttttctaattcttgaacgcattaactcgactagtcacgattgag

SEQ ID NO: 7154 - DNA, 955 bp, Theobroma cacao
ggtcttcacactcgcatccgccgctgctgcctccaaagcctttggccctggccgtaccgagccaactgaagagcgcctgaagcttcctttatcgcgccgactgcatcttcctccaacagctcctcgcctcctcccttcgcagaatgaaaggggcagttcaagcttttttgttgcatgggaatactgtaaaaaatgctgtgttgcaacgcattcgggtggtcaatccagttaagcgacccattatattttcccgctttgaatcagtttcatctgctcgcatggaagagcacggctttgagagcaccactattgcagacatcttgaaagcaaaaggtaaaggtgcagatggctcctggctttggtgcactacagatgacactgtgtacaatgctgtgaagtcgatgactcaacacaatgtcggtgccctggtggttgtaaaacctggagagcaggaatcaattgcgggtattatcactgagagagattatcttaggaaaataatagtacagggaagatcatccaagtcagctaaggttggggacatcatgactgaagagaacaagctcattactgtcacacctgagaccaaagttctgcgagcaatgcaattgatgacagataaccgaatccgacacattccagtgattgatgagaagggaatggtcggcatggtttccattggagatgttgttcgtgctgtggtgattgagcaccgtgaggagttggaccgtctgaatgcttacattcagggaggttactagatgatgatgaaatcttgtgtgtttcacctgttatcttgcatacttgttggacataagtaagcggagagcttgtaaatactgtgtgttttctgcatcctctgtcgcgtggctttatctttcccacatgtcgatatgcaacgatatgaaataatatcatgtggactaacagtttaccaataaacattatcgtcttg

SEQ ID NO: 7155 - DNA, 1185 bp, Theobroma cacao
aagtaaaatttattattattaactaataatttatttaattagtaaaaatttgctaatgttaggatcgaactcacgtctgaaaagaaaacactgcaaccactagccatctttgccaaccatacacatcgaggagggcggaagtttaataaataaatctagctaatcgccaaatataagactaaccctaggtaactcctgggcccattttttcccgaacttttcggtcttcacactcgcatccgccgctgctgcctccaaagcctttggccctggccgtaccgagccaactgaagagcgcctgaagcttcctttatcgcgccgactgcatcttcctccaacagctcctcgcctcctcccttcgtggcagaatgataggggcagttcaagcttttttgttgcatgggaatactgtaaaaaatgctgtgttgcaacgcattcgggtggtcaatccagttaagcgacccattatattttcccgctttgaatcagtttcatctgctcgcatggaagagcacggctttgagagcaccactattgcagacatcttgaaagcaaaaggtaaaggtgcagatggctcctggctttggtgcactacagatgacactgtgtacaatgctgtgaagtcgatgactcaacacaatgtcggtgccctggtggttgtaaaacctggagagcaggaatcaattgcgggtattatcactgagagagattatcttaggaaaataatagtacagggaagatcatccaagtcagctaaggttggggacatcatgactgaagagaacaagctcattactgtcacacctgagaccaaagttctgcgagcaatgcaattgatgacagataaccgaatccgacacattccagtgattgatgagaagggaatggtcggcatggtttccattggagatgttgttcgtgctgtggtgattgagcaccgtgaggagttggaccgtctgaatgcttacattcagggaggttactagatgatgatgaaatcttgtgtgtttcacctgttatcttgcatacttgttggacataagtaagcggagagcttgtaaatactgtgtgttttctgcatcctctgtcgcgtggctttatctttcccacatgtcgatatgcaacgatatgaaataatatcatgtggactaacagtttaccaataaacattatcgtcttgctcgg

SEQ ID NO: 7156 - DNA, 1101 bp, Manihot esculenta
aggctgcacaccacatcactctccccctctctgtatgtgtgtgtatatatatatacatatttcgttgtcactggcatttctgatctagggttgcttttgctttcttcatcctcagccgaaagttcaaatctttctcttcttcctcttcttcacctaggtgatcttgtgggtgctccctggaaatcaggaaaaatgcaaggggcagttaatgcatttttgtcccatggaaatttggtaaaaaatgctgttttgcaacgattccgtgttgcaaatccagtactgaggcctattttgttttctcgttttgagtctgtctcatctgcccgtatggaagagcaaagctttgaaagcactaccatttctgacatcttgaaagccaaagggaaaggtgctgatggctcttggctttggtgcaccactgaggacagtgtttatgatgctgtcaagtcgatgacacatcacaatgttggagccttggtggttgttaaacctggagagcagaaatcaattgcaggaattatcacagaaagagattacctgaggaagattatagtccagggaagatcatccaagtctacaaaggttggggacatcatgactgaagagaacaagcttattacagtcactccggacactaaagttctgcgggcaatgcaattgatgacagataatcgcatcaggcacattcctgtcattgatgacaagggaatgatcggcatggtctccattggagatgttgtccgtgctgtagtgactgagcaccgggaggagctggaccgcttgaacgcttacattcaaggaggttactagatgatgacgacgacaaagatgatggaattccagggatgtgcttaccgtgcgaagatcagtaagcaaagatcttgtaaatatggcatgtgtgtgtctccagttatgtggtattacctatggtatcagaatacctgatgtcaaataacagcttgtgaactaactggttcacaataagcacaatcatcttgcttgagacctttgtctgtacatgtttagatgattggttgtagactggtaatgtcaaagaccttctggaaaaatatctaattttaagtcttgtttgttttatcg

SEQ ID NO: 7157 - DNA, 1057 bp, Tropaeolum majus
gagtcagtgctgtttctatgaactattctctccatatagtttaagatttcttttagggtttatcataattcatccttgcagtcaattcattttctgcttttgatctacttcaactcgatttgcaactgtgaggctaaaatgcaaagggcaatgcaagcagtatttgtgcatggaaacacggttaagaatgctgttttgcagcacgttcgtgtgatcaatccagtccttagacccatgatactttcacgctctgaatcggtttcagcttcccgaatggaagagcaaggctttgagagcactacaatagctgacatattgaaggctaagggtaagaatgcagatggctcctggctctggtgcactacagatgacagtgtttatgatgctgtgaaatcgatgactcaacacaatgttggagccttggttgttgttaagcctggggaacaaaaatcagttgctggaattatcacagaaagagattatctcagaaagatcatagttcagggaagatcatccaaatcaacaaaggtcggcgatattatgactgaggagaacaagcttatcactgtcacgcctgataccaaagtacttcgagctatgcaattgatgacagagaatcgcatcaggcacattcctgtaattgaaactgcaggaatgattggcatggtttccattggagatgttgttcgtgctgtggtgagtgagcatcgcgaggagctggaccgcttgaatgcttacattcaagggggttattaagacgataatgatgaaaaaaagagttgtccgcagatcctctttggaacccggagctttgttaatattggttgttctctccatctttctgtgtttgttgtggcttgtgttttctagctgtctcttaaattattattagctagcttgaaaaagtccatgatatttaaacaaacaggtcgataataatatgcaacaacttcctgctaatgtttgaacgatattatcatatggttgttgattaggcacaacttcttgtgtgcacatgatacttcaggtcgcatttgtactaatccaatcatatcga

SEQ ID NO: 7158 - DNA, 867 bp, Prunus persica
ctccatctctatccgaaagcagaaatcgcagctgccctgccccctcagacaggtaaaatgcaaggagcatttaaagctttttcatcacatggaaacattgtgaagaatggagttttgcgacacatccgtcttgtgaatcccctaattcagcctgttgcattttcacgctttgagtctgctacgcctgctcgcatagaagagcatggttttgaaagcaccagaattgcagacatcttgaaggggaaaggtaaaggtgctgacggttcctggctctggtgcacgacagatgactctgtttatgatgctgttaagtcgatgacccagcacaacgttggggccttggtggttgtgaaacctggagagcaaaaatctatcgcaggaatcataacagagagagattatctcaggaagatcatagtgcagggaagatcatccaagtcaacaaaggtcggggatattatgactgaggagaacaagcttatcactgtcacccctgacaccaaagttctacgggcaatgcaattgatgacagataaccgaatcaggcacattccagtaatagatgacaggggaatgattggaatggtgtccattggcgatgtggttcgtgctgtggtgagtgagcaccgggaggagctagaccgcctgaatgcttatattcaaggaggttactagatgatgatgacgaagacgatgagatgctgtttagttgacatcccggaatgaccaacagtaataagcctgaatgcttgtatatatcgtgtgttgtttgtgcatctccggttgtttggttatgtatttcccaatgtctaattacaaacttgtggactatcaagtgcttaataattagcaatgttgtgtttgcta

SEQ ID NO: 7159 - DNA, 908 bp, Vitis vinifera
tgcttgggggacacagagagagaagctaagaaaggatagcgtcagtggccgccaggtaaaatgcaaggagcaatacaagcaattgtatcacatggaagcattgtaaaaaatgcagttctgcatcaaatcaggctggtgaatccaatcatgccatctgttgtattttctcgtcttcagtcggttacttcagctcgtatggaggagcatggttttgagagcaccacaattgcagacgttttgaaaggaaaaggcaaaagtgcagatggttcttggctttggtgcactacagatgattctgtttatgatgctgtgaaatcaatgacacatcacaatgttggagccttggtggttgtgaaacctggagagcaaaaatctattgcaggaatcatcacagagagagattatctgagaaagatcatagtacagggaagatcatccaagtcaacgaaggttggagatatcatgactgaagagaacaagcttatcacagtctcacccaataccaaagttctgcgagcaatgcagctgatgacagataaccgcattaggcacattccagtgattgatgacaaggaaatgataggcatggtgtccattggggatgtggttcgtgctgtggtgaccgagcatagggaggagttggaccgcttgaatgcatacatccaggggggttattaaatggttatgctaatgatgatgagatatcaagttgcctatcagaaaaaaagaagagatgaaatgcttttgagctctcttgggtggataatacttctctttgaacactagtactacgctgactgcttgtaaatatatgttgtgctgtgtggaacttatgctacttgtttttgtgcttggagtacatcgccatgtggactatggctaaataatatgcactatgattcccactt

SEQ ID NO: 7160 - DNA, 1240 bp, Manihot esculenta
gtctatccaaaatcaaaaagtggacaactaccagtgggtagcttagcctgctcactgcacacacagcacccctctcactctctctctctccctgtgtatatatatttaaccattatcaacagtttctgatctagggttgcttctgctttcttcatcctcagccgaaagtgcaaatctttctgttccttctccttctcttcttcgtctaggaaaaatgcaaagggcagttagtgcatttttgtcccatggagatctggtaaaaaatgcagttctgcaacgcttccgtgttgcgaatccagtactaaggcctattttgttttctcgttttgagtctgtctcatctgctcgtatggaagagcaaagctttgaaagcactacaattgctgacatcttgaaagccaaagggaaaggtgctgatggctcttggctttggtgcaccactgatgacactgtgtatgatgctgtcaagtcgatgacacatcacaatgttggagccttggtggttgttaaacctggagagcagaaatcacttgcaggaattatcacagaaagagattacctgaggaagatcatagtacaaggaagatcatccaagtcaaccaaggttggggacattatgactgaagagaacaagctcattacagtcactccccacacaaaagttctgcaagcaatgcaattgatgacagataaccgcatcaggcacattcctgtcattgatgataaggacatgattggaatggtgtccatcggagatgttgttcgtgctgtagtgaccgagcaccgggaggaactcgaccgcctgaatgcttacattcaaggaagttactagatgatgacgagaactgaagatcgaatgctgaggatgtgtttgctcttggaagacaaggaagcaagacaagggcttgtaaatatggcatgttgtctgtgtgtgtgtgtgtgtagtttaaggtggttttgtccatttccatatcagaatatctgatgtcaaataacagtgtgtggactaataggttcataataagcagagtcttgccgcttgatgaatggttcatgttcatggtcattaccatcttatgggtggttatagacctgcaatgtcaaactcctgaaaacttctagtttccaagatttcatggcttctttttggtagggcgaaatgtatatttaggtatatttgcatacttgtatttttaacatttttaaatagcagacatttcaattttaactgacatttaat

SEQ ID NO: 7161 - DNA, 1076 bp, Vitis vinifera
tgcacttttactttgcataagattatgaacagcttattttgtttggtttaataaaaatgctggatggattattttatctctcgcttcaggagtgcttgggggacacagagagagaagctaagaaaggatagcgtcagtggccgccaggtaaaatgcaaggagcaatacaagcaattgtatcacatggaagcattgtaaaaaatgcagttctgcatcaaatcaggctggtgaatccaatcatgccatctgttgtattttctcgtcttcagtcggttacttcagctcgtatggaggagcatggttttgagagcaccacaattgcagacgttttgaaaggaaaaggcaaaagtgcagatggttcttggctttggtgcactacagatgattctgtttatgatgctgtgaaatcaatgacacatcacaatgttggagccttggtggttgtgaaacctggagagcaaaaatctattgcaggaatcatcacagagagagattatctgagaaagatcatagtacagggaagatcatccaagtcaacgaaggttggagatatcatgactgaagagaacaagcttatcacagtctcacccaataccaaagttctgcgagcaatgcagctgatgacagataaccgcattaggcacattccagtgattgatgacaaggaaatgataggcatggtgtccattggggatgtggttcgtgctgtggtgaccgagcatagggaggagttggaccgcttgaatgcatacatccaggggggttattaaatggttatgctaatgatgatgagatatcaagttgcctatcagaaaaaaagaagaagatgaaatgcttttgagctctcttgggtggataatacttctctttgaacactagtactacgctgactgcttgtaaatatatgttgtgctgtgtggaacttatgctacttgtttttgtgcttggagtacatcgccatgtggactatggctaaataatatgcactatgattcccacttgaaacttgtttttcaatacacaattgctgacacaaagtctaattgattaataaaaaacactaattctagctgcta

SEQ ID NO: 7162 - DNA, 970 bp, Citrus clementina
atcaaataggaaaagaagtaaagaattaggatcacgggtcactctcacccactgccatttccttcttattctatttgggttacagcaggtctctcaatcttatcccgtatctgctgcttctgccgccgccaccagtattgctctctcacactcacaggaaaaaaaatgcaaggggcaattcaatcatttctatcccatggaaatatcgtcaaatctgctgttctgcaacgcatccgtttggtcaatccgatgcttaggcctgtagtttcttcgcggttcgagtcggtttcatctgctcgtatggaagagcatggtttcgagagcacaacaatttcagacatattgaaagcaaaaggtaaaggtgcggatggctcttggctttggtgcactactgatgacactgtctatgatgctgtcaagtcgatgacacagcataacgttggagcgttggtcgtcgtcaaacccggagagcaaaagtctgttgctgggatcatcacagagagagattatctcaggaagatcatagtgcagggaagatcatccaagtcaactaaagttggggacatcatgactgaagagaacaagctgatcacagtctcacctgacaccaaagttctgcgggcaatgcaattgatgacagataaccgtattcggcacattccagtaattgatgacaagggaatgataggcatggtgtccattggagatgttgttcgtgctgtggtgagtgagcatcgtgaggagttaaaccgcctgaatgcttttatacaaggaggttactagatgatgatgacaagatgaaatgttgtgatgcatgttttttgagtactactaataagacaggaggttgtaaatatggcgtgttgtatgcatctcctgtcgtatgctttttctttttccctttttcccagatgtcaatatgctttgacgtgaaataagaccttgtggactaaccttaattttgcttgga

SEQ ID NO: 7163 - DNA, 860 bp, Citrus sinensis
tcttcaggaaagattctatttcatcattgttgattatgttgtaataggaaaaaaaatgcaaggggcaattcaatcatttctatcccatggaaatatcgtcaaatctgctgttctgcaacgcatccgtttggtgaatccgatgcttaggcctgtagtttcttcgcggtttgagtcggtttcatctgctcgtatggaagagcatggtttcgagagcacaacaatttcagacatattgaaagcaaaaggtaaaggtgcggatggctcttggctttggtgcactactgatgacactgtctatgatgctgtcaagtcgatgacacagcataacgttggagcgttggtcgtcgtcaaacccggagagcaaaagtctgttgctgggatcatcacagagagagattatctcaggaagatcatagtgcagggaagatcatccaagtcaactaaagttggggacatcatgactgaagagaacaagctgatcacagtctcacctgacaccaaagttctgcgggcaatgcaattgatgacagataaccgtattcggcacattccggtaattgatgacaagggaatgataggcatggtgtccattggagatgttgttcgggctgtggtgagtgagcatcgtgaggagttaaaccgcctgaatgcttttatacaaggaggttactagatgatgatgacaagatgaaatgttgtgatgcatgttttttgagtactactaataagacaggaggttgtaaatatggcgtgttgtatgcatctcctgtcgtatgctttttctttttccctttttcccagatgtcaatatgctttgacgtgaaataagaccttgtggactaaccgtaattttgcttgga

SEQ ID NO: 7164 - DNA, 939 bp, Fragaria vesca
gtcaaggttaggtcttgacgggtccttctctaatctctatccacaagccgaaattttctcagcagctcaggtaaatatgcaaggagcgcttaaagcgttttcatcacagggcaactttgtgaaaaatgcagtcttgcgacacgtccgtgttgtgaatcccctaattcagcctgctttgttttcacgtttcgagtctgttgcgcctgcccgcatagaagagcatggttttgaaagcactaagattgcagacgtcctgaacgcaaaaggtaaaggtgctgatggttcctggctgtggtgcacaacagatgattctgtttatgatgctgttaagtcgatgacccagcacaatgttggagccttggtggttgtgaaacctggagaacaaaaatcaattgcaggaatcataacagagagagattatctccggaagatcatagtgcaggggagatcatccaagtcaacaaaggttggggatatcatgactgaggagaacaagcttatcactgtcacccctgacaccaaagttctgcgggcaatgcagctgatgactgataaccgaattaggcacatcccagttatagatgacagaggaatgcttggtatggtgtccattggtgatgtggttcgtgctgtggtgagtgagcaccgggaggagctggaccgcttgaatgcttttattcaaggtggttactagataatgatgaaaaagaagatggcaagacgtcgtttagctgacatggtggaatgactagcagtaataagccagagtgcttgtatatattgcatgctttgtgcttcgcctgttgtttggttctgtatttcccaatgtctacaatctatcacatgaactaccaacttgtggactatcaagttaataatatgtttgcttaacttttgcctaaatagtgttctttcagatatttggtattgcatataaga

SEQ ID NO: 7165 - DNA, 1089 bp, Cucumis sativus
tcatttcatctccatcgtcatcttcatcttcctcttcctcttctctccctctaggtttcattctccaagccttctaactcttcctgcttctcaactttctccaaaccggatcttcctcactcagtgcaacaggtaaagatgcaaggtgctgtgcgatcatttctatcacatggaaacgttgtgaaaactgctgttctgcaacaaattcgtgtagcaaacccccatatgaggcctgcaatgctctcacgtttttcaacatcagctagttctgcaaacattgaagagcatggctttgaaagcactaccattgatgacatcttgaaagctaaaggcaaaagtgccgatggatcttggctttggtgcaccacggaggactctgtttatgatgctgttcagtcgatgactcagcataatgttggagccttggtggtggttaaacctgcggagcaaaattcaatagctggtattataacggagagagattatctgagaaagattatagtgcaaggcagatcttcgaagtctaccaaagttggggatattatgactgaggagaacaaacttatcactgtgacacctgacaccaaggttttgctagctatgcaacttatgactgacaacagaattaggcacatacctgtcattgatgagaagggcatgaaaggcatggtgtcaatcggggatgttgttcgggctgtggtgagcgagcacagggaggagctagatcgcctgaatgcttacattcagggaggttattaagtttggtgctgtggaccttggttgcttggtgtatgattttccgataaaccagaacacttcagctcttgtacatatgatgatgatgatgatgataggcttggtatgcgcattctcttattaatatggttgtgcttcatattaatatggctgtgcttcatttcatgttgtttctaagtacaataatgaacccatgttgtaataatagactcacaacaactttgctttgcaaaatttcaccctaatttgcatcatcattgatggagatgacttgacataaatctcccccaagtttgcaatttaccaaatatgaagcagtgtatttctgttcaa

SEQ ID NO: 7166 - DNA, 943 bp, Citrullus lanatus
accttattgtacacattttttgagcctctggtgcaacaggtaaagatgcaaggtgctgtgcgatcatttctgtcacatggaaacgttgtgaaaactgctgttttgcaacaaattcgtgtagcaaacccccatatgaggcctgcaatgctttcacgcttttcaacatcggctagttctgtaaacatggaagagcatggctttgaaagcactaccattgatgacatcttgaaagctaaaggcaaaagtgctgatggatcttggctttggtgcaccacagaagacacagtctatgatgctgttcagtcgatgactcagcacaatgttggagccttggtggttgttaaacctgcggagcaaaattcaatagctggtattataacagagagagattatctaaggaagattatagtgcaaggcaggtcttccaagtctaccaaagttggggatatcatgactgaggagaacaaacttatcactgtgacacctgacaccaaggttttgcgagctatgcaattgatgactgataaccgaattaggcacatacccgtcatcgacgacaagggcatgaagggcatggtgtcaattggagacgtggttcgggctgtggtgagcgagcaccgagaggagctggaccgcctgaatgcttatattcagggaggttattgagttgctgctattgactttggttgcttggtgtatgatgtttcgaaacaccagaatgcttcagctcttgtacatatgatgatggcctggtatgcgcactctcttattaatatggtcgtgcttcctgttgcttctagtacaataaccgacggatgtaataatagacggttactttgctttgcaaaattacacctgaatttgcattatcattgatggagatgacaaatctccctcgagttagcgatttaccaaaaatgaagcagagaatttctgtttaaaa

SEQ ID NO: 7167 - DNA, 1156 bp, Aristolochia fimbriata
ttatcatgatgcaatttcgttggatctctgtattgcccgtgccgtgctgtccgttttgacgtgcttttacttttgttcttttaaaggaaagagctcttggaggataagctagtaaaatattgtgagctgatccagctgagggttgctgctgggctgctttcctgctggtgttctcgcgttcgatcgccggtgccaacgacggatcttggtcttctgtccattagaggatatgcaaggtgcaattcgagcaattagagttcgctcaagtgtaataaaaaatgctgtgcttcaacacatccgtgtcgtggatccagttgtgcagcctgccatattttcacgatatgaatcagccccctctactcggctagaagaacatggatttgaaagtaccacaatctcagacattttgaaagtgaaaggtaaaagtgctgatgggtcctggctttggtgcacaacagatgactctgtttatgatgctgtcaaatcaatgacacaacataatgttggagctcttgtggtggtaaaacctggggagcagaaatcaattgctggaataatcactgagagagattatctgaggaagatcattgtgcagggaaggtcatccaagtctactaaagttggggacataatgactgaagagaacaaactcatcacagtgacaccggatacaaaagttctgcgagcaatgcaactcatgactgataatcgtatcaggcacattccggtcattgatgacaaggagatgataggaatggtctctattggagacgttgttcgagcagtggttagtgagcaccgtgaagagctcaatcgccttaatgcatacatacaaggaggatattagagaatatgtggaaaaggatatattatttactgttgaatgaaaggtagaaaataaaagacttttgcaactggaaaatgcagagatcttttactgtaccattatgggctgggatacttgacaagctttatgtgcacaatgttgcttggtcgatacctttttgaacctttaccctagtgaaggaaacaattgcatgggtgttgtgtgaattatgtttgcgtggcgctgcctggctatccttgttgtgcagaactagcggactaagtcgggtcaattagaaattgatgaataatcactggataatacgtaaaa

SEQ ID NO: 7168 - DNA, 1012 bp, Cleome gynandra
gtttcaagagtaccaaagcggattatctctatccatcttcctgaaaaatttccactcactcccacaaatcgtctcttggctctgctcaagggttctcactctcctctccctactctctgatccaaacttaaggtgaagatgcaagctgtgattagggcctttgtatctggtggaaatgttgccaaagctgctgtgttgcatcacttgcgtgtgatcaatccggcgatccaacccgccgtgttctctcgatctgagtccactcagtctgctcgaatcgaggaacacgggttcgaaagcaccacgatatcagacattttgaaagcaaaaggcaaaagtgctgatggttcttggctttggtgtactaccgatgactctgtctatgatgctgttaagtccatgactcaacacaacgtaggagctttggtggtggtgaaacctggggaacagcaatccattgctggaatcatcacagagagagattatcttcggaagattatagtgcaagggagatcatccaaatcaacgaaagtcggggacattatgactgaggagaataagctcatcactgtaacaccagataccaaagttctccgagcaatggaactcatgacagataaccgcatcagacacatcccggtaatcaacgacaaggaaatgatggggatggtgtcaatcggagatgtggtccgtgctgtcgtgactgagcatcgggaggagctgaaccgcctaaacgcatacatacaaggagggtactaaaagatggatactttcgaggccggctaaaagaatatgcaatttggcgatgctaaagctcaagatcagtgtaaatatgcagctgttgttggtgttggtgtttgttggtcccttgtgaaattagtaggatcagcttgaataataaatggcatgtggggcatgtcaaagacattgatttcctctctctgtcttctgtaagattctgatgtttatgttaactaagctatgtactttgtatgtcaaagtcttaaagtctgtt

SEQ ID NO: 7169 - DNA, 912 bp, Cleome spinosa
ctcttctccaactccgatccaacccttcaggcctgtaaaaatatccgactttgaagcttccgtattgtgtgtctatttcatagtaaagatgcaagctgcgattagggcatttgtatctggtggaaatgttgccaaatccgctgtgttgcgtcacttccgtgtgatcaatccggcgatccaaccagctgtgttctcccggtccgagtcaactcagtctactggaattgaggaacacgggttcgaaagcaccacgatctcagacattttgaaagccaaaggcaaaagtgctgatggttcctggctttggtgtacaactgatgactctgtctacgatgctgttcagtccatgactcaacacaatgtaggagctttggtggttgtgaagcctggggagcaacaatccattgctggaataatcactgagagagattatctacggaagattatagtgcaggggagatcatccaaatcaaccaaagtcggggacattatgaccgaggagaataagctcatcactgtaacacccgacaccaaggttttgtgggcaatgcaactcatgacagataaccgaatcagacacatccctgtaatcgacgacaaggaaatggtggggatggtgtccattggagacgtggttcgtgcagtggtgactgagcacagggaggagctggaccgtctaaacgcttacatacaaggagggtactaaaaagatcgaatatttccgaggcgggccgagaactttactgaagctaaagccttagatcagtgtaaatattgcagtgcttctttgtttgggggtgtgagccatttcctaggtttacttgtgaggcaaggaccagcttttgtgatgtgggtttgaagaataatgaattggcatgtgggggggcaaatgtcaaagacaataacacttga

SEQ ID NO: 7170 - DNA, 902 bp, Carica papaya
gagagtctgaatcagagagaggaaccgtgtggcgggcagtgcggcggctgtagcggtaacatcgctaaaaatgcaaggggtgatgcaagcaatttttgtacgtggtagcactgtaaaaaatgcaattctacaacatgttcgaattgcgaatccagtaattcggccacttatattttcacgccttgagtcagtttcatctgcccgtatggaagagcatggttttgagagcaccacaattgctgatatcctgaaaggaaaaggtaaaaatgctgatggttcctggctttggtgcaccacagatgatagtgtttatgatgctgtgaagtcgatgactcaaaataatgttggagcattggtggttttgaagcctggggagcaaaaatcgattgcaggaatcattacggaaagagattatctcaggaagatcatagtgcagggaagatcatccaagtccaccaaagttggggacattatgactgaggagaacaagcttatcacagtcaagcctgacactaaagttttacgggccatgcaattgatgactgataaccgcatcaggcacattccagtaattgatgacaagggaatgattggcatggtttccataggagatgttgtccgagcagtggtgagtgagcacagggaggagttggaccgcttgaatgcttatatacagggaggatactagatgatgatgaaaatggctgtttccttctctggttatgtctcatgctcttcgaataaacttgtaaatatgctctgttgtgtctgtctttttgtgttgtgttttcctgcgttttgtatgaaataaggtcgagtactatgtgtcaatcagacaatcagcttaatgataagcagtctccgaacttcttttttggctaaaagaattgtcttttaattga

SEQ ID NO: 7171 - DNA, 900 bp, Platanus occidentalis
gtaggtgatttgctttttcatcgcctttgcctttcaaagaccagtggaggagagagcacttttactcgtcccgtttcgcaagcccagcaaggtaagatgcaaggagcaattcaagcaattcgttcacatggaaacattcttaaacatgcaattctgcaacacatccgtctgctgaatccagtcttgcggcctgttctatttttgcgctttgagtctgcttcctctgctcgattagaagagcatggttttgaaagcacgacaattcaagacattttgaaagccaaaggtaaaagtgctgatggttcgtggctttggtgcacgacagatgatactgtttatgatgctgtgaagtcgatgacacagcacaatgttggagccttagtagtggtgaaaccgggagagcaaaaatcaattgctggcattatcacagagagagactatcttaggaagatcattgtacaggggagattgtccaagtcaactaaggttggagacataatgactgaagagaacaagcttatcacggtgacacctgataccaaagttctgcgggcaatgcaactcatgacagataaccgaattaggcacattcccgtgatcgatgacaaggagatgataggcatggtgtccattggagatgttgttcgagctgtagtgagcgagtaccgggaggaattggaccgcttgaatgcatatatacaaggaggctactagatagggaatggtaatgggcgatgatgctgatgatgacaatgatgataagagatgttgaataagtgcactcttttggtggatggtactttaaatgccgtaaattgcttgtacatagtggtatctgctagttgatgtataatatggtgattaataagccacttacgtaacgaagtcagaatgataagg

SEQ ID NO: 7172 - DNA, 1073 bp, Prunus mume
cttaatccttaagacaggtccatctctatccgagagccgaaattgcagctgccctgccccctcaggtaaaatgcaaggagcatttaaagctttttcatcacatggaaacattgtgaagaatggagttttgcgacacatccgtcttgtgaatcccctaattcagcctgttgcgttttcacgctttgagtctgctacgcctgctcgcatagaagagcatggttttgaaagcaccagaattgcagacatcttgagggggaaaggtaaaggtgctgacggttcctggctctggtgcactacagatgagactgtttatgatgctgttaagtcgatgacccagcacaacgttggagccttggtggttgtgaaacctggagagcaaaaatctatcgcaggaatcataacagagagagattatctcaggaagatcatagtgcagggaagatcatccaagtcaacaaaggtcggggatattatgactgaggagaacaagcttatcactgtcacccctgacaccaaagttctacgggcaatgcaactgatgacagataaccgaatcaggcacattccagtaatagatgacacgggaatgattggaatggtgtccattggcgatgtggttcgtgctgtggtgagtgagcaccgggaggagctagaccgcctgaatgcttatattcaaggaggttactagatgatgatgacgaagacgatgagatgctgtttagttgacatcccggaatgaccaacagtaataagcctgaatgcttgtatatatcgtgtgttgtttgtgcatctccggttgtttggttctgtatttcccaatgtctaattacaaacttgtggactatcaagtgcttaataaatagcaatgttgtgtttgctaaaatcttctgtggtgaattttcacacatgcataccaatgacccttttattatgttatacatgcgtcgaaaccataatatcaagtggcttggggccgttgttaggtagaagggtcattttatcgttattattattttcaataaatagtatagccctgcggctatattacaattaaatataatatacttcacccg

SEQ ID NO: 7173 - DNA, 1113 bp, Chelidonium majus
gatagtaggcttagtagagtgagtgttgggccttttgaattgatccagggcccaattaaatttcccttattattattatttggatatttgaagagagagagagaatcaatcaatcaaaatctatagctggttctgttctttggtttccaatttcatttccctgcctcctccgctgcatctgctgatctgcttcttccctcatcaatttcttaattttccaccggaaaaaaaagacaaggaaagataaaatgcaaggagcagcaattcaagcaatccgatcgcatggtaacatgtttaaaaatgcaattctccaacacatccgtttcgcggatcccatcacacgaccagctctgttctcacgcttcgactcgttttcatctactcctcgcttggaagagcatggcttcgaaagcaccacaattttggatattctcaaaggtaaaggtaaaaatgctgatggttcctggctttggtgcaccacagatgactcggtttatgatgctgtcaagtcgatgacacaacacaatgtgggagccttggtggttgttaaaccaggagagcagaagtccatagccggaattattaccgagagagactacctcaggaagataattgtgcagggaagatcgtccaagtcgacgaaggttggagacattatgactgaggagaacaagcttataactgtgacccccgatacgaaagtgcttcgagctatgcaactgatgacagataaccgcatcaggcacattcctgtgatcaacgacaaggagatgatgggcatggtgtcgattggagatgtggttcgagcagttgtcagcgagcaccgggaggagctggaccgcttgaatgcctatatacaaggtggttactagaggaaggtggtaagtagatgatgatgacgacgacaactatgacaacatgaatgcagaagtggtaccttttactctttccgcaagtgtctgtaaatactttggtttgttatgcaacacttttgcagctagattttatctcgccatgtggttggcgtagggaaatttgctgaataataataatgatactgggaactaatataaacctaatcgccaatgaatggctaatgcagtttcgtttttt

SEQ ID NO: 7174 - DNA, 961 bp, Taraxacum officinale
cggcgcgggggcctgaagctgaagattcatttaactaaaatccccttctgcccgtgaaactgtggcctccaccttcttctttcactactccagtctgtgtgtgctactgtttgtttctgcctgatctactgatctccaatcagttcaagagaaaatgcaaggaggaatcagagcattggtatcacaagggagcattgtgaaaaatgcacttcttcaacatgttcgtgtagtgaacatgaacacccttcgaccattgatgctgtcaagatctgagtcaacttcagctgctcctcgtatggaagaacacggttttgaaagcaccaccatttcagacatcttgaaaggaaaaggaaaaggcgctgatggctcatggctctggtgtaccactgatgattctgtttatgatgctgtcaaatcgatgacacagcacaatgttggtgccttggttgtggtaaaacctggcgaacaatcagcaattgctggaattattacagaaagagattatctcaggaaaatcattgttcagggcagatcttcaaagtcaaccaaggtcggagatatcatgactgaagagaacaaacttatcacagtaactccagataccaaagttctcaaagcaatgcagctaatgacagataatcgtatcagacacattccggtgattaatgacaaggagatgttgggaatggtgtcgattggagatgtggttcgtgcggttgtgagtgaacacagggaggagttgaaccgtctgaatgcatttatacagggtggttattagaaatatggatgtgatgatgacgataagaactttgctgtttgtgttgtgttttaataaggaattagaggtcttcaatttaggagtttgtaaataatttccgtgtcttttttaatgttattgtactcttggttatcgagaatgttatattactcgagagacttgttataacaacactttttagct

SEQ ID NO: 7175 - DNA, 1290 bp, Cucumis melo
ataaaatcgggtctcgcagttccattccatcagcttcgcttcccttcgtttcatcttcatcttcctcatcttcatctccatcttcaccttcctttaggtttcattctcctaaccttctaactcttcctgcttctcaactttcttcttcaactccttcattttttcttccggatcttcctcactcaggtaaagatgcaaggtgctgtgcgatcatttctatcacatggaaacgttgtgaaaactgctgttctgcaacaaattcgtgtagcaaacccccatatgaggcctgcaatgctctcacgtttttcaacatcagctagttctgcaaacattgaagagcatggctttgaaagcactaccattgatgatatcttgaaagctaaaggcaaaagtgccgatggatcttggctttggtgcaccacggaggactctgtttatgatgctgttcagtcgatgactcagcacaatgttggagccttggtggtggttaaacctgcggagcaaaattcaatagctggtattataacagagagagattatctgagaaagattatagtgcaaggcagatcttcgaagtctaccaaagttggggatattatgactgaggagaacaaacttatcactgtgacacctgacaccaaggtcttgcgggctatgcaacttatgactgacaacagaatcaggcacatacccgtcattgatgacaagggcatgaaaggcatggtgtcaatcggggatgttgttcgggctgtggtgagcgagcatagggaggagctagatcgcctgaatgcttacattcagggaggttattaagttggttctgctgactttggttgcttggtgtatgattcgataaaccagagcacttcagctcttgtacatatgatgatgatgataagcttggtatgcgcactctcttattaatatggttgtgcttcattttcatgttgtttttagtacaataacggactgatgttgtaataatagactcgcaacaactttgctttgcaaaattgcaccctaattttgcatcatcgttgaaggagatgactgtcataaatctcctccaagtttgcaatttaccaaaaatgaagcagtatatttctgttcaaaatgtatttgtggaatctctttggatttaacttcaagattttcttcagaggcactagcaccgatcctacctacgatactgtcggtatctttctgatattctttacccgtcaattgaagagctatcccattgttaagattccttcatagaatagattctccactgcaaacaactaaata

SEQ ID NO: 7176 - DNA, 813 bp, Medicago truncatula
caccacctcaaccattccattcgacccgaaagccactctctctcactctctctctctctatctgacagccaaaatgcaaggaggattgcgatcatttttgtcaaacgggaatgtcattaaaaatgctgttttgcaacgagtccgcatggtgaatcccctgttgcagccagttgccttttcacggtttgagtctgccacacctgctcgtattgaggagcatggtttcgagagcaccacaatttcagacatcttgaaaggaaaaggtaaaggtgctgatggttcctggctttggtgcaccacagatgacactgtttatgatgctgtcaaatcgatgacacaaaacaatgttggagctttggtggtcgtgaaaccaggggaggagaaatcaattgctggaattataacagaaagagattacctgaggaagatcattgttcagggaagatcatccaagtccaccaaggttggagatattatgactgaagagaacaaacttatcacagtcacccctgataccaaagttctacgagcaatgcagctgatgactgacaacaggatcagacacatccctgtcataaatgacaagggaatgctcggcatggtgtccattggagatgttgtccgtgctgtcgtgggagagcatcgtcaagagcttgaccgcttgaatgcttacatacaagggggatattaatctttagtctattagatgatgatgaaaatcccatgagggcactcaagctaacttgaatcatgtaataagcttgagagtttgtaaatatgttttggtcagagagccatcttgtctgttttttt

SEQ ID NO: 7177 - DNA, 941 bp, Persea americana
attctccctgtccttctgtgggtgcagactgcagagtgcttccgttctaaggcagaatgcaaggtgcaattcaagcaatcagataccatggaaacattcttaaacaagccgttgtacaacatgtgcgtgttgtggatccaatcatgcgatctgctatattttcacgcttcaaatcagcttcctccgctcgcttggaagagcatgggtttgaaagtaccacaatttcagacgtcctaaattccaaaggtaaaggtgccgatggatcttggctttggtgcacaacagatgataccgtttatgatgctgtgaagtcgatgacacaacataatgttggagctttagtggtggttaagcctggggagcagaagtcaattgccggaataatcactgagagagactatctcaggaagatcattgtgcagggaagatcatcgaagtcaacaaaagttggggacattatgactgaagagaacaagctcatcacagtgactcccaatactaaagttcttcgggcaatgcaactgatgactgacaaccgtatcaggcacattcctgtgatcaatgacaaggatatgattggaatggtctccatcggagacgttgttcgagcggtggtaagtgagcaccgggaggagctggaccgcctgaacgcatatatccagggcggttactaagcgtttgttctgccacaatgttgatgacgacgacgaaggcaagctgatgcatttgaagtgggtaccaactatcaaatgcaatgtgtgtgataccttgttgcatgcttctttctcatggtaatgtcagtaagttgaggttagtcttatcttatctaccaactgaactggttctgatcagctgtggtgatgtattcagatttcagaataatacagcaacttaccgaactagggttttgtcataagatgaagcattgtctttggttggta

SEQ ID NO: 7178 - DNA, 974 bp, Cirsium arvense
gacaagatgcagggtaacaaatccttggaatttagaataaataaatactaccaaatggataaaccttgggctgcctcctcagatttaatataataaaactccatttctgcttgttaaagtgtggcctccacttttcttctgcaatctctcttgtgtgtgtgtgtgtgtgtttcagcttctccaatcagttaaaagatatgcaaggaggattgagagcttttgtatcacatggaagcattgtgaagaatgcagtcctccaacacgttcggctggtgaaccctctcgtgcgaccattaagccgtctcgagtcaacttcttcagccgctcgtattgaagaacacggtttcgaaagcaccaccatttcagatgtcttaaaaggaaaaggaaaaggtgccgatggctcctggctttggtgcaccactgatgattctgtttatgatgctgtccaatcgatgacacaacacaacgttggtgcgttggttgtggttaaacctggcgagcaatcatccattgctggaattatcacagaaagagattatctcagaaaaatcattgtccagggaagatcatccaagtcaaccaaggttggagatatcatgactgaagagaacaaacttatcaccgttacacccgataccaaagttctgaaagcaatgcagctaatgacagacaatcgtatcagacacattccggtgattgacgataagaaaatgctagggatggtttccattggagacgtggttcgagctgtggtgagtgaacacagggaggagctcgaccgtttgaatgcattcatccaaggtggctactagaaatgggtggtgccagggttgcaccgacgggtgggtatggtccgttccgttcaataacgagctagtcgtgttaggagtttgtaaatattttcacgtttcttttcgctgcaatcgaggacgttatatcactcgaggagacttgataatgacaaacttttaact

SEQ ID NO: 7179 - DNA, 873 bp, Flaveria ramosissima
aaaactcactttctgttcgtgacaccaattcactactcctctccactctctgtctgcactactgtgtgtaactgtgtgtgtcatcttcttcttcttcaatcagttaaaggatatgcaaggaggaattagggcatttgtatcacatgggggcattgtgaagaatgctgttcttcaacatgttcggctggtgaatccgctaagaccactgattacgtcacggcatgagacaacttcagcggctcgtattgaagaacaaggttttgaaagcacaaagatttcagatgtcttgaaagcaaagggaaaaggtgcagatggctcatggctctggtgcaccactgatgattctgtgtatgatgctgtcaaatcgatgactcagcacaacgttggtgcattagttgtggttaaacctggcgagaaatcatctattgcaggaatcatcaccgaaagagattatctccggaaaatcattgttcagggtagatcatcaaagtcaaccaaggttggagatatcatgactgaagagaacaaacttatcacagtaacgcccgaaacaaaagttctaaaagccatgcagctgatgacagataatcgtatcaggcacattccggtgattgatgagaagggaatgcagggcatggtttccataggagacgtggttcgtgctgtggtgagtgaacacagggaagagctcaaccgtttgaacacattcatacagggcggctactaaaaacagttaataatcgtaaaagcagtggtttaccacaatgttatgttgttttaataacaaggtagtcttttagggtctgtaaatatttaaactcctttcatgttctgtatgctgctatcgaggatgtgtggttactcgagagacat

SEQ ID NO: 7180 - DNA, 1003 bp, Carpinus betulus
ttcattatctgttaccgaatttcttagtggttctagtgggatcgcctcctcactcagatcctacgcagtgtctctctgcctttctacggttctccctctcttcttcggcgccgcgcgacgctacacaggcttcggcgctacaattctctctctaggctacggcactctctgtctccggaaaaatgcaaggagctcttcagtcctttttatcgcctggaaacatcgtaaaaaattcagttttgcgacacttccgtttggtgaatcccctgatgcgatctgttttattttcacgctttgagtcagttacatctgcccgaatggaagagcatggttttgaaagcactacgattgcggatgtcttgaaagcaaaaggtaaaagtgctgatggctcttggctctggtgcactatggatgatacagtttacgatgcggttaagtcgatgacacatcacaatgttggtgccttggtggtggtgaaacctggagagcagaaatcaattgccggaatcatcacagaaagggattacctgaggaaaatcatagtacagggaagatcatccaagtcaaccaaggttggggatatcatgactgaagagaacaagcttatcacagtcacacctgacacaaaagttttgcgggcaatgcaactgatgacagataaccgaattaggcacatccccatcattgatggaaaggggatgatcggcatggtgtccataggagatgtggtccgcgctgtagtgagcgagcatcgggaggagctagaccgcttgaatgcttatattcaaggaggttactagacgatgatgatggcaatggtgataccgctctcgcgttggctttgtcaaatgctacctgctccttgagcactaataagcttaagtacctttgtaaatgtggtgtgacgtgtgcaatttctgttttctggctctttatgtttcagatgtggatgtacggataccaaagaccagcttaaggtctacaagataataataagcactgg

SEQ ID NO: 7181 - DNA, 1133 bp, Medicago truncatula
atgaggttgtcattatcaatcacttacctacttacaagttatttgaggaacaagtcaagtgttcttgtcagcctcactcaccacctcaaccattccattcgacccgaaagccactctctctcactctctctctctctatctgacagccaaaatgcaaggaggattgcgatcatttttgtcaaacgggaatgtcattaaaaatgctgttttgcaacgagtccgcatggtgaatcccctgttgcagccagttgccttttcacggtttgagtctgccacacctgctcgtattgaggagcatggtttcgagagcaccacaatttcagacatcttgaaaggaaaaggtaaaggtgctgatggttcctggctttggtgcaccacagatgacactgtttatgatgctgtcaaatcgatgacacaaaacaatgttggagctttggtggtcgtgaaaccaggggaggagaaatcaattgctggaattataacagaaagagattacctgaggaagatcattgttcagggaagatcatccaagtccaccaaggttggagatattatgactgaagagaacaaacttatcacagtcacccctgataccaaagttctacgagcaatgcagctgatgactgacaacaggatcagacacatccctgtcataaatgacaagggaatgctcggcatggtgtccattggagatgttgtccgtgctgtcgtgggagagcatcgtcaagagcttgaccgcttgaatgcttacatacaagggggatattaatctttagtctattagatgatgatgaaaatcccatgagggcactcaagctaacttgaatcatgtaataagcttgagagtttgtaaatatgttttggtcagagagccatcttgtctgtttttttccctgtaatttcggatttcagttccatggattaacattaatccatggagtagcatgttaataataactactggatgcatcttgtttctgttgcttaactagtaaagatgtattcatctttaacttctgctgtttgcagttggtctattttatgctgcaagttatacagtagtactagtaatcaataagtagttgaaaatttagcttttaaaaaagttgcaatattgttttgatttttgaaga

SEQ ID NO: 7182 - DNA, 859 bp, Tabernaemontana elegans
gacttccaactttgctttactcctcagggtgctactgagctgctagttcaagaaagttctcaggttttcgttgctttccagatcagcacaatgcaaggaggaattcgagcaatcttttcccatgggaatgtcctcaagaatgccattctgcaacatgttcgtttagcaggtccagccatgcgacctcttatgtttgcaagaaatgagtcaacatcagctgctagaattgaagagcatggatttgaaagtaccacaatttctgacattttgaaagccaaggggaaaagtgcagatggatcatggctttggtgcaccactgaagacacagtgtatgatgcagtgaagtcgatgacacagcacaatgttggagcattggtggttgtgaaacctggggagcaaaagtcaattgctggcatcataacagaaagagattatttgaggaaaatcatagtgcagggaagatcatccaaatcaacaaaagttggggatatcatgacggaagagaacaagcttattacagttacaccagaaaccaaagttttgaaagcaatgcaattgatgacggataaccgcatcaggcacattccagtgatcaatgacagtgggatggtaggcatggtgtccattggagacgtggttcgtgctgtagtcagcgagcaccgtgatgagctcaaccgcttgaatgcgtatattcaaggaggatactagaagatgatgatgaaaaacaaatgaaacccaagatgcctttcgctgtttaagaattctgggtttgagtagttcaatgcctgtagatattgtgttatatgcatctctgaatgtgaaattaccaccaaagatgcaatgtcgtgcccaactagtt

SEQ ID NO: 7183 - DNA, 859 bp, Cynara scolymus
  misc_feature (783)..(783): n is a, c, g, or t
cggggcctctcggatttactttaacacaactccatttctgcttgtgaagtgtggcctccactttcttctagcaatctctgtgctacttgtgtgtgtgtgtgtttcagcttctccaatcagtttttgttgtgatagttaaaggatatgcaaggaggattcagagcgtttgtatcacatggaagcattgtgaagaatgcagtcctccaacatgtgcggttggtgaaccctctggtgcgaccattgacacgtctcgagtcaacttcagctgctcgtattgaagaacacggtttcgaaagcaccacgatttccgatgtcttgaaaggaaaaggaaaaggtgctgatggctcctggctctggtgcaccactgatgattctgtctatgatgctgtccaatcgatgacacaacacaatgttggtgctttggttgtggttaaacctggcgagcaatcatccattgccggaattatcacagaaagagattatctcagaaaaatcattgtccaaggaagatcatccaagtcaaccaaggtcggagatatcatgaccgaagagaacaaacttatcactgttacgcccgataccaaagttctgaaagcaatgcagctaatgacagacaatcgtatcagacacattccggtgatcgacgactaggaaatgctggggatggtttccattggagacgtggttcgagctgtggtgagtgaacacagggaggagctcgaccgtttgaatgcattcatccagggtggctactagaaacgggtggtgaactgtagcccgggntatggcgaccggtatgttctgtttcatacgagctagtcatgtagatgtgtatattcgcgtttcttttcgctgcatc

SEQ ID NO: 7184 - DNA, 957 bp, Ambrosia trifida
tgtgtaagtgtgttctctctgtgtaacataacatcttttctccaatcagttaagggatatgcaaggaggaatcagggcatttgtatcaaatggaagcattgtgaagaatgcagttctgcaacatgttcggctagtgaacccgctgagaccgttgatgatatcacgctacgagtcaacttcagcagctcgtattgaagaacaagggtttgaaagcaccaagatttcagatgttttgaatgcaaaggggaaaggtgcagatggttcatggctctggtgcaccactgatgattcggtgtatgatgctgtcaaatcgatgacacaacacaatgttggtgctttggttgtggttaaacctggcgaaaagtcgtctattgctggaattattacagaaagagattatctcaggaaaatcattgtgcaaggtagatcatcaaagtcaaccaaggttggagatatcatgaccgaagagaacaaacttattactgtaacgcctgaaaccaaagttctcaaagcaatgcagctaatgacagataatcgtatcaggcacattccagtgatcgatgagaaggggatgcaggggatggtttccataggagacgtggttcgtgctgtggtgagtgaacaccgagaagagctcaaccgtttgaatgcattcatacagggcggctactagaaccgtctgaatgcattcatacagagtggctactaaaaatggttaaaaaaccgcgatcagtggttaaccaggacggtatgtttgggtttcaataatgaggtagtcgttttacgattgtgtaaatatgttctgaatgtttttcgtgtttcttctgctgttatcgaggatgttgtcgggcgctcggatacctgataataacgcaactttttatgcttagaaacttttattgtttgttgtctttcttaattattttactaaaatttggttttcttacgttgtttaag

SEQ ID NO: 7185 - DNA, 798 bp, Ambrosia trifida
gtactcctatttatttttcttctctgtactacttgtgtgtaagtgtgttctctctgtgtaacataacatcttttctccaatcagttaagggagtatgcaaggaggaatcagggcatttgtatcaaacggaagcattgtgaagaatgcagttctgcaacatgttcggcaagtgaacccgctgagaccgttgatgatatcacgctatgagtcaacttcagcagcgcgtattgaagaacaagggtttgaaagcaccaagatttcagatgttttgaatgcaaaggggaaaggtgcagatggttcctggctctggtgcaccactgatgactcggtgtacgatgctgtcaaatcgatgacacaacacaacgttggtgctttggttgtggttaaacctggcgagaaatcgtctattgctggaattattacagaaagagattatctcaggaaaatcattgtgcaagggagatcatcaaagtcaaccaaggttggagatatcatgaccgaagagaacaaacttattaccgtaacgcctgaaaccaaagttctgaaagcaatgcagctaatgacagataatcgtattaggcacattccagtgatcgatgagaaggggatgcaggggatggtttccataggagacgtggttcgtgctgtggtgagtgaacaccgagaagagctcaaccgtttgaatgcattcatacagggcggctactagaaccgtctgaatgcattcatacagggtggctactaaaaatggttaaaaaccgcgatcagtggttaaccaagacggtatatgcttgggtt

SEQ ID NO: 7186 - DNA, 993 bp, Amsonia hubrichtii
atagattaaaagtacgagttgctgcacaaactccaatctaaggagaggagactccgtttctacaggtttcaactttgctttactcttcagagtactactgagctgttactccagaaagcacctcaaaaaatttcgatcagcaaaatgcaaggaggaattcaagcaatcttttcacatgggaatgtgctcaagaatgccattctgcaacatgttcgtgtagtaagtccagtcatgcggtctcttatgtttgcaagaaatgagtcaacatcagctgctacaatggaagagcatggttttgaaagtaccacaatttctgacattttgaaagccaaggggaaaagtgctgatggatcatggctttggtgcaccacagaagagtctgtatatgatgcagtgaagtcgatgacacaacacaatgttggagccttggtggtggtgaaacctggggagcaaaagtcaattgctggcatcatcacagagagagattatctgaggaaaatcatagtacagggaagatcatccaaatcaacaaaagttggggatatcatgactgaagagaacaagcttattacggttagacctgacaccaaagttttgaaagcaatggaattgatgacagataaccgcatcaggcacattccagtgatcaatgacagtggaatgataggcatggtgtccattggagacgtggttcgtgctgtagtcagtgagcaccgtaatgagctggaccgcttgaatgcatatattcaaggaggttactagatgatgatgacgaaaaaaatgtgaaatgcaagatgccatgcttttcagagttttaagaatttctgagtttgagcggtacagctcctgtaaatgttggttatatgcattgctgaacatgaatttgcctccaaagatgtcagcctcttgcccaactggatgtaataacaataaaactactgatgtttcttccttcctttttctcaaagttcgttgcatattgcatctgcaatt

SEQ ID NO: 7187 - DNA, 1078 bp, Trifolium pratense
  misc_feature (241)..(241): n is a, c, g, or t
  misc_feature (250)..(250): n is a, c, g, or t
  misc_feature (277)..(277): n is a, c, g, or t
ctcaaccattctattctccttcaagccactctctctttctctctcccattcatcacactctctctctctgacagcaaaaatgcaaggagcattgcgatcatttttgtcaaacgggagtgtcataaaaaatgctgttttgcaacgagtccgcgtggtgaatcccctattgcagccagctgccttttcacggtttgagtctgttacacctgctcgtattgaggagcatggttttgagagcacnacaatttcngacatcttgcaaggaaaaggtaaaggngcagatggttcctggctttggtgcaccacagatgacactgtttatgatgctgtgaaatcgatgacacaaaacaatgttggagctttggtggtcgtgaaacctggggaggagaagtcgattgcaggaattataacagaaagagattacctgaggaagattatcgtgcagggaagatcatccaagtccaccaaggttggcgatattatgactgaagagaacaaacttatcacagtgacccctgataccaaagttctaagagcaatgcagctgatgactgacaacaggatcagacacattcctgtcataaatgacaagggaatgcttggaatggtgtccattggagatgtcgtccgtgctgttgtgggtgagcaccgtcaagagcttgaccgcttgaatgcttacatacaagggggttattagtctattagatgatgatgatgatgaaaatccctcgacggcactcaagctgacttgaattatgtaataagcttgagtgtttgtaaatatgtgttggtcagagagccatcttacctgttttttttcctgtaatttcggatttcggttctatggtcattattccatggagtagcatgttaataataactgctggatgcatcttgtttctgttgcttaactagtaaagatgcatcaatctttaacttcaactctttgcagttggtctatttcatgctgcaagttatataattatcaagtagttgaaaatttagcttttgaaaatattactatattgttatggagatttggagattaatgagaaacttgaaaaattatatgcaaaaa

SEQ ID NO: 7188 - DNA, 978 bp, Euonymus alatus
ggaaaacgacacgtatcgtatggataaagttagcaaccccgtgaccatcgatctgctgcctctgaagttaggtcacttgtgggtttcaatatccagccgctttgcttcatcaagtggtcgtggcttttgtctagctgggtattgtcaactgaggaaaaatgcaagggtcatttcgtgcatttctatcccacacaagcatagtcaaaagctcagttttgcgacacatccgcgtgatggatccagtgttgcatccacttgtattttcacgctctcagtctgcttcatctgcccggatggaagagcatggttttgaaagcaccacgattgcagacgtattgaaagcaaaaggcaaaagtgctgatggctcttggctgtggtgcaccatgagtgacactgtttatgatgctgtgaagtcgatgacacaacacaatgttggagccttggtggtggtgaaacctggggagcagaaatcaattgcaggaatcatcacagagagagattatctcaggaagatcatcgtacagggaagatcctcaaagtcaaccaaagttggggacatcatgactgaagagaacaaacttattacagtcacacctgacaccaaggttctccgagcaatgcaattaatgacagataaccgtatcaggcacatccctgtgattgataaggaagggatggtgggtatggtatccattggagatgttgtacgagctgtggttagtgagcaccgggaggagctagaccgcttgaatgcctatatacagggtggttactagaaattatgatgatgacaatgaaatgaactttacttgcagacttctttcgcactaataaattaaaagcatgtaaatatggtttgttcatgttgtgtgcatcttctgttaatcgttcctagttgtcaatatgctgtgacatggaactatagttctgaagtttaataataataatagaagccatgttgcttggcaattctgctta

SEQ ID NO: 7189 - DNA, 784 bp, Heritiera littoralis
gcagtaggaaaactaccgtacaaaaacgcggtcttgcaacgcattcgggtggtcaatccagtaatgcgacccattatattttcccgctttgaatcagtttcatctgctcgtatggaagagcatggctttgagagcaccactattgctgacattttgaaagcaaaaggtaaaggtgcagatggctcttggctttggtgcactacagatgacaccgtatacaatgctgtgaagtcgatgactcaacacaatgtcggtgccctggtggtcgtaaaacctggggagcagaaatcaattgcgggtatcatcacagagagagattatcttaggaagataatactacagggaagatcatccaagtcaactagagttggggacatcatgactgaagagaacaagctaatcacggtcacacctgagaccaaagttttgcgagcaatgcaattgatgacagataaccggatccgacacattccagtgattgatgagaagggaatggtgggcatggtttccattggagatgttgttcgtgctgtggtgactgagcatcgtgttgagttggaccgcttgaatgctttcattcagggaggttactagatgatgacaaatcttgtattgcgtacttgttggacgttgcaagtaacctaagagcttgtaaataaatatgctctctatgcttgctttgtgtgatgtggtttatcttaacctcatgtcaacatgcaaggatgttggtgactgtaccgtgtgactagctgttttaataataagcattctcatgttgcttcgt

SEQ ID NO: 7190 - DNA, 884 bp, Rosa hybrid cultivar
catcttattcgaatcagatgcttatatgatctttcagattgttctagatgattttgggttgtacgattttgatgcagtagttctttgagctttgattcctgcttgatcgatcgcttcacatcttgattataaaaatgcaaggagcacttaaggccttttcatcacaggggaactttgtgaaaaatgcagttttgcgacacgtccgtgttgtgaatcccctaattcagcctgctttgttttcacgctttgagtctactgcacctgcccgcatagaagagcaaggtttcgaaagcactaggattgcagacatcttgaactctaaaggtaaaggtgctgatggttcctggctgtggtgcactacagatgattctgtttatgatgctgttaagtcgatgacccagcacaatgttggagccttggtggtcgtgaaacctggagagcaaaaatctattgcaggaatcataacagagagagattatctcaggaagatcatagtgcagggaagatcatccaagtcaacaaaggttggggatatcatgactgaggagaacaagcttatcactgtcacccctgacaccaaagttctgcgggcaatgcagctgatgacagataaccgaattaggcacattccagttatagatgacaggggaatgcttggtatggtatccattggtgatgtggttcgtgctgtggtgagtgagcaccgagaggagctcgaccgcttgaatgcttttattcaaggcggttactagataatgatgacaaagaagatgacaagatgccgtttagctgacacggtgtaatgacaagcagtaataagccagagtgcttgtatatatcgcattgctttgggcttcgcctgttgtttggttctgtatttccca

SEQ ID NO: 7191 - DNA, 966 bp, Cirsium arvense
cccctcagattcatttcacacaaactcctccatttctacttgtagcctccactttctctctctctatttctctgtgtgtgtgtgtgtgtttcagtgtgtgtaaaatttagagcttctccaatcagtttaagaatatgcaaggaggattaagagcgttcgtatcccacggaagcattgtgaagaatgcggtcctccaacacattcggcttgtgagccctctcgtgcgaccactaactcgtcacgagtcaacttcggctgctcgtattgaagagcacggtttcgaaagcaccactatttcagacgtcttgaaagggaaaggaaagggtgccgatggctcctggctctggtgcaccactgacgataccgtctatgatgccgtccaatcgatgacgcaacacaacgttggtgcgttggttgtggttaaacctggcgagcaatcagccattgccggaattatcacagaaagagattatctgagaaagatcattgtccaaggaagatcatccaaatcaaccaaggttggagatatcatgactgaagagaacaaacttatcactgttacgcccgataccaaagttctgaaagcaatgcagctgatgacagataatcgtatcagacacattccggtgattgacgagaagaaaatgttggggatggtttccatcggagatgtggttcgcgccgtggtgagcgagcacagggaggagctcgaccgtttgaatgcattcatccagggtggctactagaaaatggttggtggaccgtgaagccgggggttatgctggcgggtatgtttcgttcaataacgaggtagttgtgttaggagtttgtaaatattttcacgtttcttccgttgccatcgaggatgttatgtcactcaagagattcgataataacaaacttttaactgttttgtagtgtttttattgctcgttttatattaaaaagaaaaagtaaccgactgcg

SEQ ID NO: 7192 - DNA, 953 bp, Carthamus tinctorius
gcggggggctgctctctcctcctgattcatcatttcacacaaactccatttctgcttctgaactgtgacctccacttttctctttctctctctctctctttctttctctgtgtgtgtgtgtgtttcagtgtgtgtgaaaagaggttctcccaatcagtttaacaacatgcaaggaggattaagagcgttcgtatcacatggaagcattgtgaagaatgcggtcctccaacacgttcggcttgtgagccctctcgtacgaccactaactcgtcacgagtcaacttcggctgctcgtattgaagagcacggtttcgaaagcaccacgatttcagacgtcttgaaaggaaaaggaaaaggtgccgatggctcctggctctggtgcaccactgacgataccgtctatgatgccgtccaatcgatgacgcaacacaacgttggtgcgttggttgtggttaaacctggcgagcaatcatccattgccggaattatcacagaaagagattatctgagaaaaatcattgtccaaggaagatcatccaaatcaaccaaagttggagatatcatgactgaagagaacaaacttatcaccgttacgcctgataccaaagttctgaaagcaatgcagctgatgacagataatcgtatcagacacattccagtgattgacgagaagaaaatgttggggatggtttccataggagacgtggttcgagccgtggtgagtgagcacagggaggagctcgaccgtttgaatgcattcatccagggtggctactagaaaatggttggtgaaccgtgaggcgggggttaagcagactggtatgttccgttcaataacaaggtagtcgtgttaggagtttgtaaatattttcatgtttcttcctttgctatcgaggatgttacgtcactcgagagattcgataataacaaacttttaactgttcgagtgtttt

SEQ ID NO: 7193 - DNA, 968 bp, Lupinus angustifolius
caaaaacaatggataatgtgataatccaaaaagtaatgagggttccagtgtcacgtttatatgacaagttttataagatgccaagaaactgagtcacccattctatccgcaatcctctctctcaatttctcaactctctcagcttcagcttatttttctgacagtcaaaatgctaggaggactgcgagtgtttttatcgcacgggaatgtcataaaaaatgctgttttgcaacaagtccgcatggtgaaccccctattgcagccagttgccttttcacgttttgagtctgttaaatctgctcgcattgaggagcatggttttgagagcaccaccattgcagacattctgaaagggaaaggtaaaggtgcagatggctcttggctttggtgcaccactgatgatactgtttatgatgctgttaaatcgatgactcagaacaatgttggagctttggtggttgtgaaacctggtggtgagcagaagtctattgcaggaattataacagaaagagattatctcaggaagatcatcgtccaaggaagatcatccaagtccaccaaggttggggatattatgactgaagagaacaaacttatcacagtctcaccggatacaaaagttctgagggcaatgcaactgatgactgataacagaatcagacacatccccgtcatcaatgacaaagggatgattggcatggtgtccatcggggatgtggttcgtgctgttgtgagcgagcaccgacaagagcttgaccgcttgaatgcttatatacagggaggttactagatgatgatgatgtcgaaaatctctcatggagcactctagctgagtcggagtatgtaataagcttgagtggttgtaaatatgtttttgcaaactcttgtttgtcttttctgttaattcctaggtttcagtattatggactattaacccttgacatagttcgttaataatgattactgct

SEQ ID NO: 7194 - DNA, 1648 bp, Lupinus angustifolius
tctcaatcaatttcacaaattcatatgtatctatgtatgtatgtatatacaaataagtacacacacccaatgaattctaagacttgagccaagttcttgagcttgataattggacaagagagttattttgatctctttttgcacttgaaactctgaaagttattatatgggaattgttatgatgttggttggtatttatgaaccaattctcagactccatgaatctgggtgttagcagtaccgttcatgtgaaatgctcttacctattgatttcatcctcttttttcttttgatatctatcatatttctccaagcttaatctgaaaagatataaagttgaacagtccacaatttagagtgatccttttacactagaaacagttccacaatttgatccatccattgactttggttttgtaaccatatcagttttgtctgaagagcttgtgctatcttgtttctttcatctaatgaaaattatgcatgtcaagttctttgattaatttaactactagattatttgacttcaaaactactactaaaatgggcttcctagataattggttgatatgaatatacccggttcgcatttataggcttaagcttattggatgcaaggttgcaaactctaagaagtataacctttcttgatattagacagtcaaaatgctaggaggactgcgagtgtttttatcacacgggaatgtcataaaaaatgctgttctgcaacgagtccgcatggtgaacccccttttgcagccagtcgccttttcacgtttcgagtctgttacacctgctcgcattgaggagcatggttttgagagcaccaccattgctgacattctgaaagggaaaggtaaaggtgcagatggctcttggctttggtgcaccactgatgatactgtttacaatgctgttaaatcgatgactcagaacaacgttggagctttggtggttgtgaaacctggtggtgagcagaagtctattgcaggaattataacagaaagagattatctcaggaagatcatcgtacaaggaagatcatccaagtccaccaaggttggggatattatgactgaagagaacaaacttatcacagtctcacctgataccaaagttctgcgggcaatgcaactgatgactgataacagaatcagacacatccccgtcatcaatgacaaagggatgattggcatggtgtccattggggatgtggttcgtgctgtcgtgagcgagcaccgacaagagcttgaccgcttgaatgcttatatacagggaggttactagatgatgatgtcgaaaatctctcatggagcactcaagctgagttggagtatgtaataagcttgagtggttgtaaatatgttttttgcaaactcttgtttgcttctctgttaatttcaggtttcagttctatggacattaacccttgacatagttggttaataatgatagcagatgggtgctgtttgagtatttgttatgttctgttctgttctgaaccttgtttcgctagtacatggatgtttaactttcacagtttgcaaatgatgggttttgtactgaaagttattaatcatgcaaggaaattataaatgaaaatgttgtgtcttaaatatatgaatataactaatgtgttatatttttc

SEQ ID NO: 7195 - DNA, 1019 bp, Malus domestica
atctgaaagcccaagaaaatttgcagctgcctctctctctcctctctcctctccgacaggtaaaatgcaaggagcacttaaagcttttacgtcgcacggaagcattgtgaaaaatggagttttgagacacatccgtcttgtgaatcccctccttcagcctgttgcattttcacgctttgagtctgctacgcctgccagttcccgcatcgaagagcatggttttgaaagcaccagaattgcagatgtcttgaaaggaaaaggtaaaggtgctgatggttcttggctctggtgcacaaccgatgactctgtttatgatgctgttaagtcgatgacccagcacaatgttggagccttagttgttgtgaaacccggagtgcaaaagtctcttgcaggaatcataacagagagagattatctcaggaagatcatagttcagggaagatcatccaagtcaacaaaggttggggatatcatgactgaggagaacaagcttatcactgtcacccctgacaccaaagttttgcgggcaatgcaacttatgacggataaccgaatcaggcacattccagtaatagacaacgggggaatgattggaatggtgtccatcggtgacgtggttcgtgctgtggtgagcgagcaccgggaggagctagaccgcttgaatgcttttattcaaggtggttactagataatgatgatgacgaagacgtgagacgctgttttagttgacatgccggaatgacaagcagaaataagcccgagcgcttgtatgtattgtgtgttcgtttgtgcatctccggttgttgttgttgtttggttctgtacttccaatcactgtctaattacaaacctgtgggactgtcaagtacctaacaataagcagtgtacgttctgtttttgcttaaatcctctctctctggtagatggtagtgcgttttgtatcacgcacgttcacacgttcacgtattcgtgtaagtatagtactaatttttatttctttttcacaagaaaaaggacta

SEQ ID NO: 7196 - DNA, 1590 bp, Ricinus communis
agagacagagagagcgtactatgtgatgtttatccaaaactcaaaaagagtagacaacagtggataaatagtaagtataccaagtaacacagcacacagctaaaagaaacccaaaacccattatcattatcatcatcatcatcatcatcatcatcacacccttcactatcactttgtgtctctcaatttcaacaactagctctagggttccttccttctttccttgttgttcacttgctctgcttcttcttcttcttcttgtaggtcagctttttgtctgttgcttctccaaatcagcagggaacgatgaacagggcagttaatgcatttttgtcccgtggaaatttgatcaagaatgcggttttgcaacatgcccgtgttgttgccaatccaggattgaggcctattgttttctcacgttttgaatctgtttcgtcggctcgaatggaagagcaaagctttgagagcaccacgattgcggacgtcttgaaaggaaaagggaaaagtgctgatggatcttggctttggtgtactactgaagacactgtttatgatgctgttaagtcgatgacccatcacaatgttggagccttggtggttgtgaaacctggtgagcagaagtcaattgcaggaattatcacagagagagattacttgaggaagatcatagtacagggaagatcatccaagtcaactaaggttggggatattatgactgaagagaataagcttatcacagtcactcctgatactaaggttctgcgagcaatgcaactgatgacagataaccgcatcaggcacattccagtcatcaatgataaggacatggttggtatgttgtccattggagatgttgtacgtgctgtggtggctgagcaccgggaggagttggaacgcctgaatgcttacatacaaggaggttattagatgatgacgatgacgacaatgaacaagaggaattgctgctggtgctccttttagaagaccattaagccaagagcctgtaaatgtagtgtgttgtatttgcctcctgttttgtggttcttacctgcttcccgcatcagaatctctgatgtctaataacagcatctggactaacagcttaagaataagcacaatcatgttgtttgagactctttgtctatacaccttagacaaatgcggtcaatgctgcctcatccatggctgcgaacttataaatttccaatgccctttagaaacatttagttttgaagatctttcatggcctccttatgccaatctaaggatagcaaagtgcattttcatgttcattatggcatgtcttttgatggtttatattcttaggtactgcgtttgaaaggtttaaaaaaagtctcctgtttccttcctgggaagtagccataaggggtctgttttcattcaatttgctttttctttgttctttcttcttttcttcaccggtctaattgccaaatgaattctgcattttggatttgtttttaaatttagtaggtcgttttaatttttcaaattttaacaatgtgttttggcattagtttttatttgtctctaatgaaactattaattactaattaaaatttattaatg

SEQ ID NO: 7197 - DNA, 1036 bp, Eschscholzia californica
gagagagagatagagtgggagattactcggagggagaaagggattaggtcatttcatattattcatcacagacacagatcgatcttacccatcaccaaaggcaaaaagacaagtaaaagatatgcaaggagcaattcaagcaatccgatcacatggtaacatttttaagaatgttattctgcaacacgttcgtctcgtcggtcctagtactactcacgctcgacctgctgccgctgctatgttttcatctactcgcttagaagaacatggttttgaaagcacaaccattttggatgttcttaaagctaaaggtaaaaatgctgatggttcttggctgtggtgcactactgatgactccgtttatgatgctgtcaagtcgatgacacagcacaatgttggagccttggttgttgttaagccaggagagcagaagtcccttgctggaattatcaccgaaagagactacctcaggaagataattgtgcagggaagatcatccaagtcgacgaaagttggggacattatgactgaggagaacaagcttataacagtgaccccggacacgaaagtgctgcgggccatgcaactgatgacagataaccgaatcaggcacattccagtcattaacgagaaagagatggtggggatggtgtcaattggagacgtggtccgagcagttgtgagtgagcaccgcgaggaactggatcgcttgaatgccttcatccagggaggttactagactaagaagatgatgatgatgatgacgacgacgacgacgatgatgatgacgactactacagtgatgaatgctgcttgtaaatagtttggttttgttatgcaacaacacttttaactgtatctctctcatgtggttgggcaactgagagtttttctgaataatgacatgactagctagggagacatctcccaaatggaactgtttggttttcttcattggcagatatgattcccttttccctatgaccatcatttattaatagtattagctattattatgattattgatatccttaat

SEQ ID NO: 7198 - DNA, 1105 bp, Eutrema parvulum
atcgaaaaaggttatttatatttgatgattatccattagaaaatccattagaaaatccttcaaactctcctctcaagtctcgtcagctgtctcttgctcatactctagggttcttcagcttccactccgatccgttcttcttctataaagctcagggaaaaaatgcaagctgcgcttcgttccttcgtcgtcggtggaaatgttgtgaaagcttctatgctgcaacatctccgtgtgattaacccggcgattcatccttctgtgttctgttcacgctccgaatccactcagcctgctcgtatggaggagcatggattcgagagcacaaccatctctgatatcatgaacgccaaaggcaaaggtgctgatggatcttggctttggtgtacaactgatgacactgtttacgatgctgttaaatccatgacacaacacaatgttggtgccttggtggttgtgaaacctggtgagcaacaatctcttgctggaatcattacagagagagattatctgcggaagatcatagtgcaaggaagatcttccaaatcaacaaaagtaggagacattatgactgaagagaataagcttattaccgtgacaccagagaccaaggtcttgcgtgctatgcagctgatgacagataacaggatcaggcacattccagtgatcaaagaaaagggtatggtgggaatggtgtccataggagatgtggtccgtgcagtcgtgactgagcatcgagaggagcttaaccgcctaaatgcgtttattcagggaggttactagacgttgaagactaataagaaaagagttgccgttcgttgtgtgtcccagtgcttgatgaatctcgaaagctttaagatcaatgtaaatatggagtcttcgttgttgttgttgttgtctgatgtttgtttgttgttatctgttgtttcattggttaacttgtcaagactgagttcttgtgcatctctgcaagagaataaaaccaaagactccatctctttatggaatattatgatgtttgttttccgctataaagcatgcgtcaagtatcatattgtattaacaaataatgaagtgataattactttgaaaattcggatttggt

SEQ ID NO: 7199 - DNA, 857 bp, Arnica chamissonis
actgctccactctctgtgtgtactactgcgtgtaactgtgtgtgtgatcttctccgatcagttaaggatatgcaaggaggaattagggcatttgtctcacatgggagcattgtgaagaatgctgttctccaacatgttcggctggtgaacccgctaagaccactgattatgtcacgtcatgagtcaactgcggcggctcgtattgaagaacaaggttttgaaagcaccaagatttcagatgttttgaaagcaaagggagaaggtgcagatggctcatggctctggtgcaccactgatgattctgtgtatgatgctgtcaaatcgatgacacaacacaatgttggtgcattggttgttgttaagcctggcgagaaatcgtctattgctggaattatcacagaaagagattatctcaggaaaatcattgttcagggcagatcatcaaagtcaaccaaggttggagatatcatgactgaagagaacaaacttatcacagtaacgcctggaacaaaagttctgaaagcaatgcagctaatgacagataatcgtatcaggcacatcccggtgattgatgagaagggaatgcagggcatggtttccataggagacgtggttcgtgctgtggtaagtgaacacagggaagagctcaaccgtttgaacgcattcatacaaggaggctactaaaaatggttaataaccgtatgcagtggttaaccacaaaggtacgttcctttttaataacaaggtagtcatcttaggagtctgtaaatattttaaacttctttcatgtttcgtacgctgctgtcgaggatgttttgttactcgagagacttgataataacaaaacttgtagatgc

SEQ ID NO: 7200 - DNA, 1028 bp, Vaccinium corymbosum
tctgctctgatactggactttgtgtgaagatctcagatcaggtacaaaatgcaagggggaatccagaaagtgctgtcacatgggggtgtcctaaagaatgcagtcctgcaacacattcgtttggtgaatccagtagcacgcccacttttgtttcctcgctacgagtctgttgcctcagcgcgcatggaagagcatggttttgaaagcaccaccatttcggacatcttgaaagccaaaggtaaaagcgccgatggctcctggctctggtgtgctacagaggacactgtttatgatgctgtgaaatcgatgacgcaacacaatgttggagcattggttgtcgtgaaacctggggagcagaagtcgattgctgggatcatcacggagagagattatctcaggaagatcatagtacagggaagatcgtccaagtctaccaaagtcggagacatcatgactgaagagaacaagctcatcacagtcacacctgacaccaaggttttgaaggcaatgcaactgatgacagacaatcgcatcaggcacatcccagtaattgacgacaaggaaatgataggcatggtgtcaattggagatgtggttcgggcggtggtgagtgagcatagggaggagttggaccgtttgaatgcattcatccacggtggctactagatgatgatgaaaacaatcaaaagctggtacgctgtcggatggtgttttacggttcgcagaccgctgagctgactgcttttgtaaatatagtgtttttctgctaagtgcatcttccaagtgttctgtgcctccatgtgcatgttggattatgcaagaatcagcatgagaactgtgaggttaataataagcacttttctgccaccctgatcatactttggtttcatgatcatgcaatatattagcttgaggataacatggtgtcaacgttttctttgttagccctactttcaaatgctcagccaaactacgatgacaagtgcttatcctacagttcagaatactttctgaaggagagcactgtt

SEQ ID NO: 7201 - DNA, 1058 bp, Cichorium intybus
ggcgggggctgaaagattcatttaaccaaactccccttgtgctcgtgaaagtgtggcctccactttcttctttcactactccagtctgtgtgctactgcgtgtttctgtgtgcgatattctccaatcagttaaaagatatgcaaggaggaattagagcattggtatcacaagggagcattgtgaaacaagcagtcctccaacatgttcgtctagtcaacccgttacgaccacttatgttgtcacgctacgagtcaacttcagctgctcgtattgaagaacacggctttgaaagcaccaccatttcagatatcttgaaaggaaaaggaaaaggtgctgatggttcatggctctggtgcaccactgatgattctgtttatgatgctgtcaaatcgatgacacaacacaatgttggtgcgctggttgtggtcaaacctggcgagcaatcatccattgctggaattattacagaaagagattatctcaggaaaatcattgtgcagggcagatcgtcaaagtcaaccaaggtcggagatatcatgactgaagagaacaaacttatcacagtaaccccggataccaaagttctgaaagcaatgcagctaatgacagataatcgtattaggcatattccggtgattaatgacaaggtgatgctggggatggtgtccattggagatgtggttcgtgctgtggtgagtgaacacagggaggagctgaaccgtctgaatgcattcatacagggtggctactagagatggttaatgaccataagctcttgatggttacgttctgttttaataacgaactagacgtcttaggagtatgtaaatattttcattgtcttttatgtttcttgtgctgttatcgaggatgttatgttgctcgagagatttgagaataacaaaactttttacctgcttcaagcattttactctctacttttatatttcgaatggctagtcccttgttggtgattgttgttttagctctcctacaatcttgtttacatcatcttttttgccactttctactaacggcatatttcttagttttttat

SEQ ID NO: 7202 - DNA, 806 bp, Flaveria ramosissima
tgtgtgtgtgatctttttcgataagttaaaggatatgcaaggaggaattagggcatttgtatcacatgggagcattgtgaagaatgcagttctccaacatgttcggctggtgaacccgctaagaccactgatcatgtcacgccatgagtcaacttcagcggctcgtattgaagaacaaggttttgaaagcacaaagatttcagatgtcttgaaagcaaagggaaaaggtgcagatggctcgtggctctggtgcaccactgatgattctgtgtatgatgctgtcaaatcgatgacgcaacacaacgttggtgcgttggttgtggttaaacctggtgagaaatcgtctattgctggaattatcacagaaagagattatctcaggaaaatcattgttcagggcagatcatcaaagtcaaccaaggttggagatatcatgactgaagagaacaaacttatcacagtaacacccgataccaaagttctaaaagcaatgcagctgatgacagataatcgtatcaggcacattccggtgattgatgagaagggaatgcagggcatggtttctataggagatgtggttcgtgctgtggtgagtgaacacagggaagagctcaaccgtttgaactctttcatacagggcggctactaaaaacggttaataaccgtaagcagcggtttaaccacgacggtatgctcctcttaataacatggtagtcatgttagggtctgtaaatatttgaacttctttcatgtttcgtatgctgctgtcgaggatgtgtggttcctcaagagacttgataataaca

SEQ ID NO: 7203 - DNA, 841 bp, Ipomoea batatas
ctctcaatccatttgcagccaacagataaattccagggaccatagaattcttgcgaacccattcttaattaaaaagcctgtttttctgagcttcattttccccctttttctgtgcttgaacctaagccaagaaagcaaagaagatcactcatcagctaagatgcagagaggatttcaagcactcttttctcaggggaatgtgctcaaggctgctgtcttgagacaaatccgcttgggcaatccagcaatgcggccgctcatgtttgcctgtcgtgagtcgacatcagctgctcgtatcgaagagcatggcttcgagagcaccacgatctctgatgttctgaaatccaagggcgaaggagcagacgggtcgtggctgtggtgcactacagatgacagtgtttatgatgctgtgaagtcgatgactcaccacaacgtaggagccttggtggtggttaaacccggggagcagaagtcaattgccgggattatcactgaaagagattacctcaggaagatcatagtacagggacgatcttcgaaatcaaccaaggtcggggacattatgactgaagagaacaagctcattactgttgcacctcaaaccaaagttttgaaagcaatgcagctaatgacagataaccgtatcaggcacatcccagtcattgatgactcgggaatggtggggatggtgtccattggggacgttgttcgtgctgttgtgactgagcacagggtcgagctggaccgactaaatgcatacatacaaggaggttactaggtgataacgacgataaccccctattacttaataaattaaaccatgagataaatgctctgagcc

SEQ ID NO: 7204 - DNA, 677 bp, Parthenium argentatum
tttttttttttgtactactgtgtgtgttctctctgtgtaacatcttctccactcagttaagggatatgcaaggaggaattagggcatttgtatcaaatggaaacattgtgaagaatgcagttctgcaacatgttcggctagtgaacccgctgagaccgttgttgatatcacgccatgagtcaacctcagcagcgcgtattgaagaacaaggttttgaaagcaccaaaatttcagatgttttgaacgcgaagggaaaaggtgcagatggttcatggctctggtgcaccactgatgattcggtgtatgatgctgtcaaatcgatgacacaacacaatgttggtgctttggttgtggttaaacctggcgagaaatcgtctattgctggaattattaccgaaagagattatctcaggaaaatcattgtgcaaggcagatcgtcaaagtcaaccaaggttggagatatcatgaccgaagagaataaacttattaccgtaacgcctgacaccaaagttctgaaagcaatgcagctaatgacagataatcgcatcaggcacattccagtgattgatgagaaggggatgcaaggcatggtttccataggagacgtggttcgtgctgtggtgagtgaacaccgagaagagctcaaccgtttgaatgcattcatacagggcggctac

SEQ ID NO: 7205 - DNA, 809 bp, Ambrosia trifida
tactactgtgtgtaagtgtgttctctctgtgtaacataacatcttttctccaatcagttaagggatatgcaaggaggaagtcagggcatttgtatcaaacggaagcattgtgaagaatgcagttctgcaacatgttcggcaagtgaacccgctgagaccgttgatgatatcacgctacgagtcaacttccgcagctcgcattgaagaacaagggtttgaaagcaccaagatttcagatgttttgaatgcaaaggggaaaggtgcagatggttcctggctctggtgcaccactgatgactcggtgtacgatgctgtcaaatcgatgacacaacacaatgttggtgctttggttgtggttaaacctggcgaaaagtcgtctattgctggaattattacagaaagagattatctcaggaaaatcattgtgcaagggagatcatcaaagtcaaccaaggttggagatatcatgaccgaagagaacaaacttattaccgtaacgcctgaaaccaaagttctgaaagcaatgcagctaatgacagataatcgtatcaggcacattccagtgatcgatgagaaggggatgcaggggatggtctccataggagacgtggttcgtgctgtggtgagtgaacaccgagaagagctcaaccgtttaaatgcattcatacagggcggctactagaaccgtctgaatgcattcatacagagtggactaactaaaaagggttataaaaaccgcgatcagtggttaaccaggacggtatgtttgggtttcaataatgaggtagtcgttttacgattgtataaat

SEQ ID NO: 7206 - DNA, 988 bp, Flaveria ramosissima
ccgcttgtacaaactcactttctgctcgtctgtgtgtgtgatctttttcgataagggtttgtttgaacctttgtgaatcgtctatctttgagagctgattatggtgatatgatgattgatgattgacggatccaattatgacagacctctaatcctcgaatctctctggttcagtttgatctgattgaagaagatcatttggaaaatctgaaaaacttaaaggatatgcaaggaggaattagggcatttgtatcacatgggagcattgtgaagaatgcagttctccaacatgttcggctggtgaacccgctaagaccactgatgatgtcacgctatgagtcaacttcagcggctcgtattgaagaacaaggttttgaaagcacaaagaatttcagatgtcttgaaagcaaagggaaaaggtgcagatggctcgtggctctggtgcaccactgatgattctgtgtatgatgctgttaaatcgatgacacaacacaacgttggtgcgttggttgtggttaaacctggtgaaaaatcatctgttgctggaattatcacagaaagagattatctcaggaaaatcattgttcagggtcgatcatcaaagtcaaccaaggttggagatatcatgaccgaagagaacaaacttatcacggtaacgcccgacaccaaagttctaaaagcaatgcagctgatgacagataatcgtatcaggcacattccggtgattgatgagaagggaatgcagggcatggtttctataggagacgtggttcgtgctgtggtgagtgaacacagggaagagctcaaccgtttgaactcattcatacagggcggctactaaaaacggttaataacctcataaccataagcagtggtttaaccacgacggtatggtcctcttaataacaaggtagtcatgttaggatctgtaaatatttgaacttctttcctgtttcgtatgctgatgttgaggatgtgtggttcctcg

SEQ ID NO: 7207 - DNA, 710 bp, Guizotia abyssinica
gtactcgtgacagtgttaaatcactactccacagccactctctctctctgtgatcttcttcatcttctccaatcagtttaaggatatgcaaggaggaattagggcatttgtatcacgaggaagcattgttaagaatgcagttctgcagcatgttcgactagtgaacccactcaagccgttgatgatatcgcgccatgagtcaactgcagcagctcgtattgaagaacaaggttttgaaagcaccaaaatttcagatgtcttgaaagcaaaggggaaaggtgcagacggctcatggctctggtgcaccactgatgattctgtgtatgatgctgtcaaatcgatgacacaacacaatgttggtgctttggttgtggttaaaccgggcgagaaatcgtcaattgctggaattatcacagaaagagattatcttaggaaaatcatcgtgcagggcagatcatcgaagtcaactaaggttggagatattatgactgaagagaacaaacttattactgtaacgcctgaaaccaaagttctgaaagcaatgcagctaatgacagataaccgtatcaggcacattccagtgatcgatgaaaagggaatgcagggcatggtttccataggagatgtggttcgtgctgtggtgagtgaacacagagaagagctcaacgtttgaacgcattctacagggcggctactaaactggttagtaa

SEQ ID NO: 7208 - DNA, 1060 bp, Carpinus betulus
ctcaggtacgctttttccattttctttgtcttttattgtgatttgtgagagttgttccgcctatgtttctcgacttttaagactatcaatcttctctgggctcggtgctgcatatatcctacgcagtgtctctctgcctttctacggttctccctctcttcttcggcgccgcgcgacgctacacaggcttcggcgctacaattctctctctaggctacggcactctctgtctccggaaaaatgcaaggagctcttcagtcctttttatcgcctggaagcatcgtaaaaaattcagttttgcaacacttccgtttggtgaatcccctgatgcgatctgttttattttcacgcttcgagtcagttacatctgcccgaatggaagagcatggttttgaaagcactacgattgcggatgtcttgaaagcaaaaggtaaagtgctgatggctcttggctctggtgcactatggatgatacagtttacgatgcggttaagtcgatgacacataacaatgttggtgccttggtggtggtgaaacctggagagcagaaatcaattgccggaatcatcacggaaagggattacctgaggaaaatcatagtacagggaagatcatccaagtcaaccaaggttggggatatcatgactgaagagaacaagcttatcacagtcacacctgacacaaaagttttgcgggcaatgcaactgatgacagataaccgaatcaggcacatccccatcattgatggaaaggggatgatcggcatggtgtccataggagatgtggtccgtgctgtagtgagcgagcatcgggaggagctagaccgcttgaatgcttatattcaaggaggttactagacgatgatgatggcaatggtggtaccgctctcgcgttggctttgtcaaatgctacctgctccttgagcactaataagcttaagtacctttagtaatgtggtgtgccgtgtgctatttctgttttctggctctttatgtttcagatgtggatgtacggataccaaagaccagcttaaggtctacaagataataataagcactgg

SEQ ID NO: 7209 - DNA, 1179 bp, Centaurea maculosa
taccattcggatgagttctaggcaaagaaaacgctttatatcgcgtctgaggccttcaggtaagtctttgatcatctccatctcgtcgtcacctcccatgaccgcccaattttggcgttcgtaggtacggactctttgtctgagaagcgatggtaactgcctcctcagattcatttcacacaaactcctccatttctacttgtaaactgtggcctccactttctctctctctatttctctgtgtgtgtgtgtttcagtgtgtgtgaaattaagagcttctctccaatcagtttaagaatatgcaaggaggattaagagcgttcgtatcccatggaagcattgtgaagaatgcggtcctccaacacgttcggcttgtgagccctctcgtgcgaccactaactcgtcatgagtcaacttcggctgctcgtattgaagagcacggtttcgaaagcaccacgatttcagacatcttgaaaggaaaaggaaaaggtgccgatggctcttggctctggtgcaccactgacgataccgtctatgatgccgtccaatcgatgacgcaacacaacgttggtgcgttggttgtggttaaacctggcgagcaatcatccattgccggaattatcacagaaagagattatctgagaaaaatcattgtccaaggaagatcatccaaatcaaccaaggtcggagatatcatgacggaagagaacaagcttatcaccgttacgcccgataccaaagttctgaaagcaatgcagctaatgacagataatcgtatcagacacattccggtgattgacgagaagaaaatgttggggatggtttccataggagacgtggttcgagccgtggtgagtgagcacagggaggagctcgaccgtttgaatgcattcatccagggtggctactagaaaatggttggtgaaccgtgagccgggggttatgctggcgggtatgtttcgttcaataacgaggtagttgtgttaggagtttgtaaatattttcacgtttcttccgttgccatcgaggatgttatgtcactcaagagattcgataataacaaacttttaactgttttgagtgttttatgctcgttttatattacgaaataattgttctcatgttgacgatgacttataccgttgtgttgaacatatgaatacatggccaacttgttcg

SEQ ID NO: 7210 - DNA, 893 bp, Centaurea maculosa
ctcagattcatttcactataaactcctctacttcctacttctcaactgtggcctccactttctctctctatttctctctatttttgtgtgtgtttcagtgtgtgtgaaaaagcttctccaatcagtttaagaatatgcaaggaggattaagagccttcgtatcccacgggagcattgtgaagaatgcggtcctccaacacgttcggcttgtgagccctctcgtgcgaccgctaactcgtcacgagtcaacttcggctgctcgtattgaagagcacggtttcgaaagcaccacgatttcagacgtcttgaaaggaaaaggaaaaggtgccgatggctcctggctctggtgcaccactgacgataccgtctatgatgccgtccaatcgatgactcaacacaacgttggtgcgctggttgtggttaaacctggggagcaatcatccattgccggaattatcacagaaagagattatcttagaaaaatcattgtccaaggaagatcatccaaatcaaccaaggttggagatatcatgactgaagagaacaaacttatcactgttacgcccgataccaaagttctgaaagctatgcagctaatgacagataatcgtatcagacacattccggtgatcgacgagaagaaaatgttggggatggtttccatcggggacgtggttcgagccgtggtgagcgagcacagggaggagctcaaccgtttgaatgcattcatccagggtggctactagaaatggtggtgaaccgtgtgcgggggttatgctgtcgggtatgtttcgttcaataacgaggtagtcatgttaggagtttgtaaatattttcacgtttcttccgttgccgtcgaggatgttatgtcactcgagagattcgataataac

SEQ ID NO: 7211 - DNA, 1136 bp, Artemisia annua
ctttgtgaatgttcatgtgtttgtttcaagtgttgatgaacaatgttgtgcttcgtttgatttaaaagcaagtggataaaaagggaagtggataaacatggtaccccaaatgtcgttttccaaccgttgaagtgtcatagtttcgtaaacactattaaaagagtaaggatcacctctatactctcctctcctctcctctgtgtgtctgtatgatcatagaccttcttcagcctaactaatattaatcaggtaaaaatgcaaagaggaattggagctttcgtatcacatggaagcattgtgaagaatgctgttctccaacacattcgtttggtgaatcctcttgcaagggttctcgtgaggcatgagtcgacttcagccgctcgtatggaagagcatggctttgaaagcgctaaaatttcagacattttaaaaggcaaggggaaaagtgctgatggctcgtggctttggtgcacaactgaggattccgtgtatgatgccgtcaaatcaatgacacaacacaatgttggggcgttggtggtggtgaaaccaggagaggagaagtccattgctggaattatcacagaaagagattatcttagaaaaatcattgttcaaggaagatcatccaagtcaactaaggttggagatatcatgactgaagagaacaagcttatcacagtcactccagataccaaagtcctaaaagcgatgcagttaatgacagataatcgtatcagacacattccggtgattgatgaaaagggcatgctggggatggtttccattggagatgtggttcgtgcagttgtaagtgagcacagggaagaactcgaccgtctgaatgccttcatacaaggaggctactagaaaccatgtatgatgatgacgataagttgctactttgtaacatggtaacgttacaaatttgcagatatgtttgtagactctgcttcaacagttgtgtaatgctgtgtcgcttgcacagttgataataaaaagcttgaaggtttatgtgtttctttagggtcatggacaaaacggaccatgcccttgtgacacggaacactttttttgtctaatattattatttggttttctgttaccaaaaatatttagtgctaattgtgatatagttt

SEQ ID NO: 7212 - DNA, 1025 bp, Centaurea maculosa
  misc_feature (211)..(211): n is a, c, g, or t
  misc_feature (235)..(235): n is a, c, g, or t
  misc_feature (640)..(640): n is a, c, g, or t
  misc_feature (948)..(950): n is a, c, g, or t
  misc_feature (952)..(952): n is a, c, g, or t
  misc_feature (954)..(954): n is a, c, g, or t
  misc_feature (959)..(960): n is a, c, g, or t
  misc_feature (963)..(966): n is a, c, g, or t
  misc_feature (969)..(970): n is a, c, g, or t
  misc_feature (973)..(973): n is a, c, g, or t
ttcggtccggattcccgggatgctgcctcctctctcagattcatttccataaactccatttcctacttctcaactgtggcctccactttctctctctatttctctctattcctgtgtgtgtgtgtgtgtgtgtgtgtttcagtgtgtgtgaaaaagcttctccaatcagtttaagaatatgcaaggaggattaagagcgttcgtatcccanggaagcattgtgaagaatgcggtnctccaacacgttcggcttgtgagccctctcgtgcgaccgctaactcgtcacgagtcaacttcggctgctcgtattgaagagcacggtttcgaaagcaccacgatttcagacgtcttgaaaggaaaaggaaaaggtgccgatggctcctggctctggtgcaccactgacgataccgtctatgatgccgtccaatcgatgactcaacacaacgttggtgcgctggttgtggttaaacctggggagcaatcatccattgccggaattatcacagaaagagattatctgagaaaaatcattgtccaaggaagatcatccaaatcaaccaaggttggagatatcatgactgaagagaacaaacttatcactgttacgcccgataccaaagttctgaaagctatgcagctnatgacagataatcgtatcagacacattccggtgatcgacgagaagaaaatgttggggatggtttccatcggggacgtggttcgagccgtggtgagcgagcacagggaggagctcaaccgtttgaatgcattcatccagggtggctactagaaaatggttggtgaaccgtgtgcggggggttatgctggcgggtatgtttcgttcaataacgaggtagtcatgttaggagtttgtaaatattttcacgtttcttccgttgccatcgaggatgttatgtcactcgagagattcgataataacaaactttnnnantnttcgnnatnnnntgnncgntatactgagtcctaggtcataaacgagctgctctacctcgatggaagctacg

SEQ ID NO: 7213 - DNA, 929 bp, Eschscholzia californica
agagagagatagagtgggagattactcggagggagaaagggattaggtcatttcatattattcatcacagacacagatcgatcttacccatcaccaaaggcaaaaagtcaagaaaaagatatgcaaggagcaattcaagcaatccgatcacatggtaacatttttaagaatgttattctgcaacacgtccgtctagtcggtcctagtactactcatgctcgacctactgctgctgctgctgctatgttttcatctactcgcttagaagaacatggtttcgaaagcacgaccattttggatgttcttaaagctaaaggtaaaaatgctgatggttcttggctctggtgcactacggatgactccgtttatgatgctgtcaagtcgatgacacagcacaatgttggagccttggttgttgttaagccaggagagcaaaagtcccttgctggaattatcactgaaagagactacctcaggaagataattgtgcagggaagatcatccaagtcgacgaaagttggggacattatgactgaggagaacaagcttataacagtgaccccggacacgaaagtgctgcgggccatgcaactgatgacagataaccgaatcaggcacattccagtcattaacgagaaagagatggtggggatggtgtcaattggagacgtggtccgagcagttgtgagtgagcaccgcgaggaactggatcgcttgaatgccttcatccagggaggttactagactaagaagatgatgatgatgatgacgacgacgacgacgatgacgacgactactacagtgatgaatgctgcttgtaaatagtttggtttgttatgcaacaacacttttaactgtatctctctcatgtggttgggcaactgagagtttttctgaataatgacatgactagctagggagacatctcc

SEQ ID NO: 7214 - DNA, 1124 bp, Lactuca sativa
aaataataaagcgctatcctttcattttaagtgtatttgaaggtgaaggtgcaggtgcatggaaatatatgtgcggataagatgcagggtaacatagccttggcttttctataaaaactaccaaatggataaacctcaggctgcctgaatagattcatttaactaaaactcaccttctgcttctgcccgtgaaagtgtggcctccaccttcttctttcactactcgagtctgtgtgctactgtgtgtctctgtgtgtgatcttctccaatcagttaaaaagaggatatgcaaggaggaatcagatccttggtgtcacatggaagccttgtgaaacaagcagtcctccaacatgttcgtgtgatgaaggtgaacccccttcaatcacttatgttgtcacgccatgagtcaacttcagctgctcctcgtatggaagaacatggctttgaaagcaccaccatttctgatatcttgaaaggaaaaggaaaaggtgctgatggctcatggctctggtgcaccactgatgattctgtttatgatgctgtcaaatcgatgacacaacacaatgttggtgcattggttgtggtcaaacctggggaacaatcatccattgctggaattattacagaaagagattatctgaggaaaatcattgttcagggaagatcttcaaagtcaactaaggtcggagatatcatgactgaagagaacaaacttatcacagtaactccagataccaaagttctgaaagcaatgcagctaatgacagataatcgtatcagacacattcctgtgattagtgagaaggagatgctggggatggtgtcgattggggatgtggttcgtgctgtggtgagtgaacacagggaggagctcaaccgtctgaatgcattcatacagggtggctactaaagaaagaaaatgcatatcatcatttatttataagaagctgctggagttgaccacatcagatggttgcaccttttgtgtgtttgtgctttaataacatcttaggagtctgtagatatttttaaaacgtttttttttatggttcttgtactgttatcgacgatgttatgttgctcgatagacttgataataacaaaactttttgatgcttcaacca

SEQ ID NO: 7215 - DNA, 1073 bp, Cucurbita pepo
gagtacggacggggggaaacgaaagtagtgtaccaaaagaaaaagaaaaacgaaagaatcgagagataaaatcgggtctaacagttccatatccgtgagcttttccttccaataggtttcgttatctgtacctcactaagccgtcactctttttggttctccacttccttcgtgaatcgagaggttttcttccggatcttcatcaggtgaagatgcaaggtgctgtgcgatcatttctatcacatggaaacattgtgaaaactgctgttctgcaacaacttcgtgtagcaaacccctgtatgaggcctgcaatgctttcacgctttacaacatcaacaagttccgcaaacattgaagagcatggctttgaaagcactacgattgatgacatcttgaaagcaaaaggcaaaagtgctgacggatcatggctttggtgcaccacagatgacacagtttatgatgccgttcagtcgatgacccagcacaatgttggagccttggtggttgttaaacctgcggagcaaaattcaatagctggtattataacagagagagattatctgagaaagattatagtgcaaggcaggtcctccaagtctaccaaagttggggatatcatgactgaggagaacaaacttatcactgtgacacctgacaccaaggttttgcgagctatgcaacttatgactgataatcgaattaggcacataccggtcatcgatgacaagggtatgaaaggcatggtatcgattggagacgtggttcgggctgtggtgagcgagcaccgggaggagctaaaccgcctgaatgctttcattcagggaggttattgaattgctgctaatgactttgctttgcttgcttgtttgctttgtgatgtttggaaaaccagatggcttcagctcttgtacatatggcctggtatgcgcacactctcttattatatggttgtgcttaatgtttctgatacaataacggaccgacgatgtattaatagacggttactttcctctgcgaaatttcgccctaattttcaaacttcaatgatgatatctaaagtctcccttgagttt

SEQ ID NO: 7216 - DNA, 1162 bp, Cucurbita pepo
gtagactaaggaagaatgacaaaaacatggggagcggtgaagaggtccgaaaaacaaaaagaaagagagataaaatcgggtctcacagttttatgaccttctccttccgttaggtttcattatccgaacctcacttcgccattactctttacttctcaacttccttgaaaccagagattttcttgtggatcttcttcatcaggtaaagatgcaaggtgctgtgcgatcatttctatcacacggaaacgttgtgaaaactgctgttctgcaacaaattcgtctagcaaacccccagatgaggcctgcaatgttttcatgctttacgacatcagctaattctgcaaacattgaagaacatggctttgaaagcactactattgatgacatcttgaaagcaaaaggcaaaagtgctgacggatcatggctttggtgcactacagatgacacagtttatgatgccgtccagtcgatgactcagcacaatgttggagccttggtggttgttaagcctgcggagcaaaattcaattgctggtattataacagaaagagattatctgagaaagattatagtgcaaggcaggtcttccaagtctaccaaagttggggatatcatgactgaggagaacaaacttatcactgtgacacccgacaccaaggttttgcgagccatgcaacttatgactgataaccgaattaggcacatacccgtcatcgacgacaagggtatgaaaggcatggtgtcgatcggagacgtggttcgggctgtggtgagcgagcaccgagaggagctaaaccgcctgaacgcttttattcagggaggttattgagttgctgctattgacattgcttgcttgcttgctgctggtatgatgtttggaaaaaccagaacggttcagctcttgtaaatatagcctggtatgtgcactctcatgttgtttggtttgtgctcaatgattctggtacaataatcagtgtctggacctattatgtaataattgacgccaactttgctttcctaatttcctccctaagctacatttctttttatggagatgacaaaattctcccgacgtggcgactcaccctgaatgaagcaatcaatttctgcttcggacaggttcgaggattttattattattataatttgacttcgggatttt

SEQ ID NO: 7217 - DNA, 1022 bp, Momordica charantia
agttttgatgcttctcctttctttaggtctcattatctgaagctgacttcgccgccacttttttctctcactgattttctgtggatctccaccaggtattcatcttcttctcgccatttcctctgatctcaatctcatcgttttcctccgatcaaccctcaactccggcaggtaaagatgcaaggtgctctgcgatcatttctttcaaatggaagcattgtgaaaaatgcagttcttcaacaaattcgtgtcgcaagcccgcacatgaggcctgcaatcgtttcacgctttgcatcatcagctagttctgcaagcattgaagagcatggctttgaaagcactactattgatgacatcttgaaagcgaaaggtaaaggtgccgatggatcatggctttggtgcaccacagatgacacagtttatgatgctgtccagtcgatgacccagcacaatgttggagccttggtagttgttaaacccggggccaaaattcaatagctggtataataacagagagagattatctaagaaagattatagtgcaaggaaggtcctccaagtctaccaaagttggggatatcatgactgaggagaacaaacttatcactgtgacacccgacaccaaggttttgcgagctatgcaacttatgactgataaccgaatcaggcacatacccgtcatcgacgacaagggtatgaaaggcatggtgtcaattggagacgtggttcgggctgtggtgagcgagcaccgggaggagcttgaccgcctgaatgcctttattcagggaggttattgagtttggttggtgtatgatgtttcccaaaaccagaatgcttgggctcttgtacataatggcctggtatgtgcactctcctgttgtatggttgtgcttaatgttttctggtacaataaccgttattggactgatgatgtaataatagacggcaactttgctctgaaaatttcaccctaagttgcattttctttgatcgagatgacgaaaatccccctcaagttgcag

SEQ ID NO: 7218 - DNA, 1288 bp, Panax ginseng
ggcagtctcagaagcagtggtatcaacgcagagtacgcggggagggggaacaacacccaatacataaatatatttaatgttatttattaatagctggagtactggatgaacctgaaaagtagatctgccgcccttaatctctcttttttagcctccttctaagctggtgctgctggacgtggtagtggtagtggtagtggtagtgtgatttcctcactcacgagagatctctgatcagaatagctgctatgcaaggaggatttcgagcaatcctgtcaaatgggagtattctcaagaatgcagttttggagcgggttcgtttggtgaatccagtaatgcggcctcttctattttcacgccatgagtcggtttcatctgctcgtatcgaagagcatgggtttgaaagcaccacaatttcggacatcttgaaaggcaaaggaaaaagtgctgatggctcctggctctggtgcaccactgatgattctgtttatgatgctgtgaagtcgatgactcagcacaatgttggagccttggtagttgtgaaacctggggagcaaaaggcaattgccggaattatcacagaaagagattatctcaggaaaatcatagtacagggaagatcttccaagtcaacaaaggttggggatattatgactgaagagaacaagcttatcactgtttcaccggccaccaaagttctgaaagcaatgcaactaatgacagataaccgcatcaggcacattccagttgtcgatgacaagggaatgataggcatggtatccattggagacgtggttcgtgctgtggtgagtgagcatcgggatgagcttaaccgcttgaatgcatttattcagggaggttactagatgatgatgggccaatggcaatgatgatgttgactataagttgttgctaagttgctcagataatactttctgtttatgaatcagtaagcttgatccttgtaaatatttgtttactgtgttatgcttcctcaagatgttatccctgaagcagcttatgaaccgagactcaaacagaggttaataataagcactcagaagctacttgcaacttgtctcttcatattgatgcagattttgagcaactctgctcttaattctgtaaagtacacgagtaatacccattatcattcggttcggtttgctgttattctactttttttgaaaactatgatggccatgacaattttgaaagccatccactctcatcttcgagtaagaatcatgggacggattaaagttttggttgatttttagcatatatt

SEQ ID NO: 7219 - DNA, 1115 bp, Panax ginseng
aagcagtggtatcaacgcagagtacatggggactggatgaacctgaaaagtagacctgccgcccttaatctctcttttttagcctccttctaagctggtgctgctggacgtggtagtggtagtggtagtggtagtggtagtggtagtgtgatttcctcactcacgagagatctctgatcagctgctatgcaaggaggatttcgagcaatcctgtcaaatgggagtattctcaagaatgcagttttggagcgggttcgtttggtgaatccagtaatgcggcctcttctattttcacgccatgagtcggtttcatctgctcgtatcgaagagcatgggtttgaaagcaccacaatttcggacatcttgaaaggcaaaggaaaaagtgctgatggctcctggctctggtgcaccactgatgattctgtttatgatgctgtgaagtcgatgactcagcacaatgttggagccttggtagttgtgaaacctggggagcaaaaggcaattgccggaattatcacagaaagagattatctcaggaaaatcatagtacagggaagatcttccaagtcaacaaaggttggggatattatgactgaagagaacaagcttatcactgtttcaccggccaccaaagttctgaaagcaatgcaactaatgacagataaccgcatcaggcatattccagttgtcgatgacaagggaatgataggcatggtatccattggagacgtggttcgtgctgtggtgagtgagcatcgggatgagcttaaccgcttgaatgcatttattcagggaggttactagatgatgatgggccaatggcaatgatgaggttgactataagttgcttagataatggactacttgctgtttatgaatcagtaagcttgatccttgtaaatatttgtttactgttatgcttcctcaagatgttatccctgaagcagcttatgaaccgagactcgaacagaggttaataataagcactaagaagctacttgcaacttgtctcttcatattgatgcagattttgagcaactctgctcttaattctgtaaagtacacgagtaatacccattatcattcggttcggtttgctgttattctactttttt

SEQ ID NO: 7220 - DNA, 1016 bp, Panax ginseng
aaagcagtggtatcaacgcagagtacatggggactggatgaacctgaaaagtagacctgccgcccttaatctctcttttttagcctccttctaagctggtgctgctggacgtggtagtggtagtggtagtggtagtggtagtagtagtgtgatttcctcactcacgagagatctctgatcagaatagctgctatgcaaggaggatttcgagcaatcctgtcaaatgggagtattctcaagaatgcagttttggagcgggttcgtttggtgaatccagtcatgcggcctcttctattttcacgccatgagtcggtttcatctgctcgtatcgaagagcatgggtttgaaagcaccacaatttcggacatcttgaaaggcaaaggaaaaagtgctgatggctcctggctctggtgcaccactgatgattctgtttatgatgctgtgaagtcgatgactcagcacaatgttggagccttggtagttgtgaaacctggggagcaaaaggcaattgccggaattatcacagaaagagattatctcaggaaaatcatagtacagggaagatcttccaagtcaacaaaggttggggatattatgactgaagagaacaagcttatcactgtttcaccggccaccaaagttctgaaagcaatgcaactaatgacagataaccgcatcaggcacattccagttgtcgatgacaagggaatgataggcatggtatccattggagacgtggttcgtgctgtggtgagtgagcatcgggatgagcttaaccgcttgaatgcatttattcagggaggttactagatgatgatgggccaatggcaatgatgatgttgactataagttgttgctaagttgctcagataatactttctgtttatgaatcagtaagcttgatccttgtaaatatttgtttactgtgttatgcttcctcaagatgttatccctgaagcagcttatgaaccgagactcaaacagaggttaataataagcactcagaagctacttgc

SEQ ID NO: 7221 - DNA, 1118 bp, Panax ginseng
aaccccaaccccataaaaaatgacccaatacatgaatatatttaattttatttattaatagctggagtggatgaacctgaaaagtagacctgccgcccttgatctctcttttttaaagctggtgctgctggtagtggtagtggttgtggtagactggtagtggtggtagtggtgtgatttcctcactcacgagagatctctgatcagaatagctgctatgcaaggaggatttcgagcaatcctgtcaaatgggagtatcctcaagaatgcagttttgcagcgggttcgtttggtgaatccagtcatgcggcctcttctattttcacgccatgagtcggtttcatctgctcgtattgaagagcatgggtttgaaagcaccacaatttcggacatcttgaaaggcaaaggaaaaagtgctgatggctcctggctctggtgcaccactgatgattctgtttatgatgctgtgaagtcgatgactcagcacaatgttggagccttggtagttgtgaaacctggggagcaaaaggcaattgccggaattatcacagaaagagattatctcaggaaaatcatagtacagggaagatcttccaagtcaacaaaggttggggatattatgactgaagagaacaagcttatcactgtttcaccggccaccaaagttctgaaagcaatgcaactaatgacagataaccgcatcaggcatattccagttgtcgatgacaagggaatgataggcatggtatccattggagacgtggttcgtgctgtggtgagtgagcatcgggatgagcttaaccgcttgaatgcatttattcagggaggttactagatgatgatgggccaatggcaatgatgaggttgactataagttgcttagataatggactacttgctgtttatgaatcagtaagcttgatccttgtaaatatttgtttactgttatgcttcctcaagatgttatccctgaagcagcttatgaaccgagactcgaacagaggttaataataagcactaagaagctacttgcaacttgtctcttcatattgatatgcagattttgagcaactctgctcttaaatctgtaaagtacacgagtaatacccattattatt

SEQ ID NO: 7222 - DNA, 1169 bp, Panax ginseng
aagcagtggtatcaacgcagagtacatggggggagtggatgaacctgaaaagtagacctgccgcccttaatctctcttttttagcctccttctaagctggtgctgctggtagtggtagtggtagactggtagtggtggtaggggtgtgatttactcactcacgagagatctctgatcagctgctatgcaaggaggatttcgagcaatcctgtcaaatgggagtatcctcaagaatgcagttttgcagcgggttcgtttggtgaatccagtcatgcggcctcttctattttcacgccatgagtcggtttcatctgctcgtatcgaagagcatgggtttgaaagcaccacaatttcggacatcttgaaaggcaaaggaaaaagtgctgatggctcctggctctggtgcaccactgatgattctgtttatgatgctgtgaagtcgatgactcagcacaatgttggagccttggtagttgtgaaacctggggagcaaaaggcaattgccggaattatcacagaaagagattatctcaggaaaatcatagtacagggaagatcttccaagtcaacaaaggttggggatattatgactgaagagaacaagcttatcactgtttcaccggccaccaaagttctgaaagcaatgcaactaatgacagataaccgcatcaggcacattccagttgtcgatgacaagggaatgataggcatggtatccattggagacgtggttcgtgctgtggtgagtgagcatcgggatgagcttaaccgcttgaatgcatttattcagggaggttactagatgatgatgggccaatggcaatgatgatgttgactataagttgttgctaagttgctcagataatactttctgtttatgaatcagtaagcttgatccttgtaaatatttgtttactgtgttatgcttcctcaagatgttatccctgaagcagcttatgaaccgagactcaaacagaggttaataataagcactcagaagctacttgcaacttgtctcttcatattgatgcagattttgagcaactctgctcttaattctgtaaagtacacgagtaatacccattatcattcggttcggtttgctgttattcttacttttttttttttactcgaagatgagagtggatggctttcaaaattgtcatggc

SEQ ID NO: 7223 - DNA, 979 bp, Acacia harpophylla
gttggggtattatagcctacaactgaagtgccatcttgcttcttcatcactcgctagggtctcagccgtttccactccttccttacttcgccgcctcaccggcccctttctcaacgctgcaatctctctcacagagttgaaatgcaaggcggactgcgatcgtttttgtcacatggtagtgtcattaaaaattctgttctgcaacgagttcgcatggtgaatcccctgttgcagccggttaccttttcacggtttgagtctgcttcgcctgctcgtatggaggagcatggttttgaaagcaccacgattgcagacatcttgaaatcaaaaggcaaaggtgctgatggctcctggctttggtgcactactggcgacactgtttatgatgctgttaaatcgatgactcaacacaatgttggagcgttggttgtcgtgaaacctggagaggaaaaggcaattgccggaattataacagaaagagattacctcaggaagatcattgtgcagggcagatcatccaaatccaccaaggttggggatatcatgactgaggagaacaagcttatcacagtcacacctgataccaaagttctgcgagcaatgcaactgatgacagataatagaatcagacacattcctgtgattaacgataaagggatgatgggcatggtatccattggggacgtggttcgtgcagtggtgagcgagcatcggcaagagcttgaccgtttgaatgcttttatccaaggaggatactagatgatgatgaaaagttgaaactttgtggagcacttaaaatctaacttataattatctgtaataagtttgggtgctttgtaaatatgctgttgatgtgtccttttgctttgagagccatcttgtttgtttccttgcaagtttctaatgtcaggtttcagacaccctcttcttaagaaccatgctactaataacaacttgaatttctcctcaaaaaaaaaaa

SEQ ID NO: 7224 - DNA, 1214 bp, Coffea canephora
cgagccgggggaagataccaaacaaaggaataaattaactgaaatagtactgctttgcagtgcatactacaagttgctggataaactttgggagtgctgttatctgagggagagacagagaaaaagaaaggccatcccttgtaacttgaactctgctttactccaacaccaccgccaccaccggcagctgcagtactgagccttttcagataaagaaaatatctttttttctcggcaaaatgcaaggagggattcatgccattgtctcgcacgggaatatccttaggaatgctattctgcagcatgttcgtgtagtcagtccagtaatgcggtcacttgtgtttgcaagacacgagtcaacttcagctgctcaaatggaggagcatggttttgaaagtaccaaaatatcagatgttttaaaagccaaggggaaaggtgcggatggctcctggctctggtgtaccacagatgacactgtttatgatgcagtgaagtcgatgacgaaccacaatgttggagccttagtggtagtaaagcctaaagagcaaaatgcaatcgctggcatcatcacagagagagactatctcaggaaaatcatagtacagggaagatcgtccaaatcaacaaaagttggtgatatcatgactgaagagaacaagcttattactgtcacacctgacaccaaggtcttgaaagcaatgcagttgatgactgataaccgcatcaggcacattccggtggttgataataaagggatggtaggcatggtgtctattggagacgtggttcgtgctgtagtgagtgagcaccgggatgaattggaccgcttaaatgcttatattcaaggaggatattagaagaagaagatgatgatgatgatgatgacgacaacgacgaggaggaggagtcgagagtgcggaagggttgtaaatattctcttgtatgcatcgctttagcctgcgatttacctgcaagatgcagcctatggcttgattaggtttccaataatagcatggactctgaagccgcttgcacctgttttccgttgtttgtagcctttgcatttgctgctctttggtaacttcaaaataataagtttgacagttatctttgttagtcggatgtgccaggaagcaaggctggtaaagcatttactcttttacatataacattgcaagagaaagcttcaggctttgaatcgggcttaggctatc

SEQ ID NO: 7225 - DNA, 725 bp, Flaveria ramosissima
gtgtttcactgtgtgtgatcttctcaaaatcagttaaaggatatgcaaggaggacttagggcatttgtatcacatggaagcattgtgaggaatgcagttctgcagcacgttcggctggtgaaccctctcagaccgttgatcatatcacgtcatgaggcaacttcagcagctcgtattgaagaacaaggttttgaaagcaccaagattgcagatgtcttgaaagcaaaggggaaaggtgcagatggctcatggctctggtgcaccactgatgattccgtgtatgatgctgtcaaatcgatgacacaacacaatgttggtgctttggttgtggttaaacctggcgagaaatcgtctattgctggaatcatcacagaaagagattatctcaggaaaatcattgtgcagggcagatcatcaaagtcgactaaggttggagatatcatgacggaagagaacaaactgattaccgtgacgcctgataccaaagttctgaaagcaatgcagctaatgacagataatcgtatcaggcacattccagtaatcgacgacaaaggaatgcagggcatggtttccataggagacgtggttcgtgctgtggtgagtgagcacagagaagagctcaaccgcttgaatgcattcatacagggcggctactaaatccggttactgaaccgcaatcaatgttaaccagaagtggtatgttcgacttcaataacaagctagtc

SEQ ID NO: 7226 - DNA, 929 bp, Humulus lupulus
ttggctgtacacatttttcagtgattttttctttagggttccttatctttatccatagccgaaattaacttctgcttcttcttcttctccactcaggtaacaatgcaaggagttattcgaggatttttgtccaatggaaatgttgtgaaaaatgcagttttgcaacgtatatctcttgtgaatccagtgttgcagcctgccatcctttcacgttttcagtcgactacaactgctcgtatagaagagcatggttttgaaagcacaactatttcagatatcatgaaatcgaagggtaaaggtgctgatggttcttggctatggtgcactacagatgacagtgtttatgaggctgttaagtcgatgactcaacacaatgttggtgccctggtggtcgtgaaacccggagaggaaaagtcaattgctggaattataacagaaagagattatctgcggaagatcatagtgcagggaagatcatccaagtccactaaggtcggggatatcatgactgaagagaacaagcttatcactgtcaatccttccaccaaagttttgcgtgcaatgcaactgatgactgataatcggatcaggcacattccagtggttgatgacaagggaatgattggcatggtgtccattggagatgtggtacgagctgtggtgagtgaacataggcaggagcttgaccggttgaatgcttttattcagggaggttactagatgatgatgacgactacgacgatgatgatgacaaagatcagacactcttcggttgccctggttgaacaatgaataataatagggccggctgcttgtaaataccctttgctctttgcgactccttttgtgttcttttttttttcgatgttcatatgctatgacatcaaaacaccaacgagcgaactaacatggttaataacgaaaactta

SEQ ID NO: 7227 - DNA, 616 bp, Platanus occidentalis
ggtaagatgcaaggagcagttcaagcaattcattcacatgggaacattctcaaacgtgcagttctacaacacgtccgtctgttgaatccagtcttgcagcctgctttattttcgcgctttgcgtcagtttcctctcctcgattggaagagcatggttttgaaagcaccactattgtagacattctgaaagccaaaggtaaaagtgctgatgggtcctggctttggtgcatgacagacgatactgtttatgatgctgtgaagtcgatgacacagcacaatgttggagccttggttgtggtgaaaccaggagagcaaaaatcaattgctggcattatcacagagagagactatctcaggaagatcattgtacagggaagatcatccaagtcaactaaggttggagacattatgactgaagagaacaagcttatcacggtgacacctaataccaaagttctgcgtgcaatgcaactaatgacagataaccgcatcaggcacattcccgtgattgacggcaaggagatgataggcatggtatccattggagatgttgttcgagccgtcgtgagcgagcaccgggaggaattggatcgcttgaatgcatacatacaggggg

SEQ ID NO: 7228 - DNA, 1365 bp, Populus trichocarpa
gctagtagtgctttgtatctatccatatctttatccaacaaatacaatatttgtattggtactaatattatattatattattttataaagtggtgaagtttatctcaagtctcaactagtactcgtactggtgggccaattgatagctctgctgctgctacctggtaacctccgcctcctcctcctcctcttcttcttcacttggagactcaactctcgctctctctctgcctttcactatcagggaaaaaaaaaatgcaaggggcccttcgtacatgtttaacccatggaaatgttgtcaaagattcactcttgcaacatgtccgtgttttgagtccactcttgcggcccattgtgttttctcgttttgaatcagtctcatctgctcgaatagaagagcatggctttgagagcaccagaattgctgacatcctcaaagagaaaggtaaaggtgcagatggctcgtggctttggtgcactacggatgacactgtttatgatgctgtcaagtcgatgacacagcacaacgttggagccttggttgttgtcaaacctggagagcagaaatcaattgcaggaatcatcacagagagagactatctgcggaagatcattgtgcagggaagatcatccaagtcaaccaaggttggggacatcatgactgaagagaacaagctcatcactgtcacgccagataccaaagttctgaaggctatgcaattgatgacagataaacgcatcaggcacattcctgtgattgatgataaggaaatgattggcatggtatcaattggagatgttgtccgtgctgtggtgagtgagcaccgggaggaggtggaccgcctgaatgcttacatacaaggaggttactgagactagatgatgatgatgacaaacataacagggtgctgctaatgtacctgctcttggaagacagcaagtgtagaagagcctgtaaatatggtttgtttgtatcacctgtttatgattttcggcatttccacatcagcctactctgatgtgaaaataacagcatgcagactgcaaggtttttttctttctttgaacctgcgtacccaggtcaataagaagcactgtgatgttgcttagaactttgttattgaaccttggatggatatgcttcatgatgcgcatgatcaatgcctttcatgaagaaaggtttgggttagcatgagacatttcatgtagtttctaaatattccgcatgctaataacctgatccctatgtccaaattgatctcctgcttctatatatagaaaaaaatttaagaaattagttgaacttggtgatttaagtccttttaattaaatatttaaataaattatggatgaatgataaattaa

SEQ ID NO: 7229 - DNA, 926 bp, Helianthus annuus
cgggggggctgcctgaagtgaacaatatctatcattttagtatttatttaacttaaccaacctcccttttgtgctcactcctgtttctctctgtgtgctactgtgtgtgttctcttctctgctccaatcagttaaggaatatgcaaggaggaattagggcgttcgtatcacatggaagcattgtgaagaatgcagttttgcaacatgctcggctagtgaacccgctcaaaccgttgttgatatcacgttatgagtcaacttcagcagctcgtatcgaagaacaagggtttgaaagcaccaaaatctcagatgtcttgcaagcaaagggaaaaggcgcagatggctcgtggctctggtgcaccactgatgattctgtgtatgatgctgtcaaatcgatgacacaacacaatgttggtgctttggttgtggtcaaacctggcgagaaatcgtctattgctggaattatcacagaaagagattatctcaggaaaatcattgtgcaaggcagatcatcaaagtcaactaaggttggagatatcatgactgaagagaacaaacttattaccgtaacgcctgacaccaaagttctgaaagcaatgcagctaatgacagataatcgtatcaggcacattccagtgatcgatgagaagggaatgcagggcatggtttccataggagacgtggttcgtgctgtggtgagcgaacatcgagaagaactcaaccgtttgaatgcattcatacagggcggctactaaaactggttaatgagccgcagacagtggttaaccagaagggtatgtttcggttttaataacgaggtagtcattttaggtatgtgtaaatattttctggatgttttcgtgtttcttctgctgttatcgaggatgttgtcactcgggatacctgataataacgaaccttttaaa

SEQ ID NO: 7230 - DNA, 883 bp, Helianthus annuus
aaccaacctcccttttgtgctcactcctgtttctctctgtgtgctactgtgtgtgttctcttctctgctccatcaatcaatcaatcagttaaggaatatgcaaggaggaattagggcgttcgtatcacatggaagcattgtgaagaatgcagttttgcaacatgctcggctagtgaacccgctcaaaccgttgttgatatcacgctatgagtcaacttcagcagctcgtatcgaagaacaagggtttgaaagcaccaaaatctcagatgtcttgcaagcaaagggaaaaggtgcagatggctcatggctctggtgcaccactgatgattctgtgtatgatgctgtcaaatcgatgacacaacacaatgttggtgctttggttgtggtcaaacctggcgagaaatcgtctattgctggaattatcacagaaagagattatctcaggaaaatcattgtgcaaggcagatcatcaaagtcaactaaggttggagatatcatgactgaagagaacaaacttattaccgtaacgcctgacaccaaagttctgaaagcaatgcagctaatgacagataatcgtatcaggcacattccagtgatcgatgagaagggaatgcagggcatggtttccataggagacgtggttcgtgctgtggtgagcgaacaccgagaagaactcaaccgtttgaatgcattcatacagggcggctactaaaactggttaatgagccgcagacagtggttaaccagaagggtatgtttcggttttaataacgaggtagtcattttaggtatgtgtaaatattttctggatgttttcgtgtttcttctgctgttatcgaggatgttgtcactcgggatacctgataataacgaaccttttaaa

SEQ ID NO: 7231 - DNA, 825 bp, Helianthus annuus
ctgtgtgtgttctcttctctgctccatcagttaaggaatatgcaaggaggaattagggcgttcgtatcacatggaagcattgtgaagaatgcagttttgcaacatgctcggctagtgaacccgctcaaaccgttgttgatatcacgctatgagtcaacttcagcagctcgtatcgaagaacaagggtttgaaagcaccaaaatctcagacgtcttgcaagcaaagggaaaaggtgctgatggctcatggctctggtgcaccactgatgattctgtgtatgatgctgtcaaatcgatgacacaacacaatgttggtgctttggttgtggttaaacctggcgagaaatcgtctattgctggaattatcacagaaagagattatctcaggaaaatcattgtgcaaggcagatcatcaaagtcaactaaggttggagatatcatgactgaagagaacaaacttattaccgtaacgcctgacaccaaagttctgaaagcaatgcagctaatgacagataatcgtatcaggcacatcccagtgatcgatgagaagggaatgcagggcatggtttccataggagacgtggttcgtgctgtggtgagcgaacaccgagaagaactcaaccgtttgaatgcattcatacagggcggctactaaaactggttaatgagccgcaaacagtggttaaccagaagggcatgtttcggttttaataacgaggtagtcattttaggtgtgtgtaaatattttctggatgttttcgtgtttcttctgctgttatcaaggatgttgtcactcgggatacctgataataacgaaccttttaaa

SEQ ID NO: 7232 - DNA, 959 bp, Tragopogon dubius
tgaacaaattcatttaactaaactccatttctgcccgtgaaagtgtggcttccactttcttctttcactactccagtctgtgtgctactgtgtgtttctgtgtggtatcttctccgatcagttaaaaagatatgcaaggaggaattagggcattggtatcacatggaagcattgtgaaaaatgcagttcttcaacatgtccggctagttaaccctctccgaccattgatcttgtcacgccatgaatcaacttcagctgcccgaattgaagaacacggcttcgaaagcaccaccatttcagatgtcctgaaaggaaaaggaaaaggtgctgatggctcatggctctggtgcaccactgatgatactgtgtatgatgctgtcaaatcgatgacccaacacaatgttggtgccctggttgtggttaaacccggcgagcaatcatccgttgctggaatcattacagaaagagattatctgaggaaaatcattgttcagggaagatcatcaaagtcaaccaaggtcggagatatcatgactgaagagaacaaacttatcaccgtcactccagataccaaagttctgaaagcaatgcagctaatgacagataatcgtatcaggcatattccggtgataagtgacaagggaatgttggggatggtttcgattggagatgtggttcgtgctgtggtgagtgaacacagggatgagctgaaccgtttgaatgcgttcatacagggcggttactagaaatggttgatgatgaaaaaggtgttgtggtggggggtatgtttcgcttccaataattaggagtttgtaaatattttccatgtttttctgtttgtttctgatgatgctatcgagaggatgttatattgctcgagagacttgataataacaccacttttagttgcttcaagcgttttacacccctttttatatatcaaatgcttcctcttattg

SEQ ID NO: 7233 - DNA, 1059 bp, Trigonella foenum-graecum
gaggaacaagtcaagtgttcttgtcagtgttcatagacaaagcctcactcaccacctcattctacccgaaacccactctctctatctttctctctctctgacagccaaaatgcaaggaggattgcgatcatttttgtccaacgggaacatcattaaaaatgctgttttgcaacgagtccgcatggtgaatcccctgttgcagccagttgccttttcaaggtttgagtctgctacacctgctcgtattgaggagcatggtttcgagagcaccacaatttcagacatcttgcaaggaaaaggtgaaggcgcagatggttcctggctttggtgcaccacagatgacactgtttatgatgctgtgaaatcgatgacacaaaacaatgttggagccttggtggtcgtgaaaccaggggaggagaaatcaattgctggaattataacagaaagagattacctgaggaagatcatcgtgcagggaagatcatctaagtccaccaaggttggcgatattatgactgaagagaacaaacttatcacagtcacccctgataccaaagttctacgagcaatgcagctgatgactgataacaggatcagacacatccctgtcataaatgacaagggaatgcttggcatgttgtccattggagatgttgttcgtgctgtcgtgggcgagcatcgtcaagagcttgaccgcttgaatgcttacatacaagggggatattaatccttagtctattagatgatgatgaaaatcccttgagggcactcaagctgacttgaatcatgtaataagcttgagagtttgtaaatatgttttggtcacagagccatctatgtcgtctgtttttctgtaatttcggatttcggttccatggaaattaatccatggagtagcatgttaataataactactggatgcatcttgtttctgttgcttaactagtaaagatgcattgctctttaacttctactgtttgcatttggtctattttaagctgcatgttatatattatataatattaagcttaagcagtcgaatatacacttttttaaagc

SEQ ID NO: 7234 - DNA, 1179 bp, Eucalyptus grandis
cattacggccggggatttgtcccaatccatatccatttccccttcacacagcctctgggctcttcccagcctctccagccacactcccgtggtcgccgccgccgccgctgtagctgtcgacgcctctgcttcttatcaacgcaaagtccaaaatgcaaggaatcccaatcgttttcattgaaagcaagcttgatcaaaagtgcagttctgaaacacatccgtctggcaatcctcagattgtttcattttcacgcttcatgtctgtttcatctgcacgaatcgaagagcatggatttgaaagcacaacgattgctgatgtactgaaagccaaaggcaaaagtgcagatggctcctggctttggtgcactacagatgatactgtgtatgatgctgtcaagtcgatgacacaacataatgttggggccttggttgttgtgaagcccggagaacagaaatctattgctggaattatcacagagagagattacctcaggaagattatcgtacagggaagatcatcaaaatcgaccaaggttggagacatcatgactgaggagaacaagctgatcactgttacacccgacacaaaggttctgaaggcaatgcagctgatgactgataaccgcatcaggcacattccagtgatcaacgaagctgggatggcaggcatggtttccattggagatgtggttcgtgctgttgtcagcgagcatcgtgaggagctggaccgcttgaatgcttacatacagggcggttattaggtgatgatggagtatcagatatgggttgttgtgaaggagtgccttggttgaattatgaaggcgtgcttgtaaatatggcttgttgcgtgcacctgcttggacttatttgtatggatctcctaacttgtctaactacctgccaggacaggcaggttcataataactacgcaataagagaaaggcaactgcagtataatctcatccaattttcatctcttgcaatggccatgccgaaatgatattgcaagtagcttcgtctctggatgatgattgatacctgatggttgctcttgcagtagtttttatacaaatgaccttgccgagaaacttccatgcggttacgttgcgtctcttgcttgtaagaatgggctttgctaatgctcatgtgatcaattatatgttggttaacaatccatag

SEQ ID NO: 7235 - DNA, 814 bp, Fraxinus spp
gttcatattttttgtgacctctttactctccaggaagtagaagcaaattcaagaaaataaacccaggcaaaatgcaaggaggaatacaagcaatcttctcacacgggaatgtgctcaagaatgctgttctgaaacatgtgcgtttagtgactccagccatgcggcctcttatgtttgtacgtcacgagacagtttcggctgctcatatagaagagcatggttttgagagcaccaaaatttctgacattttgaaagctaaagggaaaaatgcagatggggtcctggctctggtgcacaactgatgatactgtgtatgatgcagtgaagtcgatgacacagcacaatgttggagcattggtggttgtcaaaccgggggagcagaagtcgattgctggaatcatcactgaaagagattatctcaggaaaataatcgtacagggaaggtcatcaaagtcgacgaaggttggagacattatgactgaagagaataagcttattacagtgacgccagaaaccaaagttttgatggcaatgcaactaatgacagataaccgtatcaggcacattccagtgattaatgacagtggaatgattggcatggtatcgattggagacgttgttcgtgctgtggtgagcgagcatcgtgatgagttgaaccgattgaatgcgtatatacaaggaggatactagtggtggtggtggtggtggtgatgatgatgtatagtcttagtttttgcacactcgtgttcagaagagtactgtaaatattgtttatgcatcttgtgcaacgtttgagatgttattagccttgaga

SEQ ID NO: 7236 - DNA, 840 bp, Flaveria ramosissima
taaacaccaaaataatgagttcactagtgttgatctgtgtgtgccactgtgtgtaatcgacaacatctgttcagtaggtaaaaatgcaaagagcaattggatctttcatatcaaatggaagcattgtgaagaatgctgtactccaacacattcgtttggtcaacccacttgcacaaactcttgttagacacgagtcaacttctgctgctcgtatggaagaacatggtttcgaaaaaaccataatttcagatattttgaaatcaaaagggaaaagtgccgatggctcgtggctttggtgcaccactgaggattccgtgtatgatgcagtcaagtcgatgacacaacacaatgttggagcattggtggtggtgaaacctggggaggaaaagtcaattgctggaattatcacagaaagagattatctcaggaaaatcattgttcagggaagatcatccaagtcaactaaggttggagatatcatgaccgaagagaacaagcttatcacagtcactccagacaccaaagtcctgaaagcaatgcagttaatgacagataaccgtatcagacacattccggtgatcggtgaaaagggtatggtgggcatggtttccattggggatgtggtccgtgctgttgtaagtgagcacagggaagaactcaaccggttgaacgcatatatacaaggaggctactagaaaccattaatgatgatgagcatcatcatcataatgacaataagttggtacctggtaacatggtaattttacaaacttgcaaatatgtttatataactctgtttcaacatatgtttatatattgtgttgcccgaacgacatgata

SEQ ID NO: 7237 - DNA, 897 bp, Centaurea maculosa
tctctctatttctgtgtgtgtgtgtgtgtttcagtgtgtgtgaaaaagcttctccaatcagtttaagaatatgcaaggaggattaagagcgttcgtatccaatggaagcattgtgaagaatgcggttctccaacacgttcggcttgtgagccctctcgtgcgaccgctaactcgtcacgagtcaacttcggctgctcgtattgaagagcacggtttcgaaagcacaacgatttcagatgtcttgaaaggaaaaggaaaagggtgccgatggctcctggctctggtgcaccactgacgatactgtctatgatgccgtccaatcgatgactcaacacaacgttggtgcgctggttgtggttaaacctggggagcaatcatccattgccggaattatcacagaaagagattatctgagaaaaatcattgtccaaggaagatcatccaaatcaaccaaggttggagatatcatgaccgaagagaacaaacttatcaccgttaccccggataccaaagttctgaaagctatgcagcttatgacagataatcgtatcagacacattccggtgattgacgagaagaaaatgttggggatggtttccatcggggacgtggttcgagccgtggtgagcgagcacagggaggagctcaaccgtttgaatgcattcatccagggtggctactagaaaatggttggtgaaccgtgtgcggggggttatgctggcgggtatgtttcgttcaataacgaggtagtcatgttaggagtttgtaaatattttcacgtttcttccgttgccatcgaggatgttatgtcactcgagagattcgataataacaaacttttttaaccgttacgagttattttatgtctcgtttttatattttcgaaattggttgttc

SEQ ID NO: 7238 - DNA, 841 bp, Cirsium arvense
ctaagatgcagggtaacaaatcctaccaaatggatttagaataaataaataccaccaaatggataaaccttgggctgcctcctcagattcatttcacacaaactcctccatttctacttgtaaactgtggcctccactttctctctctctatttctctgtgtgtgtgtgtgtttcagtgtgtgtgaaattaagagcttctctccaatcagtttaagaatatgcaaggaggattaagagcgttcgtatcccatggaagcattgtgaagaatgcggtcctccaacacgttcggcttgtgagccctctcgtgcgaccactaactcgtcatgagtcaacttcggctgctcgtattgaagagcatggtttcgaaagcaccacgatttcagacatcttgaaaggaaaaggaaaaggtgccgatggctcttggctctggtgcaccacggacgataccgtctatgatgccgtccaatcgatgacgcaacacaacgttggtgcgttggttgtggttaaacctggcgagcaatcatccattgccggaattatcacagaaagagattatctgagaaaaatcattgtccaaggaagatcatccaaatcaaccaaggtcggagatatcatgacggaagagaacaagcttatcaccgttacgcccgataccaaagttctgaaagcaatgcagctaatgacagataatcgtatcagacacattccggtgattgacgagaagaaatgttggggatggtttccataggagacgtggttcgagcgtggtgagtgagcacagggaggagctcgaccgtttgaatgcattcatccagggtggctactagaaatggttggtg

SEQ ID NO: 7239 - DNA, 720 bp, Hevea brasiliensis
ggaaattttgtaaaaagtgctgttttgcaacgcttccgtgttgccaatccactactgaggcctattatgttttctcgttttgattctgtctcatctgcccgtatggaagagcaaagctttgaaagcactaccatttctgacatcttaaaagccaaagggaaaggtgctgatggctcttggctttggtgcaccactgatgacactgtttatgatgctgtcaagtcgatgacactacacaacgtaggagccttggtggtccttaaacctggagagcagaaatcaattgcaggaattatcacagaaagagattacctgaggaagatcatagtccagggaagatcatccaagtcaactaaggttggggacattatgacagaagaggtgactgcagaacaagcttattacagtcactccagacactaaagttctgcaagcaatgcagttgatgacagataatcgcattaggcatattcctgtcattgacgataaggaaatgattggcatggtgtccattggagacgttgtccgtgctgtagtgtctgagcaccgagaggagctggaccgcttgaacgcttacatacaaggaggttactagatgatgatgaaaaatgtgatggaatgctttggatgtgcttactgtctgactaccagtaagcaaaaagcttgtaaatatggcatgtcatgtgtcttcagttatgtggttttacttttccccatatc

SEQ ID NO: 7240 - DNA, 967 bp, Brassica rapa
tcaaactctcccactcaactctctcctcaccttgtctcttgctcatactctagagttcttcagctcccccactccgatccattcttcttctctaatctcaggtaaaagatgcaagctgcgattcgttcgtttgtgtccggtggaaacgttgtgaaagcctcactgctgcagcatctccgtgtgatcaacccagcgattcagccttcttctgtgttttgcacgcgctccgagtcgactcagacttctcgtatggaggagcatgggttcgagagcacgaccatctctgacgtcatgaaggccaaaggcaaaagtgctgatgggtcttggctttggtgtaccactgatgacactgtttacgacgctgttaaatccatgactcaacacaatgttggtgccttggtggttgtgaaacctggtgagcagcaatctcttgctggtatcattacagagagagattatctaaggaagatcatagtgcaagggagatcatccaaatcaacaaaagtaggagacattatgactgaagagaataagcttatcaccgttacaccagagaccaaggtcttgcgtgctatgcagctaatgacagataaccggattaggcacattccggtgataaaagacaagggtatggttggaatggtgtccataggagatgtggtccgtgcagtggtgactgagcatcgtgaggagcttaaccgcctaaatgcttttatccagggtggttactagacggtttgaagattggtaagaaaagtgttacgtaccgtgttttatcctctgcttgatgatcctctaaagcttttaagatcgaatgtaaatatggagtcttctctgatttttgttgttgttgttgttgtctgtcgttttcattggttaacttgtcaagacttggtttttgagctactctgcaagataataaaacaaaaggactctcctctttattgaatattattatgatgttatg

SEQ ID NO: 7241 - DNA, 1113 bp, Linum usitatissimum
ccacgcgtccggctctccatttctccttccttcctgcagggtttctgtatttatccacttcttctctttcttccatccactcttcgacgcctactctctacaccttcttcctccagcattcgtctcttccgttcatccaatcaatcctccgccacctcaacttttacagaaaacgatgcaaggcgctatcggagctttcttctccaaggcaggagtagtgaagaccggtgtcctccagcacgtcagggtgctgaatccggcacttcgcccgctcgtcttctccagatctgagtcgtccgtctcttccgcggctcgcatcgaggagcatggctttgagcacaccacaatctctgacgtcttgtctgccaaaggtaaaggtgctgatggctcctggctctggtgcaccactgacgacactgtttacgatgctgttcactcgatgactcagcacaatgttggagcgttggtggtggtgaaacctggagagcagaaatcgatcgctggaatcatcactgagagagattacctgaggaagatcatagtgcagggaagatcatccaagtcaacaaaagtcggggatatcatgactgaagagaacaagctcataacagtaacacctgacaccaaagttctggtggcaatgcaactgatgactgataaccgcatcaggcacattccagtaatcgatgaaaaggggatgagtgggatggtgtcgattggtgatgtggttcgtgctgtggtgagggagcacagggaagagctggaccgactgaatgcttacattcaaggaggttactaagatgataactatcaatgacgacgatgatgacaaaggagaggtcctagtagtgttcttgcgcccgcccttggaagatgaataagcccaagagcttgtatatatagtgtttgtactgccaatgaatgtatttcctggttattctgcggtgtcgaaagaacaactagcggactggtcagctaataacgagtaggagagaactcttttatctgccatggtagtgtgtcttttcttgtttgcttcttgatgtcggacagcggagctcgtcggttaatgttcactggtcattttgcagttggtgctggcaaatgattgat

SEQ ID NO: 7242 - DNA, 897 bp, Brassica napus
accttgtctcttactcatactctagagttattcagctcccccactccgatccattcttcttctctaatctcaggtaaaagatgcaagctgcgattcgttcgtttgtgtccggtggaaacgttgtgagagcctctctgctgcagcatctccgtgtgatcaacccggcgagtcagccttctgtgtttgggtcacgctccgagtcgactcagccttctcgtatggaggagcatgggttcgagagcacgaccatctctgacgtcatgaaagctaaaggcaaaagtgctgatggatcttggctttggtgtactactgatgacactgtttacgacgctgttaaatccatgacacaacataatgttggtgcgttggtggttgtgaagcctggtgagcaacaatctcttactggtattattacagagagagattatcttaggaagatcatagtgcaaggtagatcatccaaatcaacaaaagtaggagacattatgactgaagagaataaacttatcaccgtgacaccagagaccaaggtcttgcgggctatgcagctaatgacagataaccggattaggcacattccggtgataaaagacaagggtatggtaggaatggtgtccataggtgatgtggtccgtgcagtggtgactgagcatcgtgaggagcttgaccgcctaaatgcttttatccagggaggttactagacggttttaagattggtaagaaaagtgttacgtaccgtgttttatccactgcttgatgatcctctaaagcttttaagatcgaatgtaaatatggagtcttctctgatttttgttgttgttgttgtctgtcgttttcattggttaacttgtcaagacatgggttttgagctactctgcaagataataaaacaaaagg

SEQ ID NO: 7243 - DNA, 1062 bp, Raphanus sativus
  misc_feature (516)..(516): n is a, c, g, or t
  misc_feature (1010)..(1010): n is a, c, g, or t
aatttatattttgctgattatccataagaacccttcaaacgctcctcccactcaactctctcgcatcctccgtctcttgctcatactctagggttcttcagcttccctactccgttccgtttcttcttgtttaatcaaatctcaggtaaaaagatgcaagctgccattcgctcgtttgtgtccggtggaaacgttgtgaaagcgtctctgctgcaacatgtccgtgtgattaacccggcgatccagccttctgtgttttgcaaacgctccgactcgactcagtcatctcgtatggaggagcatgggttcgagagcacaaccatctctgacgttatgaacgccaaaggcaaaagtgctgatggatcttggctttggtgtactactgatgactctgtttatgacgctgttaaatccatgacacaacacaatgttggtgccttggtggttgtgaaacctggtgagcaacaatctcttgctggtatcattacagagagagattatctgcgaaagatcatngtgcaagggagatcatccaaatcaacaaaagtaggagatattatgactgaagagaataagcttatcaccgtgacaccagagaccaaggtgttgcgtgctatgcagctaatgactgataaccggattaggcacattccagtgataaaagacaagggtatggtgggaatggtgtcgataggagatgtggttcgtgcagtggtgactgagcatcgcgaggagcttaaccgcctaaacgcgtttatccagggaggttactaacgttgcagactggtaaggagaagtgttactttccgtgtgttatatccactgcttgatgatcctctaaagctttaagatcgaatgtaaatatggagtcttctctgatgtttgttgttgttgttgtctgtcgttttcattggttaacttgtcaaagacttggtttttgagctactctccgcaagataataaaacaaatggactctactctttattgaatattattatgatgtttgttntcttgttatataaatcatgggttcgaataaatcagttgtgaatctgtgatta

SEQ ID NO: 7244 - DNA, 932 bp, Raphanus sativus
ctctcgtgtcctctgtctcttgctcataatctagggttcttcagcttccccactccgatccgtttcttcttggttaatcaaatctcaggtaaaaagatgcaagctgcgattcgttcgtttgtgtccggtggaaacgttgtgaaagcgtctctgctgcaacatgtccgtgtgattaacccggcgatccagccttctgtgttttgcaaacgctccgagtcgactcagtcatcgcgtatggaggagcatgggttcgagagcacaaccatctctgatgttatgaacgccaaaggcaaaagtgccgatggatcttggctttggtgtactactgatgactctgtttatgacgctgttaaatccatgacacaacacaatgttggtgccttggtggttgtgaaacctggtgagcaacagtctcttgctggtatcattacagagagagattatctgcggaagatcatagtgcaaggaagatcatccaaatcaacaaaagtaggagatattatgactgaagagaataagcttatcaccgtgacaccagagaccaaggtgttgcgtgctatgcagctaatgactgataaccggattaggcacattccagtgataaaagacaagggtatggtgggaatggtgtcgataggagatgtggtccgtgcagtggtgactgagcatcgcgaggagcttaaccgcctaaacgcgtttatccagggaggttactaacgttgcagactggtaaggagaagtgttactttccgtgtgttatatccactgcttgatgatcctctaaagctttaagatcgaatgtaaatatggagtcttctctgatgtttgttgttgttgttgttgttgtctgtcgttttcattggttaacttgtcaaaacttggtttttgagctactctgcaagtgagataataaaaccaaaggactcttctct

SEQ ID NO: 7245 - DNA, 1012 bp, Eutrema halophilum
ctatccaaaaatagttatttatatttgatgattatccattacagcccttcaaactctccactcgactctggtcagctgtctcttgcttctactctagggttctctcaagcttccactctgttctgttcgtcttcttctctaagctcagggaaagatgcaagctgcgattcgttcgtttgtctccggtggaaatgttgtcaaggcctctctgctgcaacatctccgtgtgatgaacccggcgattcagccttccgtgttttgtacacgctccgaatccactcagtctgctcgtatggaggaacatggattcgagagcacaaccatttctgacattatgaacgccaaaggcaaaagtgctgatggatcttggctttggtgtactactgatgacactgtttacgatgctgttaaatccatgacacaacacaatgttggtgccttggtggttgtgaaacctggtgagcaacaatctcttgctggaatcattacagagagagattatctgcggaagatcatagtgcaagggagatcatccaaatcaacaaaagtaggggatattatgactgaagagaataagctcatcactgtgacaccggagaccaaggtcttgcgggctatgcaactgatgacagataacaggatcaggcacattccagtaatcaaagacacgggtatggtgggaatggtgtccataggagacgtggtccgtgcagttgtcagtgaacatcgagaggagcttgaccgcctgaatgcttttattcagggaggttactaaaaagttgaaggttggtaataaaagagttccttctcgtgtctggtccagtgcttgatgatgtcgaaagcttttagatcaatgtatatatatggagtcttcgttgttgtttttattgtctgatgtttgttgttgttgtgttttgtttcattcgttaacttgccaagactgagttcttgtgcttctcttattgtgctactcttcaagataataaaaccaaagactccatccctttattgc

SEQ ID NO: 7246 - DNA, 1258 bp, Eutrema halophilum
aaactctccactcgactctggtcagctgtctcttgcttctactctagggttctctcaagcttccactctgttctgttcgtcttcttctctaagctcaggtctgaatctctccttcttcgctactatttctggtgtcttcctgtatatatgtatcagtcagattgaagaagtttccagttttagggttcttcaaaaacacgcagctttagtttttttttttatgtatagcttttgatgcagatcattctcttttccgatctacttagataagattcgtttgatatccgatgattgtttggcgtattgtttcctattctagatctcgttttgagtagtgattcgcttctgcttcttcttctgatgatgatctgttcctgaaactgattgatctgattacgatagggaaagatgcaagctgcgattcgttcgtttgtctccggtggaaatgttgtcaaggcctctctgctgcaacatctccgtgtgatgaacccggcgattcagccttccgtgttttgtacacgctccgaatccactcagtctgctcgtatggaggaacatggattcgagagcacaaccatttctgacattatgaacgccaaaggcaaaagtgctgatggatcttggctttggtgtactactgatgacactgtttacgatgctgttaaatccatgacacaacacaatgttggtgccttggtggttgtgaaacctggtgagcaacaatctcttgctggaatcattacagagagagattatctgcggaagatcatagtgcaagggagatcatccaaatcaacaaaagtaggggatattatgactgaagagaataagctcatcactgtgacaccggagaccaaggtcttgcgggctatgcaactgatgacagataacaggatcaggcacattccagtaatcaaagacacgggtatggtgggaatggtgtccataggagacgtggtccgtgcagttgtcagtgaacatcgagaggagcttgaccgcctgaatgcttttattcagggaggttactaaaaagttgaaggttggtaataaaagagttccttctcgtgtctggtccagtgcttgatgatgtcgaaagcttttagatcaatgtatatatatggagtcttcgttgttgtttttattgtctgatgtttgttgttgttgtgttttgtttcattcgttaacttgccaagactgagttcttgtgcttctcttattgtgctactcttcaagataataaaaccaaagactccatccc

SEQ ID NO: 7247 - DNA, 1434 bp, Musa acuminata
atgacgacacccataaagcgacgttgttatgacaggaaggcgacttcatttatgagggtttccttgtgtgccctgccgccgccgccgacgctcccctatccactcctctgctatcaactctctatctctctcacacgatcgatccgtccatatcggtcggtgagaccgccttccttctcgaggagaaatgcagggagcactccgatcattacgattgcatggaaatgttattaaaaatgctatgctccaacatattcgtgtcatgaacccagccacgctacctactgtgttttcacgttttgagtcagtttcttctgctcgattggaagagcatggatttgaaagcaccaccatccgagatattatgaaagctaaaggcaagagtgctgatggttcctggctgtggtgcacaactgatgacagtgtttatgatgctgtgaagtcgatgacacaacacaatgttggtgctttagtggtggtgaaacctggagaagacaaggcaattgctgggattgtcactgagagagattatctccggaagatcattgtccagggcagatcgtccaaatcaactaaagttggagacatcatgactgaggagaacaaattgatcactgtgacaccagataccaaagttctgcgggcaatgcaacttatgacagataaccgcatccggcacatccctgtgattgacaacaacggtatgatcggcatggtctccatcggtgatgttgttcgagccgtggtgagcgagcatcgtgaggagctgaaccgcctcaacgcatatatccaagggggttattagaagtcttttctaggatctaataatgctcaatgatgatggcgaagaagatggttttgagcagtaggcatcgggaccttatgctacttgttaagcatgtgtgtacatatatgtcgtgctttgcttgcgccgtttgttggtctttgctaactggataaaccttcttatccactctatccagtgaagtttatgggtaagctcgttggatcttttgtgcttgctggttgttgttattattggctagagatttgcattgcattctttttgcgtatctcaagccaacaaaaattgatggttttggtgaatagatgtgtacaaagtgattcaattatcgcatgatgtacgagagataccttgaatcgactgaagtgttgaatcatggacatgaagtgtggaatgatgctgccaaaaccgtgattgattaaaggaaaatatgtcaacttagattaaagagttctacataaagagtcaggtggcgaattgcttctccaacaaaagaaggttagttgtcttgggaaatttgttagcttgtgagccagggagttgtgctgtcttgcaatatggtttcattcgtctgtgttggtcttcttagcaaaatgaaagatgtggagcgtcaagttgcagagggtcca

SEQ ID NO: 7248 - DNA, 1642 bp, Cannabis sativa
tattattataatcttatatatcacagattctgtacttttatttttatttattttattagaaaatgaaaactgggttacacgtaagccatgtttggcgcgtggtatcatctgttttaaggtttggctatacaattacacagttttcagagctttcttttttagggttccttatctttatccatagccgaaattagctcctccttcttcttcatcatcatcttcttcactcaggtaacaatgcaaggagtaattcgaggatttttttccaatggaaacgttgtgaaaaatgcagttttgcaacgcatttctcttgtgaatccagtgttgcagcctgccatcctgtcacgttttcaggggactacaactgctcgtatagaagagcatggttttgaaagcacaactatttcagatatcatgaaatcgaagggtaaaggtgctgatggttcttggctatggtgcactacagatgacactgtttatgaggccgttaagtcgatgacccagcacaatgttggtgccctggtggtcgtgaaacctggagaggaaaagtcaattgctggaattattacagaaagagattatctgcggaagatcatagtgcagggaagatcatctaagtccactaaggtcggggatatcatgactgaagagaacaagcttatcactgtcaatccttccaccaaagttttgcgtgcaatgcaactgatgactgataatcggatcaggcacattccagtgattgatgataagggaatgattggcatggtgtccattggagatgtggtacgagctgtggtgagtgaacataggcaggaacttgaccgcttgaatgcttttattcagggaggttactagatgatgacgacaacgaccatgatgatgatgacaaagatcagacaggttgccctggtttaacagtgaacaataataggaccaggtgcatgtaaataccctttgctctttgcaactcctattctggttcttttcttttcttttcgatgttcatatgctatgacatcaagataccaatgtgggaactaacatggttaataacgagaacttattttctgcttaaatttctggttcctatattggtcatagactcgtaattgtttccctcatctatggtgtttgggatcttggtttttctttgagagtggaattttccatccatcaatttgtttttgttttggttaattttactcatctctttgttataggggggtgtaaaacatctttggtttttcttaaaaaaaaaatcattacattgtcataaagatttaagaacaaaccagtaggtggtggatcaggaagttattatttccttgaaggaatattcaattacaattctgtattatttattcctcactaaacagggattaaatgatgtaaaaaattgaataggactcctagtgttgtaggtctctgttgtgaaaattgtgtacgcaagtatacgcaatcgtaacaagtaataaagtgataaatcgagtatcgtctccacagggattgaaaattggaaattaatttataaaactaattactcacaaattggtttcaacaaaaataaaataaagtgatgagaatatgtaaaaaactaacaaacacaaactacgaagaaagtaagttagaattattaaattgg

SEQ ID NO: 7249 - DNA, 1183 bp, Cicer arietinum
caaaaaaaaaaaagagtatggataatgtcatgatccaaaactctagaaaaacaaatggcccactcactcactctcacattttttgtaagatttgaggaacaagtcaagtgtttctgtctgtatccatagccctcctcatctcaaccatcctaacctcattacactctctctttctctctctctctgacagctaagatgcaaggaggattgcgatcatttttgtcaaacgggaacatcataaaaaatgctgttttgcaacgagtccgcatggtgactcctctgttgcagccagctgccttttcgcggttcgagtctgttacgcctgctcgtattgaggagcatggtttcgagagcgcaacgatttcagacatcttgcaaggaaaaggtaaaggcgcagatggttcctggctttggtgcaccacagacgagactgtttatgatgctgtgaaatcgatgacgcaaaacaacgttggagctttggtggttgtgaaacctggcgaacagaatacaattgcagggattataacagaaagagattacctgagaaagatcatcgtgcagggaagatcatccaagtccaccaaggttggagatattatgaccgaagagaacaaacttatcacagtcacccctgataccaaagttttacgtgcaatgcagctgatgaccgataacaggatcagacacattcctgtcataaatgagaaggggatgattggcatggtgtccattggagacgtcgttcgtgctgttgtgagcgagcatcgtcaagagcttgaccgtttgaatgcttacatacaaggaggttattagtctttattagatgatgatgaaaatcccttgagggcactcaagctgagttgaattatcatgtaataagcttgagtgtttgtaaatatgttcttgtctgtttttctgtaatttctcaggatttcagttctatggacattaatccatagagttgtagctgttaataataactaccggattcatcttgcatgttagttatgttatgttgcttaactagtgaagatgcattgatcttttacttccactgtttgcagttggtctattttatgctgcaagttatggtcttatggacttttcttttttaacttcaccgcttcatgcatacttcctctgctcctctcctaattataagtacttatagccttaatgattc

SEQ ID NO: 7250 - DNA, 867 bp, Euphorbia peplus
cgatttttgtcccgtggaaatgttatcaaaactgcagttttgcaatgcgttcgtgttgccaatccgctactcaggccagtgttcttttcacggtttgaatcaggctcatctgctagtatggaggagcaaagctttgagagcactacaatctcagatattctgaaagccaaagggaaaagtgctgatggctcgtggctttggtgcaccactgaggacactgtttatgatgctgtcaagtcgatgactcagcacaatgttggagccctggtggtcgtgaaacccggagaggagaaatcacttgcaggaattatcactgagagagattacctaaggaagatcatagtgcagggaagatcatcaaagtcaactaaggttggggacataatgactgaagagaacaagcttatcacagtcactcctaaaacaaaagttcttcaagcaatgcaattgatgacagataaccgtattagacacattcctgttatcaatgacaaggacatgattggaatggtgtcaattggagatgttgtccgtgcagtggtgattgagcacagggaggagttggaccgcttgaatgcgtacatacaaggaggttactagatgatgatgacaaacaacacgagggagaatgcagctgaagtgtgcagctggtatgaaggaccggaccaattagcgaagagcctgtaaatatggtgtgtataaggtattttagtcattatgcggtttcatctgttgcttaaatcagaatatgtctgatgtctaataacagttggactaactgccaaataataagctgtttcttgagacctgtaaccgtggatcatttgaatggtcgtctccttttttaatgttgtaatgcttctattt

SEQ ID NO: 7251 - DNA, 695 bp, Hevea brasiliensis
gttggtttggcttttttcatccttagccgaaagttcaaatctttctgttccttctcctcttcttcgtctaggtgatcttgtgggtgctctctccaaatcaggtgaaaaatgcaaggggcggttaatgcatttttgtcccatggaaatttggtaaaaaatgctgttctgcaacgcttccgtgttgcaaatccagtactgaggcctattttgttttctcgttttgagtctgtattatctgctggaatggaagagcaaagctttgaaagcactaccatttctgacatcttgaaaaccaaagggaaaggtgctgatggctcttggctttggtgcaccactgatgacactgtttatgatgctgtcaagtcgatgacacagcacaatgttggagccttggtggtcgttaaacctggagagcagaaatcaattgcaggaattattacggaaagagattacctgaggaagatcatagtccagggaagatcatccaagtcaactaaggttggggatattatgactgaagagaacaagcttattacagtcactccagacactaaagttctgcaagcaatgcaattgatgacagataaacgcatcaggcacattcctgtcattgatgataaggaaatgattggcatggtgtccattggggatgttgtccgtgctgtagtgactgagcaccgggaggagctggaccg

SEQ ID NO: 7252 - DNA, 1251 bp, Capsicum annuum
ggatcttctcgtgcttgcttacaaaaatagtgtacggcccgattaaaattaaatcattgacacacacatttgtagagagtcgtaaattagtaaaacctataggataaactctaacaaccttaaccttttccttttcatttttcttctgactttccctgttctttgtctgaaagaaacaccagtgagtgagaaggcaaaaatgcaaggaggatttaagctcttttctcgtggaagtgtcctcaaaagtgctgttttacgacatgtccgattggtgaatccagtgtcgaggccacttatgtttgtgcgctgtgaaacaacttcagctgctcggatagaagaacatggttttgaaagcaccaaaatatctgacattttgaagggcaaaggtaaaggtgcggatggctcttggctctggtgcaccacagatgacagtgtttatgatgctgtgaaatcgatgacgcagcacaatgtaggagccttggtggtggttaaatctggggaaaataagtcaattgctggcattattaccgagcgagattatcttcggaaaatcatagtacagggaagatcatccaaatcaaccaaggttggggacatcatgacagaggagaacaagcttatcaccgtcacacctgaaaccaaagttctgaaagcaatgcaactgatgacagataaccgtatcagacacattccagttatcgatcagacaggtatgataggaatggtgtccattggagatgttgttcgtgctgttgtgagtgagcacagggaagagctgaaccggttgaatgccttcattcaaggaggttactagatgacgacgacgaataaatggatgatgactgcaagggttctgtttgcagtgtaaagatgtctgatttgagctcttaatcttgtgaatgttgatatccttcctctctaccatgatgtttgcctatggatgtgggttaccaatttgggatcaataaaagatagtctccactattattttttttggtggcattctggttttcttgcaattggtatgtttaagatgccagtttcattaaccaaaaaaactgaaaggttgttcatcgcgttccaaggacttgggttgacctactgctgccgagcatattgtccttcctctgtttccaaagatgattttctcggacggtattgttatcttttaggttcaaattgttccgtaagcttttaaacattgcaagataaatgaaccttttaagaataagatcgtcatacccacatggt

SEQ ID NO: 7253 - DNA, 890 bp, Salvia sclarea
tataactgcatagggtttgttcttgtgacttttgcttttcacttcactctgctagctgagttccaactcccacttccacaaaaatctcaacttcagccacaatgcaaggaggaattcacgcaatcttgtcaaacggtaatgtgctcaagaacgctgtcctgcagcatgtgcgcgtcgtccctccagcgatgcgggccctcatgtactcgcgccacgagtcgacctcagctgcccgcattgaggagcacggcttcgaaagcaccaagatcgcggatgttctgaccgccaaggggaagggcgctgacggatcctggctctggtgcaccactgatgattctgtgtacgatgctgtgaagtcgatgactcagcacaatgtgggagctctggtcgttgttaaaccgggggaacagaagtcaattgccgggattattacagaaagagattatctccggaaaatcatagtccagggaaggtcatccaagtcgacaaaagtcggggacatcatgaccgaagagaataagctgatcacagtaaccccagacactaaagttctcaaggcaatgcagctgatgacagataatcgaatcaggcacattccagtggtgaacgacggtgggatgattgggatggtgtccatcggggatgtggtgcgtgcggtagtgagcgagcatcgtgaggagctgaaccgcttgaacgcttacatacagggaggatactaaggccagcgacgacgacgaaaagggatgagatttcacttgctgtttgaggagaaggggccggagcactgtaattaatctgctgctgcttttatgcatcttgtggaatgtgttggagacgttgatgtgaaaatttatctgagtaataatatgcagaaactacttgctgctcgc

SEQ ID NO: 7254 - DNA, 855 bp, Helianthus annuus
tttctctctgtgtgctactgtgtgtcttctcttctctgctccaatcaatcaatcaatcagttaaggaatatgcaaggaggaattagggcgttcgtatcacaaggaagcattgtgaagaatgcagttttgcaacatgctcggctagtgaacccgctcaaaccgttgttgatatcacgctatgagtcaacttctgcagctcgtatcgaagaacaagggtttgaaagcaccaaaatctcagatgtcttgcaagcaaagggaaaaggcgcagatggctcgtggctctggtgcaccactgatgattctgtgtatgatgctgtcaaatcgatgacacaacacaatgttggtgctttggttgtggttaaaccgggcgagaaatcgtctattgctggaattatcacagaaagagattatctcaggaaaatcattgtgcaaggcagatcatcaaagtcaactaaggttggagatatcatgactgaagagaacaaacttattaccgtaacgcctgacaccaaagttctgaaagcaatgcagctgatgacagataatcgtatcaggcacattccagtgatcgatgagaagggaatgcagggcatggtttccataggagacgtggttcgtgctgtggtgagtgaacatcgagaagaactcaaccgtttgaatgcattcatacagggcggctactaaaactggttaatgagccgcagacagtggttaaccagaagggtatgtttcggttttaataacgaggtagtcattttaggtatgtgtaaatattttctggatgttttcgtgtttcttctgctgttatcgaggatgttgtcactcgggatacctgataataacgaaccttttaaa

SEQ ID NO: 7255 - DNA, 854 bp, Helianthus annuus
tttctctctgtgtgctactgtgtgtgttctcttctctgctccaatcaatcaatcaatcagttaaggaatatgcaaggcggaattagggcgttcgtatcacaaggaagcattgtgaagaatgcagttttgcaacatgctcggctagtgaacccgctcaaaccattgttgatatcacgctatgagtcaacttcagcagctcgtatcgaagaacaagggtttgaaagcaccaaaatctcagacgtcttgcaagcaaagggaaaaggtgcagatggctcatggctctggtgcaccactgatgattctgtgtatgatgctgtcaaatcgatgacacaacacaatgttggtgctttggttgtggtcaaacctggcgagaaatcgtctattgctggaattatcacagaaagagattatctcaggaaaatcatcgtgcaaggcagatcatcaaagtcaactaaggttggagatatcatgaccgaagagaacaaacttattaccgtaacgcctgacaccaaagttctgaaagcaatgcagctaatgacagataatcgtatcaggcacattccagtgatcgatgagaagggaatgcagggcatggtttccataggagacgtggttcgtgctgtggtgagtgaacatcgagaagaactcaaccgtttgaatgcattcatacagggcggctactaaaactggttaatgagccgcagacagtggttaaccagaagggtatgtttcggttttaataacgaggtagtcattttaggtatgtgtaaatattttctggatgttttcgtgtttcttctgctgttatcgaggatgttgtcactcgggatacctgataataacgaacctttaaa

SEQ ID NO: 7256 - DNA, 701 bp, Ambrosia trifida
gtgttctctctgtgtaacataatatcttctccagtcagttaagggatatgcaaggaggaatcaaggcatttgtatcaaatggaagcattgtgaagaatgcagtcctgcaacatgttcggctagtgaacccgctgagaccgttgatggtatcacgctatgagtcaacttcagcagcacgaatcgaagaacaagggtttgaaagcaccaaaatttcagatgttttgaatgcaaagggaaaggtgcagatggttcatggctatggtgcaccactgatgactcggtgtatgatgctgtcaaatcgatgacacaacacaatgttggtgctttggttgtggttaaacctggcgagaaatcgtctattgctggaattattacagaaagagattatctcaggaaaatcattgtgcaaggcagatcatcaaagtcaaccaaggttggagatatcatgactgaagagaacaaacttattactgtaacgcctgataccaaagttctcaaagcaatgcagctaatgacagataatcgtattaggcacattccagtgatcgatgagaaggggatgcaggggatggtttccataggagacgtggttcgtgctgtggtgagtgaacaccgagaagagctcaaccgtttgaatgcattcatacagggcggctactagaaccgtctgaatgcattcatacagagtggctactaaaaat

SEQ ID NO: 7257 - DNA, 892 bp, Liriodendron tulipifera
  misc_feature (758)..(758): n is a, c, g, or t
gtttggcgatcggctgcattctcatttcttccatcggattttattccagctgcagctgctctgaaggtaaaatgcaaggtgcaattcaagcaatccgatcgcatggaaacattctgaggcaggcagttctacaacatgttcgtattttgggtccagtcatgcggcctgctatgttttcgcgttttgagtcagtttcctctgctcgcttggaagagcatggatttgaaagtaccacaatctctgacattctgaagggcaaaggtaaaagtgctgatgggtcttggctttggtgcacgatagaagacactgtttatgatgccgtgaaggcgatgactcaacataatgttggagctttggtggtggtaaaacctggggagcaaaagtcaattgctggaattattaccgagagagactatctcaggaagatcattgtgcagggaagatcttctaagtcgacaaaagttggggacattatgactgaggagaacaagctcatcacagtgacacctgacaccaaggttctccgggcaatgcagctgatgacagataaccgcatcaggcacattccggtgattgatgacaaggaaatgattggcatggtctccattggagacgtcgttcgagctgtggtgagcgagcaccgggaggaattggaccgcctgaatgcctatatacagggggggttactaggcatttggacttgttgatgctgatgatgatgacaagttgatgttgaagcagagactttcaagtgggtnttacacagaatggttgtacatattttgtttgttgtgtttctcgtcgtactctcccaagtcttttgagtcgtctgtccgctggtcgtgaataagatgcgttgtcacaataatatataaagactagacaatcatcc

SEQ ID NO: 7258 - DNA, 1154 bp, Papaver somniferum
tagagatttggaaattcatccaaaatagtgcagcatcattttcacttttcttttcttcttcttgtactactactactactatatctactccagttccactcagagaaagaaaagaaagaagagataatacagaaacaggaaatttcaaaagccaaaataaagccataactaattaaggtaattgaaaatgcaaggagcaatgcaagcaatcagatcccacggcagcgtattcaagtctgcgattttgcaacacatccgtatagtggatcctgctctaagacctgctttctccacgcgcttccagtcaacagctcctcgtttggaagagcatggttttgaaagcaccacaatttctgatgttcttaaagccaagggtaaaagtgctgatggttcatggctttggtgcaccatagatgactccgtttatgatgctgtcaaatcgatgacacaacacaatgttggagccttggtggtcgttaaaccaggagaacagaagtcccttgctggaattattactgagagagattatctcaggaagataattgttcagggaaggtcttccaagtctacaaaggtcggagacattatgactgaggagaacaagcttataactgtgacccctgatacgaaagtgctgcgagctatgcaactaatgacagaaaaccgcatcaggcacattccagtgatcagtggcaaggatatgatagggatggtatccatcggagatgttgttcgagcagttgtaagcgagcaccgcgaggagctggaccgcctgaatgccttcatacaaggaggatattaaacgatgaagatgatgatgccagagacaaagatgatgacgacaataacaataagaaatagaagtgggtacctttgctttattagcagatgtttgtaaatatttgagtttgtttatgcaactatttaccctttatttgagagagtttatcaacactattaagtggttttgagttgttggaccatggcgatttgctgaataacttggcaccaaaacatcgatcagttttagacattgcattttatgtttgcttaataactgtaatttctatcgggcctaatgcctatgcctctccatacaaggcattgaacttctatagatgttttttttaacaacggaaatgtgctttgtttgc

SEQ ID NO: 7259 - DNA, 810 bp, Ambrosia trifida
actctgtgtgtaacttgtaatcaacagtcagcttctattcagtaggtgaaaatgcaaagggcaattggatctttcgtatcacatggaagcattgtgaagaatgcggttctgcaacacgttcgtttggtcaacccacttgcacaaactcttgttagacacgagtcggcgtctgctgcccgtatggaagaacatggttttgaaaaaactcaaatttcagatgttttgaaatccaaagggaaaagtgctgatggctcatggctttggtgcaccaccgaggattctgtgtatgaagcagtgaagtcgatgacacaacacaatgttggagcattggtggtggtgaaacctggggaggaaaagtcgattgctggaatcatcacagaaagagattacctcaggaaaatcatcgttcagggaagatcatccaagtcaactaaggttggagatatcatgaccgaagagaacaagcttatcacagtcactccagacaccaaagtcctgaaagcgatgcagttaatgacagataatcgtatcagacacattcccgtgattggtgaaaagggtatgctgggcatggtttccattggagatgtggttcgtgctgttgtaagtgagcacagggaagaactggatcggttgaacgcgtttattcaaggaggctactagaaaccgttgatgatgacgacgacgacaactctaataatgaacaataagttggtacttgggtaacgcggtaattttaaaagtttgtaaatatgcttaaacactggtttaactttcaaaacatgcttatggatcgtgttgctcgaatga

SEQ ID NO: 7260 - DNA, 1064 bp, Ambrosia trifida
cttcccctaccgtgtggtccgttcggtcgagtacgtcagtacgaagacgggccgacgtatctaacgacagaggtacgtcggggacgtctgttgtgtaaattagttaattctaacaagtctagcttctatttctagtaggtgaaaatgcaaagggcaattggatctttcgtatcacatggaagcattgtgaagaatgcggttctgcaacacgttcgtttggtcaacccacttgcacaaactcttgttagacacgagtcggcgtctgctgcgcgtatggaagaacatggttttgaaaaaactcaaatttcagatgttttgaaatccaaagggaaaagtgctgatggctcgtggctttggtgcaccaccgaggattctgtttatgaagcagtgaagtcgatgacacaacacaatgttggtgcattggtggtggtgaaacctggggaggaaaagtcgattgctggaatcatcacagaaagagattacctcaggaaaatcatcgttcagggaagatcatccaagtcaactaaggttggagatatcatgaccgaagagaacaagcttatcacagtcactccagacaccaaagtcctgaaagcgatgcagttaatgacagataatcgtatcagacacattcccgtgattggtgaaaagggtatgctgggcatggtttccattggagatgtggttcgtgctgttgtaagtgagcacagggaagaactggatcggttgaacgcatttattcaaggaggctactagaagctgttgatgatgatgacgaagacgacgataataaggacaataagttggtacttgggtaacacggtaactttaaaagtttgtaaatatgcttaaacactgttttaactttcaacacatgcttatggatcgtgtttgctcgaatgatgtggttatgcaaagcttgaagctttatattgtttatggttcatgttatgtctatgtcgaatctggttgggtcaggttagtttaggtcgaccatgaacagaaccaataatctgttggaatctgcagaagtatataatgtagcgagttagagcaaaaaagaa

SEQ ID NO: 7261 - DNA, 781 bp, Arnica chamissonis
taatcgacgaccttgattcagtaggtaaaaatgcaaagagcagttggatctttcatatcacatggaagcattgtgaagaatacggttctccaacacattcgtttggtcaacccacttgcacaaactcttgttagacacaactcggcttctgctgctcgtatcgaagaacatggttttgaaaaaactataatttcagatgttttgaaatccaaagggaaaagtgccgatggctcgtggctttggtgcacaactgaggattctgtgtatgatgccgtcaagtcgatgacacaacacaatgttggagcattggtggtggtcaaacctggcgaggaaaagtcggttgctggaattatcacagaaagagattatctcaggaaaatcattgttcagggaagatcatccaagtcaactaaggttggagacatcatgactgaagagaacaagcttatcacagtcactccagacaccaaagtcctgaaagcaatgcagttaatgacagataatcgtatcagacacattccagtgattggtgaaaagggtatgttgggcatggtttccattggagacgtggtccgtgctgttgtgggcgagcacagggaagaacttgatcggttgaatgcttatatacaaggaggctactagaaaccgtggatgatggtgatgatgatcatcattatgacaataagttggtggtacctggttaacatggtaatttaacaaatttgcaaatatgtttaaactctgtttcaacacatgtataatgttgtgttgctctaaagac

SEQ ID NO: 7262 - DNA, 1003 bp, Conyza canadensis
gggggttcaaacgggcgggttaccattttgaaatgaatcaatgatttcgggtagtgggttggctttctcatttacgtgtgtgaacgttttgagttaaaacactactgatgttgtctgaactttttgatgaagatttgagcttacaacaggtaaaaatgcaaagaagtatcggaacatttctatcacatggaagcgttgtgaagaatgcggttctccaacacattcgtttggtgaatcctcttgcacgatctcttgtgaggcatgagtcaacttcggcagctcgtattgaagagcaaggttttgaaagcactaaaatttcagatgttttaaaaggaaaggggaaaagtgccgatggttcatggctttggtgcaccaccgaagattccgtgtatgacgccgtcaagtcgatgacacaacacaatgttggagctttggtggtggtgaaacccggggaggagaaatccattgctggaattatcacagaaagagattatctcaggaaaattattgttcagggaagatcgtcgaagtcaaccaaggttggagatatcatgacagaagagaacaagcttatcacggtcactccagacaccaaagttctgaaagcaatgcagttgatgacagataatcgtattagacacattccagtgattgatgaaaagggcatgctaggcatggtttccattggagatgtggtccgtgctgttgtaagcgagcacagggaagagctcaaccgtctgaatgcgttcattcaaggaggctactagaaaccatagaactcgaccacctgaatgcgttcattcaaggaggctactagaaaccatagatgatgataatgacgataagttgcttcttctgtaaacacggttatatgctgagtttgaagtatgccttttctttgaatgcttgtataatattgtgttgctctacaaacttgacataaaaagcttgaagctttatatgttatatttcgttctgatgtcaattgtgactatgtgtgtgc

SEQ ID NO: 7263 - DNA, 950 bp, Flaveria ramosissima
cggtcccccaagtgtcacactctgtgcgttacgacgtctctttcgtcgctaataaactctaaacaatgaatcatgaatgtaattgatctgtgtgtaatcgacaacatctgttcagtaggtaaaaatgcaaagagcaattggatctttcatatcaaatggaagcattgtgaagaatgctgtactccaacacattcgtttggtcaacccacttgcgcaagctcttgttagacacgagtcaacttctgctgctcgtatggaagaacatggtttcgaaaaaactataatttcagatattctgaaattaaaagggaaaagtgccgatggctcatggctttggtgcaccactgaggattccgtgtatgatgcagtcaagtcgatgacacaacacaatgttggagcattggtagtggtgaaacctggggaggaaaagtcaattgctggaattatcacagaaagagattatctcaggaaaatcattgttcagggaagatcatccaagtcaactaaggttggagatatcatgactgaagagaacaagcttatcacagtcactccagacaccaaagttctaaaagcaatgcagttaatgacagacaaccgtatcagacacattccagtgattggtgaaaagggtatgttgggcatggtttccattggggatgtggttcgtgctgttgtaagcgagcacagggaagaactcaaccggttgaatgcatatatacaaggaggctactagaaacaattgatgatgatgagcatcatcatagtgacaataagttggtacgtcgtaacatggtaattttacaaacttgcaaatatgtttatataactctgtttcaacacatgtttatatattgtgttgcccgaatgacatgataatgctaagcttgaagctttatgtgtttatatttcagatgatgtttgtgattatgtttaagatgttacatcat

SEQ ID NO: 7264 - DNA, 919 bp, Arachis hypogaea
attgagtgagctacttaactgtttcttcttcttcttcttctccttcttagggctcatccatttctttattcagccgcaaatctctcatctctgttgaaacaagaaaatgcaaggaggattccgttcgattttgtcccatggcaacgttgtcaagagcgcaattctgcagagaatgcgcatggtgaattcccctcaattgcagcctcttgtgcttaagaggttcgagtcgtctgctgctccggctcgcatggaggagcatggattcgagagcaccacgatttccgacatcttgaaggtgaaggggaaaagcgcagatggatcttggctgtggtgcaccacgaatgactctgtttatgatgctgttcaatcgatgactcagcacaatgtgggagcattggttgttgtgaagtctgatgaacaaaagtcaattgcgggaattataacagaaagagattacctcaggaagattattgtgcagggaagatcatccaagtcgactaaggtcggagacatcatgacagaggagaacaagctcatcactgtcacacctgataccaaagttctaaaagcaatgcaattgatgacagataacagaatcagacacattcctgtgatcaatgataagggaatgataggcatggtgtccataggagacgtggttcgtgcagtggtgagcgagcaccgacaggaactcgatcgtctgaatgcttacatacaaggaggttactaaagggttatgtaacagcccttacttttatggcactcaagttgactttggattattatgttaataagctgtttgagtgcttgtaaatatgtttatggccgcaaaagccatcttgtttttactcttagtactttggaacagaatgttaataatcacttcttgatgatactctttggaatttcatttttctgt

SEQ ID NO: 7265 - DNA, 967 bp, Euphorbia peplus
atcagacatatacctcactatcttacaccactctaggctagggttcctttatttatctttcttcttcccacctcctttttcttctcactttcgctttccaatcaggaaaaatgcagggggcagttaatgcatttttttcccatgggagccttatcaagaatgcggttttgcaacgcgtccgtgttgtaagtccagtgctgaggccactggttttttcgcgatttgaatcggtttcgcctgctcgtatggatgagcaaagctttgagagcactacgatctcggatattctgaaagccaaagggaagagtgctgatggctcttggctttggtgcaccactgaggacactgtttatgatgctgtgcagtcgatgactcagcataatgttggagccttgatggtcgtcaaaccaggagagcaggagcagaaatctcttgcgggaattatcaccgagagagattatctgaggaagatcatagtacagggaagatcatccaagtcgacaaaggttggggacatcatgactgaagagaacaagcttatcactgtcactcctaacacgaaagttcttcaagcaatgcaattgatgaccgatagacgtattagacacattcccgttgtgaacgacaaggacatgattgggatggtttcaattggagatgtggtgcgtgcagtggtgactgagcacagggaggagttagaccgcttgaatgcatacatacaaggaggttactagacacgacgatgatgacgaacaacagtagggaaaatgcagctgaagtgtctggtttgaaaaaggaccagttaggcaagagcctgtgtaaatatgttgtgtttttgttacttgtttcacctgttgccgccaagatcagaatgtctgatgtctaataacagttggactaactgcttaataataacgggattatgttgcttaagttcgttatcaaaacataaaatgttatcgccttt

SEQ ID NO: 7266 - DNA, 1337 bp, Arachis hypogaea
acaagtgtagcattgagtgagctacttaactgtttcttcttcttcttcttctccttcttagggctcatccatttctttattcagccgcaaatctctcatctctgttgaaacaagaaaatgcaaggaggattccgttcgattttgtcccatggcaacgttgtcaagagcgcaattctgcagagaatgcgcatggtgaattcccctcaattgcagcctcttgtgcttaagaggttcgagtcgtctgctgctccggctcgcatggaggagcatggattcgagagcaccacgatttccgacatcttgaaggtgaaggggaaaagcgcagatggatcttggctgtggtgcaccacgaatgactctgtttatgatgctgttcaatcgatgactcagcacaatgtgggagcattggttgttgtgaagtctgatgaacaaaagtcaattgcgggaattataacagaaagagattacctcaggaagattattgtgcagggaagatcatccaagtcgactaaggtcggagacatcatgacagaggagaacaagctcatcactgtcacacctgataccaaagttctaaaagcaatgcaattgatgacagataacagaatcagacacattcctgtgatcaatgataagggaatgataggcatggtgtccataggagacgtggttcgtgcagtggtgagcgagcaccgacaggaactcgatcgtctgaatgcttacatacaaggaggttactaaagggttatgtaacagcccttacttttatggcactcaagttgactttggattattatgttaataagctgtttgagtgcttgtaaatatgtttatggccacaaaagccatcatgtttttactcttagtactttggaacagaatgttaataatcacttcttgatgatactctttggaatttcatttttctgtgcatttcagaggggtgtgtttaatttaacatgttttgctttactttgccagctgtttatgttgcatgtttggtatggaattcagattaatgcaaagatgtgtgccatttgtaattcaaaatttgcgccatataagaaaggaaaaacaccctctggctcctatccattattatcaatttagagtttagacaatttgtatcctaacaataaaaaattgacaaatggcccctcaatttcattttctgttagacacacaaactctttgtgcttctgagttggtctttacaaatccgacgtggatcgaaacttgtttcggacacttaattgcctgcctactcatttagggtgttcgaattttttcctcctacttctactacccatataattggagaggtaggaggaacttct

SEQ ID NO: 7267 - DNA, 2348 bp, Eutrema parvulum
gaagcggcatggcaagagtcgtcgagtcagactcgggttctggagaatccgatgtagtactgagtcttgactcgatcagggaatcgttgattaggcaagaagacaccatcgtcttcagcttgatcgagagagctaagtttccgctcaattcagctgcattcgaggaatctcgctgtctagattctggaaattcctcttctctgaccgagttcttcgtcagagagattgaaatcatccaagccaaggtaggaagatacgaaaatccggaagagaatcctttcttccttgagaacactcctccctctgtttttgctacgcacaaatatccaccgattctgcaccctaaggctttatcggttaacataaacaaacgcatttgggatatttactttaaagaactgcttcctttgtttgtcaaacctggtgatgatggcaactatgtgtcaactgctgctagtgatctagcgtgtttacaagctctttcgagaaggattcactacggaaaatttgttgctgaggtcaaatacagagacgctccacaagattacgagccagcgattcgctcgaaggatacagaggctttgatgaagctcttgacgtttgagaaagtagaagaaatggttaagaagagagtccagaagaaagcagaaacgtttggacaagaggtaaagtgcgtctctggtaatgagagtgagaagaagtataaagtggatccattgcttgtctctcgcatctatggagaatggcttatccctctcactaaggtcgtcgaggttgagtatcttctacgctgtctcgattgaatcttgagacctgaaacagaaaattaaatttacaggatgatgagtccatacaaactctttcaagattgtttcattacagaatcatctaacagttgagcctatcttgtctgttccacaaaaacctgataaaccaagccgatttgatcaaacctcaaccaagaatatttgaattcaataaccgaattagatttagtgggttaaagcagttatatgtattttcagagagccaaaaaacagaagataatccgaacataaaattgattttccattgtctaatttttttgttgtaaaatgaaaaatcaggattgacacattatcatagattttttacaaaaaacaaaaaaattattcatgtgtacctaaactggccttattaaagtgggccttaggttgaagtttataagtgggcctatggatagtgttaggatatgacagaataattgaatgaacagacatcactatttaatgttatttaaatatatttttaaggataaagaagggagagagtcgctactgtttcactatcgaaaaaggttatttatatttgatgattatccattagaaaatccattagaaaatccttcaaactctcctctcaagtctcgtcagctgtctcttgcttctactctagggttctctcaagcttccactctgttctgttcgtcttcttctctaagctcagggaaagatgcaagctgcgattcgttcgtttgtctccggtggaaatgttgtcaaggcctctctgctgcaacatctccgtgtgatgaacccggcgattcagccttccgtgttttgtacacgctccgaatccactcagtctgctcgtatggaggaacatggattcgagagcacaaccatttctgacattatgaacgccaaaggcaaaagtgctgatggatcttggctttggtgtactactgatgacactgtttacgatgctgttaaatccatgacacaacacaatgttggtgccttggtggttgtgaaacctggtgagcaacaatctcttgctggaatcattacagagagagattatctgcggaagatcatagtgcaagggagatcatccaaatcaacaaaagtaggggatattatgactgaagagaataagctcatcactgtgacaccggagaccaaggtcttgcgggctatgcaactgatgacagataacaggatcaggcacattccagtaatcaaagacacgggtatggtgggaatggtgtccataggagacgtggtccgtgcagttgtcagtgaacatcgagaggagcttaaccgcctaaatgcgtttattcagggaggttactagacgttgaagactaataagaaaagagttgccgttcgttgtgtgtcccagtgcttgatgaatctcgaaagctttaagatcaatgtaaatatggagtcttcgttgttgttgttgttgtctgatgtttgtttgttgttatctgttgtttcattggttaacttgtcaagactgagttcttgtgcatctctgcaagagaataaaaccaaagactccatctctttatggaatattatgatgtt

SEQ ID NO: 7268 - DNA, 1237 bp, Amborella trichopoda
aggggatactcatcatcctattcttgcatagtcgagtgactcagcgagagagaggtgcgtggacacgtgcagcaaatggataagtgcgcgtagcatcattattataaaaatagtactaaatttgctattcacacccattttcctattatttccctcgtatatgacagggatttggtgggctttcatcatccatccatagttccttcccctgtctctcatccgcctccgcctccgcctccgcctccgcctccgccagcgacgcctctctctcccccaccactcaggcaaaagtcatgcaaggagctattcaatccctccgatctcatggcagcattctcaaacgtgcagtcttgcagcatattcgtgtcataccagattcggttacacgaccctctccacgttttttctctgcgccatcttcctcgagtcgtctggaagagcatgggtttgagagcacgactatctctgacgttctgaaaggcaagggtaaaagtgctgatggatcttggctttggtgcacgacagatgacaccgtttatgatgcagtgcagtctatgacacaacataatgtgggagctttggtggtggtcaagccgggggaacaaaaatcaattgctggaattatcactgaaagagattatcttaggaagattattgtgcagggaagatcatccaagtctactaaagttggtgacatcatgacagaagagaacaagctaattacggtaaccccagataccaaggttcttcgggcgatgcaactgatgacagataaccgcatcaggcacattccggtcattgatgggaaagacatggtgggcatggtgtctatcggggatgttgttcgtgcagttgttagtgagcaccgtgatgagctggatcgcctgaatgcttatattcaagggggttactagagaatgggaacggtgatgatgatgatgaaaatctcttggtaggtgtcttttgaaggttcgaactgacgatgttagacgtctttgtatatacacatgttagtcttcttgcttgtcttgatgcttcctttcgatccttgtttttccttcacaatgttcgcttgttaaatagaaacgtgaatcctgaatgactgccattaggttaagcatggagctattcctaatggaaatggcatatgactttgcggaagatgagcagtttgatgcatctgataaatgattcttccatatacttgaaatccgatgcatgcattcgttgccttaga

SEQ ID NO: 7269 - DNA, 954 bp, Aquilegia formosa
ggttggcgttcttcacttcttcttctgaagagagagagagagaaagaggtacgatattaattatgatgcaaggagcaactcaagcaatccgattccatgccaacatcctaaaacactccattctgcaacgaattcgtcttgctgctactcctcctctttttcaccacatccagtccttttcatctgctgcccgcatcgaggaacatggttttgaaagtaccaccatctctgacgttctaaatgccaaaggtaaaagtgctgatggttcctggctttggtgcacaacagatgatactgtatatgatgctgttaagtcgatgacacaacacaatgttggagccttggtggtggtgaaacctggtgaacagtactcaattgctggaattatcactgaacgagattacctcagaaagatcattgtgcagggaaggtcgtccaagtcgaccaaggttggtgacattatgaccgaagagaataagcttatcactgtgacgcctgataccaaagtcctgagggcaatgcaactgatgacagataatcgcatcaggcacattcctgtgatcaatgagaagaaaatgattggcatggtatccattggagatgtggtgcgagcagttgtgagcgagcaccgtgaggagctggaccgcttgaatgcatttatacaaggaggttactagattgaactggtggtactcaatgattatgacgaagactttagaacaaaagaaccggagttgtttctagattgatggtacttctgagctccattgcagtgcttgtagatatttgttgctgagtgaatgatgttatggttcaactttactgggtttgctactataaaataaggagtgttaatttaaataatactattgggaggtaagatataactgatcaactatcatgttttatctttcaagtgatgtttaagatgaatgttttatgttgctgtgaatg

SEQ ID NO: 7270 - DNA, 927 bp, Brassica juncea
gtcggaaaaggttgtttatattattcgagtgattatccataaagaagccttcaaactcaacccactcaactctctcgtcacctgtctcttgctcaaactctagggttcttcagcttccccactccgatccgtgctttttctataatcaatctcagggaaaagatgcaagctgcgattcgttcgtttgtttccggtggaaatgttgtgagagcctctctgctgcaacatctccgtgtggttaacccggcgattcagccttctgtgttctgcagacgctccgagtcgactcagtcttctcgtatggaggagcatggattcgagagcacaaccatctctgacgttatgaacgccaaaggcaaaagtgctgatggatcttggctttggtgtactaccgatgacactgtttacgacgctgttaaatccatgactcaacacaatgttggtgccttggtggttgtgaagcctggtgagcaacaatctcttgctggtatcattacagagagagattatctgcggaagatcatagtgcaaggtagatcatccaaatcaacaaaagtaggagacattatgactgaagagaataagcttatcaccgttacaccagagaccaaggtcttgcgtgctatgcagctaatgacagataaccggattaggcacattccggtgataaaagacaagggtatggttggaatggtgtccataggagatgtggtccgtgcagtggtgactgagcatcgtgaggagcttaaccgcctaaatgcttttatccagggtggttactagacggtttgaagattggtaagaaaagtgttacgtaccgtgttttatccactgcttgatgatcctctaaagcttttaagatcgaatgtaaatatggagtcttctctgatttttgttgttgttgttgttgtctgtcgttttcattgg

SEQ ID NO: 7271 - DNA, 936 bp, Fagus grandifolia
ctggaccttggctgtcactcagttaccgaacttgctgccgctgcacctacaagttagaagtggagtgagagtctgtgactgattccggtgatcgccttctctggtaaaatgcaaggagctcttcgatcatatctatcgaatggaagcattgtcaagaaagcagttttgcagcacttccgtccattgactcccctgatgcagcctgttatgttttcacgctttgagtcggttacatctgctcgcatggaagagcatggttttgaaagcactacaattgcggacgtcttgaaagaaaaaggtaaaaagctgatggatcctggctttggtgcactacggatgacagtgtttatgaggctgttaagtcgatgacccaacacaatgttggagccttggtggttgtgaaacctggagagcaagaatcacttgctggaattataacagagagagattatctgaggaaaatcatagtacaaggaagatcatccaagtcaaccaaggttggggatatcatgactgaagagaacaagcttatcacagtcacacttggcacaaaagttttgcgagcaatgcaactgatgacagataaccggatcaggcatattccagtcgttgatggaaaggggatgataggcatggtgtccataggagatgtggtccgtgctgtggttagtgagcaccgggaggagctagaccgcttgaatgcttttatacaagggggttactagatgatgatgacaatggtgtgcttagaatcccgtgttgacttcgtcaaagacacccactctttgagcactaataagtttgcatgcttgtaaatatggtgtgctgtttgcaatttctattttatggttctttgtgtttcagacgtggatgtaaaagtgatgcagaaaaccagcataaattccacaacttaataatatatcttgcattcgctag

SEQ ID NO: 7272 - DNA, 1126 bp, Eucalyptus grandis
gaaccgaggctgagtttaggttaaaagaggacacgcatcatcgccgagtggtcattagtcccccaatccatatccatttccccttcacacagcctctgggctcttcccagcctctccagccacactcccgtggtcgccgccgccgccgctgtagctgtcgacgcctctgcttcttatcaacgcaaagtccacagaaatgcaaggaatccaatcgttttcattgaaagcaagcttgatcaaaagtgcagttctgaaacacatccgtctggcaaatcctcagattgtttcattttcacgcttcatgtctgtttcatctgcacgaatcgaagagcatggatttgaaagcacaacgattgctgatgtactgaaagccaaaggcaaaagtgcagatggctcctggctttggtgcactacagatgatactgtgtatgatgctgtcaagtcgatgacacaacataatgttggggccttggttgttgtgaagctcgagaacagaaaatcctattgctggaaattatcacagagagagattacctcaggaagattatcgtacagggaagatcatcaaaatcgaccaaggttggagacatcatgactgaggagaacaagctgatcactgttacacccgacacaaaggttctgaaggcaatgcagctgatgactgataaccgcatcaggcacattccagtgatcaacgaagctgggatggcaggcatggtttccattggagatgtggttcgtgctgttgtcagcgagcatcgtgaggagctggaccgcttgaatgcttacatacagggcggttattaggtgatgatggagtatcagatatgggttgtcgtgaaggagtgccttggttgaattatgaaggagtgcttgtaaatatggcttgttgcgtgcacctgcttggacttatttgtatggatctcctaacttgtctaactacctgccaggacaggcaggttcataataactacgcaataatagaaaggcaactgcagtataatctcatccaattttcatctcttgcaatggccatgccgaaatgatattgcaagtagcttcgtctctggatgatgattgatacctgatggttgcttttgaagtagtttttatacaaatgaccttt

SEQ ID NO: 7273 - DNA, 1056 bp, Fagopyrum esculentum
agaaccctagcagaaaccacgggccattccattcgattctccagttcccacactctcgcgccgtacctagattcgcaggatcgaagatgcaaggagcaattggatcgtttttgttgcatggaaggagcatcaagaatgcagtttcacgccatctgaacgttgctagtcctttattgaggcctgctatgttcacaaggtttgagtccaccatgtctgcgcgcatggaagagcacggttttgagagcactaccatttcagacatcatgaagggaaaaggtgaaggtgctgatggctcctggctctggtgtactactgatgacagtgtgtatgatgctgttaagtcgatgacacagcacaatgttggtgctttagtggttgtgaaacccaaagagcagaactcaattgctggaatcatcacggaaagagattatctccgaaagatcatagtgcagggaagatcatccaaatcaaccaaggttggggatatcatgactgaagagaacaagctgattacagtgtcgcccgacactaaggtcctcaaggcaatgcagttgatgacagataaccgtattcgacacattccagtgatcaatgacaagggtatgataggtatggtgtccattggagacgtggttcgtgctgtggttagtgagcacagggaggaattaaaccgcttgaacgcttacattcaaggaggctactaagatgatgacgatgatgttaatgatgatgatgacaacgatgatgacggaaaccagctgtttctttcttgttggataaccagaagcaatctggatgcttgtaaatatgctgcatttggtgcttcaaacctaggtgttttctgttgcatgtctgaatcttgtgatttggtgtgccgttggttgtgtttatgtattgctacctggtttatgaacccggaagctaataagacttaaactgctaagttcaacttcctttcttgttagcttgattggttgttggactttcgtaactgaactgtgatttcaggaaaacactttgggcctttttcttgtaaactagtaaaataatgttttg

SEQ ID NO: 7274 - DNA, 903 bp, Fraxinus spp
gttgaaaagaaaaaaaaaaaagttcatattttttgtgacctttttactctccaggaagtagagcaagttcaagaaaataaccccaagcaaaatgcaaggaggaatacaagcaatcttctcacacgggaatgtgctcaagaacgctgttctgaaacacgtccgtttagtgactccagccatgcagcctcttatgtttatacgtcatgagacagtttcggctgctcatatagaagagcatggttttgagagcaccaaaattgctgatattttgaaagctaaagggaaaaacgcagatgggtcctggctctggtgcacaactgatgatactgtgtatgatgcagtgaagtcgatgacacagcacaatgttggagcattggtggttgtcaaacccggggagcagaagtcgattgctggaatcatcactgaaagagattatctcaggaaaataatcgtacagggaaggtcatcaaagtcgacgaaggttggagacattatgactgaagagaataagcttattaccgtgacaccagaaaccaaagttttgagggcaatgcaactaatgacagataaccgtatcaggcacattccagtgattaatgacagtggaatgattggcatggtatcgattggagacgttgttcgtgctgtggtgagtgagcatcgtgatgagttgaaccgattgaatgcatatatacaaggaggatactagtggtggtggtggtggtgatgatgatgtatagtcttagcttttgcgcacgtgttcagaaacccaagtactgtaaatattgttttatgcatcttatgcaacgtttgagatgttattagccttgagatctagcgactcgaggaaaactaatatgcactctgtagttcacttgtgtatgaggttaatgtaagatagta

SEQ ID NO: 7275 - DNA, 1071 bp, Mimulus guttatus
aaagtagtgtaaaccggaagctggtgttaattgtatccaaaagggttcaagtttcttgtgacttttgcttccacctaattcttacttcaggcacaaaacaaaagatgcaaggaggggttcaagcaatcttctcacatgggaatgtgttcaagaatgctgtccttcgccacatccgtgtgggccccacagccgttggatctctaatgttcgcacgccgggagtccacgtcggcagctaggatcgaagagcacggtttcgagagcaccactatttccgatgttctcacagccaaaggcaagaaacaagacggctcgtggctttggtgcaccactgacgactctgtttacgatgccgtgaaatcgatgactcagcacaatgtcggagctcttgtggtcgttaaaccaggggagcataagtccgtcgcgggaattatcacagaaagagattatctcaggaaaatcattgtccagggaaggtcgtccaagtcgaccaaggttggcgatatcatgactgaagagaacaaacttatcacagtaacaccggagactaaagttttgaaggcaatgcaactcatgacagataatcgcattaggcatattccggtgattaacgatagcggaatgatcggtatggtgtccatcggagatgtggttcgtgcagtggtgagcgagcaccgtgaggaattgaaccgcttaaatgccttcatacaaggaggttactagatgatgacgataaaatgaacggctgagatttcacctcggagtttgtatatattttggtttttatgcaaacttctagaagatcttttgagatattatgttccgttcagatttaataatacccagaaactgcctttgtgcttttgctcgtctctttatttgtgactccaaacagagctctttctctacaagtgttggacttgtgaatggttggacttgtaaatggttttgtttttattgttctagttcatatgtttttttttttctgctgccgattctttttcttgcttaacaatttatataatgggatcagtgctatgtgattttaacaaatttgggatacatgcaaaca

SEQ ID NO: 7276 - DNA, 1091 bp, Elaeis guineensis
aagaccgggacacctcacctggacgcgctccccaactcactgctccctccccagaagaatagcacagacttgttctctctctttctttttctgcggtagaagaagagagtagtcggatcatcatccatcgtttcttcctctccttccttctcgcgctgctggtgcacaaccctgccaggcaaaatgcaaggagcacttcaagctatccgtgcacaaggaaatgttctcaagtgtgctgttctgcggcatgtgcgtatcatgaatccagccatgttacctactgcgatttcgcgtttcgagtcaacttctcctgctcaattggaagagcatggatttgaaagcaccacaatttcagatgttttaaaagctaagggcaagggtgctgatgggtcctggctgtggtgcactacagatgatactgtgtatgacgctgtgaaatcgatgacacagcacaatgttggagctttggtggtggtaaaacctggagctgataaagcaattgctggaattattactgagagagattatctccggaaaattattgttcaagggcgatcttcaaaatcaactaaagtcggtgacatcatgactgaagagaacaagctgatcactgtgactcctgacaccaaagttctgcaagctatgcaactgatgacagataatcgtatcagacacattccagtgattgatgccaagggtatgatgggcatggtctcaatcggggatgttgttcgagctgtggtgactgagcatcgtgaggagctggaccgcctcaatgcttatatacaaggaggttactagaatgagcaactctagactgtaataaagtttgatgatgatggcaaaagacggggtggggggggcgagggaattactacttttagcaagagacggaatgagtatttccagtactggttttgcgtgtgtacataagtgttgttttcctgttgtgtgcgctgttctcctctagccacgaaatgttacggttggtgtataaaattcgtggtcgtgaccaagaatccgatgaatggctcccttgttgtttgctgtggcatgttgctgatcacatttgtggcattttgctattgatg

SEQ ID NO: 7277 - DNA, 920 bp, Petunia hybrida
tcctgaaatccatttcttttcatcttcttcctacttttgtgagaaagactagtgacaggcaaaatgcaaggaggattcaagcagatcatttctcatggaagtgtccttaagagtgctgttctacgacatgttcgattggtcaatccagttacaaggccactgatgtttgcacgtcatgagacaacttcagctgctcgcatagaagaacacggttttgaaagcaccacaatatctgacattttgaaaggcaaaggtaaaggtgctgatggctcctggctctggtgcactactgatgactctgtttatgaagctgtgaaatcgatgacacaacacaatgtaggagccttggtggttgtgaaacctggggaaaataaggcaattgctgggattattacagaaagagattatctgcggaaaatcatagtacagggtagatcatccaaatcaacgaaggttggggacatcatgacggaagagaacaagcttatcaccgtcacaccagaaaccaaagttctgaaagcaatgcaactgatgacagataaccgtatcaggcacattcctgtcattgatcagaatggtatgattggtatggtgtccattggagatgttgtccgtgctgtcgtgagtgagcacagggaagagctgaaccggttgaacgccttcatacaaggaggttactagatgacgacaatgacgataaatggacggtgactgcaagggtgtatatacttgcagtttaaagatgtttgagttgagaacccccttaaatcttgtaaatattgatgcatcttctctaagtatgatgttgcctatggatgtgggcatgccaattagggatcaataagatacagactgcgcttggcttctttttctagttaggttgcatgtaattggcagttgtttaagatgccagtttgttt

SEQ ID NO: 7278 - DNA, 877 bp, Scabiosa columbaria
gacacttcactttataatttatatgtaaaagcaatttctctctctctctcttcacatctctctcgttacttgtactgtgacttcttcgagaccagatcttttcatcaggcaaggcataatgcaaggaggaatcagaaatatcttgtcacatgggagtgtcttcaagaatgctgtgctgcaacgtgtgcgtttagtgaatccggttatgcgtccccttgtgtttacacgcaatgaatctgtttcagcagcacggattgaagagcatggtttcgaaagcaccacgatttcggacatattgaaaggcaaagggaagagtgctgatggctcttggctctggtgcaccaccgatgacactgtgtacgatgctgtgaagtcgatgacgcaacacaatgtcggtgcgttggttgttgtgaagcctggggagcaaaagtctatcgctgggattattacagaaagagattatctcaggaagattatagttcagggaagatcttctaagtcaaccaaggttggggacattatgactgaagagaacaagctcatcacagttaatcccaacaccaaagtgctgaaagcaatgcaactaatgacagagaatcgtatcaggcacattccagtgattgatgataaggggatgatggggatggtttcaattggagatgtggttcgtgctgtggtgagcgagcatcgcgaggagctgaaccggttgaatgcttttatacaaggaggttactagataatgatgataaattgctctttaagttgttactgctttagattattgtaacttgtttcaagtactggcaccactacactgagcagtgtcttgtaaatatggtgtgtttgcaacatctggacccagagcttaataataacg

SEQ ID NO: 7279 - DNA, 878 bp, Juglans hindsii x Juglans regia
  misc_feature (675)..(675): n is a, c, g, or t
  misc_feature (801)..(801): n is a, c, g, or t
cgccgccactgcacttttgcaaagtgggactccgttgtcccgattgctatcgccttatccggtaaaatgcaaggagctcttcattcatttctatcacgtggaagcatcataaaaaatgcagttattcagcacttccggctcgcaaatcccctgatccaacctgtcatattttcccgctctcactcagtaacatctgctcgcatagaagagcatggttttgaaagcactacaattgcagacgttttgaaagtaaaaggtaaaagtgctgatggctcttggctttggtgcaccatggatgacactgtttatgatgctgttcagtcgatgacccagcacaacgttggagccttagtggtggttaaacctggagagcagaaatcaattgcaggaatcataacagagagagattatttaaggaaaatcattgtacagggaagatcatccaagtcgaccaaggttggggatattatgaccgaagagaacaagcttatcacagtaacacctgatacaaaagttctgcgggctatgcaactgatgacagataaccgaatcaggcacattccagtcattgaaggaaatgggatggtaggtatggtgtccataggagatgtggtccgtgctgtggtgagtgagcatcgagaggagctaaaccgcttgaatgcttttatacaaggnggttactagatgatgacgacaatggtgataatgctctcggaacatgatgtcaaatattgcctgctccttgagcactaataagcttcaagttcttgtaaatatggtgtgctgcgtgcaatttctgtnttatggttcttggtgtttcagaagacaaaatacctgcataaggtcgacaagctaataataagcaagggaatgttgcc

SEQ ID NO: 7280 - DNA, 854 bp, Gossypium raimondii
aacccattttcccttcccatcggttcatctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttcaattctcagcgttttgggctttcctctttttttatttttcccttaatttttgggttaaaatttaaaactgacatgtaatgtatgttgtgtgtaaaaaaaaaaattgtaactcctagagatctatatttttggcaacttgagaacattttctcaatgttgtttcccctttattataattaaaaaaaatttaataacataaattaaatgctttttcata

SEQ ID NO: 7281 - DNA, 2058 bp, Gossypium raimondii
tgcggcagaggcggctacgagtcgggattcatttaatttatatattcacttaacactttggttgtgtggattagggcagtcaaaagactgggatgactcagtcactagaatccgatgcaagcgctactatattaattattccatcatctcttctttttaacacgtgtacagtctgatctctttgtgcgtgtgggtcctgttagcatttatcctgtttgaaaaatgaagacgcggtttaccattacatccaaagggttttttttcttggaagaacccgttttaagatttaacttctttttttattttagagagtataaatgaacgtggcggaaaatgattggaagcccatattgaactaaagtggttcttgcaacagaaaacgaactcccacaaatcctgctttgactgccgaaacggtgcgttgtatagctcacccttcttctatataagcccacctctccctagccgttctccttaacccattttcccttcccatcggttcatctcactactgttcaagcgaagttacttaaagaaaggaaaacccatggctcctagatcaaaacccagcccgattagcccgaatcccgacccgaattctaaggagatccgctaccgcggcgttaggaagcgcccatggggccgttacgcagccgagatccgagatccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcgcgtgttcttccctccctgtgacggcgcagcgtccggtttacttcttcgatgccttcgctactggcggttcgggttgccccgcatccggcttcgctcaaagcgactccgattcgtcgtcgtctgttgtagattttgaaggaggagtgcggcgtagagtgtttgatcttgatcttaaccagctgccagctgaaatggattgatttgcctccttttttcaatatgtcgttttgagcttcaattctcagcgttttgggctttcctttttttttttttttcccttaatttttgggttaaaatttaaaactgacatgtaatgtatgatgtatgtaaaaaaaaaaattgtaactcctagagatctatatttttggcaacttgagaaaattttctcaatgttgtttctcctttattataattaaaaaaaatttaataacataaattaaatgctttttcatatttattttccaatttaaatttattttatcccttgctttaacaattttctaatttattattattacgaaaaaagaatgaacgtagattattactacatcagggatacagacgggcagtgaaacgacacgtcagcaataaaatattagtttagttagcgggaggttcggcggatgttagaaaatctatttagatgacatcacgcatgggatcccataaaccgcattagttgttagaataaaataataaacgaaatcaggtgcatcgaactacaaaatatctactacttttgcacatttgattgggctctgatcaaatccgtctggtagatcagattcagcatccaacggtcggaattaagggaaacgaagaggattcaaatggaggcagttgttgtggaaacactcgttaaacgggaggaatcgacggcggaaagcgagagggtagaatcatgatgggaaatcggatggtgggacccacagagtaattccgtgttgacgaggttcatgtcgggattttgggtttatgtcgtcaggtgcatttctcgccgcccaaatatttattttatgtacaactttcaattaattagtaccaactaactttctttttcccctttcttttttaatctattttaatatgccgaacacgtggcagctggcaatgaaattatttaattaagtttttattgttttttatatttattttttaagagtattgtggtcttttagtg

SEQ ID NO: 7282 - DNA, 632 bp, Gossypium hirsutum
catcggttcatctcactactgttcaagcgaagttacttaaagaaaggaaaacccatggctcctagatcaaaacccagcccgattagcccgaatcccgacccgagttctaaggagatccgctaccgcggcgttaggaagcgcccatggggccgttacgcagccgagatccgagatccgaggaaaaagactcgagtctggctcggcaccttcgacaccgccgaggaagcagcgcgtgcttacgatgcgaaggcccgagagttccgcggcgctaaggcgaaaacaaatttcgccgacaacaacgccaacgacttcacgcgcagccctagccagagcagcaccgtggagtcttcttctccgccgccacttgaccttactctggccagcgcgtgttcttccctccctgtgacggcgcagcgtccggtttacttcttcgatgccttcgctactggcggttcgggttgccccgcatccggcttcgctcaaagcgactccgattcgtcgtcgtctgttgtagattttgaaggaggagtgcggcgtagagtgtttgatcttgatcttaaccagctgccagctgaaatggattgatttgcctccttttttcaatatgtcgttttgagcttcaattctcagcg

SEQ ID NO: 7283 - DNA, 1068 bp, Theobroma cacao
aattttagcaatagtgaatagaataaaataaggccaacaaaaacaagacaaattaagcaattagtatgacagatgtaattaaattgatactatcagaaacaagtggtgcaaaatgattagtagccggaatcgacttaaagtggttcgggcaacagaaaaccaactcccacagatactgctttgactgcacacaacaaagcgccgatacgatgcgtatgggtgctcagcttcctctatataagccagccccctcttctccgtcctttgtaaaccaatttcactttcctgcgttctacaatttgaaaaggaaaaaaagaaagccatggctccgagatcaaaagccagcccggttaacccgatttccgacccgacttccagagagatccgttaccgcggcgttcgaaagcgcccatggggccgttacgcggcggagatccgggacccgagaaaaaagacccgagtctggctcggtaccttcgacacagccgaggaagcagcgcgtgcatacgatgcggcggcacgcgagttccgtggcgctaaagccaagactaatttcacggacaacaacaacaacgacttcacccgcagccccagccagagcagcaccgtggagtcgtcttctccgccgccgctagacctcactctcgccaacgcgagtttttcgctccccgtgacgacgcatcgtccggtgtttttcttcgatgcctttgcatctaccggtgcgggctgcccggacacctgtggagcccatagcgattcggattcgtcgtcgtcggttgttgatttcgaaggaggggtgcaacggagagtgtttgatcttgatcttaatcagttaccagctgagatggattgattttcccttttggttggatgtcgttttgaggtttaattctctgcgatttggcgttcctatgctttctttttttgggttaaaagctgacatgtaatgtatataacaatgtaactcctgaagatctatttttggcaacttgagaaaattttctcaatgttgtttctactcttattatgattaaattttaataacgaaattaaatatttttcttatct

SEQ ID NO: 7284 - DNA, 988 bp, Theobroma cacao
attgatactatcagaaacaagtggtgcaaaatgattagtagccggaatcgacttaaagtggttcgggcaacagaaaaccaactcccacagatactgctttgactgcacacaacaaagcgccgatacgatgcgtatgggtgctcagcttcctctatataagccagccccctcttctccgtcctttgtaaaccaatttcactttcctgcgttctacaatttgaaaaggaaaaaaagaaagccatggctccgagatcaaaagccagcccggttaacccgatttccgacccgacttccagagagatccgttaccgcggcgttcgaaagcgcccatggggccgttacgcggcggagatccgggacccgagaaaaaagacccgagtctggctcggtaccttcgacacagccgaggaagcagcgcgtgcatacgatgcggcggcacgcgagttccgtggcgctaaagccaagactaatttcacggacaacaacaacaacgacttcacccgcagccccagccagagcagcaccgtggagtcgtcttctccgccgccgctagacctcactctcgccaacgcgagtttttcgctccccgtgacgacgcatcgtccggtgtttttcttcgatgcctttgcatctaccggtgcgggctgcccggacacctgtggagcccatagcgattcggattcgtcgtcgtcggttgttgatttcgaaggaggggtgcaacggagagtgtttgatcttgatcttaatcagttaccagctgagatggattgattttcccttttggttggatgtcgttttgaggtttaattctctgcgatttggcgttcctatgctttctttttttgggttaaaagctgacatgtaatgtatataacaatgtaactcctgaagatctatttttggcaacttgagaaaattttctcaatgttgtttctactcttattatgattaaattttaataacgaaattaaatatttttcttatctaa

SEQ ID NO: 7285 - DNA, 636 bp, Pteridium aquilinum
aaaaccaatttcactttcctgcgttctacaatttgaaaaggaaaaaaggaaagccatggctccgagatcaaaagccagcccggttaacccgatttccgacccgacttccagagagatccgttaccgcggcgttcgaaagcgcccatggggccgttacgcggcggagatccgggacccgagaaaaaagacccgagtctggctcggtaccttcgacacagccgaggaagcagcgcgtgcatacgatgcggcggcacgcgagttccgtggcgctaaagccaagactaatttcacggacaacaacaacaacgacttcacccgcagccccagccagagcagcaccgtggagtcgtcttctccgccgccgctagacctcactctcgccaacgcgagtttttcgctccccgtgacgacgcatcgtccggtgtttttcttcgatgcctttgcatctaccggtgcgggctgcccggacacctgtggagcccatagcgattcggattcgtcgtcgtcggttgttgatttcgaaggaggggtgcaacggagagtgtttgatcttgatcttaatcagttaccagctgagatggattgattttccctttggttggatgttcgttttgtaggtttaattcttctgtcgta

SEQ ID NO: 7286 - DNA, 1909 bp, Gossypium raimondii
gacacaattagtaaatgttaaggttatctttttgaaattaggattaaattgtcataataaaaaattaaagatactaaaattatattttcgatggtaatttaacgacacaaaaatggaaaagaaaaattcgaatgtgtagttgggtcacaaaagaaatcgaaaaactgaatgacctcacaatgaaacgacgccgaatgtacagttccactacttgttacggtgcaatcagaaccataggatcgtcccgtctgcaatcaagcttcgagctcacataagacgcgtcttgccaggctggacttgtcccaagttgggccccactcctattcgaatcaaacccgaaacaaaaggtcaaaaaactcaaaagcgcaacattctccttatctctccacagtcgttctccctaattttcctccaccgctatgcatccgtctaaaccactcaatctcttttttattttaacggtcatgatccgtctctgcttcgccgatctaccttcttttcgggaggcaccggcatttcgaaacggcagagaatgtccacaaacaacatggtcctccctcgacaaagagatccacaatccctccattatccacatcgctatgacattagacactgcttacctccggggctccgtcgctggagtcttctccgttctccaccacgccacttgtccggaaaacatcgtgttccattttgtcaccacgcaccgacacggagctaaactcacgcgcgccattacctccactttcccttacctcaacttccatctctactacttcaacactaacctcgtcaaaggaaagatctcgtcttccatccgacgcgccttggatcaaccattgaattacgcgcgtatgtacctagctgatctgttgccagctggggtccggcgtataatctactttgactctgatcttatcgtcgttgatgacgtcatcaatctatggagcatcaacttgagaagccacgtgttgggcgctcccgagtactgtcatgccaacttcaccaactacttcacttctaaattctggtccaacccggctttttcggcgtcgtttaaaggaagaccaaggaatccgtgctatttcaacactggcgttatggtaatcgatttatggaaatggagagaaggtaaatacacggagaaattagaaaactggatgaggattcagaaaaggtatcgtatctacgagcttggttctttgcctccatttttgttagttttcgccggagatgtggaggggatggagcaccggtggaaccaacatgggctcggtggtgacaacttggaaggcttatgcagggctctgcaccccggtccggttagcttgttgcattggagcggtaaaggaaagccatggctgagaatcgactctaagagaccctgtccgttggattccttgtgggctccttacgatctgttccgccatccgtctttgttctccaatagctaaaatacggtggagagagttcatcggatttcgtaggagaataaggacacgtgtaaaaaaggaaagcaccttgcaacttgcttcgccagtgaaaatatggagttaccgcgggtataagttgcctgttaaccgcgatggttttcatgttttcattctgttttgtttgttcatataggaaagtgggaagtggaagtttaaaggtgtactccctttctcttttgactataatttttggattaattaaagttgtgtagattaagacaatatctacataagtagatatgaccccgtgaggtgtgtctgttgtatttattgttttcatttttgtgttattaaattattccgataatagaaattttccatcagatgccttttttatcattcattgcactcagaacgaaattaaatctcataccagaaaagatacatgtgtttctaacgatttaattaaataaatt

SEQ ID NO: 7287 - DNA, 1681 bp, Gossypium raimondii
aatcgaataactgaatgacctcacaatgaaacgacgccgaatgtacagttccactacttgttacggtgcaatcagaaccataggatcgtcccgtctgcaatcaagcttcgagctcacataagacgcgtcttgccaggctggacttgtcccaagttgggccccactcctattcgaatcaaacccgaaacaaaaggtcaaaaaacccaaaagcgcaacattctccttatctctccacagtcgttctccctaattttcctccaccgctatgcatccgtctaaaccactcaatctcttttttattttaacggtcatgatccgtctctgcttcgccgatctaccttcttttcgggaggcaccggcatttcgaaacggcagagaatgtccacaaacaacatggtcctccctcgacaaagagatccacaatccctccattatccacatcgctatgacattagacactgcttacctccggggctccgtcgctggagtcttctccgttctccaccacgccacttgtccggaaaacatcgtgttccattttgtcaccacgcaccgacacggagctaaactcacgcgcgccattacctccactttcccttacctcaacttccatctctactacttcaacactaacctcgtcaaaggaaagatctcgtcttccatccgacgcgccttggatcaaccattgaattacgcgcgtatgtacctagctgatctgttgccagctggggtccggcgtataatctactttgactctgatcttatcgtcgttgatgacgtcatcaatctatggagcatcaacttgagaagccacgtgttgggcgctcccgagtactgtcatgccaacttcaccaactacttcacttctaaattctggtccaacccggctttttcggcgtcgtttaaaggaagaccaaggaatccgtgctatttcaacactggcgttatggtaatcgatttatggaaatggagagaaggtaaatacacggagaaattagaaaactggatgaggattcagaaaaggtatcgtatctacgagcttggttctttgcctccatttttgttagttttcgccggagatgtggaggggatggagcaccggtggaaccaacatgggctcggtggtgacaacttggaaggcttatgcagggctctgcaccccggtccggttagcttgttgcattggagcggtaaaggaaagccatggctgagaatcgactctaagagaccctgtccgttggattccttgtgggctccttacgatctgttccgccatccgtgtttgttctccaatagctaaaatacggtggagagagttcatcggatttcgtaggagaataaggacacgtgtaaaaaaaggaaaacaccttgcaacttgcttcgccagtgaaaatatggagttaccgcgtgtataagttgcctgttaaccgcgatggttttcatgttttcattctgttttgtttgttcataggaaagtgggaagtggaagtttaaaggtgtactccctttcttttttgactataatttttggattaattaaagttgtgtagattaagacaatatctacataagtagatgtgaccccgtgaggtgtgtcggttgtattattgttttcatttttgtgttattaaattattccgataatagaaattttccatcagatgaccttttttatcattca

SEQ ID NO: 7288 - DNA, 1693 bp, Theobroma cacao
ctttataccagacgccatcaaatcaagtagtcgggcagacaaaggacgcgtcttgccagcctggcattgtcccgagttggcccgcactctccacatccgaatcaaataaaaaatccccgaaataccctcaagaaacccggaaaaccccaacgttctttcttatctctctcccatcactctcttagatcacgctcccatcatttcctctaccacaatgccttcatcaaagcctctcaatatctttttacttttaacggtcacgatcaatctctgcttcgccgagttaccttcttttcgagaggcgccggcatttcgaaacggcggagaatgtcccaagacaacatggtcgtccctcgacaaaaaagtccacaacccttcccttatccacatcgcgatgaccttagacaccgcttacctccgtggctccattgccggagtcttctccgttctccaccacgctacttgtcctgaaaacatcgtcttccatttcatcaccacgcaccgccgcggcgctgaactcacacgcgccattacctccacgttcccttacctcaacttccacctttaccacttcgacagtaacctcgtaaagggaaagatctcgtcctccattcgacgcgcgctggatcaaccgttgaattacgctcgtatgtacttagctgatctgctgccagctggagtccggcgtatcatctactttgactctgacctcatcgtcgtcgatgacgtcaacaagctatggagcatcaatttaggaagccacgtattgggagctcccgagtattgccacgccaacttcaccaactacttcacatccaaattttggtccaacccggtgtttacggcgtcgtttaaaggaagatcaaggaacccttgttacttcaacactggcgttatggtaatcgatttatggaaatggagagaaggaaaatacacggagaaattggaaaactggatgaggattcagaaacggtaccgtatttacgagcttggctctttgcctccgtttttgttagttttcgccggtaacgtggaaggcatggagcaccggtggaaccaacatgggctcggcggggataacttggaaggcttatgtcgggcgctacaccccggtccagtcagcttgttacattggagcggtaagggaaagccttggctgagaatcgactctaaaaaaccttgcccgttggattcactctgggccccttacgatctgtttcgtcatccgtcattgttctccgacagctgataaacggtgaaagtccagcttagttcatggaagtttcgtaaaaagattgaggacacgtgtaaaaaagagagcaccttgcgcggtcgtgataatatggagttaccgcggctaaaggcctgttaaccgcgacggtcttcactttttgatggtaaatactttggtctgtttatatgccaaaatgggaagtggaagccagaaaggtgttttccactttcaatttcttttttgttttttaattagtgagttggtttgatgttgtctttagattaagagaaaatgttaataagtagatgtgacctcgtggggggtgtcggttgtagtattgttttgatttttgtgttactaaaatattccgattgtggaatttttttttgggccatagattttgctaatctcatcttgtagaatacttatactatttaacattttcaatttttcctgtca

SEQ ID NO: 7289 - DNA, 2119 bp, Theobroma cacao
tctgacttcttaaggctttggtcttctaacttctaactccagttaagcaaattctccaaaataaacccatctgtatcctgttacgcgaatacaaatactatttcgttccaaatctttcgtactaaggcacctacgctctactacgacagtctcggtcccgtgcaataacaagatcttgtccgtttgatttcaaatactttatagcgacgcaacaattgcgcaacgtacggttccactgctacgtacggtgcaaccggaaccacgaaatcaagccccaccaacccccaccccccgctctttataccagacgccatcaaatcaagtagtcgggcagacaaaggacgcgtcttgccagcctggcattgtcccgagttggcccgcactctccacatccgaatcaaataaaaaatccccgaaataccctcaagaaacccggaaaaccccaacgttctttcttatctctctcccatcactctcttagatcaccctcccatcatttcctctaccacaatgccttcatcaaagcctctcaatatctttttacttttaacggtcacgatcaatctctgcttcgccgagttaccttcttttcgagaggcgccggcatttcgaaacggcggagaatgtcccaagacaacatggtcgtccctcgacaaaaaagtccacaacccttcccttatccacatcgcgatgaccttagacaccgcttacctccgtggctccattgccggagtcttctccgttctccaccacgctacttgtcctgaaaacatcgtcttccatttcatcaccacgcaccgccgcggcgctgaactcacacgcgccattacctccacgttcccttacctcaacttccacctttaccacttcgacagtaacctcgtaaagggaaagatctcgtcctccattcgacgcgcgctggatcaaccgttgaattacgctcgtatgtacttagctgatctgctgccagctggagtccggcgtatcatctactttgactctgacctcatcgtcgtcgatgacgtcaacaagctatggagcatcaatttaggaagccacgtattgggagctcccgagtattgccacgccaacttcaccaactacttcacatccaaattttggtccaacccggtgtttacggcgtcgtttaaaggaagatcaaggaacccttgttacttcaacactggcgttatggtaatcgatttatggaaatggagagaaggaaaatacacggagaaattggaaaactggatgaggattcagaaacggtaccgtatttacgagcttggctctttgcctccgtttttgttagttttcgccggtaacgtggaaggcatggagcaccggtggaaccaacatgggctcggcggggataacttggaaggcttatgtcgggcgctacaccccggtccagtcagcttgttacattggagcggtaagggaaagccttggctgagaatcgactctaaaaaaccttgcccgttggattcactctgggccccttacgatctgtttcgtcatccgtcattgttctccgacagctgataaacggtgaaagtccagcttagttcatggaagtttcgtaaaaagattgaggacacgtgtaaaaaagagagcaccttgcgcggtcgtgataatatggagttaccgcggctaaaggcctgttaaccgcgacggtcttcactttttgatggtaaatactttggtctgtttatatgccaaaatgggaagtggaagccagaaaggtgttttccactttcaatttcttttttgttttttaattagtgagttggtttgatgttgtctttagattaagagaaaatgttaataagtagatgtgacctcgtggggggtgtcggttgtagtattgttttgatttttgtgttactaaaatattccgattgtggaatttttttttgggccatagattttgctaatctcatcttgtagaatacttatactatttaacattttcaatttttcctgtcaatatatatctaatgtttgttattcataggggctaacgttctataatcttagaatttgaatcggtagtgtcaatgtttataaaatttcttgaaattatttttaaaaattcaaataattttttattttttat

SEQ ID NO: 7290 - DNA, 1730 bp, Gossypium raimondii
cgccatttctttaatttccgcctatataataccctttcccttatctctttcgtctcggcagattttaagcctcagcagagcagaaaaatagaaataaaaataataaaaggaagggattttttaaaatttttaaattaagaaaagtttctagaaaaaaaaatccttccttttttcctttgatttccccttatgagatcgtaaaatattcgagaatccctttttttttcctgtaaaatttatatatctaattatcgctttgtctttgattttatttggggttgttttgagttaattaatatggggagtgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggggatttcgaagaaatacagctccgccgatgacttgaagacggtgaggaacaatgttatggtggagaaggttacgattatgagacgaggtgagtcgttggattcgaagatcaagatcgacaacggcggtggtggaagggaagggggtttggttgttatgggtacggatcgtttgggtccggatccggaaatggtccctaaacagatcaaaatcgtggatgctaagtcttcggtgaccgtaaaatccgacgtgtatgccggatcggctttctccgtttctccggcaccgagctcacttcctttacctactttctcgaagaagaaacaggttccggtcgatgattcagctacaagggatctcaggcgtttgctacggcttgatctctgagacccgaaaatttagatttggatccaaataagccttcgtctctttttatctccatctctctcttgatacgtttcgtctctatttagatatctccggaattttcaagatccgatgccctccgtgatattttttcaagacggtggacggatttgaaaatctgggaaaattttaggggcgattagataatattccctgcttatcagtttatgcgttaaacaagtggggtttctttaaggaaaaaagaaaaatcaagggggttgatatgtaatattaggggaatagtgggcgagggttgagttttaaaatgttgagatgggaaaaatacttttctgctccgttgtgaaaaaagtttgtaagagatttgcaatttagtcccttcgatgtaaagtaaagataaaattagggagaaatttgagcagatttctattattattactagaatacgtcccttgctatgctttaaaaaatcatattaatttaatgtataaaaacgtaattataaagtttagcttccgaagtttggcgcagtgtttataaatgcaagtaaagaaagcaatcctatcagttcttaaaactttctaacttatatgctcttcaattttgattactctttaactaatatactttgatttttttttaattttcatttttcttttactagtcgataaatatgataaatttaagggtaaactgtggtaagttaaaaagttaccattttgattatttaactatttaaaaattttcattgaaattacttagttgttaaaatttatactatatgtttttatttgttcacactatctgcaccaatcgaaagttttctttctgcttctcttctataatttttttttcaa

SEQ ID NO: 7291 - DNA, 1319 bp, Gossypium raimondii
gattttaagcctcagcagagcagaaaaatagaaataaaaataataaaaggaagggatttttttaatttttaaattaagaaaaatttctagaaaaaaaaatccttccttttttcctttgatttccccttatgagatcgtaaaattttcgagaatcccttttttttttttgtaaattttatatatctaattatcgctttgtctttgattttatttgggggttgttttcgggttaattaatatggggactgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggggatttcgaagaaatacagctccgccgatgacttgaagacggtgaggaacaatgttatggtggagaaggttacgattatgagacgaggtgagtcgttggattcgaagatcaagatcgacaacggcggtggtggaagggaagggggtttggttgttatgggtacggatcgtttgggtccggatccggaaatggttcctaaacagatcaaaatcgtggatgctaagtcttcggtgaccgtaaaatccgacgtgtatgccggatcggctttctccgtttctccggcaccgagctcacttcctttacctactttctcgaagaagaaacaggttccggtcgatgattcagctacaagggatctcaggcgtttgctccggcttgatctctgagacccgaaaatttagatttggatccaaataagccttcgtctctttttatctccatctctctcttgatacgtttcgtctctatttagatatctccggaattttcaagatccgatgccctccgtgatattttttcaagacggtggacggatttgaaaatctgggaaaattttaggggcgattagataatattccctgcttatcagtttatgcgttaaacaagtggggtttctttaaggaaaaaagaaaaatcaagggggttgatatgtaatattaggggaatagtgggcgagggttgagttttaaaatgttgagatgggaaaaatacttttctgctccgttgtgaaaaaagtttgtaagagatttgcaatttagtcccttcgatgtaaagtaaagataaaattagggagaaatttgagcagatttctattattattactagaatacgtcccttgctatgctttaaaaaatcatattaatttaatgtataaaaacgtaattataa

SEQ ID NO: 7292 - DNA, 906 bp, Gossypium hirsutum
cccttatgagatcgtaaaattttcgagaatccctttttttttgtaaattttatatatctaattatcgctttgtgtttgattttatttgggggttgtttttgggttaattaatatggggactgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggggatttcgaagaaatacagctccgccgatgacttgaagacggtgaggaacaatgttatggtggagaaggttacgattatgagacgaggtgagtcgttggattcgaagatcaagatcgacaacggcggtggtggaagggaagggggtttggttgttatgggtacggatcgtttgggtccggatccggaaatggttcctaaacagatcaaaatcgtggatgctaagtcttcggtgaccgtaaaatccgacgtgtatgccggatcggctttctccgtttctccggcaccgagctcacttcctttacccactttctcgaagaagaaacaggttccggtcgatgattcagctacaagggatctcaggcgtttgctccggcttgatctctgagacccgaaaatttagatttggatccaaataagccttcgtctctttttatctccatctctctcttgatacgtttcgtctctatttagatatctccggaaatttcaagatccgatgccctccgtgatattttttcaagacggtggacggatttgaaaatctgggaaaattttaggggcgattagatgatattccctgcttatcagtttatgcgttaa

SEQ ID NO: 7293 - DNA, 1245 bp, Theobroma cacao
gacagattgaatcacagcagagcaaacaaaaggaagggaatttaagaaaaaaaagggaaaattcaagcgagcctcccttcttcctttgatttccccttatgaggaagaagagatcgtagaattctcgagtccttccttttttttgttgtaaatttattcatctaaatcgcagtttcttttcaattttttggggtgtgtttcgggcaaactaatatggggactgaagttttacggcctcaggattgtttgatcgaaaggatccggtttgctccgacggcttgttctcgccggagatacggaaatggtagctttaaccctagttattattataataataacaataacaacagcggaaatggtagatttaacaggaaacccgctcacaggaagcggaccgggtcggagcaggcgatatcgaagagatctagttccgccgatgacttgaagacggtgaggaacaatgttacgatggagaaggttacgcttttgagaagaggagagtcgttggattcgaagatcaagagcagcagcggtggaagggaaggcgggttggttgttacgggtacggatcgtttgggtccggctcctgaaatggtcccgaaacagatcaagattgtggatattaggtctgcggtgaccgcaaaatcagacgtgtacgccggatctgcatttgcggtctctccggctccgagttcacttcctttgccgtctttctcgaagaaaaaacaggtttctatcgatgattcagctactagggatctccgtcgtttgctccgacttgatctctgagatcctaatgtagatttggatccaaaaaagaagtatccatctcttcgtcattatatatatctctttctctctcgcgatcggttcgtctctagttagatctctccggaaatttcaagatccgattacctccgtgatattttttacaaaacggtggacggatttgaaaatcggagaaaagattaggggcgattagataaagattccacgttgttgtatcagtttatgggttaaaaaaaaaagtatggggctgtcttttattatgggatgatgaagaaaaatgtaaaagaaggaagaaaaattaaggggggttgaaatgtaatattaaggaattgtaggtgtggggttgggttcttaattgtcgggctgtgatgaatctgtgttatgctctgttgtgaaaaagaaaaaaattgtaagagagatttgcaatctcgtccctttgttcagtttgttgtaaag

SEQ ID NO: 7294 - DNA, 1219 bp, Pteridium aquilinum
ttcaagcgagcctcccttcttcctttgatttccccttatgaggaagaagagatcgtagaattctcgagtccttccttttttttgttgtaaatttattcatctaaatcgcagtttcttttcaattttttggggtgtgtttcgggcaaactaatatggggactgaagttttacggcctcaggattgtttgatcgaaaggatccggtttgctccgacggcttgttctcgccggagatacggaaatggtagctttaaccctagttattattataataataacaataacaacagcggaaatggtagatttaacaggaaacccgctcacaggaagcggaccgggtcggagcaggcgatatcgaagagatctagttccgccgatgacttgaagacggtgaggaacaatgttacgatggagaaggttacgcttttgagaagaggagagtcgttggattcgaagatcaagagcagcagcggtggaagggaaggcgggttggttgttacgggtacggatcgtttgggtccggctcctgaaatggtcccgaaacagatcaagattgtggatattaggtctgcggtgaccgcaaaatcagacgtgtacgccggatctgcatttgcggtctctccggctccgagttcacttcctttgccgtctttctcgaagaaaaaacaggtttctatcgatgattcagctactagggatctccgtcgtttgctccgacttgatctctgagatcctaatgtagatttggatccaaaaaagaagtatccatctcttcgtcattatatatatctctttctctctcgcgatcggttcgtctctagttagatctctccggaaatttcaagatccgattacctccgtgatattttttacaaaacggtggacggatttgaaaatcggagaaaagattaggggcgattagataaagattccacgttgttgtatcagtttatgggttaaaaaaaaagtatggggctgtcttttatatgggatgatgaagaaaaatgtaaaagaaggaagaaaaattaaggggggttgaaatgtaatattaaggaattgtaggtgtggggttgggttcttaattgtcgggctgtgatgaatctgtgttatgctctgttgtgaaaaagaaaaaaattgtaagagagatttgcaatctcgtccctttgttcagtttgttgtaaagtaaaagataaattagggagtaatttgagcaaaaagaa

SEQ ID NO: 7295 - DNA, 2566 bp, Gossypium raimondii
tagaatctaatcactaaaatgacacaacttaaaaaaaaaaaactttggtgagtagaagtttagtttacccataacttttttaaggaaaaaaacagagctcactcttgtaattttgcttagggttttcttttaatcaaaactaatctgattctcctttctactccaaaatcaccaaaagcccagatttcgtttagaaattagaaaactccatcgtttataccgctgttaaatacctccataaacatcatcccctcagaaaagtagaagcttctctctcccattaaccctaactacacaacaaataaaattacctcaaaacaataggatggcagaagcagaggtaggatctggtgaaggaaagccccaagagatgtcgttgaaggataaagggaatgagtttttcaaggctgggaactaccttaaagctgctgctctttacactcaggccattaaacaagacccttcaaatcccactctttatagcaatcgagcagcagcgtttctacatttggttaaacttaacaaagcgctggctgatgctgagacaacaattactttgaaacctcagtgggaaaagggatattttcgaaaaggatgcattttagaggctatggaacgatatgacgatgctttagctgccttccaaatagctttgcagtacaacccacaaagtgcagaagtctcaagaaaaattaagagactttcacagcttgcgaaagataaaaagcgagctcaagaagtgcaaaacttgcgatccaatgtagatatagcaaaatgcttggaaacattgaaatctgaaatgtctgaaaagtacaaatcagaagatagttggaaagagatgttttcttttcttgttgagacaatggaaacagctgtaaaatcatggcatgagacttcaaaagtggatcctagagtctacttccttcttgataaggagaagagccaagccgataaatatgctccagttgtcaatattgacaaggcttttgaatcacctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtatttccacgccttttcaaagaaaagctatccagttcctcatgagctttatcttaggctgaaggaaattgctaggcatgccggtggactttgattgcgaggtttacatatgaaaaaaggtaccaacaacatagcgtgcttgcttgttacttcgagctggatatgaatttccttttatatgtgaaaactcgccaactaggtacactttttcgagtcacatagcactcattttcttggttttgaaaaattttctaaagaagtttacaagccttttttgagtgattacattttatgggtgtttgttaaaactgctttcttgccttaagtgattcgcgggtttcggttcttgagttggttatatatgttggaagaacagtaaagctagttggtgtagaacttataatcttgttttctgttgtaattatatgtagaaagttattgataagggctgatgtagttttgtttcatttatgcatgaagggtttctttcttttaagctcacttccctcctgctagccttttatctacatttcatggactcttcaataatggttgccatattcgtgtccaaagtccaatacttcattataggatagaacacataatatgcgtaaaacgagtcagaaatgcatgtgtatatatatatatatatatcgtgttgtatgttagaggaaattgggtaaaagtaccataaaaactctactagaaatcaaattacattttgctctctacttaaaaaaggggtaattagtccctctataggcattattaaaaattccatctatttctactgttaaaaattagcccttgtacgctagcatgaggtacacgtagcacgtcacgtgtaattgtctgattattccattagctacgttagtttttaacaaaagaaatggataaaaattttaataaaaacgatcaatttgctctttgatctaattaatagagattaatttgtctattttttttaataaatggagcaaaatgcaatctgatttctagtacaaagttttcatggtacttttgcctaagaaattggttttcattcacaaaatcacatctctttgatgggggtatcagcgaacttccaagcataactggcaacttctcttgtgccactcacatcatcaataggcacagcatcacggatttctttcaaatcctcttgtgtaagcttcaatgccaaggatccaacattgtctttaatgttcttaaaaacgagataacgagattcgagggtcattatgtgcaacaatatgaaagaatcatcagttcatttgcaaaatatagagcaaa

SEQ ID NO: 7296 - DNA, 2186 bp, Gossypium raimondii
cacaaagaaaaataaaagtgagaaaaaaaagatcaaattacaccgtatataaatattgcgagttaaaatttttagaatctaatcactaaaatgacacaacttaaaaaaaaaaaactttggtgagtagaagtttagtttacccataacttttttaaggaaaaaaacagagctcactcttgtaattttgcttagggttttcttttaatcaaaactaatctgattctcctttctactccaaaatcaccaaaagcccagatttcgtttagaaattagaaaaccccatcgtttatagcgctgttaaatacctccataaacatcatcccctcaaaaaaaggagaagcttctctctcccattaaccctaactacacaagaaataaaattacctcaatacaataggatggcagaagcagaggtaggatctggtgaaggaaagccccaagagatgtcgttgaaggataaagggaatgagtttttcaaggctgggaactaccttaaagctgctgctctttacactcaggccattaaacaagacccttcaaatcccactctttatagcaatcgagcagcagcgtttctaaatttggttaaacttaacaaagcgctggctgatgctgagacaacaattactttgaaacctcaatgggaaaagggatattttcgaaaaggatgcattttagaggctatggaacgatatgacgatgctttagctgccttccaaatagctttgcaatacaacccacaaagtgcagaagtctcaagaaaaattaagagactttcgcagcttgcgaaagataaaaagcgagctcaagaagtgcaaaacttgcgatccaatgtagatatagcaaaatgcttggaaacattgaaatctgaaatgtctgaaaagtacaaatcagaagatagttggaaagagatgttttcttttcttgttgagacaatggaaacagctgtaaaatcatggcatgagacttcaaaagtggatcctagagtctacttccttcttgataaggagaagagccaagccgataaatatgctccagttgtcaatattgacaaggcttttgaatcacctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtatttccacgccttttcaaagaaaagctatccagttcctcatgagctttatcttaggctgaaggaaattgctaggcatgccggtggactttgattgcgaggtttacatatgaaaaaaggtaccaacaacatagcgtgcttgcttgttacttcgagctggatatgaatttccttttatatgtgaaaactcgccaactaggtacactttttcgagtcacatagcactcattttcttggttttgaaaaattttctaaagaagtttacaagccttttttgagtgattacattttatgggtgtttgttaaaactgctttcttgccttaagtgattcgcgggtttcggttcttgagttggttatatatgttggaagaacagtaaagctagttggtgtagaacttataatcttgttttctgttgtaattatatgtagaaagttattgataagggctgatgtagttttgtttcatttatgcatgaagtgtttctttcttttaagctcacttccctcctgctagccttttatctacatttcatggactcttcaataatggttgccatattcgtgtccaaagtccaatacttcattataggatagaacacataatatgcgtaaaacgagtcagaaatgcatgtgtatatatatatatatatatctatgtgttgtatgttggaggaaattgggtaaaagtaccataaaaactctactagaaatcaaattacattttgctctctacttaaaaaaggggtaattagtccctctataggcattattaaaaattccatctatttctactgttaaaaattagcccttgtacgctagcatgaggtacacgtagcacgtc

SEQ ID NO: 7297 - DNA, 1714 bp, Gossypium hirsutum
cttaaaaaaaactttaggtgagtagaagtttagtttaccctataacttttttaaggtaaaaaaacaagagctcgctcttgtaattttgtcttaagggttttctttttaatcaaaactaatctgattctgctttctactccaaaatcaccaaaagcccagatttcgtttagaaattagaaaaccccaccgtttatagcgctgttattaaatacctccataaacatcatcccctcaaaaaaggagaagcttctctctcccattaaccctaactacacaagaaataaaattacctcaaaacaataggatggcagaagcagaggtaggatctggtgaaggaaagccccaagagatgtcgttgaaggataaagggaatgagtttttcaaggctgggaactaccttaaagctgctgctctttacactcaggccattaaacaagacccttcaaatcccactctttatagcaatcgagcagcagcgtttctaaatttggttaaacttaacaaagcgctggctgatgctgagacaacaattactttgaaacctcaatgggaaaagggatattttcgaaaaggatgcattttagaggctatggaacgatatgacgatgctttagctgccttccaaatagctttgcaatacaacccacaaagtgcagaagtctcaagaaaaattaagagactttcgcagcttgcgaaagataaaaagcgagctcaagaagtgcaaaacttgcgatccaatgtagatatagcaaaatgcttggaaacattgaaaactgaaatgtctgaaaagtacaaatcagaagatagttggaaagagatgttttcttttcttgttgagacaatggaaacagctgtaaaatcatggcatgagacttcaaaagtggatcctagagtctacttccttcttgataaggagaagagccaagctgataaatatgctccagttgtcaatattgacaaggcttttgaatcacctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtatttccacgccttttcaaagaaaagctatccagttcctcatgagctttatcttaggctgaaggaaattgctaggcatgccggtggactttgattgcgaggtttacatatgaaaaaaggtacgaacaacatagcgcgcttgcttgttacttcgagttggatatgaatttccttttatatgtgaaaacttgccaactaggtacactttttcgagtcacatagcactcattttcttggttttgaaaaattttctaaagaagtttacaagccttttttgagtgattactttttatgggtgttgattaaaactgctttcttgccttgagtgattcgcgggtttcggttcttgagttggttatatatgttggaagaacagtaaagctagttggtgtagaacttataatcttgttttctgttgtaattatatgtagaaagttattgataagggctgatgtagttttgttt

SEQ ID NO: 7298 - DNA, 1387 bp, Theobroma cacao
ccaatcccatgtttctactttaaaaccccatcaagcaggatctttctttaaaaccccatcagcttttcactctgcagatgaacctccaaaattatccaaagcaaaagcatttctctcccattaaccctagcagcaacaaataaaaatacccaccagaaaacagcaaacctgaaaagagagatagaaatagcactttgtttgaatccctgtgttattgaataggatggcagaagcagaggtgggatctggtaaaggagggcctgcaggaggtaatggtggggaagaagagatatcattgaaggataaagggaatgaatttttcaaggctgggaactacctcaaagctgctgctctttacactcaggccattaagcaagacccttcaaatcccactctttatagcaatcgagcagcagcatttctaaatttggttaaacttaacaaagcacttactgatgctgagacaacaatcacattgaatcctcaatgggaaaagggatattttcggaaaggatgcatattagaggccatggaacgatatgatgatgctttagctgccttccaaatagctttgcaatacaacccacaaagtgcggaagtatcaagaaaaattaagaggctttcccagcttgccaaagataaaaagcgagctcaagaagtgcaaaacttgcgatccaatgtagatatggcaaaaagcttggagacactgaaatctgaaatgtctgaaaagtatggagctgaaaattgctggaaagacatgtttcttttccttgttgagacaatggaagcagctgtaaaatcatggcatgagacttcaaaagtggatcctagagtctacttccttcttgataaggagaagacccagactgataaatatgctccggttgtcaacattgataaggcatttgaatcaccccacacacacagcagttgtttttcatttcttaggcaatatgctgaggattcgttctctggagcggcttgcttagttgcacccaaaagtatcatagcttatccacaggtttggaaaggtcaagggtcaaggaagtggagacatgggcaacatgatggtttctttgtacaatttgagtcaccactcttgcgaaaactatggtttatttcaagtgccaatgagatggggcagacattgtgcagggctccagacgttctggatataggtgcacatgaactgcttccacgcctgttcaaagaaaagctgtccaattcttcatgagctttctttttggctgaaggaaataactaaggcaatcgggtggacttgattcgaaggttctcatattcagaaaagaacagacaacatagtgtgcttttttgttgctttgagctggatacaaattcccttttagatgtgaaagtttgcagcaag

SEQ ID NO: 7299 - DNA, 2028 bp, Theobroma cacao
cgaaacaaaaccaatcccacgtttctactttaaaaccccatcaagcaggatctttctttaaaaccccatcagcttttcactctgcagatgaacctccaaaattatccaaagcaaaagcatttctctcccattaaccctagcagcaacaaataaaaatacccaccagaaaacagcaaacctgaaaagagagatagaaatagcactttgtttgaatccctgtgttattgaataggatggcagaagcagaggtgggatctggtaaaggagggcctgcaggaggtaatggtggggaagaagagatatcattgaaggataaagggaatgaatttttcaaggctgggaactacctcaaagctgctgctctttacactcaggccattaagcaagacccttcaaatcccactctttatagcaatcgagcagcagcatttctaaatttggttaaacttaacaaagcacttactgatgctgagacaacaatcacattgaatcctcaatgggaaaagggatattttcggaaaggatgcatattagaggccatggaacgatatgatgatgctttagctgccttccaaatagctttgcaatacaacccacaaagtgcggaagtatcaagaaaaattaagaggctttcccagcttgccaaagataaaaagcgagctcaagaagtgcaaaacttgcgatccaatgtagatatggcaaaaagcttggagacactgaaatctgaaatggttctgttttctcttccctctgaaaagtatggagctgaaaattgctggaaagacatgtttcttttccttgttgagacaatggaagcagctgtaaaatcatggcatgagacttcaaaagtggatcctagagtctacttccttcttgataaggagaagacccagactgataaatatgctccggttgtcaacattgataaggcatttgaatcaccccacacacacagcagttgtttttcatttcttaggcaatatgctgaggattcgttctctggagcggcttgcttagttgcacccaaaagtatcatagcttatccacaggtttggaaaggtcaagggtcaaggaagtggagacatgggcaacatgatggtttctttgtacaatttgagtcaccactcttgcgaaaactatggtttatttcaagtgccaatgagatggggcagacattgtgcagggctccagacgttctggatataggtgcacatgaactgcttccacgcctgttcaaagaaaagctgtccaattcttcatgagctttctttttggctgaaggaaataactaaggcaatcgggtggacttgattcgaaggttctcatattcagaaaagaacagacaacatagtgtgcttttttgttgctttgagctggatacaaattcccttttagatgtgaaagtttgcagcaaggtgcttttctaagtcacatacatgttcttgattttgaaaattttctaaagaagtttacaggcatctttgagtcatactgcattttgttggtgtttattgaaattgctttcttgcacttgttgattcaagtgttttggctcttgtgtgggtttatgctttatttttgttccattcttacgttatatgttggaagagcattaaagctacttggtgtagaacttactactttgtgttgtaattatatgtagaaagtgattcaagaagggccatagtagttttgactcatttcctattgatttatgcatcaattttttattagccatttccctcctgcttcttaccttttatgttatactattatagactatatcaatcgatttacgcttgtatgttttgtcgtcaacttctttagcatttaatcttttgtgtctgaggtctggcttggttgtaagcccctgctagaactattaagatgatctaagaatctgtacatttcacgattgttaggacaatggtaatggtaatggtataggcctctagattgtatctgccatttttcatttgaaaatctacaaaacaaccaggttactgaaaatacatcagaatggaacaa

SEQ ID NO: 7300 - DNA, 1325 bp, Fagus grandifolia
atcttcttcttgttgttcctatagttaaagaacaagaatgactgaaccagcagcagaggcaaaatcaggtgcggtaagctcatcggacgagatttctttgaaagatagaggaaatgagtttttcaaagctgggaattatctcaaagccgctgctctctacactcaagccatcaagcttgacccttctaaccccactctttatagcaaccgtgctgctgcatttctacagttggttaagcttaataaagcacttgctgatgctgagacaacaatttcactaaaaccccagtgggaaaagggatatttcaggaaaggatgcatattagaggccatggaacaatatgacgatgccatggctgcctttcaaacagctttgcaatacaatccacaaagttctgaagtatacaaaaaagataaagagaatttcccagttggcaagagataaaaagagagctcaagaagtggagaacaagaaatccaatattgatatggcaaagcacttggagaagttgaaatctgaaatgtctgaaaagtgtggatctgaagaatcctggaaagagattttctctttccttgttgagacaatggagacagctgtaaaatcatggcacaaaacttctaaagtggatccaagagtctacttccttcttgataatgaaaagacccagactgataaatatgctccagttgtgaatattgataaggcctttgaatcaccgcatacacatagcagttgttttccatttcttaggcagtatgctgaggattctttctctagagcggcctgcgtggtggctcccaaaagtatcatatcttacccacaggtctggaaaggtcaaggatcaagaaagtggaaacatgggcaacacgatggtttctttgttcaatttgagtcaccttccctgcgaaagctttggtttattcccagttccaatgaaatgggacaaacgttgtgcagggatccggaggttcttgacatcagttcccatgaactgcttccacgcgtattcagggaaaatctgcccaagtcttcgtagtctttcttattttggcatgtgatccatctcataaatttgggaggtctgctaaagttggatggctttgagaaagacacaacattagctgcatgtgttttgccttgatttggtatgcaagttcctgctttgatgtggtgaatgtttcaccagtaggtgcttttctttgtcataccattcttgtagtcagtttcaaactctttctgaaaattccgcaggctttttgagtggttttgttctgcagggattctttaccatatgattgcttttcctgtattctggtgattaggg

SEQ ID NO: 7301 - DNA, 1645 bp, Ricinus communis
ctgaaattgaaattagggatttaattggaaactgcagtttaagataggtcctagtaaaaattgaccatttgcccagaaactctcaatgttcgcacccgcaaaatagctgcctgcttcactgacttcactcgagttttatgtgataagcgaagatcacccttgtaaaaccctagcaagtagcagcaacaaattacgcgccccagcgcactcctcttcgctattatcgagtaacaatggcaggatcagctacagcagcctccacagatggtaatggtggggaagaggtatcgttgaaagataaaggcaatgaattcttcaaagctggaaactatctcaaagctgcagctttatatactcaggccatcaagcttgacccttcaaatcccactctctatagcaatcgtgctgctgcatttctgcaattggttaagcttaacaaagcgcttgctgacgctgagatgacaatcacattgaatccgcaatgggaaaagggatatttcaggaaagggtgtgtattagaagccatggaacggtatgatgatgcgtcggctgcttttcagacagctttaaaatacaatccacagagttctgaggtatcaagaaagattaagaggatatcccaattagcaaaagagaaaaaacgagctcaagaagtggagagcatgaggtctaatgttgacttggcaaagcacttcgataaattgaaatctgaaatgtctgaaaagattggatctgaagaatgtttgaaagaaattttctctttccttgttgagacaatggagatggctgtaaaatcatggcatgaaacttctaaagttgatcctagagtctactttcttcttgataaggaaaagacgcaaagtgataaatatgctccagctgttaatattgataaggcctttgaatcaccccatacacacagcagctgtttcacatttcttaggcagtatgccgaggagtcattctcaaaagcagcttgcttagtggcacctaagagtatcatatcttatccacaggtttggaaaggtcagggatcaaggaagtggaagcatgggcaacatgatggcttctttgttcaatttgagtcgccttgcttgcgaaagttatggtttatttccagtaccaacgagaaggggcaaacactgtgcagggatccagagatgctagacattagtgcacatgaagtatttccgcgcttgttcaaagagaagctgcccaattcctagtgcatttaattattttctttggcatcttcaacagaggactcagaatgcgcactttaacaggaagttgcatgtgaaaagaaaaaagacagtgccagtccatgttttgccttgacttgtaactgagctcctggttaggtgttgtaagcattttaaagaggtgctttttattctccagtgtgcgtgtattcaatttttttaagctggttttttggagttaatgcatttctttctttccgagtattgtattggcaagtagggtttgacccttgtattgaatgggttattccccaccctgaatattaaatgatagctttcatgtagcagaagcttacagctgcttgctgcaatttaattaattggcttttcattgtttgaaattactgcatagtccaaataacatgaccaaattttagctttca

SEQ ID NO: 7302 - DNA, 1018 bp, Manihot esculenta
atcttctctattgaataacaatggcaggatcagctgcggcctccatggaaggcaatggcggggaggaggtatcattgaaagataagggtaatgaattcttcaaagcagggaactatcttaaagccgctgctctttacactcaggccatcaagctcgacccttcaaatcccactctatatagcaatcgtgctgctgcatttctgcaattggttaagcttaataaagcacttgctgacgcagagacaacaatcacattaaacccccaatgggaaaagggttatttcaggaaaggatgtgtattagaggccatggaacagtatgatgatgccttggctgcttttcaaacgtctttacagtacaatccacagagcactgaggtgtcaagaaagattaagaggatatcccagttggcaaaagaaaaaaaacgagctcaagaaatggagagcaaacgatccaatgtcgacatggcaaagcacttggatacattgaaatctgaaatgtctgagaagattgcgtctgaagaatgttggaaagaaatgttctctttccttgttgagacaatggagactgctgtaaaatcatggcatgaaacttctaaagttgatcctagagtatactttcttctcgataaggaaaagacacagactgataaatatgctccagttgtcaatattgataaggcctttgaatcaccccacacacacagcagctgtgtcacatttcttagacagtatgctgaggagtcgttctcaaaagaagcttgcttagttgtgccaaaaagtatcatatcttacccacaggtgtggaaaggtcaaggatcaaggaaatggaagcatgggcaacacgatggcttctttgttcaattggaatcacctttcttacgaaaattatggtttattcctagtaccagtgagaagggtcaaacgctctgcagggatccagagcctctagacatcagctcacatgaagtgcttccacgcgtgttcaaagagaagctgcccaactcttagcggattca

SEQ ID NO: 7303 - DNA, 1421 bp, Manihot esculenta
cacactcgctgctgactacaatggcgggatcagcttcgagtgcctctgcggaaggcaatggtggggatgaggtgtctttgaaagagaagggtaatgagttcttcaaagcagggaactaccttaaagctgctgctctatacactcaggcgatcaagctcgacccttcaaatcctgctctttatagcaaccgtgctgctgcatttttgcaattggttaagcttaataaagcgcttgctgatgctgagacaacaatcacattgaatccccaatgggaaaaaggttatttcaggaaaggatgtgtattagaggccatggaacggtatgatgatgccttggctgccttccaaacatctttacagtacaatccacagagcactgaggtttctagaaagattagacggatatcccaattggcaaaagataaaaaacgagctcaagaagtggacagcataagatctaatgttgacctggcaaagcacttgggtacattaaaatctgaaatgtctgaaaagattgggtctgaagaatgtttaaaagaaattttctctttcctcattgaaacaatggagacagcagtaaaatcatggcatgaaacttctaaagttgatcctagagtctattttcttcttcataaggaaaagacagagactgatgaatatgctccagttgtcaatattgacaaggcctttgaatcgccacatacacacagcgattgttttacatttcttagacagtatgctgagaagtctttctcaaaagcagcttgcttagtggtgccaaaaagtatcatatcttatccccaggtgtggaaaggtcaaggatcaaggaaatggaagtatggacaacatgacggcttcttcgttcaacttgagtcgcctttcttgcgaaaattgtggtttattcctagcaccagtgagaagggtcaaacactctgcagggatccagagcctctagacattagcgcacatgaagtacttccacgcttgttcaaagagaagctgcccaactcttagcaaattcacacctcttgtgtaatatattttctgaggagaaggaatgtgcaatttgatgggagagttgcgtatgaagaagacgaaccaggcccatattttgacttgactatgctattggagctcctggataaactaatcaccttcaacaaggtgattttttgtagccaaagtgatgtattcaattttttatatgtatgtaatggattgttgataaaatatagacaagcagctatatgaaatatcaaagaggagaagaatcaagcaaagacaaatactcatcacatggttagctagtatttagtaggttttttcgtgttgattgaaatcggaaatatgttcaattcgtagtttcatttttaagagttcttgacagatgcttgcagagattgttgatttgatgcaattcaa

SEQ ID NO: 7304 - DNA, 1601 bp, Populus trichocarpa
aacctaagttttgcacaggtatcaccagcgtgacccgtcgacaggaatcactcagcttcacttccttctacactctctgagtattacaaactttcaaaaaaaaaaaaacccaaagatctcgctcacataaactctagcaagaacccggtaacaatggctgaagcagagaaaggatcggctacgacagggtccaaagaaagcaatgtcaaggaggagatatcattgaaagacaaaggcaatgaattctttaaagcagggaactatctcaaagctgctgctctttacactcaggctattaagcttgacccttcaaatcccactctttatagcaaccgtgctgcagcatttttgcaattggtcaagcttaataaagcacttgctgatgccgagacaactatcaaattgaaccctcaatgggaaaagggatatttcaggaaagggtgtgtattggagggcatggaacggtatgatgatgcattggctactttccaaatagctttacaacacaatccacagagcactgaagtatcaagaaagatcaagaggatatcccagttggccagagacaaaaaacgagctcaagaggtgcagagcatgagatccaatgttgacatggcaaaacacttggaaacattgaaatctgaaatgtttgaaaagcttggatccgaagaatgttttaaagatatgttctcatttcttgttgagaccatggagacagctgtgaaatcatggcatgaagcttctaaagtggatcctagagtctactttcttcttgacaaggaaaagacacaaactgataaatatgctccagttgttaatattgataaggcctttgaatcgccccattcacacagcaattgtttctcatttctaaggcagtatgcggatgattctttctccaaggcagcttgcttagtggtgccaaaaaatatcatatcctacccacaggtttggaaaggtcaaggatcaagaaagtggaagtatgggcagcatgatggtttctttgttcaatatgagtcacatttaatgcgaaaaatatggtttattgctagcaccaatgaaaaggggcaaacactttgcagggatccagaggttctagatattggtgctcatgaagtgcttccacgtctattcaaagaaaagctgaccaatccttaattcctttacttgtattttgttgactatctactggaggacaatacaatgccctcttcaatgggaagtttatatatgaactgagaacagacagcgacaagcctttcttgtttgccttgatgctgcactgaagtttctggttagacgtgatagctgataaacagatgtgagaagttgatttttgttagccataatgtgcatttgtttagttctgaactcttaatagtatcttgtgagcttcttttgagttattgcatttctagatgctctttcttctatggtttgctttccttgcattgcttgtaaattgagcgagttattctccatcttgggtataaaatgctaatgttgatgccttgaaaatttgcaaatgagtagcacaaaacttattttcttgtaatcaatgcatatctatgaatgacaggcgccatttctgagtctttttt

SEQ ID NO: 7305 - DNA, 1310 bp, Tripterygium wilfordii
agaaccaaaccgcccgctttggtgcgaagaagagtggaggattctggagcaacctcgaaaggagactctcttgtgcaaaccctagcagcagctgcaaccacagccctctgacaacgatggcggaagcagtggcaagatcaagcgcggcaactggtggcggggaggaggtttcgttgaaagagaaagggaatgaattcttcaaggccggaaactacctcaaagccgccgctctctatactcaagctatcaaacttgacccttccaatccatctctttatagcaacagagctgcagcatttctacagttggtaaagcttaataaggcacttgctgattccgagacaacaattgcattgaacccccagtgggaaaagggatactttagaaaaggttgcatattagaggccatggaaagatatgatgatgcgttggctgctttccaaactgctttacaatacaactcacagagtgcagaagtgtcgagaaagattaagcggatttcacagttggcgaaagataaaaaaacgagcccaggaagtggaaaacatgaggtcaaatgttgacatggcaaagcacttggatactttgagatctgaattgtctgaaaaacttggatctgaagagagcttgaaagagatgttttctttccttgttgagacaatggaaatggctgtaaaatcatggcatgaaaatgctaaagtagatcccagagtttattttcttcttgacaaggaaaagacgcaaattgataaatatgctccagttgtcaatattgataaggcatttgaatcaccccacacacatggcagttgtttttcgtttcttaggcagtatgccgaagaatctttctccaaagccgcttgtttagtgacacctaaaagtattatatcttacccacaggtttggaaaggtcaaggaccaaggaaatggaggcatgggcaacatgatggtttctttgtacaatttgagtcacctttcttgcggaaagtttggttcattcccagttctaacgaaaagggtcaaacgttgtgcagggacccagacactcttgacatcagcgcacatgaagttattccacgcattttcaaggaaaaaaaataaaatccatagcctcacttagcttggtttgagtttttatgaggaaattgacaggaacattcaaccggggcataagtgctaaaggattgcgtagggcctgggatttgccttgacgtggcatcccaattcctgcttagattcggtaaccttttgaaagaagatgcttttcttaattgtgcctcgcctgtgatcaattttggtgtctttctaag

SEQ ID NO: 7306 - DNA, 1705 bp, Populus trichocarpa
aaccgcactgctagcttgcttcacttgacttgaacaccctctgagctagtacaagtgtacaaccttaaaaaagaagaagaagaagaaatcaaagatcactctcgtaaactctagttagaacccagttacaatggccgaagcagagaaaggatcagctacgacaggctccaacgaaggtaatggtaaggaggagatatcattgaaagacaaaggcaatgaattctttaaagcagggaactatctcaaagctgctgctctttatactcaggctatcaagcttgacccttcaaatcccactctttatagcaatcgtgctgcagcatttttgcaattggtcaagcttaataaagcacttgctgatgccgagacaactatcacattgaatcctcaatgggaaaagggatatttcaggaaagggtgtgtattagaggccatggaacagtatgataatgcattggctacttttcaaatagctttacaatacaatccacggagcactgaagtatcaagaaagattaagaggatatcccagttggccaaagacaaaaaacgagctcaagaggttgagagcatgagatccaatgttaacatggaaaaacacttggaaacattgaaatctgaaatgtctgaaatgcttggatccgaagaatgttttaaagaaatgttctcctttcttgttgagaccatggagacagctgtaaaatcatggcatgaagcttctaaagtggatcctagagtctactttcttcttgacaaggaaaagacactaactgataaatatgctccagttgtcaatattgacaaggcctttgaatcaccccatacacatggcaattgcttctcatttcttaggcaatatgcggaggattctttctccaaggcagcttgcgtagtggtgccaaagaatatcatatcttatccacaggtttggaaaggtcaaggatcaagaaagtggaggcatgggcagcatgatggcatcttcgttcaatatgagtcacctttaatgcgaaaaatatggtttattgctagcagcaatgaaaaggggcaaacactgtgcagggatccagagattctagatattagtgctcatgaagtgctgccacgccttttcaaagaaaagatgccaaatccttaattccctgtattttcttggcaatctactagaggataatacaatgcactcatcaatgggaaatttacatgtgaaatgagaacagacagccgcaagcctttctggcttgccttgatgtggcgcagaagttcctggttagatgtgctaactgataagcacatgcgagaaggttatttttgttagccatatcgatcatttgttcagttttgagcacttactgataacttgcgagcttctttgagttgttgcatttctagatgctttttcttgtatggtttgcttttcttgcattgctcgtaaattgagcgagttatttcatatcccgggtataaaatgctagcgttgatgtcttgaaattttgcaaatgggtagcacaactcagtcctgattcctaggctattttatcttttttgggctttggtgaatgatgcaagtcgccccatctttatctctgtaattgttttggatttttttttattgattgttgaagttctggagcattttagctcttttatcttctatccttttgctaaaataatgaatagtaatggattcaaacctcttcggcctttg

SEQ ID NO: 7307 - DNA, 1580 bp, Citrus clementina
gtctcgaaacagatcaattgagccccgccccctgactcacaggaacccaaattagcacaagcatcaaacctcgaaaagaaccaaaaagaaaaaaacaagttgtaaacgtctaacataaaccctagcaaccgaaaaaccacaaaacacagtgataatttcttcttttgttggaaagatcatagctttataactgaaagtatggctgctgaagcagaggaaatgtcattgaaagataaaggtaatgaatttttcaaagctgggaactaccttaaagctgctgctctttacactcaggcaatcaaacaagacccttctaatccaactcttttcagcaaccgtgctgcagcatttctacatctagtcaagcttaacaaagcacttgctgatgcggagacaacaatctcattgaacccccagtgggaaaagggatattttcggaaaggatgcatattggaggccatggaacaatatgatgatgccttaagtgccttccagacagctttgcaatataatccacagagtgcagaagtatcgagaaaaataaagagggtttcccagttggcaaaagacaaaaagcgagctcaagaagttgagaacataagatccaatgtcgatatggtgcagcatttggatgagttcaaatctgaaatgtctgagaagtatggagctgaagaatgttggaagcacgtcttttcatttgttgttgagacaatggagacagctgtgaagtcgtggcatgaaacttctaaggtggatgctaaagtttattttcttcttgataaagagaagaccgacactgagaaatatgcgcccattgtcaatgttgataaggcatttgagtcaccccatactcacggcagttgttttcaatttctaaggcaatatgctgatgattctttctctagtgcagcttgcctagtggcaccgaaaagtatcatatcttaccctcaggtttggagaggtcaaggattacgaaagtggagacatagccagcaggatggtttcttcgttcaatttgagtcacctctgctgcgaaaactatggtttattcctagttccaatgaaaaggggaaaacactatgcagggaccctgaagttttggacatcagtgcccatgaagtattcccacgcttattcaaagaaaagctgtcaaattcttagtagccattttcttttcacttgaatcagaagacaatgttggcacgctggagctgttatgccattaaacacaatggaaacatttgggtgtattcctttgtcctcaagttggtatgcaacactacttgggtataataactctagtgcaaagtgctatcttggccatataatccatgcactcaattttggactctcgagagtttttctgtgcttgttgagtggtttctctttgcagacgttctttattgtaaaaattacttcctgtacactctgttacaggggctttgaccccttaaattttttgaaattatttgctactctgtgtgtattgcttttattggtgttgcaacacttaatgtggaatgggttgcattgcactccacaattgtcttgatacttttatatagagagtgctgaagata

SEQ ID NO: 7308 - DNA, 1579 bp, Citrus sinensis
gtctcgaaacagatcaattgagccccgccccctgactcacaggaacccaaattagcacaagcttcaaacctcgaaaagaaccaaaaagcaaaaaacaagttgcaaacgtctaacataaaccctagcaaccgaaaaaccacaaaacacagtgataatttcttcttttgttggaaagatcatagctttataactgaaagtatggctgctgaagcagaggaaatgtcattgaaagataaaggtaatgaatttttcaaagctgggaactaccttaaagctgctgctctttacactcaggcaatcaaacaagacccttctaatccaactcttttcagcaaccgtgctgcagcatttctacatctagtcaagcttaacaaagcacttgctgatgcggagacaacaatctcattgaacccccagtgggaaaagggatattttcggaaaggatgcatattggaggccatggaacaatatgatgatgccttaagtgccttccagacagctttgcaatataatccacagagtgcagaagtatcgagaaaaataaagagggtttcccagttggcaaaagacaaaaagcgagctcaagaagttgagaacataagatccaatgtcgatatggtgcagcatttggatgagttcaaatctgaaatgtctgagaagtatggagctgaagaatgttggaagcacgtcttttcatttgttgttgagacaatggagacagctgtgaagtcatggcatgaaacttctaaggtggatgctaaagtttattttcttcttgataaagagaagaccgacactgagaaatatgcccccattgtcaatgttgataaggcatttgagtcaccccatactcacggcagttgttttcaatttctaaggcaatatgctgatgattctttctctagtgcagcttgcctagtggcaccgaaaagtatcatatcttaccctcaggtttggagaggtcaaggattacgaaagtggagacatagccagcaggatggtttcttcgttcaatttgagtcacctctgctgcgaaaactatggtttattcctagttccaatgaaaaggggaaaacactatgcagggaccctgaagttttggacatcagtgcccatgaagtattcccacgcttattcaaagaaaagctgtcaaattcttagtagccattttcttttcacttgaatcagaagacaatgttggcacgctggagctgttatgccattaaacacaatggaaacatttgggtgtattcctttttcctcaaattggtatgcaacactacttgggtataataactctagtgcaaagtgctatcttggccatataatccatgcactcaattttggactctcgagagtttttctgtgcttgttgagtggtttctctttgcagacgttctttattgtaaaaattacttcctgtacactctattacaggggctttgaccccttaaatttttgaaattatttgctactctgtgtgtattgcttttattggtgttgcaacacttaatgtggaatgggttgcattgcactccacaattgtcttgatacttttatatagagagtgctgaagata

SEQ ID NO: 7309 - DNA, 1780 bp, Cajanus cajan
gggtttggaaggaacaaacatcttcgtggtaaaccctacataaaattaggaaccagaatcccagttcacaggttacaaggttcaaactacaaagatcatcgatggcagaaacgaaagaagggtcaggtccggagatgtctctgaaggatcagggcaacgagtttttcaagtcaggaaagtatctcaaagctgctgcactctacactcaagccatcaagcaagacccttcaaaccctactctctatagtaatcgtgcagcagcattgctacaattggataagcttaataaagctcttgatgatgctgagatgacaatcaaactaaaacctcaatgggaaaagggatatttcaggaagggaagcatattggaggccatgaaacgatacgatgatgctttagctgcctttcagatagcattgcagtataacccacaaagtcaagaagtatcaaaaaagataaagaagataaaccaactggtgagagatagcaagcgagctcaagaagtggagaacatgagatccaatgttgacatggccaaacatttagatacattgaaacctgaaatgtctggaaagtatggatctgaagaatgctggaaagatatgttcttattccttgttgaaactatggagacttctgtaaaatcatggcatgaaacttcttcagtggatgctagagttcactttcttcttgatatggaaaagacacagaccgataagtatgccccagttgtgaatattgataaggcctttgaatcaccacatacacatagcaactgcatttcatttcttagacagtacgctgaggagtctttttccaaagcagcctgcttggtgactcccaaaagcatcattgcttatccacaggtctggaagggacaaggatcaagaaagtggaaacatgcccagagtgatggtttctttgttcaatttgagtcaccttccctgcgaaagctatggtttatacccagttcaaatgaaaagggacagacattgtgcagggatccagaggttttggacattggtgcacatgaagttcttccccggttattcaaagaaaacatgccccgttcttagagtacttcactggtacttggtgtatatttattccataaggtaaaaatgacaggctcagacgacggtttgcatgttcaatgaatacagatacaatttggtgccgatgttttgttgtcttggtatgtgacaaatgctggcaggatgtatgctccataattttgtgagatctgtttatttatttatttaattattataaactatccaatccattaaggacatgcatttttggtaatctttttattgtttgtttgctcttctctgttcttgtggtttggagactttggcatttagtttgttcacttcagatgactcttctttgttgccaaggcaagtttcaagtagtcagtcagcaattagcataggtattttatctgtattttattttggtccagatatgaatattgaatttggtggttaatgttcagtttagatcaacaatttgtttttgtaccctcttttgtttgtacttcatagaaactcagaattggtcaatgagtttttgttctctaatgatccgaaggcaagagttacagaggtgattcaacaagctcgggacctctggttgtttgagttagtttaatgcagaggttatgcaaaggggttgtaattttaacacccagaatcaagaaacttgcgagtctttgattcgatttgtagactattcgtaaactttcaagaatttacttgatataaaaaataatatt

SEQ ID NO: 7310 - DNA, 1635 bp, Quercus alba
tgctagtgctgtgagagagagaatatcattcagctttttctttttgtgtcaaagagctaccccataaaccctactaatacccccacaaaccaaaaagaacaaaaacaaaaacaaaaacaaaaacgaagaatgagtgaagcaacagcagagccaaaatcgggtgcggtaagctcatcgggaggtggtggtggtggtggtgagatgtctttgaaagacaaaggcaatgagtttttcaaagctgggaattacctcaaagctttatacacccaagccatcaagcttgacccttctaaccccactctttatagcaaccgtgctgctgcatttctacagttggttaagcttaataaagcacttgctgatgctgagacaacaattacactgaaaccccagtgggaaaagggatatttcaggaaaggatgcatattagaggccatggaacaatatgatgatgccttagctgcctttcaaacagctttgcaatacaatccacaaagttctgaagtttcaaaaaagattaagaggatttcccagttgtcgagagacaaaaagagagctcaagaagtggagaacaagagatccaatattgatatggcaaaacatttggagaagttgaaatctgaaatgtctgaaaagtggggacctgaagaatcctggaaagagattttctctttccttgttgagacaatggagactgcagtaaaatcatggcatgaaacgtctaaagtggatccaaaagtctacttccttcttgataatgaaaagacccagactgataaatatgctccagttgtaaatattgataaggcctttgaatcaccccatacacatagcagttgtttttcatttcttaggcagtatgctgatgattctttctccagagcggcctgtgtggtggctcccaaaagtatcatatcttacccacaggtctggaaaggtcaaggatctagaaagtggaaacatgggcaacacgatggtttctttgttcagtttgagtccccttccctgcgacagctttggtttattcccagttccagcgaaatgggacaaacagtgtgcagggatccggaggttcttgacatcagcgtccatgaagtgcttccacgcgtattcagggaaacgctgcccaaatcttaatactctttcttatcttggcatgggatccatctcataaattttggaggtctgctaaagttagagggctttaagtcaaaagaaagacacaacatcagctgtatgtgttttgccttgatttggtatgcaagttcctgctttgatgtggtaaatgcttgccaataggtgcttttctttgtcatatcactcttgtagtcagctttaaactcttgctgaaaattctgcaggctttttgagtggttttgttttgcagagaatttttattatatgattgcttttcctgtaatctgatgaaaacgagggctttggcccttgaactaagtgagtcatttctggtgccgattttatattactaacatcaatgtcaggaactcttggaagtaattggcttaaaagtgtttaaaatggctatatcttataaatagtgctaatacaggtattccagatctccatttatgtaattttcaatgaaacaatttttatttattggtctgtgtttac
